United States Patent 8,067,671 (METHODS FOR GENETIC CONTROL OF PLANT PEST INFESTATION AND COMPOSITIONS THEREOF) - sequence listing, part 39

SEQ ID NO: 75963 - DNA, 622 bp, Heterodera glycines
  Genomic contig location: Contig_ID=SeqID_12360; Location=2043..2664; Strand=-
  SCN-specific regions: Sequence locations=1-36,66-78,126-213,258 -337,370-457,524-622
  Gene Ontology: Biological process=embryogenesis and morphogenesis
atggtggaagttcaacgaatttatgccttcttggctctgttcacatttatttattttttggagtccattggcggaacgtaaaaaatttttaaattgttttttttttgaaatttaaatatttttttcaggtatatgatcgcttctgttcaaaacattgagcgacaatttcgaataccgtcaaaattgtccggttttctcgtctcagcccgtcagaattttttcaaaattttttttttaaattttttaaaattaaatttccaatttttcagatgacatttcctatgtgctcactgtggtttttgtttcttactatggctcaagaggtggtggaaaatggaattattattttttttattaatttaaattttactgttttttaaggtaaggggtaaattatttgagaaaatgtttaaaaattcgaaaaaggatttaaattagctcatgtatgtactaattcattattttattatagaaattaatcaaaaatttattatttatttaatttttaaattttgaaaattatgtatttgtttttgggggcagctcacttttaaaaattttccagcgattttttgggaaaattttttgacgaaaaacttagtgtaattcttcgtaaaataaa

SEQ ID NO: 75964 - DNA, 1773 bp, Heterodera glycines
  Genomic contig location: Contig_ID=SeqID_12361; Location=609..2381; Strand=+
  SCN-specific regions: Sequence locations=1-100,130-165,188-219,258 -556,581-582,620-626,648-731,755-821,886-1057,1079-1146,1169 -1173,1200-1220,1243-1742,1764-1773
atgttcaatgatcgaatattaagggataatgtgatggtgttgtgtatgatgatcattattcttcaatggaatgtgaggatggtcgtaaaaaatgggtgcgaaatttaaaaaaaataaaataaaaatatacccatgccgtaatggccatttcgcagtgtcctaacaattcgtacaatgaggaacttgtaaattttttttctaaaaagctagaattatctctttaaaataaaaataaaaaaatttttttttgattttttcgttttttttttgaaaaatgataatttccatgaaaaaaacgagaaaatttcaagaaaccaactacaataacatgttcgaagagttcatctcgtttggtcaaatacaatatttatggccaaattaagtaaattgatgatcgaattttcaccgaaattaaaacgagacaaaaatgttcgctcggttttcgatcactcaaacttttggtcaaattcaatcaaaacagatctacgatttatgacaatggcgtcattattttaaaacccagacaaaacttttcatgaaataattaatgcaattttagaaatttcacaattattttttcactaattttttattaaaactgaaaaaaataaaaatttatcgaaagattttcatttctataaaaatattttctgtcaacaaacttaaagcaatttctgcatcaacagcaaaagccacttgaaaggaagaagaagcttttccctagaataaactttcaataaaataaaatgttttgtctggcacaaaaaaaaagttgcgaatcatccaaaaaaaatttttcaaaattttatcattagaggcacaaaaatttatattatttttgaccaaaaaataaattaaattaaattaaaattttctttttttttactagccgacgaagatgaaagtttgaagcgcatttttgacatttgaaaaaggaatttttcgagccaatgaatgcatcaacaaaatgtgtcatggcttttgctttttgaaaaaagggaaagggcgcgcgaaagaaattccaaaatgaaagaaaaaaaggaaattgtgaaactgaatgaatgctatctttccattcttcatttttagcataatttctcgaatttttgactaggctgatgttaaaatggaatttaaaggatttaaaaggaggaaaactataatatttacacattttaataattacaaatgaataaaacggataaattttagacatactcaaattataaaatttttaattatggcctaatttgggaatgtttaacccagttgagtactaaaagttacccatttgagtactaaaagttacccatttgagtactaaaagttacccatttgagtactaaaagttacccatttgagtactaaaagttacccatttgagtactaaaagttacccatttgagtactaaaagttacccatttgagtactaaaagttacccatttgagtactaaaagttacccatttgagtactaaaagttacccatttgagtactaaaagttacccatttgagtactaaaagttacccatttgagtactaaaagttaaccattagagtactaaaagttaaccattagagtactaaaagtatgtatgtagctgcaactagagcccggagcaggaccggatcctgcgcaggattttgcaggatcccagtctgcaatcctgcattttttggaaaatgcaggatttgcaggattaatccgggccggatccggtcctgcaaaaatttttgaattccaatccctgcacagggttccgcaaatttga

SEQ ID NO: 75965 - DNA, 715 bp, Heterodera glycines
  Genomic contig location: Contig_ID=SeqID_12362; Location=1053..1767; Strand=+
  SCN-specific regions: Sequence locations=1-203,234-503,525-532,568-715
atgctaaatttaatatttctgttaggtctcaactgacttcaaaaataaatatttaattgacccgagttctgcgtttatttgagaatttggtcaagaaaaaacaattgtatgtggcaaaaatcgtataggtaaaaaacattaaacatttaaaaaaaataccaaatggacatatttataaaaaaaaagcttcgataatttatgccaaaaaatcaataatttaaattttatttttagtgcctggcttgatactgatccattagaaagtgacaatgataattagatttgtaattatatgaaatccatatttttttcctggactgttggaggcctgaaacgcatgaaaaacatgtttttagcttggtttgaagcctctaggaaggagttcttatccatatttttccatatttcgcgatttatttccatattttggcattaagtcctattaaacggcccccatcagctaaattagccgttttgaccccaaaggccgtaaaaatttccgaaaaagacattttttagcaaaattttgtcgaaaaaattgattaaatttaaattttcttaaaaattggttaatttatgtcaaaaataagcaaaaatggaaattttcgattttttggtttgttttctctagaaattgctttttttcttctaaaacgagttcttatacagtatttagccattttagatgtattttactagaatttgatgaatttga

SEQ ID NO: 75966 - DNA, 1339 bp, Heterodera glycines
  Genomic contig location: Contig_ID=SeqID_12362; Location=2156..3494; Strand=+
  SCN-specific regions: Sequence locations=1-34,57-140,163-284,306 -384,406-747,781-940,963-970,992-1103,1147-1216,1242-1282,1317-1339
atgcttctcgacctcgtctccatttcttttattctctttccttccattgggcttttcttatttttgatttaccaaaaaggaaattctgctgctgatgataaaaatgatgactcatttgaggacaaagtgaaccatttatcattttaatttattcatttgtctctgtttgtttaaaattggatttatacgcaaaatattccaattttctaatggtttccctattttcacttttcatttaatgatggcaaccaaaatttattaagagagaagaaattatgacaacgaaaaacacaaaaatttttaaatttctaagttcttgcgagtttactgggtttatatttccacatttttcggcatgttttaagagaatacgcgtccaatatatttgatatggcctatgattttgagcaccgttaaatactcaattgttttttacgcatccattcattttttcaatttttactttgggatctggctattacagagttcccaagtgtctttctcttgtgtcttccctttgaaggattctttcaaattcccgaattttattcagaaaaatatgctgtacgaattgtttgggattgtgcacagtttccgttcacatttgaacaagctctttttggagtgtgttttagttggcgaagtgccaaaaaattggagtgacaattccctttttgcattgtttggcgctgcattgaacggacagattgaaacccttaaaattctggtaattgcattcagttttagattaaaaaataacaaaataatttattttattaagtcggaaagcaacgacgtaaatctgagaatgggccaactgaaaaccgctggaggcacaatcggtgattaaatacaatagcaagatctggacttgctggccggatccattcctaaatttttctctgatttttttttccaaaaaatataggtccagatcagtctgaaaacagaatttagacatgaaaaatctgggttatttttcattgtccagctttgtctaattctgaagtcactttattagatataaattgtgtgtttagacggcgtctcattgctttggattgcatctgccgccggccattttgaaattgtcaaatttttggtaaaataaataatcaatttaaaatattaaaacttaattttttagcaccaaaagggcgacgatgttaatggaaatggatcagtgacatttggggatcacaaaataataagtgacaaatttaatttaattaataaaaattgaaatgtgataaaattccaagagagggaaagaggaaattcctataaaaaatattttattttttaattatttttttgtattacctaataatacaaataa

SEQ ID NO: 75967 - DNA, 2406 bp, Heterodera glycines
  Genomic contig location: Contig_ID=SeqID_12363; Location=120..2525; Strand=-
  SCN-specific regions: Sequence locations=1-81,103-309,332-460,482 -622,652-927,949-968,1020-1203,1225-1355,1402-1456,1480-1568,1602 -1676,1705-1803,1832-1871,1893-2180,2202-2304,2326-2406
cgcaaatttgaccagctcaacgcgtgcaacagtgaccagttcgacctgatcgaataccaaagggaacgcggcggcgaatttgccctcggcagcgatggcagcggcacaatgccattgaacaagaagcggcagcagaaagtgatcaaactgcgccagaagcggcaaaaagtgctgatcgacggcgccttccgtgccatccccatggtcgacacaatgtgccgcattgtcgagagtcaagactttgaccggaccgacttgttcccattgggtgtgtgttgatttcactcactgtctgactgttcacatttcaatttttggaaaacagtaagggaaacgatctactccgtaaaaatttaatttcctatggttacgggttaatccaaactctgtgggtttttcttccaacaaattcacattgctccgtttttcgtcagtgtttcaattgccattatcaattttctttttccctcaaaaaaggtctcgagccgtcggacgacgaaagttcggacgattcctttccgtcgttgggtgaagaaagaatcggctgctcaagtagcagaagcgccgtcggctacgtaccgccgccccaaacaccgccggcgccgtcgtccaacggttgcggcgttccctccgccgccgccgccgctcccattcaaaacgggggctgtcggctggagctgtacctgctgaagaagcagctgcggctcgagagttgtcggctcgtccagcgtgccaaactgtgcgtgcccatcaacaccaccgcccgcgagtacaaaaacagtgtgggcgcagcgctacgtgtgcgagcaaacaaccacagcagcagcaccacaaccaccaacagtgggagcggacgttgcgggcacagcctcggcagggagcagcaacggcggatgcagcggtgcgcatacatcgcacagccccaacaggtgggagaattgttttcaaaaatgaaatatttgtccggcaaaaatttttaaaaacaatttttatcaatttttttcgtatttttataatttctgaaagcttaaaaaccaagatattcctttgacaaatgcatttgtttccgtttaaattaccgcttctaatttgtctccaaattcacagagccatcatttgccgtcttcgtcggatggcaccggcgtggacggcaacaccaacggtggtggcggtggcataccgccgtttcgttgtcctaaccaatgtttgccctgggcccggcactgtgccgaccacatcacgtacaacgtggcgcagcagttgttcaccttttgcaagtggcgtttgtgcaacgaggcgatgccaaccacggacctggtactgtttgatggactgtgccgacgccatttttacgcacaacaacagcaccaaaatcaacaacaacatcagcaacagcagcaaaggcatcagttggtggcaccgaccgagcagcaacaacacccgcacagactgcaacacaacaacaacggcaacaacagccacggcattgtcaacgcgatggcacagagcgtaagggagggattcatcggaggaatttcatggcattaagagcattaattgggggagatttatacctgccatgttgaaaatgcacataaaaatatggcgattttttagcatgtttgtgcagcttgggtcgctcccgtaaccgcaggagggagggggggttcccacgccaccccaaaatgaaaactaaaagaaaatttttgaattttcctccttaaagggcgatctgcggttgtccatgctgcaccatggcgttgcttgtcccgaccattcgctgaagaagaattgccactgctttcaacagcaccaacaacagcagcagcaattcctcctccaccaccagcgcaccgccgcccacggcgattcgtcgctgtcctccgccgtcacaattcgctgcgaaccttttggtgtgccgcaccacgcgccgtactgtcccagcagtgtgccgcccgcaaaccgaggggacgaccatctccatgaaagtgcgttcaggacaacaccccaaaaagactaaatatcgaagggattgttaggcccgtaaccagaaaaattttgctgaggaggggggaaatccgaaaacctttttatgtaaaatttacaaacgaatttaagccatggatgtgtcgttggcctccgtcgcgaaggacctcggcttcgacggccacgacctgaccgacatgttggccaaactgccggtcgaagagggcttcgagggcgacatggacccggacgaggacaccctgctcagtaattgcccacaacattgggtggctttccagtccaaagtgtccccatgcttagcagacatcaacaaggaggactcggacgaggcgccccccggcacaacgctgggccacagttgggccgacgtggaacagtttctgctcgagcaggaggagg

SEQ ID NO: 75968 - DNA, 306 bp, Heterodera glycines
  Genomic contig location: Contig_ID=SeqID_12363; Location=1119..1424; Strand=+
  SCN-specific regions: Sequence locations=1-6,53-183,205-306
atgcctttgctgctgttgctgatgttgttgttgattttggtgctgttgttgtgcgtaaaaatggcgtcggcacagtccatcaaacagtaccaggtccgtggttggcatcgcctcgttgcacaaacgccacttgcaaaaggtgaacaactgctgcgccacgttgtacgtgatgtggtcggcacagtgccgggcccagggcaaacattggttaggacaacgaaacggcggtatgccaccgccaccaccgttggtgttgccgtccacgccggtgccatccgacgaagacggcaaatgatggctctgtga

SEQ ID NO: 75969 - DNA, 1603 bp, Heterodera glycines
  Genomic contig location: Contig_ID=SeqID_12365; Location=1080..2682; Strand=-
  SCN-specific regions: Sequence locations=1-463,485-506,529-851,873 -907,959-967,1019-1147,1169-1218,1244-1467,1494-1603
atggaaaaggggggttggctcaaccgaatttttttttaattttcgggaagggcatccgaaattgttgttgttgtttttttcggacctaaatgttttgttatttttctaaattttcagccccgtggaaaacaggaatttatagtcgttttgcgccaaaaacaatttgttaccttgtaaacaatttttaaaatttgcgaatttttggactgcggttgtctgtcatacatccaattttaactttaccaaaaaagaaaaacttttttgtttgaaaatcaattttgaggtccggccgcgctgtgttccaactgtacgcggacagtgatgcgcaacaacggctgatcaccggacaggcgttgcgcgcggggttccaggcacgtggcactgaatactgaatttctcataactgcttaagtgggcagttttgccgtttgttcgatttgtgggtgtgtccactgtcagatggcctttccaaggtcccaaaaaagtttccggaaattgtccgagtatccccaaaattttttgaaaatcggaaaaaaatttgcgactactcggacatttacacccttgcaccaaactaggtatttcaaatttaacttctttttttttaattcattctaaaattgtatattcaaaacgcattttcagggtggcataattgtcgaccgcccggactcggccagacatcgcagtgtttttggttttaagtgccggcaaagcggccgcatttgggtagcatttgaagtattgtaaatgatgcccaatttttttttttgttattcgacgccaaagttgaaaatgcttttaattgagtgtcaatttatggaacataatgcatttttgcttccaaaaaagcgggtgcatctcatttccacagccccccccctcccccttctgtcgtccttccgagaaaatttaataatagaatttttcaaaaaaatctagtaataaaaattttttagccagaaaaatatagtatctttaaaattttgaaaaatgatgaaaataatttttaaattgcaaatacagtttgcgagtttgtcttgtttagatggaaattttctcgagtgattggaaaacgaccgacttcgaaaaattgtctaattgattctcccctatgcaaaaaaatttggcacgcattttgccatggtaaaaaaattaaaaaaaaattctgtttaagcccaagtgctcatctgttgagaacatcgacaaagcaaatgggtgaagatggtgatgatgatggtggaaatcagcagcaaattgaaaatgttggacgaacacggccatggaaaggggcaaacaaaaagaaagcggcggcatggaaaggcggtgccggcggaggacgggtggaaaagagacggcagagacgcgaagcgaagagagagcgcaggaaaggcggagattggcacagagatggacagcagaagagacaaacagaggaaaatgatggggaagaaatggagcaatgacagagagaggaagagagagagagagagcacaggaaaagtggagagaaattagagatggagaaggacagaagagagattgtggcgattctaattcaaatttttgtttattgttttcttcaattgttactttaaataaa

SEQ ID NO: 75970 - DNA, 902 bp, Heterodera glycines
  misc_feature (262)..(262): n is a, c, g, or t
  Genomic contig location: Contig_ID=SeqID_12366; Location=1432..2333; Strand=+
  SCN-specific regions: Sequence locations=1-117,149-902
atgcttattttcaaaattaataaacaagtccatttcacatacttaccatgggccaatcaagtcgaaaatattaaatggactaacaagggaacctcgcgaactgttagtcaaaaagtgggtataaatttggtatcattggatagagcagggtcgacttctgctgttgtgaatttttaatattagcggtgtgagatcaaaaataaaaaagttatgaggcctcaaaaatcgaaattttagtataagagactacttaccggctttngctaacttttcccttaccctctctcactctattcccataagatatgagggtctacttataaacgcattcaaaatgtttttctacaaccttatcaaataataagcaatcaaaaaggattttttacgcaatgggtgatcataacccgacgacttcttcagcttcgataattccagacgattcaccggtaaatgtacaaaatcctgaaaattcagatagcatttgattttaaggtcgatgaaaaagatatgccggcaacggaccgcgcgattgaaaaactttttgatggaattgacgcaatttacttcatggaaaacggattcaaagcgattgcgcacgaattggaagtgcgtgccaattggaattcttacaaataaacataaaatttttgcagtagatttagttaaatttagaacaattttagaaactttccgccatttgttccgaattggaaattgacgagttggaaagggaacggtttaagcttaaacggcaaatgcaaattgtgtcgaggaaaatgtcggcgttaatcgtcaaaaattcgctgtctttcaatcgacaagtggaaaattatgaaagtgtccgaacaaatgctgaacatttgttacgaataacgaggcgaatgccgaggtgcgaagaatga

SEQ ID NO: 75971 - DNA, 569 bp, Heterodera glycines
  Genomic contig location: Contig_ID=SeqID_12367; Location=1587..2155; Strand=-
  SCN-specific regions: Sequence locations=1-199,222-503,527-569
atgtggcgtggcaaaagtgcacattttggcacccggcgacaatttgccattcacaaacaattcggtggactttgtggtcagtgcccatgtgttggagcacttttgggatccgataaaaaccatcaaagaatggctaagggtggtgaagccaggtaaaacgggagaataagtgtcgaatgcaaattaatagctaaattgcttaattaaaattccaaatgtttccctagggggcttcgtttacatggatgtgccgcacaaagagcgaacgatggaaaacaatttgccacggacgccgctcaccgaactgcttgaacggcacgaaggaaaacggaagccgaccaatccggcggaggaactgaagccggaacggcacaagtcggtgtggatcacgtcggacttgctggagttgtgccggcatttcaattggaatgtggtggaatggcgagatgtggacgacaaagttggaaacgggttcaccattgtgatcaaaaagaaatgaacaaacagtggaaaaaacagaatgtgatgaaaaggaacggaatggcattgtgtacattaaatacaataaa

SEQ ID NO: 75972 - DNA, 1692 bp, Heterodera glycines
  Genomic contig location: Contig_ID=SeqID_12371; Location=630..2321; Strand=+
  SCN-specific regions: Sequence locations=1-150,186-635,657-669,719 -804,830-1083,1133-1409,1438-1692
atggtttcggactttttctgccccaacacgggcggagtggagacgcacatttatcagctgtccaagtgccttctgcgcaacggacataaggtaagagcggacatgtgctcccaaatggatttatccgggattttttagaaattgagtttgaaattttaagtaaaatatttttactatttaaaattcatctctcacttcattatgtgggtgtcaaaatatttattgcatcggaataataaaataaagccttcaaatagccggaaattcattaatttctaaccggtatattttttgaaaaaatatcggcggattgttttccatgaaatgctgctgaagaccaaagcaaaatggtagtttttctgtatgtgtttttttttgttgagaaaagtaatattaatctctgatcacttatctgtgattttgatctatgatttttatcatccgacggattaaatttacgatgaaaaaaccactaaaaaaacgagaactaaacttcttagtctttttttcatctcaaagttcgagcgacaacacccgaaaattaaaaaaaaacaggcggggacgggtagcaaagctttctagaagaatataaaatcaaatagttgttatatgcaatttcattttctccaacgtttattcaagaattttctttacaaatacataatcgacaaataataataaaatcttttaaattggtttttttttaaattgaatttttctatgcatatgcaatttaataacgaagaaattattgtatctctgaatacgtgtaaaactaaattaaattttcattgcttttggttgtatattaaatttaaaaaattattttcaaatacaaataaagtatgtactatgtttttgcagttttgtatattttctcaaggttatcgtactcacgcacgcgtatggtcagcggaagggcatacggtacctgtgcggtggaacactgaaggtgtactatttgccaggcttggtgttgggcaacaactatttgccgtctgtgctcggctcgttgccgtggttccgacgcattttcatacgcgaacaaattcaaatcgtccattgccattcggtaggaatcgcattttttattactataattattatgtttattaaaaaataaaattaattaggacaataataatagcatataataattacatttaattcttgttttaatcaataattaataaggatgggaattttatgtaagaaaaatcgcgaaatatgtaaataaaaaatgttaaaaaaaatgctaaaatatgtaagaaaaaatgtacaaaaatcccaaaatatgtactaaaatatgtaaataaatttttctaaatggttaaaaaaattcctcttaaagggtgaaataagcacaaattgccattaaaataatctaaataggcttagagatcacttttagtattttaaaaattatttttgatatctcacttttggaaagaaaaaccgattttttcggtaccttttctaaaaaaaattttaatttttcacaagaaatttatataaagtgtcaaaaatccacaaattgcaaaatatgtacgaaaaaatccaaaatatgtataaaaatatgtacatatgtaatatgtagaaaaaccttggcctaatgttttgtcagcattggtggatttatttgtgatcttcgagggttgaaatgggattggttggcgcattgaaatgccacaa

SEQ ID NO: 75973 - DNA, 641 bp, Heterodera glycines
  Genomic contig location: Contig_ID=SeqID_1787; Location=1058..1698; Strand=+
  SCN-specific regions: Sequence locations=1-132,160-215,392-641
atgcgccaaacttacggatgcaatattgccaatacaaagcaatgtgatctcttcagagccgagaaaggcaccgaccaaatcggcaaaaatgttggtgagtgtcgaaatgagaatggccgggcccgtgtcctaattgattgattgattgattaattaattagcatcattagcaactagcataatgattattagggtgccccattagttttgcccgtataaattaattaattaatgaataatttttctttattattaattgtttttcattgtttactctaattaatttggcattaatattaattaattggtctttcgtaccaattaattgattaattaattagtgggtagttggtattttgcgctaattaataaaaacattaattagttaattggcaatcccaaattgaaaaagggattattaacgttttaaatgagggtaatctgttcaaatattcaacacctctaacacttcggccaactgatcgaccaccgccaaattcaccgacaaagcgtcgtgtgccattacagcgcggccgccttcgtgccgtcgacgttttgaggctaattgccaagaatggatcattaggaaggcgtcatcaacgcctggagaattaaataaattaaacacgaatttatacata

SEQ ID NO: 75974 - DNA, 2644 bp, Heterodera glycines
  Genomic contig location: Contig_ID=SeqID_1787; Location=1057..3700; Strand=-
  SCN-specific regions: Sequence locations=1-33,55-165,370-459,481 -499,521-649,671-993,1015-1033,1055-1095,1122-1367,1444-1746,1788 -1843,1873-1886,2011-2252,2429-2484,2512-2644
tcatcatcagaagcgtcgtcctcaaatcgtgttcacctctttggacagtgtggagatggttgtgttgctgtaccgtgccgaacgaattggcggatggaaagacgacgacatcaggcaaaacaattgaaaattggcaattttaaaaattaatttactaaattcggcatttttaataagatttaattgaatagaaagtttttatacattttaaacaattttttaaataaaatattttacgatattacaaaaatttgcaaaaaaaaaaaaaataaaattattgaacttttttcattttacattttaatttatcatttgaattttcattttttttaaagaaaaaaatcttgtttaaatgaaatatttttttttcgaattgaaaatttctaaaaattttccctaaagtttataatgagaactaattatgtgttaattaacgactaattaatttcgaactaataattggtcaaatcaacatcaatttcagtgactacgagatgagcatctccaactacttcaaggagtacgacgctttttgacagcaaacacatttaataataattgcccttttttgcccatatttagcaaatacattggccaacatattcgcgttctgaccatctcgacatcgtaagttttgacactgtttaatggaattttgaattttttgggattatctcaaattttcgggcaatttttcatccattggtactccatttttggcactttttcatttctggcattttatttttgccattttcactcttggagttccacttttggcattttttgatgttcagcattccatttttggcactttttcatttttggcattgtatttttgctattttcaccctaaaacgttccatttttggcgttttttttccattttcatcatttgcataacctttttgccattttcacccttggcattccacatttttgccattttcttcagttatgtccaagtggaggtggaccgtgccggcaacatcatccgctcctattttggctttgggcttgccgtgatgattttgtgctcactgttcagcaattcattatccgcttttttcatgcatcaattctccatttataaggttaaaaaaaaattaattttaatttttcaaattcggtgtgcctatttttccaaggccccttcattaccgtacacctaatgcaggataattctctctttatcttgggaaaaattaggggtttctcacaactagagcccggacatgacaccggatcttgtcagaattgttccggacccctaatgagtcctgtcaaacaggatttctaatcctgaaacttagtgaaacctgttctgaaaatccgggctcctctttttaaaacggagcatttttaggaaaaaattaaaaattaattaattttagaaaataaattaatcgctaatttaaaaaataaaagaattttcaaaaatttctcgagtgtctgctttattttgaacaactgtacagtaagaatgcctgggtggggaaggctttacaattagctcattgtaccgtaaaatgtatacggtaaacacagtaatggttggccaattaattgactaaatcatttgtctaattgtttttttttccatgtgcagttgcccgtcgctattttcgcctgtctgtgcccgttcatggccagcggcactgcgcttggcattctgttctttgccggcgttcggcacagttcaattttggcggtcactccctttctgatcttggcactaggccagtcaattaattcattaattattcaattaactaattggctaattaccttaattatgaatttaatttgtgtgaaaaataaatgaatttcaaattgttgaaagttattttataataatttttatctttatttgaatggttttttgtttaaataagtttaaatattattttaataaaaataaattcaaaacttaaaaatcattaaataaatttattattctatttatttaatttaaatttaaataaattattattatttttattatgtataaattcgtgtttaatttatttaattctccaggcgttgatgacgccttcctaatgatccattcttggcaattagcctcaaaacgtcgacggcacgaaggcggccgcgctgtaatggcacacgacgctttgtcggtgaatttggcggtggtcgatcagttggccgaagtgttagaggtgttgaatatttgaacagattaccctcatttaaaacgttaataatccctttttcaatttgggattgccaattaactaattaatgtttttattaattagcgcaaaataccaactacccactaattaattaatcaattaattggtacgaaagaccaattaattaatattaatgccaaattaattagagtaaacaatgaaaaacaattaataataaagaaaaattattcattaattaattaatttatacgggcaaaactaatggggcaccctaataatcattatgctagttgctaatgatgctaattaattaatcaatcaatcaatcaattaggacacgggcccggccattctcatttcgacactcaccaacatttttgccgatttggtcggtgcctttctcggctctgaagagatcacattgctttgtattggcaatattgcatccgtaagtttggcgcatc

SEQ ID NO: 75975 - DNA, 612 bp, Heterodera glycines
  Genomic contig location: Contig_ID=SeqID_1788; Location=392..1003; Strand=+
  SCN-specific regions: Sequence locations=1-135,157-187,209-373,395-612
atgaacccccaaaaatgggccaaatacagtagtaagtgtcccaaaaaccgataccgtaacccacctgtatgtttatacgttgtccgaacactgtagaagtgggatagtcaagctgcacattgtgactcggttgctggtgcttggccacccgtcgttggtggtctttgaagccgtcctgacaaattgggcacaaaatttgtgtacaaattaatcaatgaatatcatggcaaccgtgccaaaaacgacggcatgagaatgccagaaaaatggcaaataatttgttttaaaaaaatttctaatttggggttttcagcgtcgaagacaattttagacattgaaattcaaggggaatatttttttctacaatatgctcttggattgatatttatgtagaatttttcttaatttgtgtccttgaatgagtcaatttccagggacacccctcgagggaattccaggacgaaataattccatcaaatgatcgcacataaaacagtcggacgggctcattaattgtgcaaaaacggcgacaaatgcgcgaaaacggctcatcacgttgagtgatccgattgtaaatggtcaaattgttttggatcagttcgtcgacctgaa

SEQ ID NO: 75976 - DNA, 1767 bp, Heterodera glycines
  Genomic contig location: Contig_ID=SeqID_1788; Location=1488..3254; Strand=-
  SCN-specific regions: Sequence locations=1-40,64-114,136-160,183 -250,272-330,352-377,399-479,501-637,672-1767
atgaatgataatgatagggcaattagtaatcatcggcagaaacaacaacaacaacaacaacaaggcggcgacatcaatggggcgattgtgattaataatttcactgatcaacaacaccaacaccagcagcagcaaaagagtgggtttatcagaaagaaagaaatttaaaattaatttttaatcaaaaatcattagccttttaaatgtacagtttgacatttttaatgtacttaaaattcaaattgatcgattcatttaattttgacattttaaatgcaaatatatccagaattaatgcctttttgtcattgatcggggttttacaaattgaccagacagagatttatttacccaccccttttatccaaatctgatcaatggtgataaacaattcaaattgatcacacagcaaaaaaaaccacactaatcacacaatatatttagcaaaaattacatccaaatttgacaagcgtgtccaatccaaaaactgatcagagagctgcacagctgactgttgtcttccaataattattgattgactagagctgatcaggctacaaaatttcaccctgaactgatcagtgatcaccaattttgttcactttccagcagctgatcaacagtgccattcaccgtcggcatcgtcgtcatcctcgtcctcggcatcctccgctgcccacagtgacacgtcgtcccaatcgttttccgcccgctgctccctccgtctccatgcggtcgttgcgcgtgcctatcgccgctgggcccattttgtggtggcacatccgtacaaaattgtgttcatatgcttcatcttgaccgcaatatgtgtggtcaaaatggcaaaaaccaagtgagtgagtgatgcggagtgtgccaatttagccgagaaaattagacaaagtgccgatggggcccaagtaggatgagggctaaatgccgaaaagtacggcccaaaaaggatggcgacaaaatgccgaaagtgatgcccaaaaagggcggggacaaaatgccaacaaagtgggacaaaacgccgaaaaatgcgggccaaaaaaaggatgggacaaaatgccggaaagtgctgcgcggctaaaaaggacgggcaaatggcaaaaaccaagtgcggtgttggcggagtgccaattttaccgagagaaatggggcaaaatgccggaaaaccttgtcctgatggtgtgccgtaggcagtcttaattggtcccttaattttgacattttgtctagctttcggctttcgacaccactttaccccaactttgtcggcattttatccaattttttgttattttttattcattttgtcctaattttatcccacttcgccttttctctcccatacattttatctgaaatgtgagcttttgttccccattatgtcgacactttgtcccactcttcgtgccattttcccctcttctgtcgaccttttgtcccacttaagacataagaacaacatccgtggctatacgccgtacggctcacgggcactgtatgagtttgatgtgcgcgacgaattttttgaccagtccggtgttggcattcgcttctttgtgctgattttgcctcggaatggcaccaatatgatgcgcatggaaacactgcgcgagacggttgaggtaaaaaaaaagaaaacaaatcgccaaaaaacagggattttgaacgacttccaaaaaccgttacaatgaatggcttttatgtatacggtagcaaaaaattattgtacaaaccaaaataccgtagaaatttaataaa

SEQ ID NO: 75977 - DNA, 742 bp, Heterodera glycines
  Genomic contig location: Contig_ID=SeqID_12373; Location=263..1004; Strand=+
  SCN-specific regions: Sequence locations=1-242,264-507,529-635,658 -670,693-714
atggcgcttagaatccgattctcaaattttgggttaataatcacaattgtaccagaatcttttttcctagtgccaagcgttatcttaattgtaccagaatcttttttcctagtgccaagcgttattttagggaaggtaccccggccgagatttgggattttctaaaaaaataaaattcaagtaacatttactacaaaattcaagtcccgattttaagtctcgagcagcaagactcaatttaccatcattatcattattttggacagcatcggaaaatgtatttccatatttccatcccatttaatttataataaccgcacaatgaattgaagaaaactttgcttttgcccatttctttctttttcacttccttttttgccacaataatcacgttttcggcaactttttatcgcttttgcttgaccgtgcggttaattgagtcccagctgagtttggcactccatttccggcactttttcagcctgaaaagggcaagcacgccgctaattctattttccttcccatttctgaatttttacatcggttctgaccctttttgagcagttttgagtttgtgacctaaagcaatattttccatattttctgatttctatgctaaaagaaaaaaattccttcaaaatttcaaatatggattcataaaactcggaaatttgactttttatagcttttctggcaaaaattctacaatctgtgataaaaaaaaatataaaaaacaaattta

SEQ ID NO: 75978 - DNA, 792 bp, Heterodera glycines
  Genomic contig location: Contig_ID=SeqID_12373; Location=1726..2517; Strand=+
  SCN-specific regions: Sequence locations=1-13,39-121,143-244,266 -574,597-607,629-653,684-792
atgagctcaacacaatatttaatattttttcttttgttgtgctgcttaaaaaatatcagtggaattggtttcgatgaatttgcaaaaaatgctggtgcgataaatttagctgatcagtatcttaaaaaagaaataaagacaaaaggagaattattggaaaagcttgcccaaattggagttgaaataagtctaaggacgctggagagacatctttcaaaaataaaaagcaatgtttttcaaaatttgacaataaatttctttttattattggccatggagacgaatatagaaaataccaaaaaacgaacgaaaatgcaaatactgtctatgcctaatgcgaaacgtggttttatacatttagtaaggcgttagtttggtgaaaattattgaataactatagatgaagaccatatagactactcagaaccgtttgaatggcactgtgtcaaatcactccgagataagaaaggatgtaattgaatatttggaagaaactgtttaccaacattctttttctaatcatcacgataatgaatggtggtgtaagtctgctattttagtttttaacatgtagccaacattttagtgctttttgatagtattgaaaacataagaaaacacatagagaatgctattgctcctgcaataggcacccatgaaattgaaaaatggatgaataatttggatctagcagcagtcaccaaaatgtttcgaataaatataattgtgtgtgaacgtatacaagaacgaattttccgttggcaagtgtactcaccagatttagaaacatcg

SEQ ID NO: 75979 - DNA, 953 bp, Heterodera glycines
  Genomic contig location: Contig_ID=SeqID_12374; Location=2454..3406; Strand=+
  SCN-specific regions: Sequence locations=1-133,155-203,225-240,262 -798,885-953
atggactgtcccaaaaaagttaaacttccccctgaactccttacggagttggccaattgccttcattacaattcgctggtatggcatccgaatttctttgtcctttgaccattttctcgccaaaaatcaaaagaaaattcttcgcaataaaataaaggtaatgagttttcctctgcattaaatattggaaatgagaataagtgaaggtccattagagctcattagacattgtgtacttaatttttaatttaaacattttctctcgggtctttttcctcatcttaattgctgtttcagagaacagagggagaaattgatgctctgaaggaggctctcgcaagtttggagcaacgacacaccttggacgggttggaaatcgaacgattgaagaagaatatcagaagtttgtgccgccgcaaagcgaaagtacgagtcaacagcccgtcagttcggtactgtaacttcaaaaattgtaacatttaatattttttttgaaaaatttacaaagttgcaaaaaaattttttaaattttcttggcggggaaaccgtgcggggaactgagcccgggggggagggaatagctgctaccgatttaacattggccctaggtcagtttcggtgatgcctactttgattttctttttttttaatcaaaattttcatttttttgtattttatttgaaaaagccaaattccgatgcacttatgtaaaatccatctcaatttgtttactaaatcatcaattaaattcatatgacaaatttttatttagccgcccattgatccgccaattttggagaaagaagaagagggagaggagccagaagcaaagagactgaaagcaaacgacgagtgaaggaacaaaagggaaagaaaagaaaagggcacggcacactttgacaagaatgccatttgccgatctctgtacaacgaaacataaaggaattgtttaa

SEQ ID NO: 75980 - DNA, 714 bp, Heterodera glycines
  Genomic contig location: Contig_ID=SeqID_12375; Location=20..733; Strand=+
  SCN-specific regions: Sequence locations=1-97,119-283,307-608,630 -671,709-714
atggcacaaattgtgccattactcagcgaaccaccggaaggagggtatgggcgacaaatcgggcgtcaaaaatgctgacgtatacctaattttttataagaaaatttaaagaaaaaagtagtatttcatcataaaccttgaaaaatcgttggaaaatttttttcgaaaattttgttttcttgaattttaaaatttatgtttgaatttttctttttgttagggagagggacgggaaacggtgggggaatggatgtagtacacccatttggtcaatgatcagtatttaaaccccccaaaaatttaattcaggaacgtaacattaaagccgggattggtgatcgggtggcctaccgctgggagggaaacgagccaggcgacgagcggacaatcacttaccaacaactgcttgatcaggtggtgttttcaatggcaaaaaatgataattgagcctattgtagataatgggaaataattttctcagaattatgccatgttacctggcttaaaaagggttgatggcttttcgtacaatgggcagttagtttgtacaatggagtttcgtacatttttaatttccaattaaaacctagaatttctttctcaaaaagaattaaaattattatttttttctaggaaacacgaaaaatttctgctaattttttcgttatttcaaatttaaaaaaaattagaattttttaaatttttttagaaaaa

SEQ ID NO: 75981 - DNA, 1397 bp, Heterodera glycines
  Genomic contig location: Contig_ID=SeqID_12375; Location=1871..3267; Strand=+
  SCN-specific regions: Sequence locations=1-232,257-655,689-938,960 -1165,1187-1360,1383-1397
atgtcccaagaggaattgctgctgtcgttccaagatgaaactgctctggactggttcgttcggcttgcccatccgtcgttgtcctttcgttctggccatgccgaattggacgcactaaatgccattgtcccgggcgaactggtcgaaattgttgggcgggaatcatccggcaaattgcaggtggaaaatgaatcaaatcgctgaaatgccatagatggtggacctctttttgaaaaattttttttttttaatttttcgcgaataaaatatttaggaaacccgagtttgccaatattttggtccatatttatcaattttcgagcattttagtccatataattgtctgccctagtaaaaaactaactcattctttttccgataaaaataatcgtcaaaaaagcaacaaaaaataagaaaacacattcctaagaattgaaaaattttaaaaaatgatcctctaaaatcttttttttcttgtgattaagtttttaaatgttttggctaaagcgttactaaaaatttaataaattttcccatttttgtgcctatttaatccccattttgcgcttgtttctgcctttttcacgatttttatgcctaaaaaatgaagccctacttatggccaaaaatcgtaattctctgttatatttttcacatttaataatttttttttatttgtaaaaaaatagagaaagcgctaacgaatgataccaaaaaatgtttaatttggtcgaccatttacaaaagttatgacaatttaaacagttggccatgactttggtggcggaatttttgttgtgcgaaagcaaagcggcacagcaccgggccgtggttttggatttcaacggcagcttccgcacggagcggctaatgcaaattttggtgaacaaaaggccacaattggaggaaaatgtatggaaaatgaatgggatgggaatttgtaaaataccgttttccttcaattcagtcccccccccctctcaattagaagcgccccctgaaataaaggcctcactttttaggtgggggtggaaaataaagcccctgggggcggagtagctcagttgggccccggcacgtttgggccccagcgggtttttggctataacttttttctttgcaaaccaaattcaacaatcttggtatcatttagttatggccagaagaatttaaaaacccagattttccaacctttttttgccataaatttgttcaaaattgacgaaattttttcggattttgcaggctaatagatcatgtgaagagctttcgaatgataccaagattgttagatttgattgacaaagaaaaaaagttataatccaaaaacatgctggggcccaactgacgtgtaccgcccgggggctttattttaggaaaaacggtagataagcaaa

SEQ ID NO: 75982 - DNA, 165 bp, Heterodera glycines
  Genomic contig location: Contig_ID=SeqID_12376; Location=1231..1395; Strand=-
  SCN-specific regions: Sequence locations=1-134,156-165
ccgaacgaaggctgcctgagcgggttcatcaccggctttggtctcgttggttacacggcactttggctgatcgaagtgccattcacattcaacagtccgatcagtgatcacaaggatttgcgtgaaaagctgcaggaggcgcttgatgatgtcattgactattga

SEQ ID NO: 75983 - DNA, 1043 bp, Heterodera glycines
  Genomic contig location: Contig_ID=SeqID_12377; Location=7..1049; Strand=-
  SCN-specific regions: Sequence locations=1-132,165-678,723-745,772 -908,948-1043
atgattcaattccgtcatcctttaatcctgctgctgctgatacttattggagttgaagtcatctgcagcactaaggacaacaacagcaattataaagttcatgtgaaaaccgtgacatgggaggttgatgcgattaaaattcaaaaaaataataaaatataaatctgaccctgatgataaatgcgtgaaggcccgagtccgctccttatttctaagatttgttcttatttggaggggccatgtcctagaaacttaaaatgtccttatttctaaaatttttttatttcaggcttcccctaaactttttaaatttctgtgcttaatgatttatttcgctaatttttagtggtttatttttaatgattttttatgttgagctgattatattgctaatttttgagaaatttcggtttgtagtcctgttttaattatttctaaaacgtagccattttttcaaaaaatcatatttttgaggtcaaactcttaattttagcctcgtttgtcttattttgaaaaaaaaagttgggagccttggttttacaattttaatgaaaaaaacaaaaaaataaaaacccaaaaacaataaaacactgtgagattgtaaaataattaaggaatttgttgctgatgcactgaaatcggacaatgaattggaacgcgaagaagtgagttaacggcatatttttttttacagaaaaaatagtaaatatttaataaaaattgcgataagcatacgccgatcggccccatttttgggcaaattttttaaaattttgcacaattttctatatgccataaaatttctcggcggcgcctatttgcaccgccatgctccattgaaccatcattttttgaaaatttgatcccaacacggaaaaaatttagtcatttttggcgcaaaacagttaaaaatgctttatttttggatgcaattttcaggtagagccactttttgacccgatctacaaaaaggacaccgagcggatgaaggcattgattggcacattaagcgaggagaagctgcggcgcttcttgcgcacgcg

SEQ ID NO: 75984 - DNA, 689 bp, Heterodera glycines
  Genomic contig location: Contig_ID=SeqID_12377; Location=2190..2878; Strand=-
  SCN-specific regions: Sequence locations=1-155,179-396,441-486,508-666
atggctgtcaattatggaaatatggaaaaatatggaagtgaaaaggcatcctagaagcatcatcaaaccaagctaaaaacactatttacgtggtttttaggccgaaataagtgtgcaaaaaatatggaaatccatacaaatccggttcctagttattatgtatgaaaaatgcatgaaacatttattatttaattgttagcataaatgtaaaagcgcaattcattatttaattggcaggtaccataaacagaaaggcagaagatagttagggaaggcgaacatttcaccggattacggtagtcactgcctggtttggtcaggtgatcaacggaatttcatagaatattggtgcatcatcgaatgcgcgcacccattttatacttcacaaggtacttgaataattatttaaaaatatttttaaaatatttatttttaatattggatatcgccaggcattccaaacgctattcccatttgtattcaaacgaatttcaaatttgaaccaagtaattttattgcaaaatgggcttatattaggcactacgtaaatttgaatgatgtcatccagcagaagatattctttgctatcaatcagcccatcattaattggcagtgaaattgatgctacgatttttttctatttttataaatccgccgttctccgagaaattttcttttaaaaaattaaa

SEQ ID NO: 75985 - DNA, 1077 bp, Heterodera glycines
  Genomic contig location: Contig_ID=SeqID_12378; Location=241..1317; Strand=-
  SCN-specific regions: Sequence locations=1-67,91-357,581-722,745 -766,796-974,1006-1042,1066-1077
  Gene Ontology: Biological process=protein biosynthesis
atgtcccgtcacgaatcctttatccccaaaaaccctcgtaaatcccgaaaccaattgtctcctacgccacctacagtattggtgtccatatcatcagatgaatccgacaatgaaagtgcagaagaacaacccgagcaacagtcgaaaaaacaacaaactgtggtcggcattcagcaacgcccctacaatccgaaacttcatgaatttgagaggagcaatgtccgagttcttaattcaattgagcaacgccgtgtttctgaacaacaaaaaatggtacagtttcctgaaacggcaacagaaagccaacgggaaagggaaattcgagagttgaagcagcgaattctcttactcgaaagtgaaaatgcaaaagaagagcaaaaaacagaagaaaaggaagaaaaagcgaagaaagatgccgaagaaaaggaagaaaaagcgaagaaagacgccgaagaaaaggaagaaaaagcgaagaaagatgccgaagaaaaggaagaaaaagcgaagaaagacgccgaagaaaaggaagaaaaagcgaagaaagatgccgaagaaaaagccaaggaaggtaaagaaggaggtgattcggaattgtcattaggggaagatgacatagaaagagaagaagctgaaagaaaaattgaagaaataagagaaaaattacgaaaaaaggagcgaagggatgcgttgaaggcaaaaaatgatttgcgcaaaacatcagaaaaagagaaagggcagagtgtagtaaaaggaattttgagaagaaaaatgactgaggaggaaaaggaagaaaagacaaaaagggaagaagcgcaaggagcagccaagaaagaccaggaggaagttggcaaaaatgccaatcaaaaaggaccgttaattggcgccgacgcaaaaaaatcgattcttgagacgatcaaccagccctacgtccacggacgagtgatagggcaggtcattgatcccagggcggaagtggaagaaccctgggacatgaccaaagccctcgcgaatcgagaaaaggaggatgaaataagagtgaaaaggaaggatgaaagagaggaaggatggaaaaatctg

SEQ ID NO: 75986 - DNA, 972 bp, Heterodera glycines
  Genomic contig location: Contig_ID=SeqID_12379; Location=61..1032; Strand=-
  SCN-specific regions: Sequence locations=1-9,31-972
atggcattcgatgtagatattattcacagaccgggaaaacgaaaccaattctgtgactatttatctcgatatttgggcgacaaaacggatcaaggaattaattcattgaaattcgaccagaagataacacgagaagaaatgatcgcagcacaaaaacaggacaaagaatcgcagagaatttgcgaattaataaaaaatgcggacgaaaaagggaattctgaggggacattcggaagatggaagctttttgggggacttttgtgcgttacagataggggagagtggaaaatttatgtcccagagtgtatgcgacgccgggtaatgagtgaatatcattctgaccctttccaaggaggccatttgggcgagaaacgaacgaaagaaaaaattagacgaagtttattttgggaagggatggacaaagatattggaaatcaggtcaaaaactgcgacgcatgccaaaggaggaaaattattggcattaataaaagcgcggaaccaatttgtccaatagaaccggcagctcgaccatttgaaagacttcatctcgacttaatgggacccctaagaacgtctaagggaggattccaatacgttctaatgattattgactcattttccaaatttatggccgctatcccactgagagaacaaacagcgacaactgttacttcagcattcgtagaaaaatttctatgtctatttgggctaccaaaaattgtgataacagattgcggcacacaatttttgagtgcgacttttgagtcactcgctgagaattggggctttaaacaccaaactacggtaccgtaccatcagtccgctaatggacaagttgaacggtacaaccgaacattggtggatatgcttgttacaacgacaggggggaaagattgggcttctgcccttccaatactttgttttgcgtataattcttcaataattcgcaaattggacatcaccgttctatga

SEQ ID NO: 75987 - DNA, 752 bp, Heterodera glycines
  Genomic contig location: Contig_ID=SeqID_12380; Location=36..787; Strand=-
  SCN-specific regions: Sequence locations=1-105,141-653,675-752
atgggtgaatttgaaggcaaatttccgatattagtaagcgaagacgaaggatgcccatgtgcagcgataatcggaacggatttgatggatcatatcagtgaacaaggaggagaagaggaaattgggcttaattttaaaaagggaactgttcgagtcggccatattcaccttccaatgatcgctgcaataaacttcgaaaataagccaaccgaagttcgactcttacaaacacagacacttcccccattatctgactcattcgtgtgggggcagataaatcgaaattttgatcccgaggacacattcatcactgtcgaaaaagaacacggctattttcctattcgtgtcggaaagtgcttaatttgtcccgggtcaacctgagttattccgcttcgattacttaatttcggcaattgtgttgtgaaagtccacgccggctcgcgattggcatttattgagcctatttccgactcagcagaaataaattcgttaaaaagggatcagaatcccgacgatccaaacatgctaatgaatgacgaagaatggggaaaatttaaatcggaaagagaccaaattccaccagaggcggattggaccgacgaaaccttggtattcccgaaaaaggatgacaaaattaagcctattttggaacggatttcctttaaaatgaggccatattcagtcctaattcaatggaaagattgaagggaattattagtgacaacgaagaagctttcattagaccaggagaa

SEQ ID NO: 75988 - DNA, 561 bp, Heterodera glycines
  Genomic contig location: Contig_ID=SeqID_12380; Location=958..1518; Strand=-
  SCN-specific regions: Sequence locations=1-229,254-493,516-561
atgaccagacccgaacttgatttcggtgaaatcaccgcaatggaagtcaacaacactgatgacaatggaaattcaatctctggaattttttcggttggagaaatattggttgaagcggcgcaagaggaaggagaaaatttaaggcaaaaagccagtgaaaccatcgaaaagggcaaggaatggatggaagatccgattgggatcgttaaatatattaaatggaccgcttttattattattgccattataattctcattggctgctccgttctcctaataaaggctaaattatacgcctcagcactaatgcttcccctccaactaatccgctcgcttatcaccactttggtgagctgcttttcatcaggcagagaaattgcggaccaagtccgttatccaatggtaatggaagtggaattacgggagcaaacaaaaccaacggcaccccctgaagaagcgttactcgaaacaaaagcatacgttttaaattatatgccaaaaatctgtcaaataaatcgatcaggaccgaagaaaaagagatgttatgtgaatattttctga

SEQ ID NO: 75989 - DNA, 480 bp, Heterodera glycines
  Genomic contig location: Contig_ID=SeqID_12382; Location=381..860; Strand=-
  SCN-specific regions: Sequence locations=1-207,230-243,265-480
atggccaatcatctattgctggtccctgccctgctctttcatttgctctttgttctccacggccgctcaaaattttctgccattctgccatttttgctctctggactagttcacaattggccgctatttaagccatgggtcgcaagaatgggccatcattcgtttccctccgactccccaattccaaacacattctgtgccatgcccgccaagcccaactctctctcgcaggagctcgccgatttggaaaaaaggaaaatggaactggaaaagctgatcgcttcagctacgaatgaaaagccggaagggaaggcccgacgcccaaagaagtgccaaaaccctgacgagcccccccccacgggaagaacaggaaaaaaagggaccaaaggcggcagcttcatccgattccccgactacgcagccatcccattcgccgatcaatgttgtgccaccgccacctgtcgactcagaaatggctga

SEQ ID NO: 75990 - DNA, 1480 bp, Heterodera glycines
  misc_feature (1404)..(1404): n is a, c, g, or t
  Genomic contig location: Contig_ID=SeqID_12384; Location=78..1557; Strand=-
  SCN-specific regions: Sequence locations=1-232,254-556,579-720,742 -1172,1195-1441,1465-1480
atgtttaaattccctttgcaagcaaaatcacattctgttcaaaggctcccagtgcatttggaaaatgaacagataatatattttgatgaaaatgatgatgttgaaacaattacagaaaaaagagataaaaaaagtaaattgatggcttattttgctttttttaacgaaaatcattgttcacctaaatttttgtacacagaaatgcctaaatattgtatttggaaccctaagcaaggaaagtggatattgcgaaaaaacccagaaataagtaaaacaatcggacgaatgtttccgattagtccaacggagggcgaaaaatattatctccgttatcttttacttcatgttcatggtacaagttttgaagaccttaaaactgttaatggaattaaatataatacttatgcaaaggcgtgtttagcacgtggattaactaaagacgatgatgaatggaagcattgcttaaatgaagcaagtcagttcaggtttccagcagcgttaaggagtttgttcacaagtatcttattgtatggtgacccaaaacaaccagaaattttgtgggaacaatttaaaaataatttatcagaagatttcttaattaaaaaccaaccaaacattgcttatgtattggctttgacccgtatcaataaaaatttattacaagaggggaaatctttgaaagattttaaaaatttaccccaagaaacctctttaacagatgaaaacgaaaatataaactatgaagaagaaaagaaaatcgcagaaaatttgtataagtctatgaacgctgaccaaaaaattatttacgaaaaaataaaacaaatagcatcaggcaaacttaatcctaaattaatttacattgatggcccgggtggcacaggcaaatcatttacattgaatgcattatatcatttagtacgtagttataaaaaacatatgacaaacatggcattttcaggaattgctgctacattattaaaaaatggtagaacaatacataatcgatttaaatttccgcttaatcttaatgctcatattatttctggagttgttcaaggcactaaagctgccgaagaaataataaaaagtgatttttttgttatagacgaagcgccgatgacaccacgatttgcacttgatgctatcgagaaaaaattgcgtgaattaactaactgtaaacaattatttggtggcaaaacaataattcttgcaggtgattttagacaaacgttacctgtaaaaaaatttgcagtaagaagcgaaattattgacctgacaataaaaaagtcaatattttggagtaaatttgagcagatgaaattaataataaataatcgggctaaagaccaaattttcgctgaacagatacttgaaattggtaatggaacttttggcgattctatntcattacctaataattgtatcatagccaacgattcaaatttaatagatgaaatttatgatgatgtttttaaagaac

SEQ ID NO: 75991 - DNA, 1715 bp, Heterodera glycines
  Genomic contig location: Contig_ID=SeqID_12385; Location=61..1775; Strand=-
  SCN-specific regions: Sequence locations=1-476,498-795,829-959,982 -1442,1464-1715
atgttccgatttttaaaatacaaggaaatatttatcattcttataatgcagttgcccagccgaataacggtgagttaccgacaaacgggcaattgtattttattgacacagaccaagcaattgattttcgattaacatgttgggtgaaaaatcctctgattcaaatgataatataattgaaataattgcatatgttgaaaattatcttcgtgaaaattatgtttactcgcattcatacgaaatgatgaaaaatgtctatgaaaatgcggtagaaaaggcaaaaaacatgggcacaaatatccccgaaattatgatgttatttgatattcgtgaaggtacagatctaagattgaaaccattttccctttaagtccattggtggaacctatgtgttatcccctattttatcctaataattaccgagggtggcattataatatgaaagatacaaacaataaaaaaatatcgttgtgcgattttacaaaatataaattatttttccgaaatgaaggaaaatttttgcctcatcattatggtaatagactttttcagcaatggtgtgtcgaccaggctgccagaattgaatggagtagattaaattacataagattacatcaaaaagaaatctgtaaagagtcgtataatgcaattgataaatttttgtatgcaaaagcagctgaaacaggtgctcaggttaaaaaaaagataattttgccctctagctttaatggcggccctagaaatttgcatgaaaattttatggatgcgatggctattgttaatgaagttggccgtcctgatttatttattacttttacatgtaatccaaaggatgaagacatacaaaaagggatattatcaggtcaacaatcttttgatagacccgacattgtagcaagggtttttcatttaaaagttacacaatttttaaaagaaataattgatggtaaaatatttggaagagttgttggattttgttatacaattgagttccaaaaaagaggccttcctcatgttcatattttgttaacattggacccattaaataaatggaagaacacgagtgacattgataaatttatatcagcggaaatacctaatgaaaataatgatagggatttgtatgaattagtcacttcattgatgactcatggcccttgcggttcagagtttccaaatgctatgtgttggtgccaaaaaacaaaaaagtgtattaaaaaatttccaaaacaatttagagaaaaaacagaaaccaacgaaaatggttatcctttgtataaaaggccaaataatggcaaaacattcgttaaaaaagattggaaaacaggaaagatcaaaataatgactaaccaagatatagttccatataatcgatatttattaaaaaggtttaaatcacatataaatgttgaaaaggtggctgacataaaagcagtaaagtatatttatatttaaaggttatgatgcagcaactcttcgctgtatatcaaacgaaaatggaaatataaaagaattagtttatgatgagaccggaacctatttggacgcacgttttttaagtcccgtagaggcttgctggaaaatgtttaaattcccgttgcaagcaaaatcacattctgttcaaaggctcccagtgcatttggaaaatgaacagataatatattttgatgaaaatgatgatgttgaaacaattacagaaaaaagagataaaaaaa

SEQ ID NO: 75992 - DNA, 1163 bp, Heterodera glycines
  Genomic contig location: Contig_ID=SeqID_12388; Location=797..1959; Strand=+
  SCN-specific regions: Sequence locations=1-147,187-943,978-1092,1114 -1163
atgtatataaaatatgaacataatgataaaatatggacaaatatggaaaaaacttatgtttgaacccgattttttgcataggcgcaagtgtttggacatgatccattcggagatccaaaaaaaaatttttttgttgaatgcatggataaattaaataaagtatattttttctttattctaattctatttttttcaattagaatgcatcggttgacgaaaaaaatggtagagataatgttaagaagataaaattaaacaaaaaggaagacgattataagctacagaaaagatatcatatagacgataagaaagaagcagaggaaaaggttgacaaagtgaccaaagcaaaaagaagtgttaaaaagtaagtttgctttttgtacttttaattgagggggtgaatagcagggatgggctttcgctttcgcgtttcgctttcgcatgtttcgctttttggtactttcgctttcgcattttggcgcaaaacgcaaatattacaccccctaagaatgagggataaaaagcccctaaaattttcaaaaatttgatatataaattggctaattgtcagtgaaaagctgtttaaaaatggtcaaaatttccaatttttcccccagcagcgccaatcggcaccgccgtgccccaaaaagccctattttttcttataaaaatggtccaaaaatcgcaaaatttgataattttttagtgaaaatctgttgataaattgtattcaaattttcaaaaattttcccggcagcgtaaaaaagttgtagaaaaaatttcgctttcgcgtttcgcaatttcgcgttttttggaatttcgcgtttcgcataaagacaaaaaaacgaaactagagaaattttgagaattttaagccacaaacctagaaaggaagaaggcattttgttgctcattgttgagaaattggattttccaagcattcaattttaaaaaaaattttttttttaatttttaaaggaccattgattcattggctgatattgagaaaaaagatgaaatgtatttatttggaaattttttcaatttgccagtgcgccagaaatcagcgccgtttagagcagaaattttggcaagagagaatgaaaaggtcatagaaatgggcaaagattatatgacaatttgggtaaaacgtaactcacaaa

SEQ ID NO: 75993 - DNA, 588 bp, Heterodera glycines
  Genomic contig location: Contig_ID=SeqID_12389; Location=76..663; Strand=+
  SCN-specific regions: Sequence locations=35-265,291-346,368-546,570 -588
atgtggcacccacaaaaagagaatgacaaaaagaaagcggggaagaaaaaaagtacgaatgtcgaacccaaagtcgaacccgacccaaaaaagctgaaagaagtcaccgaatttctactgcttgatgcggcactcgatcgggaggcgcgcaacttgtgcctgaacttgatttttagagtgccaatgcgcaattgggcagcgattgcgaaagacatggacgacaaggaaattgaaaactacttcataaagccattggaggaaaagcatttaaaaaataataatatttaaatgaacggtggtgctatgacgttactcaaaacccataaaatttgggcgttagacaaaaaatcattaaatgaaaatatatatttttttgatataactttgctcaaaagcaaccaaatttttaattattgataccattcgatagccctaagtgttttctattaaaccttcaaaatttcataaaatttcgttacatttcaagaaagctatgaccaaaaatgttcaagaaaacttgcttttttgagtttctctgctcataactatatttaaaattaatgaaattttttgaaattttgcaatata

SEQ ID NO: 75994 - DNA, 1396 bp, Heterodera glycines
  Genomic contig location: Contig_ID=SeqID_1791; Location=1051..2446; Strand=-
  SCN-specific regions: Sequence locations=1-130,158-377,401-1188,1210 -1282,1304-1328,1373-1396
  Gene Ontology: Cellular component=extracellular space; Biological process=cell proliferation
atgatccctttctctttgctctccgttcaattgttcgtcattatcgttgcttctgtgctcacactcgtcacccaatgctgtgcttgttgtaagaaaaaggtgaataaatgattcattcattatttatcaaatgaattaatttaatttgttttttattgacagaaaaagccaccgacaacaaacttcgctgatcgtaagtgctgtttactcaagtgttttgtgtctccgaacagctccaaaacctttatattttcagcagccgattcgcgctattcgacgcttgccggtataaacaaggaaattttcgttcaaaaaacgccatcgcagcaacagcggtcacaagccgtaccctatggaccttattgtatgtcggagtgttttgtttgcttttttgaaatggcattaattgcgttttttggtttcagcaagtgcgacgcccgtaaagccggcactttcggacgagtacaaattcttgccgacattgcgcgtggacccgcccgcttttccagcgcaggccgcaccaccaacttctgtattggcctcaccgaccatctcggcaaaaccgaccgctccaacaaaaccgacaatctcagcaaaaccgaccacctcaactaaacggcccacttcagcagcaccggcaccgaccgctccagcaaaaccgaccatctcaacgaaaccgaccacttcagcaccatcggcctcaccgactacctccgcaggaaaatcatccatttcatcaacaccgatggatttggcttccacatcgatggctgagacgcaaccgatcattgcagaagcaacgggtgtggtttttgagcaattcttcaagatttcagttctaaattctcaatgttagcatccattcatctttttctttccttttcagcagccgactcgggatactcacaaatggatcaatttggtccggacatgtccattaaagtgctaacgccggaggaggcgaagaacagaagtgagagagtgcagcagagcattgcattgattctgatcactcgtttagcgccagagacgggccaatccatcttgatttttgtgccggtcagcagcagtaagaaggcggacaagcgccgctgagatcgtcaacggtcagtcaaacaatcgaataaatgtgtttttttcaatgtttatctgttctttttcagcactcgatcggatggcttatttgtgatgctctgttggccaattggaccgttaatttaccctttgaaagcgttcgctgtgttcagatgaaatgtgacctttcgataacctctgtttatcatgtgcttgctgtcttattattcccactgtttctgtccccttaattatgttcttgtcattgtcatgtgattattgtatgtattatttacatgaaatgtcgttgcatataaataaa

SEQ ID NO: 75995 - DNA, 1452 bp, Heterodera glycines
  Genomic contig location: Contig_ID=SeqID_1792; Location=750..2201; Strand=+
  SCN-specific regions: Sequence locations=1-54,77-212,247-363,426 -665,687-889,911-1096,1118-1121,1152-1188,1212-1232,1254-1266,1300 -1413,1446-1452
atgctttactggtcttcacaacaaaaaatagattattcaataagatgtttgaataagaataaaatttatataatgtaagattattttggcggatttgtaaacgcttaattctgccgattcatttggtcgagcaaaacattgtccatgaaattgcgaacgtcgctaattactttggagaggctcattaagtaatattcatcacaagtcgggcaaaacttcagcagcaaaatgacataaggctgcaaaaattggaaacattaagtgaaaaatgagccaatttatggacaaagggcttctgttggggttttagaatatttcacatttaacaaatttaaaacgaaaaaatttaggaacaggtggcagatttaattttaataatttattttttcattatttcgaaataattcttttgttaatattttaatgaaaaactgacagctgtgtcgagcggcacaaattccacttgcaatactttggacatgagcacagagtttacaacggtgctaggtcgtttcttaaaaaccgccacattgggcgttttttaaaaccgccagggcgtttcttaaaaccgtcagggcgtttcttaaaaccgccaactcatatgattatgtatgtatatccgttaaattaaatatacaataataatcggttagactcttttgattatacaaattcatattaaaaatttagcttacgaatctgagtcaaaaagaaacaacagcatcagtatttttgtattataatgatggacattttgaactgattaaacagccaacaaagataaattaattattttgttttatttctgtgataatctttataaaattcattcccttttgaaagttgcaaagaaattctgtgggacttattgtggcacctctctattagactcttgtctaatagctcctgtaatctggttttgcaactttcaaaaaagtaacaaattacgaattagcaattttatattcgaaaattttgcagttgataattgttgctataaccacgatgtgtgctacataaataaatatcagaaacgttacgattgtgatattaaattttgcaattgccttaatgaatatcctaattgctttctaacaaaagtctgttctccaactcatatcttaaatatttttttttttagaatatattatgctggtcagttcatatttttggagaacgttttaaaggataaaaataattattttattttaccgtcactagatatgcatatgtattttaaattttttattgttatgtaaacttctaatatatatatatatatatatatttatatacataatcatatgagttggcggttttaagaaacgcccaaagtggcggttttaagaaacgcccaatgtggcggttttaagaaacgcccaaagtggcggttttaagaaacgtcccagcaccatatttaatataattttattctattttattttcagaata

SEQ ID NO: 75996 - DNA, 629 bp, Heterodera glycines
  Genomic contig location: Contig_ID=SeqID_1792; Location=2629..3257; Strand=+
  SCN-specific regions: Sequence locations=1-168,190-447,469-629
atggcaataaaaactcgggttcaaatggcacaaattttcacatggatggagggggcgaacgatgttgacattcttccaccaggcggaagagttgcaaacattgctacgatggattggagttttaaggcattgagtttattcaaaaatggtaataactgaaaacgaataaaataaatttcctttttaattgtaattaatgaatttaatattcatagattcccgtaattcggctgccactgagcatggctttcccgctcatttgctgctttcaaaaggctatttccaagtcagtctgagccgtgccatggtcgagttcatccagctggaactgaacctgaccgagttagtcagacgtttaaatttgattggatatggacgggacgaaatcctgctcaccactttgcactccgccgatcagcttaatgcaccgggcggatttacgcagacgtgcttcagccggaagggtggcggacggaccaaccatttgaccaggtgttttttaacgggatttaatttacaaattaaaagtcttagcatttttggcatgaagcatgaaattgtcaaagttttgtcttaaaatttaattatctgggctttccgaacaggctaaaagtattgaaacgtattaa

SEQ ID NO: 75997 - DNA, 343 bp, Heterodera glycines
  Genomic contig location: Contig_ID=SeqID_1792; Location=3607..3949; Strand=+
  SCN-specific regions: Sequence locations=1-56,80-129,165-170,192 -221,255-343
atgacatatttacacacgggaggagaacaattggacaaaatggaggcgttggtgaacaaatctgtggttgagcagctgccgaatgtgagtaattattgttgtgtaagaaatatgaaaatgagccaagtcataaattaatttttttttttttttaatataattttccaaaatttttaagaaatttcaattttaggtgaaatttcagcgatttaaaagggatatgattttacgcaacaaaaacaataagcaacaaaagcgtggtgttggtgaaaagcaattaacattcgaagaagtgatggggtttcagtgtgaagtataatgacttaaagcattcaatttataa

SEQ ID NO: 75998 - DNA, 718 bp, Heterodera glycines
  Genomic contig location: Contig_ID=SeqID_1793; Location=116..833; Strand=-
  SCN-specific regions: Sequence locations=1-426,449-449,521-571,594-718
atggtcgataagggcgaaggctacaccggctatcaagagctgaaggacggagtgtaccacggctatcagccgttgaagccgcgcaaaacgcccaaattcaccgcagaatttggactgagctcgggcatgctgaacatgtagggtctgacacctgacacaaaaacatttaggcatagcgaattttgaaaattctatgtgctactgactcatttggtaaagtaatacaaatgccaaaatattacggtggaatttgaaaataaattattcttaggcgctttataatttttagaagcaatttttcaaaaaaaaaacttgcttctcagtgcggttgcccgcgacattgactcaattccgaagggggacaaccaggacggaagccaataccagtacttgtcggcacacaacgtggccagaggtcaggtaagaaaacaaaatgatttataaaaacgaaatatatttaaataaaaaattaatttaaaaataaatgaaaacaaataattctatttataaataaaaaattcagtacattcctccgaccaacccgaacctgccgaacttggacattcctgttcaacaacagcagcaggaagtggccgaagaataactggataattcagaatccaattggtgatgaagatggaaaagaatgttcaatttaatatgtttgaatggttaaaaaaattggattaaaattacgataaaattgaaatttaataaa

SEQ ID NO: 75999 - DNA, 1689 bp, Heterodera glycines
  Genomic contig location: Contig_ID=SeqID_1793; Location=1737..3425; Strand=-
  SCN-specific regions: Sequence locations=1-736,777-946,968-1031,1102 -1221,1269-1403,1425-1477,1530-1541,1577-1689
  Gene Ontology: Mol. function=chaperone activity; Cellular component =nucleolus; Biological process=nucleocytoplasmic transport
aaggaaacggacaattcgacttcggtgaaggcagagacggaagatgcggactattcgacaactgagacaaaggaaacggacaattcgactttggtggaggcagagacggatgaagcggactattcgacaactgagacaaaggaaacggacaattcgacttcggtggaggcagagacggaagatgcggattattcgacagctgagacaaaggaaacggacaattcgacttcggtggaggcagagacggaagaagcggattattcgacaactgagacaaaggaaacagacaattcgacttcggtggaggcagagacggaagaagcggattattcgacaactgagacaaaggaaacggacaattccactacagtaaaggcagagacggaagaagcggattattcgacaactgagacaaaggaaacggacaattcgactttggtggaggcagagacggaagacgcggattattcgacggaaacggacaattccactacagtaaaggcagagacggaagaagcggattattcgacaactgagacaaaggaaacggacaattccactacagtaaaggcagagacggaagaagcggattattcgacaactgagacaaaggaaacggacaattccactacagtaaaggcagagacggaagaagcagaaagttcgtctactgtaccagtgagcacgaaaatctcaatcaaattggtaatttaagaaaaaaattcatcaatcatgttacattaaaaagttttttaaaacaaagatggtgaagaaagcgattgtcgcactgaaatcaaaaaaggggtcggccaaaggcgcaattctcaactacattatgagcacctttgacgtgggcaaggacacttcccgcgtaaatgcactaattaattacttttcaaaaaatgtttgagttggtaaagcaataataattattatttcggtaattatttgtaaaaataagcatctattttcactagtacacacaattaatgaatgataatcacaaatacaccaaatgataattgtcattgaatattaattaaattattgatttatcattcttaattttaattaattaatgtgcttaaattattttttcaaacctttgaatttaagatttatgaaaagatggatttggcaatcaaagaattagtccactctggtgaactcattgaggtaaataaatatgtaatcatttacgagatcaatcaagaaacattgtttaaataatatttatttaaaattaatttcatttttctttatttaaagacaaaaggaattggctcttccgtttactacaatctcaacgtcattacgaacgcaacgccttctgctgctgaaaatatggtttcgatggatgtcgtgctcggataaaaacacggctaaatgggaatttgggattttgttttcttaagaattaaataccacattttgtaaatgagttatcaaaattctatttttcattttaaaagctgtgaatttttcatatttttttaagttttcaaattaatttttaaataatattttttgacagtgatcggaatattttattataattaatttttaataattttttgaggattcttttgcttttcttttttattgttaatgtatctttgtctaatattttttatttgtgactaatgtgatgtttttacttattcattttacatttttaaccttaataaa

SEQ ID NO: 76000 - DNA, 1119 bp, Heterodera glycines
  Genomic contig location: Contig_ID=SeqID_1794; Location=375..1493; Strand=-
  SCN-specific regions: Sequence locations=1-31,54-354,376-1119
  Gene Ontology: Mol. function=chaperone activity; Cellular component =basement membrane; Biological process=nucleocytoplasmic transport
atgaaaaaagacgttacgaaaaaggttgctgtcagagaagttggaaaagtggacaattcgactaccatgaaagctaaaacggaagaagcgggcaatggcaattcaactaagggaaaggtggtggagacgaaagaagctgtcaattcgactacggtaaaggcaaagatggaaaaagtggacaattcgactacggtaaaggcaaagatggaacatgcggacaattcgactacggtaaaggcaaagatggaagatgcggacaattcgactacggtaaaggcagagacggaagaagcggacaattctactacgggaaatgcagagattgaaaaatcgaactcgacaactgtgatagctgagaaggaggaagtggacaattcgactacggtggcgtcagagacgaaaaaagcggacaattcgactacggtaatggcacaagcggacaatttgactaagggaaagacagagacggaagaagcggacaattcgacaactgagacaaaggaaacggacaattccactacagtaaaggcagagacggaagaagcggattattcgacaactgagacaaaggaaacggacaattcgactttggtggaggcagagacggaagacgcggattattcgacaactgagacaaaggaaacagacaattcgacttcggtggaggcaaagacggaagaagcggattattcgacaactgagacaaaggaaacggacaattccactacagtaaaggcagagacggaaaaagcggattattcgacaactgagacaaaggaaacggacaattcgactttggtggaggcagagacggaagacgcggacaattcgacaactgagacaaaggaaacggacaattcgacttcggtggaggcagagacggaagatgcggacaattcgacaactgagacaaaggaaacggacaattcgactttggtggaggcagagacggaagacgcggacaattcgacaactgagacaaaggaaacggacaattcgactttggtggaggcagagacggaagacgcggattattcgacaactgagacaaaggaaacggacaattccactacagtaaaggcagagacggaagaagcagaaagttcgtctactgtacca

SEQ ID NO: 76001 - DNA, 2165 bp, Heterodera glycines; identical to SEQ ID NO: 12391
  Genomic contig location: Contig_ID=SeqID_12391; Location=1..2165; Strand=+
  SCN-specific regions: Sequence locations=1-89,111-156,178-206,228 -673,698-1932,1954-2019,2041-2133,2155-2165
  Gene Ontology: Mol. function=helicase activity; Biological process =growth

SEQ ID NO: 76002 - DNA, 436 bp, Heterodera glycines
  Genomic contig location: Contig_ID=SeqID_12392; Location=327..762; Strand=-
  SCN-specific regions: Sequence locations=1-78,100-436
tttaatgtaccgttttgttttttcatttgtcttttcttcctcccttttgtgccgtcgttttgctctgttaaatgccctcccctccgccggcatttttccccgtccttttgctgctcctttcggtgttcggtccgtcccggcaccaatcgctcatcggcaccggcaatccgttgcccgacattggcattggcacgcccatcgccaccactccctccggcgcaatctctcttccgaccagttcgcccattagcaattcgtccgtccccccggcggtggttggggcgttgccgcccattcagctgaaaatcggccttctctttgtcaatggcagccaacggttgcgaatgcttttcggctttggccaatccgcgcccgccgtttctttggcactcgaaagggcgcgacaggaacacctcatcgacaacatcaacttcac

SEQ ID NO: 76003 - DNA, 2478 bp, Heterodera glycines
  Genomic contig location: Contig_ID=SeqID_12394; Location=291..2768; Strand=+
  SCN-specific regions: Sequence locations=1-45,67-195,217-434,457 -570,659-676,734-802,824-852,879-956,980-1022,1045-1057,1080 -1218,1241-1379,1407-2478
atgcaagtcacacttaaaggacataaggttaaagctatttatgataaaaatatttgtaatattgttacaatatcattggaaggatgttattcctgtactagtggtgctaattggactctatcatgcaaaacaaattttggtaccgcattagccaatgtggaatgtccaagtcaaaaggtccgagtgaattgtgataaagaaggaaaagaacaacaaatccaactcgcatataataagaaaaatattacagaaaattgtgaagttatatgtcccgatggtaagactgaaattattagctaatctggaatacatacaccaacaagatacaaaaatcattcccactaacaatactaatgaaaaccccactattggaatttcatttgaccaagtaactgatatattaaattttatctattcccttattaaagccaattttttcaatatatttattattatcatattcatactcattatgattttcctaattccatgtctactacctattctatatagaattatgtgtcgttgccttcctctttcgcgcgggagtgtcgcgacaacgcgaaatcctaagataaaacccaaaataaaaaagaggaaaaataaaaaacaatagaaaataaaatggggaaaaataaaacataaataataaaaaatatttttacatttattttggaaaaataatattataaaaaactatcgaaaatataattacataaaaataaaaaaaaaaccttttgaaatgaataacggaaaattgtttgaaaaggaaaagtgcatttcctcaggaatgaaaggaacgaaaattaattaatattaaattgcgaattctgttaaggattgttcgtaaacaaattattaataattaatatattaaagaaattggaattgtaaagggaaaacggaaaagcaaacaattaatgggaaaatggcaaatccaaacggataacacacaaaaacatattttaattaaaatgagaaattgtagcgtactttggtgcaaaaaaatcgtatttaaaggggtggacttttccggaaatttcagattcgagacaaacggttccctccgaagtttcccggcacccgcccaccgcctttcactgcacccggccttcgctgctctctgtctgtgcgagtgccctccctgtccgcgcctactcgagtgccctccctttcctttgccattgtgtggccccttttggaccagccgttgcccgaatgcccttccttttcccatcgccgttctgaccccttttgattttgccacatttttccatttgtgatttatttactgtcaccgtttttgtgcccccttttccccgttcacattatcatgtttgtcccccatttttcgtttccctcaccgtcccgattgggacggtttaattacccaagtttgaggtcgacacaataaacatactcttattaaaattgtgcccaacttggtctatttgcctggacgaaaaccggcacgactcatcgctctccgatcggtcccgaccccctacattcccccgaacggctactctgcgcgcctcgcccatttcatccccttcccgtccccttcaccccgcagagttcgacgcaaatttcttgtcgccacgacattttttgcctatcaaatattcgcaataaatgcccatctatttaaaaaatattctattctattaaaatgttctgtattttgctatatattaagaatagccgtacatctaaaggagtcagtaattgaacaaatttctcaaatttcaagaaaggttcaggcagtcgccgtaaaaattgtctatataaaaacaatggcgatacgcatttctgcactaggtcctttttcaaaattgatgtgcttttattgaaaaacatgtttaacgggccacaaattaatagacaaattcaggcacattcttaaaaaattctgcttttaattagttcatttaatagattatgcttttgctttgtttttttaaattctacgcccgcgattatctgataggacaatgatatcaataaattttcttctgaagaagcgaagagttagcccaaatgttttccttcctttctatttaatgatctatcatttcagatataacagtcaaaatttaatcggccggctaaaaatgaattcggtaggattttatgaaaatagtttgaaaaaattgaaaatttctttcaaagatttaatggaagctagtagaaggatacctttttgagtaatattcgagatgttgccaattgtttaatggcaccccatacctcaaaaaagcattattctttggctaaaaaatatcattagaaaatagcgggcgtagatactgaaaaaactgttcttataattttaaacaattagaaacgccaaaggttacaattatagtaaatgccaaataggttgtaagaataggctcatttgctacaatttagaacagaatgtaatcggcaagaaagggtttttaaactaatttcaatgaaagaacttcataacaa

SEQ ID NO: 76004 - DNA, 181 bp, Heterodera glycines
  Genomic contig location: Contig_ID=SeqID_12394; Location=1243..1423; Strand=-
  SCN-specific regions: Sequence locations=1-54,77-89,112-154,178-181
gcacagacagagagcagcgaaggccgggtgcagtgaaaggcggtgggcgggtgccgggaaacttcggagggaaccgtttgtctcgaatctgaaatttccggaaaagtccacccctttaaatacgatttttttgcaccaaagtacgctacaatttctcattttaattaaaatatgtttttgt

SEQ ID NO: 76005 - DNA, 484 bp, Heterodera glycines
  Genomic contig location: Contig_ID=SeqID_12394; Location=2947..3430; Strand=+
  SCN-specific regions: Sequence locations=1-232,259-484
attttttgcctatcaaatattcgcaataaatgcccatctatttaaaaaatattctattctattaaaatgttctgtattttgctatatattaagaatagccgtacatctaaaggcgtcagtaattgaacaaatttctcaaatttcaagaaaggttcaggcagtcgccgtagaaattgtctatataaaaacaatggcgatacgcatttctgcactaggtcctttttcaaaattgatgtgcttttattgaaaaaacatgtttaacgggccacaaattaatagacaaattccggcacattcttaaaaaattctgcttttaattagttcatttaatagattatgcttttgctttgtttttttaaattctacgcccgcgattatctgataggacaatgatatcaataaattttcttctgaagaagcgaagagttagcccaaacgttttccttcctttctatttaatgatctatcatttcagatataacag

SEQ ID NO: 76006 - DNA, 540 bp, Heterodera glycines
  Genomic contig location: Contig_ID=SeqID_12397; Location=465..1004; Strand=+
  SCN-specific regions: Sequence locations=1-201,293-490,513-540
atggcaaacaatcggcggctaatgaaaagggaaaagcgccctctggcgaaagtaagccaaatccggggcagaagccgagcggagaacggcgaaagagggacgttttggggcacgccggcggatacgtcggaggatgggaccatcccattgactcgacactgtaagagcataaatttaataaaaatggcatattcaaaaatgaaaaatacattttaaattaaataattattattaatttgagttattatttttaaaaagtttacaaattaaaatatttcttttgaatttaattgtcctttattttagtgattgggcaaagagtcagtggaatgatgccaattggctcgccgatgttgtcaacagaaacggatgggaaaacaccggcactccaaccggcggacgatgaatcagtgaattgtgccgaccaaagaacgaaagacggcatttttgcttgggaatttaattgactttttggaatcaaacacactttcctgtttaaattttagatagttttgcggttaagcattaacggcaaaagca

SEQ ID NO: 76007 - DNA, 664 bp, Heterodera glycines
  Genomic contig location: Contig_ID=SeqID_12397; Location=1850..2513; Strand=+
  SCN-specific regions: Sequence locations=1-7,51-106,129-551,573-664
atgtacccattgaaaatatttgcaaaaattacaaagaaaaaggaaagcactgacaatgagaaaagtttgggcattttccttttgtgtgatgctccaaaagaaggtgcacaataaatgttcatcaaaagtaatcaagaactaattgcaattaatcgaaaattggaattgcaaatgttcggcaatcattcgaattgtctcgcaaataaacataatggaagattattggggagaattcagcgaagaagaacttttagcagcaaatcgaactccggctggggatattccaatttcatttcattttcagtgagtaattaatatgaattaactgattaatttgaaatgagcagaaaattggtaaaagcaagtcaaaatttcaaatgcatatttgatgactgccgtaaaatattaagtttatttttaagagaacattttttgaatttattatttttcaataacttaaaatgttattttgttttattcatttttcattttctgtgttttttcagttccatccgaagttttatcagaagatgaagtgcacgctgtttatcagttcaaatctcttccaaattttcttgggatttccgacggacttttcccaatcccatttccgaccaatgaaagatatatggaaaaggacagagttttgctgtacattgaaaaa

SEQ ID NO: 76008 - DNA, 1346 bp, Heterodera glycines
  Genomic contig location: Contig_ID=SeqID_12398; Location=256..1601; Strand=+
  SCN-specific regions: Sequence locations=1-50,73-87,111-304,345 -440,462-977,1007-1088,1110-1346
cagcacaccgcgccgcacaacacattgatttggccacggtccgtcgccgacaaaagcagcaacaaaaacaagttggaggaggacaacatgacgatgatgacgacgacgagcatgaacatgaacagcagcaacccgttgctgaacaacaacaatggttgcgacaacgtcagcaacaactgttgttggccaacaccgagtcgtccagtcaggaggcggcggatgaagctgatcagagctgttgctcatcatccatcgcctcgtccagctccgttacatgccgtgaggaagtgtcgggtaaattttattttcgaaatttatgggggaaaaaatttgggaaatttttctccaagaagcggcttgaaaagcaaaaaaaaaaacgttgatttatatggaccggacgcacttaattaaaaagccttagcgacatcacttattagggtattaattaccattaattaattcttacccgcactcgtttagattttaattgccattaattaattccctgccgagtgttaattagcattaattaattcctacccgcactcatttagcttctaactgccattaattaattccttcccgattgaatattaattagcattaattaattcctacccgcactcatctagctttaattaccattaattattcctagtccgcactcattaccattaattaatttcagccgacaacaatttggtgacagccgtttcatcttccactgttgctgctgctgatcatttttgtcactctcaacaacaaatgccaaattcgtctgttgccgaattagcggcttctgctgacccattggcatcgtcggcattggcacataaaccggcttctgccgttgttgctgttgatgaacatgactacactaccatggacaaggtcagctgttcgtccgactcattctcccacttgccggtgccgcaacattgtgagtttttttttattggcattagtagttaattaacttttttggcattatttaaaaatattttgggaattctacttttttctgtttagacaatttaaattttgtcattaattaattaatagtttcttggatttaaagttaattaatcttttttgtaaacagtggcaattaatataatcaatcataaccactaattaacattcttttactaatttttaggaatttatttttaagggaatttatatttagttttcttttaaatttaattatccattttctgctttctccaggggatcgtcaacattcgtcaattggaattggcggctgctgccaagaggaaatttgttcctgtgccagcgacagtggggacagttgctactcatcaatggtcggtcattaaatttga

SEQ ID NO: 76009 - DNA, 62 bp, Heterodera glycines
  Genomic contig location: Contig_ID=SeqID_12402; Location=1366..1427; Strand=+
  SCN-specific regions: Sequence locations=1-62
atgagcaaagagcagcagatgtgctcacacttacatttaacatggtcaatagcaaatacaat

SEQ ID NO: 76010 - DNA, 1723 bp, Heterodera glycines
  Genomic contig location: Contig_ID=SeqID_12403; Location=164..1886; Strand=+
  SCN-specific regions: Sequence locations=1-82,104-229,251-494,517 -712,734-921,944-1024,1049-1073,1100-1337,1359-1477,1499-1723
  Gene Ontology: Mol. function=extracellular matrix structural constituent; Cellular component=extracellular space; Biological process=cell adhesion
atttttacagcaattggggtgagaatgaatatgaaaattaaaaaaaagtgaaattgcaaaaaaaaaataaaaaaaacacccgccccccttaattacaaaatttggcagaacaatgccgaaacgcgtcgcctgattcggcatcagatgagcacactgtgcaaggaagacactttctgtgcatcggtgaaattttagaaatggaaactttcaaatgattttaaatttcaaattgattttaaattaatgccaatgctttctcatttctcagtgcattttgccgtgtcgcgaatcgctgtacgaattcgacgtgtgttcccacactttgtgcagggtaaaacaaacatacccgacaattcactttgcttttccacttttgaggacactcccgacccaacgcattgtcgagagtcttgcgttttcatggaacaaattgcggccaaaaaggcgggccattgcccaccacaaaaaccgtcggtccccgtttcagtaaggcaatttggcaaattttttattaatttttggcacatttcgaaggaatgttcggcattttgtgacgtggacagcgattgtgccgaagtgctttctgcgaattgctcctcaaattgctccgaattcaggtggaaaaatgctgcgtggtcggctgcagtcgcttttgtctgtccccgtccctcaacgactcgcgccttctcccgcgccccgagggcataaccgtacacgagaggaagaggaaacggtaatgacattaccgtaataccagggagaagggcccttgttggacaacaccgtattgtgaaactacagaaggacaaacactcattttttcaatttaagctcggccattttgcgatgggttatgaagcgattgtcgccacaacacaccgccacaaattcgaactgtatttgccaaaatgaaaattgctcaatttgcttttttaagtgtttgtcatccaatggcgttggtccgtccacaaacaatcggacacaatggcaccttggcaaaccgtgggcatttttgaaattactaataaaaaataagaagaaattcttcaattctaaaaggcagcacttcacccattatttttttaaattttaattatttcttcttttttcagattatggtgcgcaacaaaatgtacgccattcttaagcatttgctttcgcccggccgcttttacattttccgagtggcggcagtgaatttgcacgggacatgtgagaaaagggcgaatgaatggggtgaaatatcggcgaatgtccgttcagacggattttcggagccaagtcgcccgcccttcaaattgagcaaagaagcgaaggcaccgccggtggggggaaagattaaaaattcacataaaaatggagaggaattgaaaatattcttaaaaagaactaaaatcattttatattaaactttttcctttggtttagaagctttaaaacacataaaatacattaagaaatgggcaaaatgttaggccgtgggtgggaatcgaaccaaacgtgcccacccaaaccgtggggagctttgccattgagctaccaagacacatccgcccggcttttattaatcccaattttccgcattttaacctctcattagccatcttcttctttacagtgtcaatgcttttccgtttaggcaccactcaatttgacttttgtttacgaccctttttcaccaacgccaaaaattgttggaatgcgccaatttcggaaattcctc

SEQ ID NO: 76011 - DNA, 2176 bp, Heterodera glycines
  misc_feature (2160)..(2160): n is a, c, g, or t
  misc_feature (2166)..(2166): n is a, c, g, or t
  Genomic contig location: Contig_ID=SeqID_12404; Location=1..2176; Strand=-
  SCN-specific regions: Sequence locations=1-144,169-505,528-727,797 -805,836-851,873-873,926-1220,1242-1253,1276-1473,1495-1747,1769 -1804,1826-1869,1893-1939,1961-2176
  Gene Ontology: Biological process=positive regulation of growth rate
tggtgttcgccgtgtacgggtgcagtcagttgcgcgaggggttggagccggtcaacctgctggtcaaagactcgtatgccatcccccactaccgggcgctagagaactatttttggcactacggcgccaccgttcaggttcatgtttgatataaaagcatttttaaaagtaacataacaaaaagaagattgtcgaattcgactttgcggcctcccctcaaaaatttggtttacaaaaacaaaaaaaaccaagaaacccccccccccccttttttcatgtgtcaagaatttatttttgggagagcaccatttcccgtctgggtgggctctttttaagatattcctttaagattgttttaaaatatatcagtctctacaataatcacaccttttttgtttgtttttcgttgtctgtttttttatgcttttaaaatggcaaattaaacaaaaaaaaaatcaaaatttttccatttttttcttcgaacagtgtacgtaattttgtaggaatggatttaattaaccaaaaattagataaaatcgaactattttcgaatatattaacagcattttgattttgatttgattttttttataagtgtgttttatacaaattttattctttcgttttagtttttatccattaaaaggtgtaactagttgttccaacctaagccttaaaaatttctacttataaagtattttgttattggcttcattgtgtccagctgtagctcagttggtagagcggaggactgtagttgttcaattgacatccttaggtcgatggttcaaatccgtccagctggaattcttttttcccattttaaattggaaatttttgctttaattcgccaatttattttgtttcattttgttttataattttcaaaatttttttaaaaatatttttgaagttattattttttgcagattgttgtgaacaatccacccaacttgggcgacccggacgaacggcaaaagattcgctcgatggtccacgcatttgccaacactcggcacaccatcggggacgagtcggtccagttttggatggacgaaatggagcactattacatggaccaccggatgggcattggtattccggtgcacaatgtgaccagtgcaaagcacttctacgggttgacacaggttttgtttttcagacatatttattaccaattttgtacaacaatttatgcttcttttttgtcatttttagtgaaagatttttgaaagcattttctgggggttttagccgtcccttaatttttgccacttttttatttccccgtcaaatttagaactaaaatccctccatattcaagcataaactattttttgggttttcgtaatgtcgcaaaatcattgtaacgggctgcctcacgatttttattgtttcgcccttcaaaaaagccgctttttcgatggacacgtgacatacatgcacaagaggtgtctcgacacacccctcccccctcggcacagcggaccgcctgccacccccttccccaaaattgtcactgtcccactcgtccgtcgtatggcccttgggttaagtaagacaccccgtgtatgactcgtagcgcaactttacaacatttacagaaaaaaaatgattttgtttttttttagcattttctctccgcacggcgcaacgacttttggcccgaggatgtgaaatgggaatggcaaccgaacaaaggcttttcacgcatcaaagcatttcggtgagtgggcgagaaagcaattattaaattaagtaaaaattgaaaaaaaatccctttcgctcaacaatcactaatctccaacaaaaaataactaaaattctccccgatttataaaaaaaatgttgcaaatcatctccgcgccattttgaaaaaataaagaaaatttgattcgcattgtcgtcatttctttgcgctgtgccgtcccgtgccattccattttgtgccgtgccgctgcgtccggtctacccgtagagccgaaccagtctgtgcggtgtcgtgccgtcccaattggtgccaacaataagactgggctcagccctcgggtggaccgtgcgtttgcgtgaaaggcgccattttgggacgtgaaaattaattcatgccctcctcctttcgctctcccatctcaaagcgaaattttgctttattgactcctnattcantattataaaa

SEQ ID NO: 76012 - DNA, 2069 bp, Heterodera glycines
  Genomic contig location: Contig_ID=SeqID_12405; Location=1..2069; Strand=-
  SCN-specific regions: Sequence locations=1-306,328-771,794-1299,1325 -1542,1564-1671,1693-1705,1727-1735,1772-1947,1973-2009,2031-2069
  Gene Ontology: Mol. function=sterol transporter activity; Cellular component=integral to membrane; Biological process=positive regulation of growth rate
attcgcacctacaaaagcccatacatcagcttcacctatctttactcacaggtttttttatttttatggaataacaatagggtgcaaaaaaaatcgaaattttaaaaaatcaaatcaaaaaacagagccaaaaagccagtttttgatatatttttaaaggatagccaacgcctgagtgaaacaaaaaaattttcccctaaaagcattgtaaaatccgaaatttttatacaattgggtgcaaattgtagacagttaattgtaagcaaccaattacttttggcaatagtccaataaaaaaaattacggttggctttggtttttgcgctaaattgattactgtatgtattttttttcatacccgcctaccctttttttttgtcagacattggccgaagagttgaaacgcaacgcggacacgctggtgccccgttttgtgttcgcctttttcatcctcatcatgttctcggtaagcgatgttttttttcaaatttcagcggactaaatttaaactatggcaattatttttggtgacaattccacatgcttaaaggaataactcaatttgagcacccaataatttttaatttgtccaatatatattttttatgtatttggttcaagaaacaatttttaatatttttttttgtctcaattttgataaacacaacgcaaatgttttggtttgaccatgtcgataattggcacgatgtgcaaaatattttgaaattggcgaaatctttgctacgaaaattggttcaaagcccaacttttcacagtttttcaaatttttcattgcctttatcctataatttgcaggtgttgtgcaacatgtccacctgtcgtgcccgcaactgttacattgactggacactgtccaagccggtgctggccattttgggtgtggccaacgcggcatgggcattgtgacggccatcggactgctgaacatgtgctcggtgccctacaacgacattgtcggcgtgatgcccttcctggttgttggtgagtgtttttgtgccgagcccgtaaaaattggtgtgtggggcaagagcgcgctgaaggcattttttacaattactattctcatagcataaattaacggaacggtaaaggtcctcccctcccaattttgcgtataaattacataatgtgaaagcgatgcttaactcctatttgtgcgagttcctttggcgcgaggattgcaaaagacgcaatgtggacccttttgaagaaattttgcttcagattgttgcatttatggccccaaaatagggcgcatactaaaatgccttcagcgcgccctttgttgacattttttaaaattttgaggtgtaggcacaaaaccgaaaagtaccgatggagcagcttttttgaatttttcgcaaattttaccaaaaaaacgctgaaattttttttcaaaatatggtctgccaaagtgacgacctatatttactgtccgagaaaatggaccaaaaaggcaccgtcgtccaaaaattaaaactgaatttaaaaaaatataacccacaatttcgtttcaactgttttccctcaaatgaagaaaaatttttttggctaaaatgcccacatttgccattttaaatggcattgtatacatttaaattataaataagggatttgagtttcaacggacctgaaatgagccttcagggataaatgtttctgttaattccattgaaattgcaacctttttgttgtttgattgtttattgggtgcaaaataattttaattttaaaattcaaaaataatttagctgtcggtgtggacaacatgttcctgatgattgcggctgttcgacggacaaatcgggcctcgcccgtctgtcgacggatgggcgaagcgatggcggacgcggcaatttcggtgggtacacttcccctctccacgttcggagcaggacaaaactccgtctgcgaaactccgccaagaaaaaattataaaaaaatttttaaacagaagggaaagaggtgactaattactattaaaactctaattatttcctttgggggagcgaatcgttatttttttttttcgtttagctttctaagaa

SEQ ID NO: 76013 - DNA, 4842 bp, Heterodera glycines
  Genomic contig location: Contig_ID=SeqID_12407; Location=486..5327; Strand=-
  SCN-specific regions: Sequence locations=1-426,448-825,847-1681,1703 -1993,2015-2203,2225-3519,3541-3608,3630-3952,3974-4543,4565 -4576,4619-4842
atggccatccacagcactaatgtagaacaaatgccaaccatcaatgaggttgagcatttcttcaacctcgaatccttggggatccaggatgatcctgcccaggatgacgaccaaacagctctgaagctgtttaacaaatccatccgtcaggaagctgacggaagatactccgtcaaatggccgtggaaggagtccaatccggacctctcttccaatttcaaaatggcccacagcaggctgtcatcggtgctaaccaaactccgacattctccagaaattctggagaagtacgatgccaccatctgcgatcaactgcaacagggcatcagcgaggaggcccaaagggctcctggacagcttgagcacttcctccttcaccatggagtgctcaccaaaaagctacgcgtcgtttatgacgcgagtgcacacacacgcggaacaccaagcctcaacagctgcctcttccgaggcccattgcttctgccagatttggcaggcatgcttcttcggttccgttgcccgacttttccacttctcgcggacattcaagccgcatttctccaaatttcattggagccggaagaccgggaggtcacgaagttcctctggctaaaggacacttcaaagggactgactcccgacaacttggcaatatttcgattttgccgagttgcgttcggggtcgtcagctcgccattcattttggcggcgacactccgccatcacttgcaacagttcgactccccactgtccagggagatttcggagtccatttatgtggacaatgtactcctcgagtgcgagacggtacaggaggccttggaaaaatacaaattttccaaggacatcctccaacaaggatgcttcaacctgagggagttcatctctaactcaaaagaggtgatgaaacaaatccctcaggaggatcagcttgataagccgaaggccaaagtccttggccttccttgggacaccgagaaagacgaaattgtcttcaaattcccaacacctgatccattgaggccagtcacacgaagactggtcctcagccatctagcatcgctcttcgaccctttgggggtccttgggccatgcattttgccagccaaacgactcttccaagaactttggaaggagggccactcttgggatgatgccctctcagaagaggactcaatccgctggaattctatccaaagacaatggaaagacgaggaaatcagagttcctcgccgagcaatgctcaatgacacacagtcaattgagctccacgcttttgtggacgcatcggtccacacattcgcgaccgcgatatacgtacgctgcgccatgaacgacaaggttcaagcgtggctgattttctccaaaaatcgtttgaagccaaagagtgcctcaaaggcactcacgatacccaggatggagcttttggccatcctggtggggaccagagcactcaaatttgctcaaaggcagttgcgccgtccaattgccagccttcatctttggagcgattcacaaatcgctctgtcatgggtcaaaacccatgaaactcaaccacaatttgttgagcgaaggctgaaagaaatccaagaatgtctcggatgtacctttcatttcgtccgtactggggacaacccagcggacctcgcaacacgcggagcaactccttcggagctccgcaaccatcatctttggtggaaagggccaccttggctcgcacaagcgagtcaccattggcccagcgaactctgttttcaagtaacagagtcggatcaacagccagactcaacagagaatgttggcccgagtggtgcgtttctcgcacatactcactcaaaccagccaaatgagcaggtcttaattgacccctcacgcttcagctcatggaaacgccttatgcgaacaacaatgttcgtattaagattcctcgccttaatgttcaaaagaggcgaagaaccgattgcttcactcgtgaagcacagaaaggaaattcgccagatttccaagtctggggacttcaaggcggaagacttcgcactcgcggagcgagttctcatccgcctagaccagatggatgacgctgaagaattccagcactttaaaacagtgactggagacgacggaattctccgtctgagaaccagactggagatgagtgagaagccgtacagcttctctcatcccattcttcttgccaagcattcagctttggcaaagctgatcatcttggatcggcaccaaaaaaggcatcaccttggagtggacactactctgacagaattcctgagcgaattctggatgccaagtgcacgtttaaatgttaaacgagctcttcgggactgtcttctctgtcgccgaatgaatgcacaacaatttgcattaccaaccatgccacccttgccgggtgagcgagtgcgccgacacgcgccatttcagtccattggaattgactatctcgggccaacgacaatctcgttggccggagaaaaaataaaggcatggatcctcatcataacatgcctcgccacgcgcgctgtctaccttgaggcaacattggacctcacatcggaatcattcatcaatgttctccgtcgattcataagtcgacggggaaaacccgacatcatttggagcgacaacgctacgacattcaagctcgctcagaaaaccctggagcttctcagtgctccggggccggatcaggaagtacaaaacttcctgacccataatcgaatccagtggcgattcattgcccaaataagtccttgggcaggaggcttttacgagcgcctcgtgaagctagtcaaggactgcttcaagcgaactttgggccgaaggattctttccttcgaccaactcaacacattcgtggccgaagtggaggccaccctcaattacagaccgattactgcggtctcagacgcagtggatggaccagttccactgcgtcccatcaatctcttacaaccagagattcagatcaattgggaaaccgcaacagacccaattgattcagaggaacagatttcctccacacacgaacgtctagcttcccgaatacaagcacttcgggaagccaacgacgttttctgggccaaatggcactctgagtatttaacattactcagagaaagagcccagtgggaccacaaaggcccacgactccaaaacttcggtgaaccgaagaaagggatggtggtcctaatctctcaggacctcgttcctcgcaatcaatggccaatgggacgaatcgttgaaacacacggacggcctggagccatccgaagtgttaaagttgaaatccctgtccgagggaccaacaacaggaaaccaaaggacatgccacgaaagacagtccttactcgtccagtgaaccgcatcttccctttggaagcgggtcctgaaatgacggacccaggaactgaagctgttgctgcaactgaacagccaaatgaaaaccatcccaagctcgctcgagagccgggacatcaaatggtcaccagaagaaaggccaaactactggaaatgcttccagtagtggccatgatcattctcacacttgctcttccctatgcaagtggtttcccaattgggaaatgtgatgagtgtggcctcacttgttacacgaaaggaatcgtcgtaacagtgccacccgaaatccaaaagttcgaaatatgctgtgcagaaagctgcatagttcggcaaggcatcaaagccttgaacttcgaactaccaatcgaagtcctactcaacaatcatcactgtgaggccagattttggactgactcacagcacaccttcacatcaaacacgacctgcccggcagtcgatgaatgtgatctcatcgactgctatttttgtttcacacaacttgtgaatccaacatgccagcctgtcattgcggcaatgctggcaggaggcctgtccctaagtctcttgtgcttcatcttcaccatgtgttccatggtgggatacgccatggcaggactgagaatccttttttggattttctcagtcttgttcgcgcgcttattcaagccgcgaaaagagacatgggtattgagtgaggaggaggaaaacctcctctatcctcaccgacgaatacgccggcccaggccagcaacaagaaactgggccagtggccgagttagccaaatggcaatgcttgtcatggcatctctcccgtttgtacacgggggaattgagacagtggccataatggccaaatcagagagctgtctcaacaacggcacaactaaaatgtgtcaagtcaagggaagcgtgactcttgcgcttctcccggcaggacaaccgaatgtcctgtcaataaagaccgatgatggtctcattttgggaacccttcaagtgatcttgaaaggactctccctcgaatgccaagccttcaccaaggcatggaaacgatcacgagatcgcttccatagccagcaaacgatgtccgtctgctggctcatgtttcggagacttttgtacaaaagtccgaccctccacagccatccgagagctgagggagacagaaatgttccccgggaacagtttctgcatcgacagcacggctttttggggaaaccaatgtctcctcgccgccagttcttgtctcttctacaagtggtttgccaaaccacgctcatcagccatttacgaagtcattggatgcaactcttgggagtttggcatccatattcaacttcgcctcgactctaccactggaagaagtgccacagtcgaaactgtgcttcttccaggtcgtgtgctcaaatggcacaacatcagcatttcaacaataggggtcagccaagcaccggcccccctattgaacgctga

SEQ ID NO: 76014 - DNA, 533 bp, Heterodera glycines
  Genomic contig location: Contig_ID=SeqID_12407; Location=4353..4885; Strand=+
  SCN-specific regions: Sequence locations=1-129,151-533
ggtgtcccaaggaaggccaaggactttggccttcggcttatcaagctgatcctcctgagggatttgtttcatcacctcttttgagttagagatgaactccctcaggttgaagcatccttgttggaggatgtccttggaaaatttgtatttttccaaggcctcctgtaccgtctcgcactcgaggagtacattgtccacataaatggactccgaaatctccctggacagtggggagtcgaactgttgcaagtgatggcggagtgtcgccgccaaaatgaatggcgagctgacgaccccgaacgcaactcggcaaaatcgaaatattgccaagttgtcgggagtcagtccctttgaagtgtcctttagccagaggaacttcgtgacctcccggtcttccggctccaatgaaatttggagaaatgcggcttgaatgtccgcgagaagtggaaaagtcgggcaacggaaccgaagaagcatgcctgccaaatctggcagaagcaatgggcctcggaagaggcagctgttgaggcttg

SEQ ID NO: 76015 - DNA, 2061 bp, Heterodera glycines
  Genomic contig location: Contig_ID=SeqID_1796; Location=716..2776; Strand=-
  SCN-specific regions: Sequence locations=1-169,191-249,272-448,472 -764,786-863,885-970,992-1101,1137-1446,1469-1761,1783-2061
tctcctacacggggcaataatctattagatttattatttacaaacaatgaaaatctgttgaataatgttaaagttggacctccattcgggaatagtgatcataatgcaattcaattcagcataaatttacaggttaatagtgatgcctctaaaaaattttataacttcaaaaaagcaaattatttggaaataaatggcatactctcaatggttgattggaatttatttttttctgattgcccggacatagagcttatttaccaaaaatttatgtttttcctaaataatttgataaggaattatgttcccatacaaacaacgaaaaaagttgaaaaactaccagaacatattttgaaactaatcatctatcgtaaacagctttggaaggacattcacaaagaccatataaaaataaaattcttagaagtttcgaaaaaaatcgatgtagaaataaataaattttataaaaatcgcgaaaataagtttttgcggaccttggactctaaaaaacgtttccaatttataaattctttccttaagactaaaaatactatgatacctgcatttactgataaaaatagtctgattctcttctcagataaggaaaagtcgaatgcattagcgcaacaatttttttccgtttttacagatcaaaatctagaacaatttcaatgcatagaaaatcctgaaaaaaatatcgaatattttaacataactccatatgaaatttatttttctctttccaaactttcaaattctaacaacactagtattgatggaattcccaatatttttttaaaaattgtaaagaaaatttagtccgacctcttttccatatttttagtttctcattgatgactgccaaaattccagaaatatggaaaaagtcaattatttgccctgtcccaaaaattcaaaatccggtaaacccagtcgactttcgtccgatttccctgctatgttctgtttccaaaattttggaagaaaatatagcaggaaaaataaaaaattttgttgaaaaaaataatttgttaccaaattgtcaacatggttttcgtaaagcacattctgttactactcaacttcttgaagtggtggatgatttcagttttgctttagaaaatagaaaatcaattgatgtaatttattttgatttagctaaagcattcgacacggttccacataaccggctaatatctaagctccaaaacattggtataaataattccttattaaaatggattcagaattacttaaaaaaccgaaagtttttcgtcaaaatcgggtctgatttctctgatgaatatccctgtctcagtggtgtgccgcaaggctcaatattgggaccactgttatttcttatttacatttacgatttaccaaaattctgcgaaactgaaaatgttaaaattaaactatttgccgatgatcttaaggcctatcatgttctttcaaatatttccttttctccactccaaaattttattaacaaatttaatcgatactgtaaattaaacggccttaaaatcgcttcaaataaatgtttaactttacatttaggacacaaaaaccaaaaaataaattattttattgatgattttccaattactaaaaatcccggaaacgaaccagtcagagaccttggcatttattttactaatgatttgaaatgggcacaacatattgaaattatctcgaagaaagcattacgatctgcttttgctatattaaagtcaatcaaaactggtgatacgaaaatacttgtaaatttgtttaatatttattgcagaccaattttagaattcggatctccaattttcaatccttatttaaaaaaggatattgaaaaactggagaatgtccaaaaaacttttttgagagtaatatttagacgtaacaattatgctgctgatttacctaattatgctgaattgttaaacatttatgatcaaaagtcgcttgagagtcgtaggttaaaaatagacttaaaactttttcatgaaataattttaggtaaaataaatttacaaaataacgaatccttttcttttcccaaaaccc

SEQ ID NO: 76016 - DNA, 1314 bp, Heterodera glycines
  Genomic contig location: Contig_ID=SeqID_1796; Location=4453..5766; Strand=-
  SCN-specific regions: Sequence locations=1-42,130-280,348-509,561 -628,650-966,995-1314
atgacttcaattaacaccagttcaaatgacccggtaaaagtgattaattaatgaattaataattaatttaattttaattatttttaatgttaaaataaataagaaatttttattttgatttttataattcagctttatttggcctaccgttctatcggtccatccgccgatttgattgtgccggccgttgcgctgtatttggttgcattggttggcattgtgttaaacggcacagttttagtggtcactgccagatccaagtaaatgccatggcattttcttattttatttataatgatttaaatgataaattaaattaaactttccatttttaattaatttaatttcctatttttcagttccctccgcggctccgccaattttctgatggctttgatttgtctttgtgaattggtccaccaaattgggcacacttttttcctggttgttgtcatttcgggcacaaattttgtcagttttctcactgctgacttaattatgaaggtatattttgaaagttaaaaattatttaaatattccaatttttagccttcaatttttgctataaattgtggcttaatggcaatgctttgtgctgcagttgaccgactttttactgttatttcacctttaaagtgaggaaaattaacagtttttgacttaaaactttgaaaaagaaaatcattttcgatacgttagttataattgagaattattttaaacagaatgccaaaatttatttttattaatggacattttttctttctcaaaaatgccgattccaaggaacattctgtccataaatttatttatttttatgtttttagacatatggacattttattacagttcaaatatgtgtacctgttcagttatctgttaatttgcacaatttatggtgcatattcattgaattatgtgctcgcaaatgcatttgaaaatgcgggaaagtatggcgcaattagaattaaatatacttaattttcaaattttgtttcagtccaaccaccggaatggtggccgaatcttttcggggcaccgttgggtataaatccatcacccacacattcattatttcattgtgtagcacttgttgttacgtggcaatttttgtgctcatccgacgcagaaattttggcaatttttggcattatgaaaaaatttgaaagtatttttttacagtaaatcaacagacgaacgcacgagtgttacggtcattagtcatcattttgtccattaatattggcgggtatttgttaaatttggcaatatatcaatttattggtgcatttcgccatatgtttgtgtaataaa

SEQ ID NO: 76017 - DNA, 863 bp, Heterodera glycines
  Genomic contig location: Contig_ID=SeqID_12408; Location=3206..4068; Strand=-
  SCN-specific regions: Sequence locations=1-267,380-439,462-718,740-863
agtgccattgggcagtgtcccaaacggaaatcgccgtgtcacttggctgatcgcaatggcatggctgctagccattctctgcgctcttccgatgaccgtcttccgtggcactcggcccatcccccacacgccgttcgtccaatgctaccatcttcaagggttcaacgccagtcatatcattgtgtaagttcttctccattttggtttcccgttcagtgtctttttccttttggcacttttttctgggtcacttttccattgctggcactctcccccttacccccccctcctttctcgtcccttttgattccccctcccccctttgtcgctttttctttacatccccatcccctttgttatccctcctcctcatccccctttcttgtgccgcctatcccccattgatcccacccccccccctcattcgcccatgtgtgattttctctctcctttttcctcttatccaccttattgccgcttcagtttccacttcttccatgtgatcaccaccttctacatccctttgggtgtcattttgttctgctacgtctccatcggcttgtcccttcgccatcagggcgcttcgctgcgtcagtccaattgtttggccaacaccgaccagcacaaacggcttcagcaaaacacaaaattgcgctttctgaaggcaaccgccgccattgtgtgcactttcgtgctcagttggctgccttatcaggtgtttcccctcccccttcccaatgaatcaatcattcaatgcttctcaggtgatggcacttcttcgcgtggtctgtgagcccgagtcaaagtgcgaacagttggcctcaaatttcaattggcttcagtccattctgctggccaggtaa

SEQ ID NO: 76018 - DNA, 353 bp, Heterodera glycines
  Genomic contig location: Contig_ID=SeqID_12410; Location=558..910; Strand=-
  SCN-specific regions: Sequence locations=1-58,80-86,108-163,196 -198,239-278,300-353
accatggcaaaaaacatagcctgttcaatgatttataactttttttcagaagcaaatagattaaattttctttttagaatttcaagtactctatttattctatttatctttaaaatttcaaaaaatttcattgagtttcaaaaaagttctggacaaaaaattctgacttaaggttttgtggaatttaattaccatatctttttatatacttaagtaaaaaatttaataaaattatattctgatagaaaacacctagagctattgaatgataccaagaattattaatttggttgaaaatggaccaagttatgaatttatatgtcttacattttttgttttcctaccacatggcg

SEQ ID NO: 76019 - DNA, 409 bp, Heterodera glycines
  Genomic contig location: Contig_ID=SeqID_12411; Location=2113..2521; Strand=-
  SCN-specific regions: Sequence locations=1-409
atggtttggaaatgccatttggattcgaagagacaggcttttcctattcccagtgaacttcgcgattacatcgttaatgctctggtcgaaatgggcgttgaagtggccaaacactcgttcagactgactccgtcatcttttttggcaatttcgaattcgcttatttcagtttagtaatcacaataatcgaaggtttaagactaactcttccgtggataaagtgaatgtctatggaattgtccgttcctttcgtgccaacccggccgagtccattcttctcgctgtcccaatgcgttcttctaagattgaagcggttgctgttgccttagcttttgctgattatgctaaaagttgtgccatttcggctcgtagccaagggagagggacaaatgccctccctattctatga

SEQ ID NO: 76020 - DNA, 674 bp, Heterodera glycines
  Genomic contig location: Contig_ID=SeqID_12412; Location=688..1361; Strand=-
  SCN-specific regions: Sequence locations=1-239,267-591,613-674
atggggagtaagaatgggagaattccatccgaattgcttttcgaactcatttccaatcttccgtttgacattcgatgggccttcacccgggtttccaaggcctatgattgttttgtgtggcagaaacaaaattcatgggttagagctgagctaatccgcaagaatgctggaaggaaaaaagtaggctaattactaggaaaatatggccatttttggcataaaagtttttacaagtccaaggcagaaacaaaataaacaaatttttgtcaataaaaaaagaatttagaaaatcgaattggttcattgtatcaactcggttttggtctatgctcaaaacattagcgatgacgttataagggcaaatgaaggagaatgcaacgcccatattgaaagtaaatattttatgtttatcaatttttgcaattatatcttttttagatctgctttgtattcgtcgtcagttggctcgtctgtaccgcttgggcagaacgtcaccgattgacacgtcgcaggtaacaaagaaaaactgataaacttgaaatttggaatttgcttgcctgggttttccctacacatgtaaatgaatttatgtttatgttcctgatttcttttaattttctattccatgttatgttcagactgtatctgccgaagaagttaatgccgaagattga

SEQ ID NO: 76021 - DNA, 1184 bp, Heterodera glycines
  Genomic contig location: Contig_ID=SeqID_12413; Location=25..1208; Strand=-
  SCN-specific regions: Sequence locations=1-670,699-941,963-1184
atggaacaagagcaaaatccgggcgtgacaaatactgaggtttgattttcagtggtttcacattgcgcctcgtgttattcgggtcggagtcagttcggcgccgacagtcgccaaagtgtaaacttacatccaaaaattggcatgctttaaaatctatatgggctccacatttacctatgtgtcaaaacgaaacggttcatgaaggcataaattttggctgtcagcaaagaaaagaaattgttattagcggtgccgaaccgcctgtgccgtgtcattctttaatgagacaatgaaattattggcaacactaacatattttgtgttttaggcttcgtcaacatcggtcgctattctcgacccttctgctgtgaccgaatcagaccgttcgtcaccgttggtaccggagtccgctgctgtggccactgacgccgccactcattttgtagcccaaggcagtccccaagcgtcggtaagtcagttttatcacaaaattctcatcttgtgctttgtaggctggttgtccccagggataatttaaattttaaaagttgggtgaggctagggagggaaaatattgccaatggaactaatttaacaacgaaataaaatgtctgtctggcagcacagatgggagtaaattactgttcttcctttgatattacccctaacgtttattaaaattcttttaaaaaatttttgtagcttccaacgcctccatacattgagaacaatgacgtgtggagaggacagttcatatggagggaacaaaaattcttcgactgtacgtgcacacctttgagtggtggtcctacagtgtcaaaagcgggtcgtgagatgatgacaaccgtgtcggaaggcgaacagagtggaagcggtgacggaggaggacgcatctttttgatcggactgacggactcgtgcgctgtttggaagtacgtggtggagctgagggacagctgggatgagaaggtgtgtatgatgatcatcaacaaacccgaaggtatgtaattaagcacttgttttcgttcctgcttttctctcaatccatttattgatgtcgttttacaaaaattgttttataggagggcaacttttggacaaatacagcgaatgtgttactttctgcgacaaggaaaaccaaattggtgtgctggactttgtcgaccacccgacaatcaaagacg

SEQ ID NO: 76022 - DNA, 49 bp, Heterodera glycines; identical to SEQ ID NO: 51273
  Genomic contig location: Contig_ID=SeqID_12414; Location=981..1029; Strand=-
  SCN-specific regions: Sequence locations=1-49

SEQ ID NO: 76023 - DNA, 961 bp, Heterodera glycines
  Genomic contig location: Contig_ID=SeqID_12416; Location=928..1888; Strand=+
  SCN-specific regions: Sequence locations=1-98,131-356,385-707,729 -891,960-961
atgattgacaatgaacaaaagccattggaacgcaaatttattcaacaattgatagacaaagtgcgaccattgtacggtaagtgaaggaaaaagtactgtaattttaaataaaaataaaatattaaaaaaagtagttgatacgaagaaggaccatctgcatttgtggtccaaattgcgcattttggggcatgacaagcagataaaagatgacatatccaccacggaactgttggtaaaaaatcttatgtaattgttagacactagcgggtgcgtgaaccgtcggctatttagctgggaaaaagcgcttcgcgctttgggagcttcgctacctagatttgatcgaattggttggagagatttttttgaatttttaaaaaattattaggggtttttagtccacatcgaggctcaagacgggcgcttcgcgcccgtttttaaatttgttggccttggacgggcgcttcgcgcccgttatttaaagtttgttggttcatacgggcgcttcgcgcccgttattcaaattttgttggccttacagagattagaagaggtacaacagtgattaaaagacgtcaaaagtgattaaaagaggtggtacatcagtgattagatgaggtacaactgtgagtaaaagaggtacaactgtgattagaagaggtacaatttgatcgtaaatatacacctaccctatcccgagttatgattttttgaaaattccttcaaattcccagtggccaaaaaagccggaaagtgattaaaagaggtacaaaagtgattagaagaggtacaagagtgattagaagaggtacaatggtgattagaagaggtacaatagtgattagaagaggtacaacagtgatttgaagaggtacatcagtgattagtaaattcattaaattaaaatgaaaatattttttaacaaatttaattaatttattaactcaaaaaatattttaaatga

SEQ ID NO: 76024 - DNA, 906 bp, Heterodera glycines
  Genomic contig location: Contig_ID=SeqID_12417; Location=156..1061; Strand=-
  SCN-specific regions: Sequence locations=1-154,187-377,399-619,649 -695,724-843,872-906
atggaggacaattctacacaaactgacattaacgactgccattccgaacattgttcgaaagaaaaaacccatatttccgaattgcataaaagtgtgcaaaagaaatttcatctcgagttggaacaaactgagaaaaaggtcgtaaaaatatgacttttaaattaaattatataaattaataattatgctttcttacaatttcaggacgtaattatcgaggagcagagcaaaaaattggaagaattgcaacagaaggcgcacaaagacgaagtcgcgaaggcagcgctcagacaggcagtcgccgaggaatgccaacaaaagtgtgactacgctgacaaacttggcaaagtggaagcagctcttgagaaagcaaataaaaacaacaaggaactgaaagatgatctcgacaaagtccgacgacagaaagccgagaatgatgcgcaaaacgcggctgaaattcgccgtttggaaagcgacctagaattggttcagcatgtcaccagcgccattcatcagcaacgttctcattcggtagtgcttggctattaatagggggggggggggtgttaatgagagaatttattttattattatacagtagcatacagtatttcaaatgataatttatgaatttaaaaataaaaaatagggggggggttaatgagagaacttattttattattatacagtaaacatacagtatttcagatgaattttatcaattacaaaataaaaaatcacaataatttttgaaaagaagcatttaatcgaagtttatttttttgaaatttaaggcaattggccacttttcgttcacgacttccaccaggaccatttcatcaccggaagaagaagaagaacaaaatgaaaaggcgctggacgaattggcaccaatcggagcaaaaa

SEQ ID NO: 76025 - DNA, 374 bp, Heterodera glycines
  Genomic contig location: Contig_ID=SeqID_12418; Location=387..760; Strand=+
  SCN-specific regions: Sequence locations=1-158,216-282,304-374
atgaaacgttcttcaagtggaaacgagtctgacagtgcgaccaaaaaaattaaatggtaaaaaattctttttttaaattgtttttccatgtaaaaatcctctacaggagcccaccggaaaaaataaacttcaatcactactggactgggtaagttatgttataataacttaataattattacttttttaaaaatttaatttttcaataattaattcatcttttaggaaggttacgtttgcgcagtactgggacgggtaaaaaatataatgttaatatgttacttacaatttttaaattcagaggctaccttcctcctgaccccgaatttgcgaattggtgagtcagaaatattaaaaaaaatgtaaacaatata

SEQ ID NO: 76026 - DNA, 156 bp, Heterodera glycines
  Genomic contig location: Contig_ID=SeqID_12419; Location=191..346; Strand=-
  SCN-specific regions: Sequence locations=1-72,97-156
atggaagacgacggtccagcggtgcgcacagaagtttcgacggtgacgaaagttgttgcaccaatgacgatggatgaagaagaagaggaagcagcggcagacgcagattttgttgaagataagcataagcaactcatattagctaaatttataatg

SEQ ID NO: 76027 - DNA, 586 bp, Heterodera glycines
  Genomic contig location: Contig_ID=SeqID_12420; Location=285..870; Strand=+
  SCN-specific regions: Sequence locations=1-35,58-586
cttcatctctgccgactgttggctcgaagtgtttgctttacttccgccttctcagcttggactcggaatcgctctgatcagtcgccgattttaccgccgcgtggacaaacatttcaaagcacgcaaatggatattggacaccgaattgcgaattcaagagaaagagctatggtttggcaggaagcaaatggaaattgtcaatgccaattggaagcgtttgccaatcccacaaaatccgttgcccaacaaagtcatcggatttaaacacattacgttcatgtaaaattgataagtttcccattggtttgagataactttttcttgttttagttacttcgaccacaatattctcacatttgtccgccgttttcaccgctttttcactttaattacaacatctttgggcattatgagtgaaaatgttcgcatttttgagttcttcctgtccaccatttggccaatttttggtgacttgatttttaaatttttgataaattttctagatttttttcctaaaattagaagaaaaaaaaattttcggcggcgggagacgttttgtggtgtacccgggacggacggtgccgaa

SEQ ID NO: 76028 - DNA, 1744 bp, Heterodera glycines
  Genomic contig location: Contig_ID=SeqID_1798; Location=58..1801; Strand=-
  SCN-specific regions: Sequence locations=1-317,339-585,614-948,971 -1228,1257-1315,1338-1411,1433-1565,1593-1613,1637-1744
  Gene Ontology: Mol. function=protein C (activated) activity; Cellular component=extrinsic to plasma membrane; Biological process=cell migration
gatctttctcctataattggccttattgtatgttgcctacttattgtgcttttttctcccattaagatcagccacggtaatccggtaaagtcaaacaacaaatggccatggttggtggcactgtttgcccgcgaggccggcatttgtggcgatgatggcaacaaattctgttgtacggcatcaatcattggaccgcagcatgtgctgaccgcggcacattgtttcatgtctttcaaaggcgaacagcgagaaaatatgcacgaaaaggttaatgaaaatcgaagggaaaatatttttatattccttattaggcccactaattaattaattttatatatgatttgccgaattgaacacaaaattgtagggctattgaatgttgtacctgagtagtctaaataaattcacttggagtagggttgttgctgggacgatagccaaaaactatcaaaatggcgttagtcaaaaaaatatcaaattgaaaatttttgacagaaaattcttcataacttctcccattttcatttgatgcttttttgactaacggccattttgattttagtccgactcactaactaattatatcaaaatgttttttaaattaaattttggaaatttaccgaaatttgcctactggtggtgggaggaagttaaaatttttaacggatttttaaaactggcattaaaaattgagcattttaaaaaagaggaggcaaatgacgccggaagagcgcaaatcgccacctttggctaagttccattttttactttttaaaattgagctctaggaagtctgatatttttctctgatcagatttttgtccgcctcggctcatacaatcacagctcaaaggaggcaattgagcccaatttagcgaaagtgattgtccattcggagtacgatgagctcacatttgtgaacgatttggccatcataaaagtcagcgacagagaaaaacaataatcagcagaaggctttatgttaattgacattagtccaaaaaaaactatatcatgaaggtttgtttagcccttcacataaaagaaggagcaccagatgtgggaccgaattacgcattttgcattccggcatttttatgacaatttcggaaaatgcaaattcttattttgcaggaatagtgttttaaaataaaaaatgcccataatgaaaaatacatattgaaaaaaacgaactcagcaaataaatgagaaatttagatactatttcaaaattattaatagatatttaaaaaattccgtaattctaccgtattccgtcaatttttgcgggcattgatagagggaggatgcttgcattttaattaatattattatttcaatgattttcaatttagttagctgaaccaattacttttatggaaaatgtggagccaatttgtttggccaattctacttctgaaaaagattttaattccaataataacttgcacattgttggctggggacatcaaaatggtaattaattactaaatgattcgcaattaaaaataattttctctttgataagctaattaggtataaaatcgcccaagcattaaaacagcaattaatattaaaatatatttaaatatggacactcagaatgctgaataaaagttggcatttgttttacagaagccgaatatgatgaagagggaaacgaattgtggcgagacccggatgttgagccggaaatgttgcgggaaggactcgcgcagaaacgcgatgaggacgaatgtgcaat

SEQ ID NO: 76029 - DNA, 632 bp, Heterodera glycines
  Genomic contig location: Contig_ID=SeqID_1800; Location=2123..2754; Strand=+
  SCN-specific regions: Sequence locations=1-549,580-632
tatagtcgtgccggaccactcatattctttccgcgccattccgatggaattcgtttataacgcacttcattacaatcacgttctgggtcgtcctccggaagaaaatgttcagcactgtttaaatcagctggttgtgcattttccgcccctgcaagcagagttgaatcagagaagtcggcaggcaaacgcacataatttgtgtaacgcacttctaaaaataaaacaaagaagagaaacaacaaaacaaactgcgctataaattacctgagagctctgtaaggtcggtatatggctttggaaaatgttttcggcatcgggttcgcccctgctcatcgacctctgtgcacgcagaattgcaatcatgcagcatcattgtagtaacataatgccatagccggcgctgctgatttgcttctattgacatgtcctccattggtggaagcggaggaattcttgcaaacacatattggtcaacactttcaggtgttaaaaccctctcccgttcttccaggataagaagcatatggatgtgtggcatgcctaaatttcaaatgctataaatattttctaaaaaattcaccacgcttttggtgttcaacgctatagcaccatcctgccacttttccaagcac

SEQ ID NO: 76030 - DNA, 2638 bp, Heterodera glycines
  Genomic contig location: Contig_ID=SeqID_1800; Location=1314..3951; Strand=-
  SCN-specific regions: Sequence locations=1-276,300-341,364-789,811 -1250,1281-2024,2046-2601,2624-2638
atggatgctgttcgtagccgtgctgactgtacggttatcgagcgtgcagatgctcccacagctaagcaagtggccgtaatatgggtgcaagaagacggccttgctccagaagttaatggtaaaacttgcactattgctttatgaattaagtttttaaggtttctggctgagtgacaaggcgggcaaaatgagggagttgaaaagcggaatgccacagctagacccctgttgcttcccactgcttcatccaaaaggcactgctgggtggcgttggttcatgaagaaggcatttttgcaagggcgcaatgtaggtttttttattaattactccaatccaactttttaattcttcctttgcctcttagataagtgctgatttaaattcaagtcaaaataatgcatcaaccgttaatgatgagtctgaacacattaacgatttcgagaccgaatttgacaacgagcctgaacctgagagtgcgcaggggcggcaagtggagaatgatgtacaaacttttttacatgttctttgattatagtacatattaaggtggtggttgctcaaaatgactctgtttttgaacctgtttttggtgtgcagacaaagaagcgagaacttggtatcaagaaaaccggttcagaggaaaatatttccgagaggcaattttaccgctatcgtttggcgttacgagaaaatagcaagggggcattccactggctatggtttgcccgtcgtttggccgaattcttcgtcattgctgttctcaaccgaattgagcgcaatgagatggaccatatcaaggcaattcagcagcgtaaaaattaccgccaaactcttgctcgagattacatcaaagccattgagcaaggactccagcagcagggacgcaatgccaaattgggaagcgtgtatttgatgccccagacctttgcgggatcaaggcagtactatcaacaaaaatatgctgatttgatgacaattgttcggagtttgggaaatccaacatggttaggtatataatgtgaaatatcggtcactctgttgcttttaggtttgtcacctttaccggaaacccaagctggccggaactcaaagaggccttgcaggggcgccaacaatatacgcatcgtgcggatattgtatgcagaatatttatggataaggctgctgaatttgtgcgcgacttggttgaaaagaatgtgcttggaaaagtggcaggatggtgctatagcgttgaacaccaaaagcgtggtgaattttttagaaaatatttatagcatttgaaatttaggcatgccacacatccatatgcttcttatcctggaagaacgggagagggttttaacacctgaaagtgttgaccaatatgtgtttgcaagaattcctccgcttccaccaatggaggacatgtcaatagaagcaaatcagcagcgccggctatggcattatgttactacaatgatgctgcatgattgcaattctgcgtgcacagaggtcgatgagcaggggcgaacccgatgccgaaaacattttccaaagccatataccgaccttacagagctctcaggtaatttatagcgcagtttgttttgttgtttctcttctttgttttatttttagaagtgcgttacacaaattatgtgcgtttgcctgccgacttctctgattcaactctgcttgcaggggcggaaaatgcacaaccagctgatttaaacagtgctgaacattttcttccggaggacgacccagaacgtgattgtaatgaagtgcgttataaacgaattccatcggaatggcgcggaaagaatatgagtggtccggcacgactatatgtaataatgtttatactttttttcaaatattataacttcaggagaagtgtggtctattctaccagaaaagaaacaaacgtggcaggggcgtcttacttcttgatgatagccgtgttataccctacaatccattcctacttttaaaatacggctgtcacattaatgtcgaatatgtatttggtcagaaggcgtgcaaatatatttttaaatatttgctaaaaggtatacctaaaagtcgggttttcgaacaatacgtgtgttgaatttaagggtttgagaaagcatacgtaaaggttatgcagccgcgcaggggcggtgcgtctacaaatgaagaagtctacgactatgacgaggttgcggcaacgttcaaagtccgttacatgacttcaatggaagcatatttacggctcaattcgtatcggattgtttccatgtctcatcaaatctatcagctttcaatacatgacgaattagggcaaacaatcgttattgaagaaggccatgaagagcaagggcgcagaaggattgcaaacaaaactcgtctaacagctttttttgcattgtgtgcgaaggaaccagctgtttccgaattaacttataatcgtgtgccctatttttattagtaagtacaattaaagcataaacttagtgtttgtatatttaagctggaaccagaaaaacagcgattggatcaaacgaaaacgtccgctgaaagagggtgcaggggcgcggatgttggtccgcgtcttcacggtttccccaaagcgtcatgaattatttgcaattaggttactataccagaaataaa

SEQ ID NO: 76031 - DNA, 305 bp, Heterodera glycines
  Genomic contig location: Contig_ID=SeqID_1800; Location=5797..6101; Strand=-
  SCN-specific regions: Sequence locations=1-3,28-155,257-305
atggaaaataatttggaaaatgggaaatgtgaattaacggtaaattcctgtttgtttagcatctggcgaaaacccccctaattttaacacagaaacattataatgtgaaagaaatataattttattatatgcacatattaagagaaaaattgccattccttgaatttattgaatggaataattgatttatattttttctcattataatgaataaattaattttatttctttttttttatattaattaatttattaagaaatttggaaatttatagattcaacattctaatgtaaagtcaaataaa

SEQ ID NO: 76032 - DNA, 71 bp, Heterodera glycines; identical to SEQ ID NO: 53617
  Genomic contig location: Contig_ID=SeqID_12422; Location=34..104; Strand=+

SEQ ID NO: 76033 - DNA, 71 bp, Heterodera glycines; identical to SEQ ID NO: 53617
  Genomic contig location: Contig_ID=SeqID_12422; Location=654..724; Strand=+

SEQ ID NO: 76034 - DNA, 71 bp, Heterodera glycines; identical to SEQ ID NO: 53617
  Genomic contig location: Contig_ID=SeqID_12422; Location=1275..1345; Strand=+

SEQ ID NO: 76035 - DNA, 759 bp, Heterodera glycines
  Genomic contig location: Contig_ID=SeqID_12423; Location=31..789; Strand=+
  SCN-specific regions: Sequence locations=1-20,42-134,188-365,387-759
atggcggttctccactgggcaagtctaaatgaaattacgacgaaaaaggctgctggacgcattgcttctgatgcggaccgacccgatgaagagtaaggaaattcttgaaaaaaacctaaacatttaaaatcaggaataaaaacaatatttaaaaattattaaaaagtatttaaataatattatttatcatttttggctttactccacatttccagtgatgttgagctcggtgctgcaccggacggaaacaaattttcggtggcacaaaaattctcgcggagcatttcgatgatcggcggcaccatccacaggcaggacaccgccacgggacgtgccaaaaagaaggcgatgggctcgccctcagaggcggccatgctcaattacgtaaaccaactgatcgacgtggaggagacgcgcgcaaacaacaacgtaaaatggccaaatcacacaaaatggcaaaggattggtacttttcagatcgttttcgaagtgccattcaactcgaagcgcaaatggcatttggtcattttggaacagtccgaggacaatgccgacggactgaagcagtacaaaatgttgatgaagggcgcctcggagattctgtcgcacatgtgctccacctttatggacgagcatggccaccaacagaagctgggcaacgtggagctgaagcagttcgaggacgcgtacactcacttcgcggaggggggacaccgcgtgatcggattctccaccaaaacattcagtgcaccacggtaa

SEQ ID NO: 76036 - DNA, 1727 bp, Heterodera glycines
  Genomic contig location: Contig_ID=SeqID_12424; Location=1..1727; Strand=+
  SCN-specific regions: Sequence locations=1-1,24-225,264-441,466 -562,584-627,654-754,776-1256,1278-1727
  Gene Ontology: Mol. function=sodium/potassium-exchanging ATPase activity; Cellular component=sodium/potassium-exchanging ATPase complex; Biological process=neurotransmitter uptake
aatatttacttacatactaactgtcaaataattaaaaaaggaagtttatctataataaacccctgctaattaatgcagaattttgccaaaagtgctgaagaagtcccaaactttcgcctcgcatcagcagttggcactttgcgtgcccaaattgatgatgaaaacgctgagctcggaattgccattgagcaaagcggaaaaggatttcgaggcatggcaaattcgaaaattaaataaataaataattgtaatttaataaatttgccaaggtcattcatggtgaacgaatttcgcgtctgagtccctccgaatgggacgaactgatcgaaaaggaatcggtcgtttttgcgcgcacgacgccggagcaaaagctgatgattgtggagcagtgccaacggcggggaaaactcatcgcaatgactgtacaaatttcaaatcgaaaaaatgaattttaaatgcattttagggggacggagtgaacgacgcacccgcgcttaaaagggcggacattggcatttcaatgggttcaggtgcaaaaacggcaccgccattttgacattgatttttgcatttttgtgcttttcataggcagtgaagtggctaagcaagcggctgacattgtgctggtggacgacaacttttcctccattgtccatgccgtggaggagggccgcgtgatgttcgagaacatcaagaagttgctggcctacacaatgccgcactctttccccgaagtttggcccgtgataatcaacttttgtttcggctttccccctggcattaccgctttgcaggtgcaacactttaacaaattgcataattagctggttaattggttgtccaatttgtgtgtccagattctctccattgacttgtgcaccgaaattctgcccggcgtttcgttgtcgcgcgaactcgccgaaggcgatgtgatggcacgcccgccacgggccatgaacaaagtgctcatctccaacactttgttggcttactgtaatttggtcatttgaattcggaacggttttgtcgtcctacttttactttagcatatgcctacacgggccaaattcaatcgttgggctgttttttggcctactgttgcgtgttctggtaccacggcatcgccatctccgacttgtggatgtccgccctgacaagttggaagccggacggagtggcatttgccaggtgttctaacaaatttagcgaacattcgaatttttggcaaaatgaatttcagcaatggcaaatcgttctccgtggagcagcagctgtacattgggcgtcaggcgtgcagtgcctggcaaatgggcatcgtcttcgggcagttcttcaacatttggagcgcccgcacgcgccgagtgtcgctgttccggcacggctttctctccaacaaagcacttctgttggcattgcttgtcgaattggcactgatcaattgctttgtgtatatgcccggtttgtgagaaaagattttaatgaattcccacggagtccgccccatccgcacaactttaaaatgttttcaactctttcatatttcaattttaatctccaatgagctagcttttttaggtgtcaactcttttctcggcggtgctcccatcccttggcactgttgggccgttgtggccgcggttggcttatttatcaacgcgtacaacgagatcaggaagtattttgtgcgtaattaccctcaaaacagaattgttcgctgcttcaaatgg

SEQ ID NO: 76037 - DNA, 1175 bp, Heterodera glycines
  Genomic contig location: Contig_ID=SeqID_12425; Location=94..1268; Strand=+
  SCN-specific regions: Sequence locations=1-221,246-613,635-841,874 -1175
atgtacgggcaggtcagcccaactaatcgctaattaataactagggatacgatttttcggctctaaaaactgccaaaataggtcggctttaggtcctaaaaacctcaaaaataggctctaaaaaatggaaaatggcactaaaattacctcatttctaaggtgtgtaaaatgacaaaatttattcaaaaaagtaaaaaaattaggccaaataagtaatgagctaaataaatttaaaaaaaaattttggacatgaatttttgagaaatttttcatttcttaggggtgtatttttcgttttcttacgtttttgttaacaaattttgggaaaaatgccaaataggtcaaaatagatttttttcagcattttttgatttttggaaattttttgaatttaattgaaattttttcgaattttccaaaatcccgcaatcccgcacgggatcccgcaaattttaaatgcgggatttgcgggattaatcccgcgggatcccgtcccgcaaaaaattttgagttccagtcccgcagcgggatccgcaaatttgaaatttccgtctctattaataactattaaatgctatttaaataaatatttaccaattacagatttccacaaaatttgatatttggtcagttggaataattgcctttgaaattttcattgatcaactgagtttggaggagaaaaaggcaccaatgaacggggtaagcatggatcaatgtatcatcagagacgggagccaatcccgaatcatttcaaaatcttggtatagttcggtagccctaatgaatttattaacatcattcttagtttaagaaaattccatcaaacaattaaatttcaattatttgtcgaacaaatgaatagatgaagaaaagccggacaaattttgggtggtgttggtcaattatttcgcactgacttttattagtttttttatggatatgatgcaattttttttttgaaataaacaatcaaaacaaaaaagttttttttaaagatggagcgaaggacaatgctttgcaacatcggcaatttgttcttcggatttaaacggaatcgcttcggagattaccccggcaatgtcaaagaagtgccgcttttgtactcggaagacccaaattgggtgtggcaaaacaagagacgccattcacgcggtgctgcgactttggcttaa

SEQ ID NO: 76038 - DNA, 942 bp, Heterodera glycines
  Genomic contig location: Contig_ID=SeqID_12429; Location=529..1470; Strand=-
  SCN-specific regions: Sequence locations=1-349,372-730,752-942
  Gene Ontology: Mol. function=carboxylesterase activity; Cellular component=cytosol; Biological process=formaldehyde catabolism
gtcgaacgaactcttctgatcagaaataataaacccaaaatggtgtcaatttcagttatttggacgcgacggaaacaaaatgggcacagaattatcgaatgtattcctacattttggatgaactcgtgccactcgtgttcagcactttttcagtggagaaaaataaatgcggaatttttggacattcaatgggaggccatggcaagtggtgaacacgcggtgtaggcacggaccaatctgtccgcggttagagggagggtacacggagacacacccaaccatggaacacccccccccaccacccatgggacacccaaccccgccatcccaatccgctaccagacataatgaatccagagagcaccgtcctcggagttggcattaaaatgggacattcactcactcaaccaaaatactttcacaatgttttcattttgccagacttttgtttgagtttaaaagaattgttaaatgtctctgcacttttgccactgactttttcccaggtgctctgaccattgcgcttaagcatccggaattgttcagctccgtgtcggcctttgccccaatttgcaatccgtcgaaggcgaaaggacagaaatatttgcgtgtctttttggggaacgatgagggaaaatgggcaaattacgacgccacggaattggctaaaaaatacgaagggcccaaaagggaagtgctaattgaccaggcgagtagaaaaacaggaacaaaaagtgatcaaaaatgatggaatgttttgaagggaagtgccgacccattccttgccaacggcgaccttttgccagccaatttgttggccgttgaaaatccgaatctgacgtggaaataccgacttcatcccaattacgaccacggctacgcttttatccagacttttatcggagaccattttgaacaccacgccaattgttgggcaatttg

SEQ ID NO: 76039 - DNA, 435 bp, Heterodera glycines
  Genomic contig location: Contig_ID=SeqID_12430; Location=1..435; Strand=-
  SCN-specific regions: Sequence locations=1-371,398-435
gcggcgcgcccaagcactcatttacaaattataaaattcgttaattgcatatccatttctatttaaaattggctaattgttagttaaagagccgttaaaccgctgcagctgaaagcatttaaatttaaacttcgtttttgacaatgtcgctggtcgaattaagcaaatcccggtggttcaatgggtatcagaaaattttcgaacataacaggtttagtgaaatgaaaaaaagcaaattggaattattttattgttacagtgcccagttaaagtgccgaatgcgatttggggtttatttaccggacaatcagccggaaagcaaattgccagtgctcttttatctttctggtatgaagtcaatagaatttgaacggctggagagggagagactgagaaaaaacatttgagggttgaaatgcaccgaggaaaattttg

SEQ ID NO: 76040 - DNA, 414 bp, Heterodera glycines
  Genomic contig location: Contig_ID=SeqID_12430; Location=2991..3404; Strand=+
  SCN-specific regions: Sequence locations=1-414
atgtcaccaattcgctatccctcgggagttaaattgcctcccttcgcccgcttttatgataatgtgtactggaaagtgaagcgctacatgaagccccaattcttcggagttgtggccactgttacaattattggtgcggcattttgggcgattgccattcagccgatgatcagcaacgaatattatgctgagaaacaacgcgagtggtggaaacggatgcccgtgtcgagggaggaacttgcgggagggctgcccgtgtggagggacccattcgaccgcgaggaccgcaaaacgccgtcgtacgccaaatagcaaccgaaaagcgggaggtcgttgaatccctttctcattgcccacactttgactgcatttttcgtttgtcggcacttttatagatacggcagtatgtataga

SEQ ID NO: 76041 - DNA, 581 bp, Heterodera glycines
  Genomic contig location: Contig_ID=SeqID_12430; Location=3538..4118; Strand=-
  SCN-specific regions: Sequence locations=1-182,205-418,444-581
atgagtgttggggaagtgaatggacggaaagtggcgcgaatattggccacgaggtgggagtgttcacaaagataacatttggatcggttccggtttcagaagtggcattgatgtttataatgcggacaccgaaggcgcacttctcacttttgcacaacggcggaagccgcaaaaaaagtggtgagaaaagcaataacaacaaaaatattgagattatataattaggtattaatttttggacaaatcggttgtagctgtgcaaccagcaacaaatgtaatcattcgttggcggaggagcggcgcattgtcattacgtcacggaggcaatcgccacaagcggaggacgacgaactggtcgaagttctgtctgccaaaacattaaccgaagagagaagggcacacagtggaggaggacagaaaagtggcaaaaatggacaaagaaaagggcgaaatggggaggaggacgaggaacagtcaacgctggaccaagtgacaccaatcccaacaactttggaactgagcaattccacatgataaactaacaataagttattccacgttaccaattaaagtgtaataaa

SEQ ID NO: 76042 - DNA, 2200 bp, Heterodera glycines
  Genomic contig location: Contig_ID=SeqID_12432; Location=27..2226; Strand=-
  SCN-specific regions: Sequence locations=1-111,140-407,429-1216,1238 -2200
  Gene Ontology: Mol. function=acetylcholinesterase activity; Cellular component=synaptic junction; Biological process=synaptic transmission, cholinergic
tgatcactgcttttttggtgcaatttatttatgcttttcgtttcagcttcttcacttgtgccctcattgaatttgctgacattgtgtaagtttttaatcgcattgattagcttaattgtttttaatttgttttcattttagctcagagaacattttcggctccgtattcatgtactattttgtaaaacgttcttccgccaatccgtggcctcgttggatgggcattatgcacggctatgaaattgagtgggttttatatttgaataacaaatacagtaggatcgtttaccgtagtaatttgtcgtaaataccgttaaaattaaccattcatttaccgccaatcatcgaaagctacccaaagaaatattgatttttctaattggcaaaaaaagccggtaattgaacccttataaatttatcattacaagtcgttttcggggtttcggtgaaaaaacgattacggtaattaccgggtcgccgaaaaggtcgcattgatcgaaacgaaatttttgtcaatttttcaaatcataatcatggtaaagcatttcgatcaatgtgtccttttcaaagcgcagataacggcaggtccaaatcatctattcggcattgtcacctcccacattttcatggcttttcctcccattttcaggtatgtgttcggcatgccatttcggcacccacaagcatacgaccaaaaagagttggacatggagcgggcattttcggcaaaaatcatggacttttggggacgttttgcgcgcactgggcaagttttgggattgcataaatcatttaaacgataaatttatcattttcaaatccacatttcagtgaacccatcgagttctggcccaagtacaacaggatcacgcgaaagtgtggcatttgtttatggtttaagccattagggccggacagaccaatggcaaccaacccatgggaatcctgagactgttcctgatcgagaaaattgatcaaatatgatcataattttttatttatcggtcgagaaaactgatcgacacgaaacataatttaagtgaatattggccagtattttaaaaaatttctgattatttaattgttttttggtgcaacattttgacatctctattttgggcttttctaatttaacagatttttcatcaatgaaaacttgtagccctaattatcatcgtttttccatcttctgacaaatattttatgatttttctgcattataaaattttaattaattggggcccaattttgctccatgatcgttttggtcaattagtaaattaattgctcattaattgactgaccctaattccctcacaggtcgctggtgctcagcgatgagattgcgcgcgggaacagtcatcgcatttatgtggacgtgcacggcaaactgtgccgtctgttggaggaggcgcaggcgctggcgcggctggcgccggaccagcgccaggtgcggctcagcgcacgcggacccatctcaacagaagcggtaataggagcagtagttcaatgtggtgttgagctgattaagattctcgttctcgagaaatttctttgatttatttcgtctcggtcgtggtctcgaatttaagggctttttccaggatcgaaaatcctttggcgtattaatttttaattgttttgaaacccgaattaaattgacttttaaactcatttgggctaaattataaaaaagtaccaaccacgcggacataaactgtcattaaattttcaattagcttgcaaatttagaaaaaaaaacaactttggaaaaatgaaaaacggcccagaatcagttttaatttcatagaattaaggaactaattgaattttttggctcaaaaattattaagtcaatcgggacccggcatttttgacgacccaaaaaatgtgatcagattgatcagttaagttccaaataaatcgtcgttcattcaatcgtaaaaaacaattctggcatttaggacctcgttgctgttgctggacacagaatggcaccaggcattgacatggcatcgctgaacacgtggcatcgcgcttcttctccctcactaaactcggcaaccgctgatcagcgaaatttacaccgtccgatcacttttttgacatttggcaccctgctaacagtctcaatggcatcaccattgatcataataccgcccaacaaattttatttgttcatttccatttcacattttct

SEQ ID NO: 76043 - DNA, 1205 bp, Heterodera glycines
  Genomic contig location: Contig_ID=SeqID_12433; Location=55..1259; Strand=-
  SCN-specific regions: Sequence locations=1-975,1035-1205
  Gene Ontology: Mol. function=acetylcholinesterase activity; Cellular component=cell; Biological process=synaptic transmission, cholinergic
atgaattttgcgtttgtgccaatcgatgaggacgccaatttcttcaagggcaatctgttcgagaagttacaacgcaaggagttcaagaaggatgtgagcatcatgctcggcacggtccgggacgaaggtgttccaaaaaagggggatggcaccggcactggggcggcattttgtgccacaactgcttgatgccggcaattaccgtgcattcgattaggccttgagaatttagccagagatacgaaaccccaaaaaacgcgaaacctttcatgactcaatgtcgagcttctcgtgcagccctaatttatgccaaatctggcatttaattggttttcaaattgagaattgattgatcaaattaaatcaactaacgatcaatttgtagaagcaaaaatcgatcgaattgaaggttgaagaattttttcgggttgattgggtggtgatcaaaaaaaatcaatcaatctgggaaagttttccggtttgatcccatcattaaaaaaaaatgaatttaaattatgcaaaaataattgttaaatgaatgcgtttgccgttaggcaccggaaactcagcctctccagagagtttttttgaattttgagagccgctgaaaaaaaatcttagcacaacaaactttacaggcacttactggctaccgtactaccttcacaaatacgggttcggcttcaaccataccatatcaccggaggatcagtacaatcaggcactggtcactgagtaagttggaatttacaattaggcttattaccttgttttttgtccatatcattcctttaaaatttggtgggcttctgatcactttttttatttaatcatttttgatcaattaattgttctaaggatgggcgggacgggatttttggaaacgccgggaccggtaaagtcgggaccgagatttgtttcttccaaaataaggatcatgttcagaaaaatccgggaaaatttcagaatttcaacatttaaaaatttacataaatttattagcaattttttagaaaaattaagaattaaaaaaacttcctattctttcatttttctatttttgaaaattttcttagagctgaatacaccaaagcttttgacgccttcttgccttactttggcaactcgcagttggtacggcacgcgctgatgcacgcctatgcgcgcatcacgcctgatcacaaccatgccaaggcggtggaacg

SEQ ID NO: 76044 - DNA, 1106 bp, Heterodera glycines
  Genomic contig location: Contig_ID=SeqID_12434; Location=629..1734; Strand=+
  SCN-specific regions: Sequence locations=1-22,44-676,698-918,962 -1080,1103-1106
atgcatccaatcaaaaaatttatatttttgtatcttatactttaccaaagtgtgaaaatcgaacaaaaaccggtacaccgtcgtgctatcctctctgtcttagcaattggaggtattgtcgctcttgttttggtaccaattgtggtcggatcggcggtagtagggtatttgatatcctacaacatacattgtgctaatggaagatgttagtttgtttatataccgtactcaaaaggcttatatcataaaaaaaatttaattcccctattaaacagatgtcgaacgattgaaagtcttttttgcttaaaatgagaatctacgaacaaaaatttagcagcttctagctgaattttagatgcaaaaagcatagttccaatttctcgatttctatagatcatccattctgtttcagtaaatgtttttcccattagtagtttgagtgatcctaattttgttagttgtaatctttcaggaacatcaaagggatcattcgaatctgtgccttgtaattggtgccgcttacggttgtaagcgcgtcgaactgatatccaagaggggtaattactcgaaatcgaattttcatctaacggatctctatctgtttttaagtcggcttctcgtgcttttcacaaaccttggcgccaaatgatattgccttctgactcaaatttataattttctcttctttgttctctatcaacctgttctgcttctagtttctctaatttttctggcttacagttagcattatgagttggctgcaacataacaagtttggttccctgtcgcagaacagctgacgcgacgttcgatttgacattaacatttttttcttgttcgcgaaaataacgacattttgaacaagaaatatatatgtcttcattattctcatttgtttgaatatattttctccaaatcttattgtcttttaaaaaattggctctaagctccaccctctcttatccaggcgtggatttttgcctaggtccagaggttcacgccatttttagcaacatgtatttttcctgaacctggatttttgtaaagaaaagctatgcttagacccgtgctgagtcgttccacaaaaaagctcagtgattgataaa

SEQ ID NO: 76045 - DNA, 2331 bp, Heterodera glycines
  Genomic contig location: Contig_ID=SeqID_12435; Location=128..2458; Strand=+
  SCN-specific regions: Sequence locations=1-638,661-863,885-1391,1413 -2331
atggactacccaagaataaacgaaagtgaactcgcttttcccatcccttcggggataattgtcagtgggccgtcctcttcgggcaagacccagctggtccttcgtctgttacggcatgccagcttgatgtttgacccgccgcccaaggcaataggtatgtgcaaagggggtttctgtgcagtggactgttgctatttagtatgggcatacggtgagtactcgacgcagattcccgatctggagcggcagggagttgtcccccacgcaggtgccccgtctgacgagatgctgaaaaagctgccaaagccttgtctgattgtttacgatgacttgatgggtgacattgaggccaagaagttggccgatctgtacaccaaaaagtcacaccataacaatttttccgtgattttcctcacgcaaaacctgttcgataaatcaatgcgggtgccaaggtccaacgcccagtacatcttcctgatgcgggctcccaacgacatgcttagcattcgtaatttggccagccagatgttccctcgcgagcagggattcctgatggatgcctaccgacaggcatgtgccctaccgtacggctacctgttggtgactctccacgcgaacagagacaacattatacgcctaaggacaaacattttcccagacgacgaggagagaatcatttttgcccccaaaaatggttaagcgggaacagaagatcggtgagcgggttgtgcacaactacgactatttgaagaagttgggaaagacaacgtcggagaagaagcgccgtcatttgttgaacagtgccggttgtgaggaactgttaacgcttgtcgagatttgtctcaacgttttgaacgggagtttctgtctgagcaggaaacaaaagcagagacttgcgccatttgcaaaagacatcagacagttggcacgtgtgcgaagcgagaggggtgcgcgaaaactagtgcagcagtcaggcggatcactttttgcccctttgttggcccccattctgattgaggctgcccgatacctgctttcgcgcagcaataatggccaataaacttattctgctgccgtacgagcactacaaggggctggttgcagcgagggagacaaagaatgacgacgacattgctgagcggacaaacttgggctttgtcaaacgacaggtgaccgctgcagtacagaagcggaagggaaacgtcagcgaacggaacgcaatgtacaaccagcacctgcgccggtacctgaagatgcgcaaggaacataaggagcggcccgtccgagtacagctcagcaacggcgctcaactgctaaataaaacagtggagacgggtgtgcaggtacggcctggtccggacgaaccgaaggacaagtccgtgatggttaccgacgaagatgaagaggaagagattgaagtgccaaagtttttaaccccaacaagcccgacgcagggaagcagccgatcacccaggaccaataagaaagcagcaaaacagcaaaaattgatcgagaagaaggaccacctgttggccatcattatgtctgatccgcagagattcggcgcaacagaccgtggaaaaatcattaacccaaagacgggccgagagttcattgactcggacctggcctggtcaattgaacgcctggtggaccctcgcccggagaatgccccttcgccaagcggaaccaaagagttgaagaggaaactcgcacagaatccgcttgccagtagcctactcaatcgactgtttgttgggtctgggttcgtcggacaagtcaaacaaacgagaggatttattccctcaaaatggacaaaaaaataaacaaaatatacaccgacccggccaatccgggcgggtatgcgggggcgagtgctctgtacgcggcggtgaaggagaagcacccgaagttgaagcgtgccgagtttgaggactttttgcaaaggaacaccacctacacgctgttcaagccaaagagggagaagttccgacgcctacgcactgtgcctacgggtttcatgaccggtaagttgtaccggggcttattgcgcacaattcagggttcagatgttcaggcggacttggcagatttccaggcactttcgtgcaagaacagcggctaccgttacttgctgttggtggtggatgttctatcgaggcgaatgttcggcgcgcccgtaaagagtaagcgccctgtggacatgaaaagggcgtttgaagagctatttgagcaaatgccaagggtgccagacacaatgtacaccgatcgagggctggagtttgtggcaaaaccgttgaaggagttttacgcggagaagggcattcaaaa

SEQ ID NO: 76046 - DNA, 1240 bp, Heterodera glycines
  Genomic contig location: Contig_ID=SeqID_12436; Location=214..1453; Strand=-
  SCN-specific regions: Sequence locations=1-323,345-550,575-783,812 -1036,1093-1240
  Gene Ontology: Mol. function=dihydroorotate dehydrogenase activity; Cellular component=mitochondrion; Biological process=pyrimidine base metabolism
tacgacaaagtgtcgggactcaaattgcccaagccgagacggttggtgtacacgcgcacgtcgttgaccatttcagtgctcctctccggtggcattggctattacatgtacaaaatattgcggggcgacgagcgcttacacagggaatgggtgagcaaaacaaaaaaacggggcatttttattcgaaaaatgactctctcggaaggaagggagtcaaaaattggggaaaaaatagttagaaaattttcaaaaaaattttgtacgcattttccggggtggcgataaacgacctgctccgtatgaatgaagatttgcatatgttttcaatataaaatatagtacaaagttttttttaacacgattattcggatttttttgaaaatttaaaaatttacgagagtttttttccctgttttttttaccctctcctccatttttttgcaggcattttttgaaaaagttttttaattcgccgtaataattttgagaagaactgctccttctgaatgaagggttcaatataaaacagcaccattttttaacacgcttattcgggattttttaaatcaaaattaagtttgctaatttttttcaacttttcccccattttttgaggttgttccgatggtccaccgttggtttgctcccgaaagtgcgcacattctcggcgtcaaggcggtcagattgggtttcctcgacgattttgtggagagtcgcaaggagtaccccgagttggcatgtcaaatgttcggcaaacagttgaacaacccaatcgggtgggcctttaataatatttatttaaaaaaaaattcattctaattttagttgtttaatggcggaaaaaaaacaaaattcgatcatcaaattcagccaataaaatccggaaaaaacacacaacaaatttgcaaatgacccctattttcattttttttttttttttacgaatttgtcgattgtggtggagggcgagaaatttattgtaaaaaaattctttttcaaaaacgattttcgatttctgtaaaactttttctgtcggaaaataattattttaaaaattccaattcaaataattaaataaataaaataaaaattcagtttggccgccggctttgacaagaatggggaggccattgacgggctgcgcaagtcgggcttcggcttcatcgaaattggcacggtgacgccaaaagcgcaaattggcaatgatcggccacgcgtttttcgcttgagagaggaccag

SEQ ID NO: 76047 - DNA, 267 bp, Heterodera glycines
  Genomic contig location: Contig_ID=SeqID_12436; Location=2527..2793; Strand=+
  SCN-specific regions: Sequence locations=1-267
atgcaaacggagttgaataagcggaacaaatttggtggttggggaacaatcagtgtcagagacaagctgagaatgaatgcatcagagtaaatgaaaattttcataattttagggttgcaaaatggaaaattttaaatcaaaaattcacatttgacaaaaatttattgcattcaaacaaaaaaaaaggttaagattttcagtgaaacctttgtggtgtagtcaaaactgcggaccaccaaatcggacattcacaaaaaatgggaaaaa

SEQ ID NO: 76048 - DNA, 264 bp, Heterodera glycines
  Genomic contig location: Contig_ID=SeqID_12436; Location=3655..3918; Strand=-
  SCN-specific regions: Sequence locations=1-264
tctccgttcaaatttgttgacgacgccatttcgctgaaagcagcgtccgacgggtcgtccgcggtggcaagcagttcaattgttgctggagtcggcgatgaccaaaagagtgtgaagtcctgctccaacaactcgtcctcatccaaccatgccaacagtagcagctgcgcactggacgcattggtgaacggcgccggtggcgatggcactgaatatcgcattaaactgatttcggtacaaaattttaagcgaatggatgcttga

SEQ ID NO: 76049 - DNA, 674 bp, Heterodera glycines
  Genomic contig location: Contig_ID=SeqID_12436; Location=3273..3946; Strand=+
  SCN-specific regions: Sequence locations=1-53,91-674
atggcatttggtactgttggcaaattaacagggacatgtaaaaagtattagcgaaaatttacaaaaaaataaaataaaataaaaatttttcggtgggttaaccccatgttaatgtttttgctaatttgtgtgcgagactaaaatatcaaaaacattggtcatatagatccgaattggaggcagtaaggctcgactaaaacgccaaaaaatttttttttttattgttagtcacgaaaaaattttttgagtctgaattcgagaaaatcttggttgggctacctatacggctagggcaataattctaacaataagcgcatagcggggggggggggggggaaatacccaatttagcagcactgaattttggcacaaaaaaagaagatcaagcatccattcgcttaaaattttgtaccgaaatcagtttaatgcgatattcagtgccatcgccaccggcgccgttcaccaatgcgtccagtgcgcagctgctactgttggcatggttggatgaggacgagttgttggagcaggacttcacactcttttggtcatcgccgactccagcaacaattgaactgcttgccaccgcggacgacccgtcggacgctgctttcagcgaaatggcgtcgtcaacaaatttgaacggagactgcagcacataaatgaatttgaaatta

SEQ ID NO: 76050 - DNA, 792 bp, Heterodera glycines; identical to SEQ ID NO: 12437
  Genomic contig location: Contig_ID=SeqID_12437; Location=1..792; Strand=+
  SCN-specific regions: Sequence locations=1-792
  Gene Ontology: Mol. function=structural constituent of muscle; Cellular component=sarcomere; Biological process=nerve ensheathment

SEQ ID NO: 76051 - DNA, 488 bp, Heterodera glycines
  Genomic contig location: Contig_ID=SeqID_12438; Location=2483..2970; Strand=-
  SCN-specific regions: Sequence locations=1-188,228-488
atggcgtttgccccgcttggtccgatggctttgtccgttggcccattgttcgccgccgctccgctgatggatgaagaggacacagatttggaagatgacgaagacggggcgagagaaggcaaagcatcggcaaaggaagacggagggagacaggacgacgaattggacgagagagaacggatattggggatggaagacgcaaagtgaggaggaggaggggcagcagggaactgaaaatcaaagggacggaaattgttgacccgatggaaaaaaacaaaacaaaactcgctaaaacacaccacgggaataaacaaatcatctttttaagtttttgcccaaactcactgcccttccttttgtgctcaccgtcatgttcgcctgctgttgttcatggtgccgatggccgtcctcgccagacaaatggccaagtcgttcagcaaagtcaatgcaaatgcaatgttcgtactcccgttggcatatttgtttaa

SEQ ID NO: 76052 - DNA, 728 bp, Heterodera glycines
  Genomic contig location: Contig_ID=SeqID_12438; Location=2259..2986; Strand=+
  SCN-specific regions: Sequence locations=1-485,525-728
atgccgcctcctctctatctgtccccaataattgaagtcattcgttgccaaatctgcgcccattcccaattcgttcagagggatgctcaattggtccctcgtgaccaattgttggcgcatatcgctgcgcacattaattacggaccaacttctgtattaatccataattaaaagaagggagcaaaggcttacttattcttatttataggagaagaatgaacgtcttaaacaaatatgccaacgggagtacgaacattgcatttgcattgactttgctgaacgacttggccatttgtctggcgaggacggccatcggcaccatgaacaacagcaggcgaacatgacggtgagcacaaaaggaagggcagtgagtttgggcaaaaacttaaaaagatgatttgtttattcccgtggtgtgttttagcgagttttgttttgtttttttccatcgggtcaacaatttccgtccctttgattttcagttccctgctgcccctcctcctcctcactttgcgtcttccatccccaatatccgttctctctcgtccaattcgtcgtcctgtctccctccgtcttcctttgccgatgctttgccttctctcgccccgtcttcgtcatcttccaaatctgtgtcctcttcatccatcagcggagcggcggcgaacaatgggccaacggacaaagccatcggaccaagcggggcaaacgccatcaaattggagagagtg

SEQ ID NO: 76053 - DNA, 167 bp, Heterodera glycines
  Genomic contig location: Contig_ID=SeqID_12439; Location=283..449; Strand=+
  SCN-specific regions: Sequence locations=1-167
atgccaactggaagagaatggggcggaagaggtgagcaaattgggaagtcgggggaacttatggtaattagggaatggatggacaaaattttacttttcaggaagaggacgaagacattcagcagatgtattgcagttgccttatgccggacaacaaagaaacgtga

SEQ ID NO: 76054 - DNA, 544 bp, Heterodera glycines
  Genomic contig location: Contig_ID=SeqID_12440; Location=82..625; Strand=-
  SCN-specific regions: Sequence locations=1-157,196-332,354-544
atgaattgggctaaggcgcccgacgggcttttaccaggccgccagagcccggtgccggtaaattccgtaatcttatttattattattttgcacttgagctttagctgctaataattttcattgacgaaaaatttcaatgcaaagaaaataaaataccaaattaaaaaattattttcttatttaaataatttttttgaaatagcccccactttctgctgattttatgcttgatgtcactgagcttttgtccgtctcaaagtcaatcacttctaagcctcttcgtcgccgttggcttcgtcgccaaaagcgcttgtcacgcgaagcttcagcagaaaatgttaaaatttcaatgtttttcaatattttctggaattttccaacctctatggttgccattccgccgcttgtgcttactgtagctcattgtcaacagattactgtagaagcgttgcgcggacgacggacggtccaactgaagagcaattggcggggacgaagaacagtcgtcagaatcggaggagacaaacgaggagatgatctgtga

SEQ ID NO: 76055 - DNA, 1211 bp, Heterodera glycines
  Genomic contig location: Contig_ID=SeqID_12440; Location=2640..3850; Strand=+
  SCN-specific regions: Sequence locations=1-151,176-364,391-416,439 -629,693-703,725-752,774-1144,1166-1170,1193-1211
atgacaaatgtcaacactgatttggtcgaagacattgtccaaatgaggccgaacagtgcgaaaaaattggcggaggatgaggacaaaagtttgctgagagatgttgacgaattggagacggatcagcaacagcgggagaacaatcgcaggacaaaggcaccaccgccgccaatgcttcgcttccccggcgtcggattaaacggatatcagcgcaaagctgtggaaatgattatctccgaaatgagcgcaaatgcggcattgcagcaggcatttcggtactcaattggaattccgattcaaaattcgacaactttaagtgttttttttgcatgtaaaatttaaaaaacccatcaaattttggcagtttaattaattttttaaatttaaattcttgagtaattttaaatttttgagactaaaagtgaaaaatcatttaattcgggaaatacaaacaaatttgatatttgtatttgtgaatttctgaaattaatcttttctcaacgagaaaaaataattttcaaataaaaaatagaaattttggaaaaaactattagacaatcgaattttttcaaaatttttctgtctttaggagtcctttgaaattttcttttttttgtgtgagatagcacaaatatgaataaaaaatagaatatagagaaaaatatgatcaacagaaaatataaaaataaaaacccatccttgatgcttcttctaaccaagctaaaattattattcacttggtttttagactaaattaaatgtgccaaaatagaaatacaaacaaatcagtccttatttgttagcgcaaaaatgatgaaagttcggctgggaccaaactcggcaatgtttggccaaatgttgcgcaccacttgtgggccggacgaagtgtgcctaagcgattccattcccgaattgggcgagaaatacccggaccaacagttggaaattgaggcaaattagttgggagtaaatgcaaaatgccaaatttggtaattcacagattgcacctgtgcaagcgcccaacataaaatttgccaaaggtattttatcagggttgttgcaaacacgaaatgatcaacccccgggtatttactctttttgtgagaatgatttaattgaatagaaatcaattttatattaaacatgaaaagcagaggccaaaaaacagacgaaaaaagtaattaaaggaaaatgcccaaatttaatagaaa

SEQ ID NO: 76056 - DNA, 927 bp, Heterodera glycines
  Genomic contig location: Contig_ID=SeqID_170; Location=2021..2947; Strand=+
  SCN-specific regions: Sequence locations=1-150,175-472,494-621,669 -775,798-891,913-927
atgagccaaaaccgtgacgaaaactcgcagccacctgtactcgatggaccgtacccgctggcacaagagcgcaatgagtttgtggaagatgaagcaccggtgctgcttgagatgttggatcgtctgtcacaaggagtgggttttgttttgaattatttaaattttttaatttttccattttggcttatgctaattgttgattttgtttagggaatttgccaagccatgggcctgttttcgtttgcacttgccgactgtttggccacatttcatacatttgccatactgttcgactgtgagacacctgtgccatttgacgagcagcacaagcgatacgtgttcgaacacagggacaaaccgcggctaatctacgtttcggaagatggtagcgctatacaggttgacggtgtggtgaagcaaggggaatttgtgatgagcatcgagacgatgtatctcgataagcgaaacggagttgatcacttttgcacattcctgcacacttttggcatttgtttcttgatgtgccattgaatgtgtttatttgtttcctattcagagcagtaaattgtttgcataattctgtttaattattttttgtttacaaccaaaatattgatccgcatttttatgttataattttaattcatttttgaaatttttatttaaatggcaaacgaagacttccgcttgtccgaatgcatccgttttattgagcgaacagcccaagagtatgattgtgttctgccggttccacggcttgggtttgtcacggaaattttcttaataatttttaaaatagctcaaggcgcgatgagcacctggatgcctgtgttctcatggaatcagtgggctcaggccaccgcctctacattttcgaatttgaggactgccttcaggtatttttaaaatatgaggtcaattaattaa

SEQ ID NO: 76057 - DNA, 1593 bp, Heterodera glycines
  Genomic contig location: Contig_ID=SeqID_170; Location=5766..7358; Strand=-
  SCN-specific regions: Sequence locations=1-71,95-227,265-293,572 -722,746-1067,1089-1223,1245-1406,1429-1593
  Gene Ontology: Mol. function=cytoskeletal protein binding; Cellular component=cell-cell adherens junction; Biological process=protein biosynthesis
atgattgccgaagtggaacggctgttgacacgaaaaaggtccgcaccggtgcatgcaagttttgggaacattgacgacgacgatgaggaggagggcgagattcttgacgtctcgtttgttgaggaggaagaagacaatacgggcgaagcgcccttaaacccactttcatatttggccaagcaatcagcggctcaacaagaaacgttgcggcatgaaaaatgggcacaagaagagagaaagcgaagggaagaggagcagagaaagcagcgagaaaatgaacgtagacggcgagaagaagaggagaggcgtcgtaagacagaagaagatagaaggaagactgcagagaaagcagccaaggaaaagaaggcaaaggaagagaaagaggcaagtgaaaagaaggcaagggaggaaaaactggcacgggaaaagaaggaagagcagagaatagcaaaggaaaagaaaggcgagaaagagaccaaggataaaaaggctgaggaggagagagtagcaaaggaaagaaaggcagaggatgagagagtggcaaaagaaagaaaggcagaggaagagagagtggcaaaagcggaagcggagagagtggcaatggtaacaaaggcagaagaggaaagagcggcaaaggcggaagcggagagagtggcaatggtaacaaacgcagaagaggaaagagcggcaaaggcggaagcggagagagcggaaaacgagaccaagaaaaagcaagaggaggaaaagcagttggaagagcttaaacgacagcaacaggccataagaaagcaaaaagagttggagctgctcaaagagttcagaccgtggcgaggcgggtacatgaggctggtgcacggcaaagacccaaccccagacgtacactatctgcacgaaacggatgattaccactttgtgaatgctgtacacaagtaccgtgtccggcactcagagctcccctgggaggcgcccgagtttaacccatccgcgcacatccaacagaatattggggagttccgtgagctgtttgagcaagaggtgtacgatgaaaactatgcggtgaaaacgcgagaggaaaaggaggagctgatcgagctggtcaaagggttccgcttttacttcaccgagcaaattggcagatttgagctcaaagttttcaacgggaaaatttcgcacattacgctgactgatcaactggcctacgtgttgggctatgaacaagagcagcagatcagaaatgaagagcttgcaaaatatgcggttgatttgggtggtggtgtgagccacctgtgcatttacctgaacagtggcgtcattgagagcatgattgtcggcaacacctttgccaatctgctccaagtgattgccgttgagggaaagtcgggtagtgtggtagagaaggacttccaggcgccgttgtttcacaaaatcatagcaagggaggtggatgtgcttgacgttgagattcgcactctgaccgggaggttaggctcttcagcagggcaattatttctaatcacttatttaagggaggtgccatttgagtttggccaagttgttttgactcttcagtttaaaaaggtgttaacgttctga

SEQ ID NO: 76058 - DNA, 744 bp, Heterodera glycines
  Genomic contig location: Contig_ID=SeqID_170; Location=7627..8370; Strand=-
  SCN-specific regions: Sequence locations=1-34,56-325,348-485,507-744
atggatgagtcgaaacgggaaaatttttcccctcaaaatgatgatgacgtcatcacaattggagacaacaacaacactcaaacactgcttgacctgcaaccggggccctcaaaaaggggacgcaagcctcgcttggacaaaatccatgaggaaattgcttccgctatgaaaaaagcaaaagccatggaagctgaaggtttggctttttctgcaaatttctttaaattagccaaattttagtggatgaatcgcccaaaaaacaaccgaccaatgtgtttgagtacccgaccatattttggaaattggcccgcccaaaggttttggctaatatttaatttgaaaaaataggaaaatttcttaagtacggagtgttcacgttcatgtgcaaagagtgtcgtgatgacaatttccggcaggggaacagccgattcaaactcatcaatcagaatggcgagcagcaacgccttgagttcacccaatcgttttgccaagactgtgcaaagctgaactttgactgcaccgatctgatcatgaagcacctaaagaaggatgaaccggcaacgacgacgacgacgacgatggcaaagagtttccgctggatcaaagatgggggaaagtgaaccgagatggcacaccacgatataaggacgatctcattttgaagaatttatacttgttgatcaaatgacaaactctttctttgtaattttgccgagcaatacgccaggctttgttggaaataaa

SEQ ID NO: 76059 - DNA, 199 bp, Heterodera glycines
  Genomic contig location: Contig_ID=SeqID_171; Location=33..231; Strand=-
  SCN-specific regions: Sequence locations=1-34,56-58,80-199
atggatgagtcgaaacgggaaaatttttcccctcaaaatgatgatgacgtcatcacaattggagacaacaacaacaacactcaaacactgcttgacctgcaaccggggccctcaaaaaggggacgcaagcctcgcttggacaaaatccatgaggaaattgcttccgcaatgaagaaagcaaaagccgggggggctgaag

SEQ ID NO: 76060 - DNA, 2948 bp, Heterodera glycines
  misc_feature (2944)..(2944): n is a, c, g, or t
  Genomic contig location: Contig_ID=SeqID_171; Location=1633..4580; Strand=+
  SCN-specific regions: Sequence locations=1-638,661-863,885-1397,1419 -1480,1503-2404,2426-2675,2706-2907,2929-2948
atggactacccaagaataaacgaaagtgaactcgcttttcccatcccttcggggataattgtcagtgggccgtcctcttcgggcaagacccagctggtccttcgtctgttacggcatgccaacttgatgtttgacccgccgcccaaggcaataggtatgtgcaaagggggtttctgtgcagtgggctgttgttatttagtatgggcatacggtgagtactcgacgcagattcccgatctggagcggcagggagttgtcccccacgcaggtgccccgtctgacgagatgctgaaaaagctgccaaagccttgtctgattgtttacgatgacttgatgggtgacattgaggccaagaagttggccgatctgtacaccaaaaagtcccaccataacaatttttccgtgattttcctcacgcaaaacctgttcgataaatcaatgcgggtgccaaggtcgaacgcccagtacatcttcctgatgcgggctcccaacgacatgcttagcattcgtaatttggccagccaaatgttccctcgcgagcagggattcctgatggatgcctaccgacaggcatgtgctctgccgtacggttacctgttggtgactctccacgcgaacagagacaacattatacgcctaaggacaaacattttcccagacgacgaggagagaatcatttttgcccccaaaaatggttaagcgggaacagaagatcggtgagcgagttgtgcacaactacgactatttgaagaagttgggaaagacaacgtcggagaagaagcgccgtcatttgttgaacagtgccggttgtgaggaactgttaacgcttgtcgagatttgtctcaacgttttgaacgggagtttctgtctgagcaggaaacaaaagcagagacttgcgccatttgccaaagacatcagacagttggcacgtgtgcgaagtgagaggggtgcgcgaaaactagtgcagcagtcaggcggatcactttttgcccctttgttggcccccattctgattgaggctgcccgatacctgctttcgcgcagcaataatggccaataaacttattctgctgccgtacgagcactacaaggggctggttgcagcgagggagacaaagaatgacgacgacgacgacattgctgagcggacaaacttgggctttgtcaaacgacaggtgaccgctgcagtacagaagcggaagggaaacgtcagcgaacggaacgcaatgtacaaccagcacctgcgccggtacctgaagatgcgcaaggaacataaggagcggcccgtccgagtacagctcagcaacggcgctcaactgctaaataaaacagtggagacgggtgtgcaggtacggcctggtccggacgaaccgaaggacaagtccgtgatggttaccgacgaagatgaagaggaagagattgaagtgccaaagtttttaaccccaacaagccagacgcagggaagcagccgatcacccaggcccaataagaaagcagcaaaacagcaaaaattgatcgagaagaaggaccacctgttggccatcattatgtctgatccgcagagattcggcgcaactgaccgtgggaaaatcattaacccaaagacgggccgagagttcatcgactcggacctggcctggtcaattgaacgcctggtggaccctcgcccggagaatgccccttcgccaagcggaacaaaagagttgaagaggaaactcgcacagagtccgctcgccagtagcctactcaatcgactgtttgttgggtctgggttcgtcggacaagtcaaacaaagcgggcgttttattccctcaaaatggacgaaaaaataaacaaaatatacaccgacccggccaatccgggcgggtttgcgggcgcgagtgctctgtacgcggcggtgaagaagaagcacccgaagttgaagcgtaccgagtttgaagactttttgcagaggaacaccacttatacgctgttcaagccaaagagagacaagttccgacgcctacgcactgtgcctgcgggtttcatgaccggtaagttgtagtgggcttattgcgcacaattcagggttcagatgttcaggcggacttggcagatttccaggcactttcgcgcaagaacagcggctaccggtacctgctgttggctgtggatgtgttgtcgaggcgaatgtttggctctcccgtaaagagtaagcgcccagtggacatgaaaagggcttttgaagagctatttgagcaaatgccaagggtgaccggacacactgtacaccgatcgagggctggagtttgtggcaaaaccgttgaaggagttttacgcggagaagggcattcaaaagtttgagaccagttcaaagaagaaggccgccgttgcggagcgtgccatacgcaccctaaagactcggctgtacaaatatttttcctccaacaacacatcggtttgggtggatgtgcttccaaagtttttgagtgccatcaacaactcggtgtgccgcgcgaccggacttagacccaacgaaatcagcgacaccaatgcgagggaggtctggaagagggtgtacggcgaagggctcgcacaattggacaagacaccaaaaatcagagcaggggaaacggtcagaattcccgagcctaagcacattttcgagaagggtactgtatttcacacattttttcggtcaatttattttaattttaggttatatacccaattactctgatcacgtttacacagtagacgaggcccgctcaaccaacccccagcactatttgctcaaagactattatggcacaaagttgaagagaaaattttatttaccagaattaacaaaagtacaagttgatgaaaacacaatgtatcggattgaaaagaaatacaaagaacgagtgagagatggaaaaagtgaaatattggtgaaatttattggctttccggaaaatattgngtga

SEQ ID NO: 76061 - DNA, 2048 bp, Heterodera glycines
  Genomic contig location: Contig_ID=SeqID_171; Location=4643..6690; Strand=-
  SCN-specific regions: Sequence locations=1-99,121-159,185-252,286 -796,832-904,927-1029,1068-1244,1273-1417,1446-1577,1601-2048
atgctggaggacaacccagccatgaaggcgtatttcgacaattgtccggattctggaccaattgacttccacgatgccttctttggcggtaccttttccatttaatttttaactaattttccggcacaggtcgaactgggcccgaatacttgggcgcttcagtgatcaacccagagacgggcgactggaaaagccgcacaatcaaagtgaaggactttaacagtctttatccttcgcggtaagaaatgccggaaaaaattaataattgaaaaattttggctttttaaggaatatgtacaccaattacccggttggccacccgactgtggtgcagtttgacaaggacgtggaatggaggagtccagcggacattgttggcgacgacggcatccgcctcgaggggatcatcaagtgctacgccgtgccgccacgccactgccactacgacatcccggtccttccctatcggctcaacaaccggacgctgttccccctctgccggacgtgttcggaaatgtacccgcgcggcttgatcgaccccgagtacaactgcaaacattttgaggactctgaaaggggtgggtttagaaacttataattaagcaaatatttttcttgataggattttcgacaactgtcacgcacattgagctggaggccgccctccgctctgggtacaaggtgacgcacgtttaccgtgcctacatctggcgcctcgcgtgcgattggagcaatgggctgttccactcgtatctgctgaagttcctcaaaatgaaatttgagggtgaaaatttggaaaaaaattaataaaaaatcataacaaaaatttaagcaagcggatatccagcgtcttgtacggaggcgggcatcagcgatgaggagtcggcacggcggaaacaggaccacatcgacaaggccaaagaaaaggcccaagtccatctggaggcggaccggatcaagcacaaccccgggctccgctacctgtccaagttgtgcttgaactcgctgtggggccggttcgcacttcggtaaaatttctttaaaaaattatgaaaaaaaaaataaaacgtacaggaatcggctcacaaaaaccgaaatcgtcgagtgccatgcggaatcgccaaactgctcaacgactcgaagattgaggtcagcagcatcgatcagctgacggaaaagttttggatggtctgctacaaggccaaggatgagcatgtggtggaacacagcacgagcaacgtaagaaaaaattttaaattttgaaatttatttgcctttctcaggtggccattgccctatggaccacttctgctgcgcgaatccacctgttggaatcgttgaaaaagtgtatggacctgctcctggtgtagagcgctacgacacccgcattctctacatggtaaaactggaaataaaatgaaaataggaaataattttttataattaggacactgacagcatcttctacgactacctgacgcggctgggggacccccttccgggtggtgagcagctcggggaactcgctgatgagcacccgaaccacacgattatggaattcatttgtggtaaaactcattaaaataaaaaaaaaaaaaatggaaattttttgtttagctgggcccaaggcgtacggattgtggctgcgcaacaacgcaacgggggaggacgagtacaagctgaaggtgcgcggcatcacgctcgactcggatgcctgcgagcgcatcaccttcgagaagatgaaggacatggtgcagaacaagctgggacagccggacaacaacgtccgcttcaactacccaacgaagaactttcggatcaccaagaagggagagattttcaccgtccccttggtcaagcagttcaacccgaccgtgaataagggggtggtcagggatcacgggttgaaggtggtgccctttgggtacagcgacaaagagtggtgtaagtggaactgccctggcgcttgtacctgtctgttcaacccagacctcaatgtgaacatgttcacagaagaggagctgaacgaccccgacattatgccataa

SEQ ID NO: 76062 - DNA, 592 bp, Heterodera glycines
  Genomic contig location: Contig_ID=SeqID_1801; Location=298..889; Strand=+
  SCN-specific regions: Sequence locations=1-559,582-592
atgccgacagagcctgttgcagctgctttaacacaactagcagatttaccagaaaacaacttcagctttcgaatcaatccgctcccagttgtgccccgctcagtatcgattcaataccttgatgatgttgaacgttttaaagtttcattcaatgatcggttgatacgtcatttgtcattctcaccgcagttgggctatgtgctcgggtttgaaaacccgcagcacgtggtgtctaatgaggtagcaaaatatccggtggatttgcgaggcggaatctcgagttttgccgtttactcaaaaggactaactgagaatatgattgttggaaattcgctgagttcactgctccgtgttgtgtcagtcagcggtgcaacacccaatgactacaatgagaaaatttacgattcgcccatttttgcgcgagtgctgccacgggagatcaacgagattgagattgagctgcgcacaatggacaagggtcgcctcgtcccattcgcctacggcacgacgctggtcgtgttattatttaagaaagtgataaatttctgaaaccactcattttttgtattcattcattcattgaacgtaaaaa

SEQ ID NO: 76063 - DNA, 1599 bp, Heterodera glycines
  Genomic contig location: Contig_ID=SeqID_1801; Location=2748..4346; Strand=-
  SCN-specific regions: Sequence locations=1-218,249-298,322-450,475 -760,782-974,996-1439,1461-1527,1549-1599
atgaaacgccctaatcctttgaaccttccaatgaatgagaaaaagcccaaacttcgtcgacgcctgccggctgaattgaacagcgagctgatcagttttgtgccattagtctgcctatttgccaatgtgaagcggactccaattggtcctgtttgttaccaattcgagtgtttccgtagtcaacgccaaaagtgctttgaatatttggtattttcaccatttttattttattacataaattatttatagaagggtgttatcgcattattcgatgtgatgtttgaggagaaaaggacaccgaagaagaagaaagtggggagactgcttctacaggaagaactgccgcatgacctcagccgaaatgagctcctgcactacctgtgctacggacgactgggaacgaatttgttcgagacttattttgtgatgagccaagcaacaaatgtaagcgaaaagttttaaatttttaataacaacacaaaatttttagtcaattggcattgggaatttgtttgggcttctgctcgattttgcaatgagctcaccaactccttggcacatgaagcgacccatttgctgtggaattttcttccgacaacatttgccgtggattctgcaacaaccgatgaacgtaatgctttctcatggcttttttccggaggtccgaagtgatggttttgaatttttttggctgttcaacccacacttgaaaaagtatgctgggtatgtccgaattctccctgagcttagtcagcctgacaatttgcattttttccttagcattttctaagcattttacttgaccaatttattcatcattatcattacatacatgtcggaatttgtcggttttttccattttctcaataaattgttgaaatgaatgaccttgtgacatatgatacacaaaaacaatacaatgtggggcacacgttgacactaattgggattgataggaacgaatattttttcttaggcccattggaaacttattcaggaatgatgacacaatgacagatggtattttttgggctaagctgtcataataaatcactggttcttccattcccttcgcataaattgcacaccaatgagaccctcccttgtaatgtgggtcccggttcacaattagcgctgcgggatactgtagagtgaccggaggcggtaattgatcactggcgaagcagccccgaaagactcgtgcggtcccccggttttcgttcaagattgatgtgatttgcacgctgtccattcttcagccaaaaaatagagcaaagttgatggagaaccaggctgacaataagcatcaagtacaatgcaaacaccgcccagcaaatgacttgctgaaaaaaattttcctcttctggtcggtctttgcacaattggatgagtggcgtgagaccagctgacacttgctcttcaattaacttgtcgttttttgggggagaggaggtggtggttgttgttggtgtgcttgtagacggaattgttttagttgttgtcgatgtaagcattgcctttcttcttatatattctgaatactcaggaatttcctctcggcatgacactacgggaagagaaatccgaagaaggaataaa

SEQ ID NO: 76064 - DNA, 3990 bp, Heterodera glycines
  Genomic contig location: Contig_ID=SeqID_1801; Location=4990..8979; Strand=+
  SCN-specific regions: Sequence locations=1-371,410-483,505-1812,1835 -2927,2949-3820,3844-3990
atgaactcttgggtgtcgtgcacttccttggatcggtgcagcaaggcgaaggaacatcaaaagaggcaaaggactacgttaaaaaattcggagaacaacatcgagcacatggccaaattccactacgtcaaaatcaagtcaaaattcaccattaccgacttgccgagtacacctgaggcactgttggctgggattttccaacactgcatcgacgaagcaattgttgaaagccgtgagcgcaacatcgaacctacacacctcggctgtatgatcagcagtcctctgctggaaggcggcgacatcccaatcccgatacgacaaatgacaaacaacactctcgacaccattctcaaccagttcaaaaaagtggcgcagtcaaaacaacagaaaaatgtgtcattatggggggagccgtttaccgtcaccatcacgactctcgaccgtaatggactaccatccaaacgtcgtgtcaaagggggagctcgtcgccctgtcaaaacggccgttcaccaccgaattaatgaccaatgcctgattaaaattcgtaataacgacaaccacttctgccttttctacgcgctgcaggcaacaatggtcgacaaaacatgcaattggccacgatggaagtttttggactacttgcacgacagacacggacagcagggacaactccatcatgatactgttaagctcatgcagcaggtgaaagcaccaatggatttggttggctacgacgcggacacatttgtgcctcacgtcgttgactactggaacaacgcgcagcgacaacaccgctttgctgtgttcatctttggatcgttgggacagtataagccgctgtacaagtacattgacaacatctacgacactccgctgctgttgtacttcaatgaggaccatttcgatggtgtgcagaagcagggtggtctgttcggtcaaccgtactgtttggagtgtgaacggccatacgacaaaatgtcaacacacaacaaaacatgtaaagcgcgctgtgtgctgtgctcacgtgttggaccagcttttccatgtccatcatccaccggcttcatcaaaaagtgtaaagagtgcaacaaaaaattcaccaacaacggctgctaccagcaccatctgcagtcaggcttctgcaagcggtcgaaaaagtgcaaggattgcggtgctgtttgggatgttgtcaacaacactcagaagggcagaaaagggcatgtgtgtggtgaacgcttctgtaagatgtgcaacaactaccacaacacggaaagaggctgtttcatccaacccattgagcccaaggaacgcgacccctaccgcatcgtggcatttgacttggaaaccatgcagcacacgccatctgtaaagcctgagaagcgtgagcatttgccgaatttcatcgcagcacgagtcgcttgccccgactgcattgaaaatgagagctggcgagaggcatcgggagggtgcgaggtgtgcgggccaaacagaacagtcgccttttgtcaacgccgcttcactgaaacaacagtcgacaagcaagtggtggcggaaaacccattggaagcgtttgtcagctggctgataaacgacttgccgttggcctacgacacctacgccttctctcactttggcggccgctttgatatggtgctggtgttccgcgaactgttcaaacgcggatataacccggacatgttgcgcaaagtaataattgactattttccataacttgtgtataatttttctattttcagggaaataaaatgtacgaaatgcggattcgaaggcagaagaagcgcaaccctaacattgttttccgggattccttcaatttgatgccaatgtcccttgcctcgctggttccatcatttggcttggatgtggaggacaagccattctttccgcacatggccaaccacccagacaactacggaaagcagatccatccaacaccagacgactatttggtcaagggtatgatgccagataaacgacaaaaattcgacgactggtatgaacaacaccgtcaggaaccattcttcctcgacgaggcgttggcaagctactgcaccaacgacgtggagatactgatggcggcgctggtggcttttcgtcatgagtttttggatgtgacgaaacgaaatgaaggaatcgttgcggagcgtgcggccttctatgagcaccacgacggcattgatgtgttgcgggagtgcatgacgatcgccggcgcatgtatgaagcattttcgcaccaaccatctgccgaagaagcacttggctatcgtcccggaacgcggctacgacaacgcacaaaaccagtcgttgctggcacttcgcttctttcattggcatgcggaggagcatggtgttgtggtgcagacggcgcattcggctggcggagagaagaaaattggccaatattccgtggatggctgggtggaggaagaaagaagagcaattgaagtgaatggatgcgtgtggcacggctgcaatgaatgcttccccaataacaacatgatgatgccgaatggaaagacagctggggaggtgcgagagcgggatgagaagcggctggaattcatcgaaagtcaagtgtcacgagtggatgtgtactgggagtgccaaattaaaagaatgctgaaccgtgacccgtacatgcgcgaaagttttggtgattatgtggatgatggcccgttggacattcgcgaggcgttcatgggtggaagaactggaccactaaagctgtaccacaaagcgggagagggcgagaaaatctcgtactatgactttacgtccctctacccgtacgtaaagtgagttttgtttcgatcattattcacaatttataattttttatttccagcttctccaccacttacccgattgaacacccaaaagtgctcatcttgaatgaaaatgtggagtggacaagcgcacgcgacaacccctacaaattgtcgttgctcaaggtgtgggtgattccgccgcgaaagtgtgatgtaccagtgctacccgtcaaagtcaacaaacggctctgttttccgttgtgcatgcagtgttgtctagactacccgaagggaggcgttgattttgactaccattgtgaacacgacgaccaacaacgcggatgggtgacaacatgcacatcaattgaattggacgcagcacttgaagagggctaccgcgtgaccaaagtgttccgggtgctgaagtacaggcatggcgacgacaaacttttccaaccatacatcgccgagttcatgtcgcagaaaattgaagcttccggatttgacgccagcatcaagggaaatgaagagttggagcagcagttcatcacagaatgtgcggagaaattcggaatttcaatcgacaaggacaacatgaaagtgaacaagggcaagcggtcgttggcaaagctgtgtctcaacaacctgtgggggcgcttctctctgcgcaacttcggcctcgcccagaccctcatcaccgacgacccttcagtgttgactgaatacgtggaaaacagctcaatcgacatcatttccgttgatgagctagacgaaaaacatcaattgatcagctacgtccagaaaaaggagtgggtggaggagcacgagtgctccaatattggtgagattttaaaatgccgcctcctctacacggacaccgactcgctgattttcgtccacccgatcggcatgaatccattggagacaggaccaaacttggaacaattcaccgatgaataccccaagcatgaaattgtggagtattgtagtggaggagcgaagcaggttaatttaccgtttatttagtgcataataatttatactttatcatttcagtatggactcaaacttcggcgtaatgggcaggacgaatttgtgctgaagctgaggggcatcacactgaactacgacgtgatgcagaaccagtccctatgctacgacacattcaaagaagaagtgttgcggtatgctgaaaccggaga

SEQ ID NO: 76065 - DNA, 666 bp, Heterodera glycines
  Genomic contig location: Contig_ID=SeqID_1802; Location=233..898; Strand=+
  SCN-specific regions: Sequence locations=1-148,170-198,222-666
atgcagaaggtggtgagaacgcctggatgccgcctcctctacacggacaccgactcgctgatctttgtccacccgatcggcatgaatccattggagacaggaccacacttgggacaattcaccgatgaatacccaaagcatgaaattgtggagtactgtagtggcggagcgaagcaggttttcaccttttaataattcataatttatactttatcatttcagtatggactcaaactccggcgtaatgggcaggacgaatttgtactgaagctgaggggcatcagtctgaactacgacgtgatgcagaaccagtccctatgctacgacacattcaaagaagaagtgttgcgatatgcccaaaccggagagtatgagccaataaatgtgatgtaccccaactttttgagaccggacattaggggtggcggacacgtcacttcaggccccctccaaaaatgttatcgcccatatgtaggcaaagggatagtgggccctaattatgatgttctcaatttcggacacactttgtaaatttatcgttcaccattcattgtatccctctcacacacacacaccccatacacacgtacacacgcatgtaccacctttgtttttcatgttttataccaaaaattgtgtaattttgtcattttatttgcgttttta

SEQ ID NO: 76066 - DNA, 386 bp, Heterodera glycines
  Genomic contig location: Contig_ID=SeqID_1803; Location=688..1073; Strand=-
  SCN-specific regions: Sequence locations=1-386
atgcagaaaacattttttgtcgacggaatatcggaccatggagcggctttgaccccagcatacggcagacttcgacaaccatacaacattaacattgctgcccatttctacgctcggcaccgtatcaagctgcatctcccgtacgtgccatgtgttgtggagaaatacttctggagtggcgaagacagatactacccaatggagctactcgaaattgtggatgaggactacaccaacaaagagcgatggcttggcaaattgtttatggaaattgaagatgacttcattcctgtcaaacgccttggtcgagttgaggaagtcgaagaaattgacgacaatgatggtggtggtcgctacgaatgcagtcaaccgtcttacgtttattg

SEQ ID NO: 76067 - DNA, 381 bp, Heterodera glycines
  Genomic contig location: Contig_ID=SeqID_1803; Location=1369..1749; Strand=+
  SCN-specific regions: Sequence locations=1-381
atggcaaaacaatttgtacaacatgaaactgcggaggagcaacaagtgaaagctaagaagccaaacgttgatgagcgatttctttggaaaatcacgcggggccaatttgtactagcgattcggctgtgctcaggttaatcaaaaatttttgacgaccaaattaattgacagctttcagaggactggaacaatttatttcacaacaaagacaaggcacgtcggctggaagatgggcgagtggcgattggactcgagatgtgtgaaaaatgtgcccgaatcaattgctgtgtcagtgacatgattgctgatcaaaagaaaaagccaaaaaccaccaaataattcatcaaatttttcgcattatttggataattttgactacca

SEQ ID NO: 76068 - DNA, 430 bp, Heterodera glycines
  Genomic contig location: Contig_ID=SeqID_1803; Location=1941..2370; Strand=+
  SCN-specific regions: Sequence locations=1-430
atggcttcatattgtgaagcgtcaaaacagcagcggcaccaacaaaaccatttcaatgaaatgtgcgtggcatttcagagtatggaaatgtcggaatcggcaagacccctgcctggcggatcaataaatggaccaaagtccttcggtagaacaatttttgatatgcattttcagttcttactgtaatttttaataattttaggatgtgcatttctgaaagaagaaatcgacaaacagatgacgaatctgattttcacaatcacaaaaatcgaagagcgcttaaacggactacccgacccgcaagcggcgcacctttatggaatagtcaaggagcagctcgaaagaactattcgtcaaattgagaaggactgcttgtgaatcggtattggtgaagggaattattttggtggtgatgggattattttttaaa

SEQ ID NO: 76069 - DNA, 1467 bp, Heterodera glycines
  Genomic contig location: Contig_ID=SeqID_12442; Location=447..1913; Strand=-
  SCN-specific regions: Sequence locations=1-219,241-254,276-737,760 -1137,1159-1467
  Gene Ontology: Mol. function=polypeptide N -acetylgalactosaminyltransferase activity; Cellular component =integral to membrane; Biological process=O-linked glycosylation
atgtcttttcgcatttggcaatgtggaggaagccttgaaattcatccatgcagcaggttggcaatccgcaaaatggggggggggcaccaatttaaatttattgtttgagcaatataatctttaattgctgtttttcattgtaaccaataaatggaatcgccaatttaatcatttcgactgcaaactacagatgccgatttttatgtcaaaatttaagattaaaaaccccataaataatttttcctgaaaatcgtggaaaatttttcaaaaattttcactcactttctttaattctcatccgattttttttcgttaattccggtttacctattttagggttggccatgtctttcgcaagcagcacccttacacgttccccgggggaagcggccgtattttccaaaagtttttgtgttttaacttttaattttcgcttttttatttttcagaaatacgcgaagagctgctgaagtttggttggatgattacaaggagttttatttccaaactgttccttctgccagatacgtaaacttcggagagtgcgtttaaaccaatgaaaatttatctccgaatttttgatttttttagcatttccgagcgcctacgcattaaagaaagattaaattgcaaaaacttttcatggtatttgaaagaagtttacccggaactcaaaccgcttaaaaattccggggagcgccgtgtacaaatcattcaacaaggaatgtgtttggacactttgggaaagttcaaatggaatcagtcgccagggctctaccaatgtcatggtatggtttttggtaataaatacgggacgaagctctcttgtttatgtgacggaggcaatcaagaatggatgtacagtccattaagtggaaaactcagacacaacgccttcaaattttgtctcacggtcaatgcttcttcgggcgtcccgttcaatggggattgtaaggtttgtgaaattatcaaatgcctgagattaatacccaatgattttaggtcgcttcggtcaattggcgtcttccaactccgttgcaaggacagaatcagcacgaggcaaatggtcttgtcaaaattggtttaaaatgtctcggcagtgcctccgaaactcacgagggaaacggcttgcaatttgttctacaaactttttcatgtgatttacgagaccctaatcaattgtggaccgtacgctacttatccatgtgaatttcgcatttttttgaaatttatcacccagtgtttctataactaatctgccatcgactttccattctttttgttaacttacttacaaatttgccatacttttctttttttttaatttaacttagaatttcacaacatttgaattatcttgccttattttatcattttttctcctttattgctttaatctcttttcttttcatttttacatactttctatgcaattgtttaattaatattttaatgattgtgaataaa

SEQ ID NO: 76070 - DNA, 152 bp, Heterodera glycines
  Genomic contig location: Contig_ID=SeqID_12442; Location=171..322; Strand=-
  SCN-specific regions: Sequence locations=1-152
atgccggcaacgaagaaaaaggcgcagcttgatcctttggtgaggcgatcgattgctttgttgtgggcttataatggcagtgatttggtccttttgacatttctgcctggagaatgtcgcttcgatgagtattgtcaggccaaccgaaagaa

SEQ ID NO: 76071 - DNA, 732 bp, Heterodera glycines
  Genomic contig location: Contig_ID=SeqID_12443; Location=1..732; Strand=-
  SCN-specific regions: Sequence locations=1-280,302-390,412-732
  Gene Ontology: Mol. function=polypeptide N -acetylgalactosaminyltransferase activity; Cellular component =integral to membrane; Biological process=O-linked glycosylation
ttttcccatgttcttccacccacatcgattataataactttccacaacgaggcaaggtccacattgttgcgtacaatttggtccattttcattcgcactccatcgcatttacttaaagaaattattcttgtcgatgattactccttcgatggtttgcatttggaacgaaaaaatcaacatatgagtaagcattttagccactattggcagagatttatttggtattgacaaaatgcgaattatccgaaacagaaagcgagagggtgggttttgtgctcctttttggctttgttaattctgtccgttaagggcttattcgttctcgagttcatggttccattatcgccagtgctcctgtcctcacttttttgggtttgttttttctttcatatattattaattcccatttagacagtcattgtgagtgtaacgtcggatggttggaaccggtgcttcaacgtctggtcgaagtactgttaccgacccggcttttgatttccttttttacagaatgacaaagctgtcgttgcacctgtgattgacgttataagtgattagaaattgcttggttaacggttttgagttattttagacatggacaacttcaattatgtctcggccagctcagatttacgcggaggatttggttggaatttggtgttcagatgggaggcattgggaagagaaaaaaaatattccggggaaaaaaaccggaaaaaaccaataaaggaa

SEQ ID NO: 76072 - DNA, 1077 bp, Heterodera glycines
  Genomic contig location: Contig_ID=SeqID_12444; Location=102..1178; Strand=-
  SCN-specific regions: Sequence locations=1-560,582-879,901-1024,1059 -1077
atgctttatttttttccttcaatttcttttaccatcttttgttatctgcttttagttccagtttcaagtgcaattcaatcggtgagtttaccacacaaaataattaattaggacaattattttggctaaattccaatttgataggtcgacgaaggcatgctaattgaatttatgaagggccataacgaaaacaaaatcagtgaattttcaatgcaaaaatatgaggcacacattggcattttgcactttatggaaaagaattggcaatgtgacaaaattggagagcaatttaaagcacattatgaacagacaaaatgccaaaaatatcgcaaatatttggacattttgtatgaatatttgataggagagtatgccggaattccaacagtaaagccaaaattcgtgtttaaaaatagacattttgaaatcgaagggccaataatttatgcggtgaattgtctggccataatttggcagttttatttgaactcaacaattagtaattatgatgaacttaaattaattcacttgattaactctcattttaaactaaatttgttgaatgaaaagagaataataaattttaatgccaaaaaggacgccgatgaaaaagaaaaagatgaaaaacaaatgccaattaatgaaatgattttacaattggccatagacacggattatcaataccaaataaataaaagtgtggaccgaataatacgaaaaacactggatcaaaatttggagaaaatgctgaaaaaagcggaagaaagggcaaaggatggccggccaaaagcgaaagccgatgaaataaatggggacaaaactttgataattttggattcaaaattcgacgactcaaagggatgggtgagggaggagtttttagggttggccggggtaggccgggtcccggtatttttaggaaaaaactggcccggatattgctgggtccagaaaagccgagccggacccatgtccaaatttttcaaccgggtccgggtatcgggtccaagtgggtaaaaaatccaaaaaaaaaaaaaaaaattaatttctaaaaattacttttttcacaaaaataaa

SEQ ID NO: 76073 - DNA, 1115 bp, Heterodera glycines
  Genomic contig location: Contig_ID=SeqID_12445; Location=975..2089; Strand=-
  SCN-specific regions: Sequence locations=1-171,214-380,402-600,628 -667,689-722,744-803,846-862,903-1044,1066-1115
atgcggaatacgaagaaatacgaaacattaaacaccccaaagacacaaaaagacaaaccgctaaacatgatacacgtaatttttactaacaaattctaaaaaatatttcaatcattcttaaaattttatcaaaaaattttcaaaatcattttatagtcacaattttttaccataaattcataaaagttataaaattattatttttttaaatttgaattctcctaaaattccttaattaaggtgtgattcccgccggcacataaaaatcctttttctcttaaaaaattgagtcaaaatcgcaaaacttttgtcattttttttggtgtaaatatgttaacaagcacacacaaagcccggcggcgcctaccggcacgccgcgacccccccccccccccccccccttgtagcccaaatttttttgaaaaaattcgccgtaaaaagggttttgaaaaagcaaaaaaggccgatcggtataattctaagctaaaataaaattttcataattgatttgaaaattttaatggcaacaaattcctttgcctacatcaaatttaaaaaataggtaaatatttaaagttttaaacagtatacgggtggaccaaaattccattttaaattattaaatttcagcccaaaattctttcgtgtccaaccatggctgcacgcaattacggattacggattacggaaattacggggttttgggagttacggattacgggttacggatttttgggatttttccgtaattttgatccgtaatttgacttttggattattttttcgagacgatttcttgtacgattatttttataaaaaacaaaattttctattttttatttaaagggctacccgtatttcgatttatttaagaattaaaatagatttataattttttatttgttgttgttaaggctatttgggtagttcgcctagaaaatagaggcatcacttttttgtcacacctatttttcacgcattttatgaaaattcataaaaccttagccaggtgaggggaggaattccccccttcccccgcccgaaatgaaaaattaaaaatttttacatgaaaaattgggacttttaatttttttttgtagatttttcttaataaa

SEQ ID NO: 76074 - DNA, 792 bp, Heterodera glycines
  Genomic contig location: Contig_ID=SeqID_12447; Location=480..1271; Strand=+
  SCN-specific regions: Sequence locations=1-133,157-296,353-402,440 -640,673-792
atgagaaatttgcaaaaagaacggaaagtgttggacctcgaaagatatatgcggaaaagagagcaattcgagcagattttaaaaagcaacaaaaggcaaattgagaaaaaacttccgtttttagaagaattcctggcaaaaaagccaaattcctttgaaaaaatctatgccgacaaaggcaaaacaaagacatacacaaatgaacaatatttgaagggacttaaagcaattgaggacgaattaaacaaatttgaattcgtttggtggcataatgaggagaaaagatggacaattagtaaaaaaattaaacaaaaataataataataataatattttctatttttaaaaatatgcgacaatcaaaatatttacgagttcaaagggctcatttaaatgcctttctttttaaattttatttataaatgaaaaatttttttatcacagaaacagaagcggaaaatgtcgcctctaattattaaattatcttgtcactttttgcaggtgatcgtccggcaatccgacaaattgtgtgggtggtccgacacgcggaaaaaagaaatggcggaacggaagacgaaacgctgacagagaaaggcgaagagcaggcgaaagaactgggcaaatggtaagaaatgactatttaatttgaaaaatagaattttaatttcaaaagtttggccactttttggacatttaattttatgtggccactttcacaaaatttaaattccaacaaaagtcaagtatctcgctttttaaaaattaaagccagaagactttgctgttttcaaa

SEQ ID NO: 76075 - DNA, 925 bp, Heterodera glycines
  Genomic contig location: Contig_ID=SeqID_12447; Location=1358..2282; Strand=+
  SCN-specific regions: Sequence locations=1-310,389-450,472-925
atgcccgttcctcgcgttaggttcaaaacagtgcccatcaccaaagtgttcgcgtcgccattccaacggacaatgcaaaccgccgcttctctgctgggcgaaggccatcgcgcgttcgttcacattgagcccggacttagcgaagtgtgaaaatattttaatacatttgataaaatccgaattttcagttcgagaagccatgcgatttgaaaattggacataaaaaactgacggagctgcacaaagacaaagcctttccgcacacaaacccaaactattggcctatgtacagcgaaaagtgagcaaatcgaattaattaattattatttaaatggaaatgtttttaaatttcattgcttttctaattaattttaattatattttatttgcctttttagagcactcaagctgattaaggcggaacgagaagagagtaagcggaaggaagaaagcgactgccattttgtggtggagcaaacactgcgacgcattttgacggaaaacaaaaatggtacgaaaattaatgcatttttttgactcggataatttgtcaccggccaaaacagtactcagcagggattaacaaacattgctttaactcagccacccatttgaccaatttggcccatttaattgttttttatggaactatttgggtaataagccaattaattgccaattaggacaatcgtttaattatactttttttggactttgcttttgttcagccgaacatattgtgctggtctcccaccgtgacgtcattggccacgtcaacgaattgttgggtggcaattgggccgtcgtcgacaccgctaccgtaaacaaatatgtacagtatgcgaatgggaaggaccaacagaaggaggatgacgatattctgagcaaatttgttattgagcacacgggagtgcacgtgcactaa

SEQ ID NO: 76076 - DNA, 2126 bp, Heterodera glycines
  Genomic contig location: Contig_ID=SeqID_12448; Location=322..2447; Strand=+
  SCN-specific regions: Sequence locations=1-215,261-815,837-990,1012 -1492,1514-1766,1788-1910,1951-2126
atgagtcatgcattccgtgtgccaccgccccatcgcccacagtgagaatttctccccattcattagggaatcattttgaagattttgtttatctttttcagagcaaagaggcatatcttctgtactacaaactgaccaactcaactaactcacaggccaagtgatataatattatcattattatttatacctgtgtactgttaccaaacattttcaaataaatatttttgtattattttaaaattaaaaagataaaatatcggactaaattggaaatactgactgtaaaattgcagtaacaaaagcgagggcgaaagaaacgacgctgacgacgacgacgacgatcaaactgagatagaacagtttaacagagaactcaatgaaatttgtcaaatgttgcgtgaacattaccgtaatgaagttccgaaaattggccgactttgcgcccaaatgagcgaaggaactcgccaagcgttggccatccaacaacaagtcccaaatcccgacgaagtgcaacaacaccgggagaacaatgctagggacaacaaaaacaagaattcgtccaacaaaggcatttcttcgagcaaaggcaacaactgtgacaatgccaatgtcaagtgtgaatcggtgagcaacaccaaacaattgggatcactaatttttcttagctcggattatcaatgccataagttaaaaagctcaaaacaaaatactgggcatgaaaaattaaaaattggagaattgccccattttttagggtttgcatcagaacgcgtggtggcaacaacaatttcatgaaattgagcaagcacttgataatgatgctgatgatgaaggcatttcgtctggcgagtgcagcgacaacggaaccaatgaaaatgataacaaaagtgacgacgatatcgaaagtgatgccgaaagtgacgacaaaccctatgaatgtgattgcgaaagtgctgaccacccaatggagtgtccgttgctggccgctcgtcgtgcgcttcgtcgtctcaaattgccgaccattcttgacatttgtgccgcaaccgaagcagaagtgcgacaatacggcacaaaattaagtgacattgtcaaacaaatcgccaaattacgcgttcaaaacggcggagcactgacaagcgaattggaattgcggagcagacagaaacaagcacaaaatctgctgcaacaaattggaaatttaatgccacaattggtcgttgaagaggaggaagtggcagaaattctcaaattcgtcgaacaaagcgccgatcgcttttccattggatttcgggacagaaagcagcaaaagcaattcaaaaaagcaattcgacagccaaaaaaggtgtgcagcaatttgaaattagcgagaagtttcttccttttatctctagtcgaatatttttggtattttgttatttaaaaagttacaaaaaaaattgctgagaaatttccaatgagtgaatggttggtttgcttaagctgcaaatttatatcccttcgttcaaacaaataattattcggctaccaccaccaacaggctttcgaggttctgttaaagcacaatttggacagtttggtggagccattttataaggactgttacaaaaaactgtattctattgacgatgaaacacgggaacaatcagaattgttcgtgaggcttttggccgaaattgcttttgtgcacgtcgtgggattaaggttacagctggaaatggtcagtagagaaggcatggtttaacaaaataataataataataatgcattttggcagtgatttttggatattttttatgggatgttagactagatcagctgatagaaattataaattacatcatagaaactaaaaatatttgaaaactcattaaacaactttcttattacttataatttgtgcacttttcaattatttataaaatttaaagatatatttaatgaatttaagtcataaaaatttgacaaaacatgctttcgtaggttttctggtccctttttcaacttgggtccgttaattattcttttatgccaaaatccaacagataattaattcctcctgtattgttcaggtggaaactgaatggacgcatattgtgcacgcgatgttgcagatgcgtaaatta

SEQ ID NO: 76077 - DNA, 255 bp, Heterodera glycines
  Genomic contig location: Contig_ID=SeqID_12449; Location=417..671; Strand=+
  SCN-specific regions: Sequence locations=1-255
atgtttaaatgcggtgtgtgtacttattctaatgttatacagtatacgtatctcccgtcggacattttctttgatggccttggcaacaaagttcgctcaaccgttaaacaaaccttggctgaacagagtacaaaaaatgcagaagtggcggaagcatttgcgttgctcaaaaagctcaaaaaacaccgcactcaaatggacagctgcgaaagtgtcggcacaaccgacgcggaaggggcagaacaaaagcagaac

SEQ ID NO: 76078 - DNA, 1020 bp, Heterodera glycines
  Genomic contig location: Contig_ID=SeqID_12451; Location=147..1166; Strand=-
  SCN-specific regions: Sequence locations=1-170,215-404,426-430,461 -710,737-835,857-934,962-993
atgaagaaatccgttaccatctctgtccctgagcaaaaagaaattaaccagcctaattcagaagcggagccaccaaagacggacactacaaaaaagcgcaaggtggaggaccgggagctatggaaactggcaaaaggaaagttcatgctagcgacatatttgtgcgaaggtaaaaatgaaaataattttaaattttgtgaaataaaatttttaagacgactgagaccgactgttccataaccaacagaaagttgcgcgcttgggagatgaccgtttcgcggtcagctttgagctctgtgaagaatgcgcgtgggccaattgtcgcgtaaccgatctcattgcccctatgaagaaaaagctgaacaatgcatgagagatgaattttttgagtgatcaacaatcaataaaatttttgaaatatttctctttctttaaattttatttgttaataaattatttagtgagaatatccccactgtgttcatttcgcgagtctttagccggtcgaccggatatctatgattaataggcgtcactcgtacagttgaatctgaacagtgatgggagggaggggggtgtggggatgagccgctgaaacatcattaattattagagggtgatgacaggcacaagaaagaccatattgttcattttttgccgtttacttaactcgaactgaaatgttagagaaatgggcggccagtgaagtgaaaataattaaatttaattatttttagtgattatcattttagcacttttcgccttatccgttcgacacgacttcgtcgttttcgccatccgttctgcgtgaatcgttcgatttgctgaagcagcaagaaaatgtgcataacatcatggccgatccgattctgcgccacggcaatgtagagatggcagttgtgcaaactgctctcgcatcgttaaaacggactatttcgtcatcgtcatcatcatcggcatccccaccacctgaggaatgatatactgtaatgcttatttattattattatttataataaa

SEQ ID NO: 76079 - DNA, 623 bp, Heterodera glycines
  Genomic contig location: Contig_ID=SeqID_12452; Location=6..628; Strand=-
  SCN-specific regions: Sequence locations=1-302,324-623
agctgtgcttatatggagcgcttggcaggctgcctaatctgcgggcctcactggaccgtcgctttctgccagcgcctctttgcggacactaacgttgatcaccaaatggttgctgacaacccgctggaggctttcgcgaattggctggtgtttcaacttcaacttccaaaaaaatatgacacacgcctattcgcactttggtggccgctttgacatggtgctcgtcttccgcgagctgttcaagattgactttaatcccgagatgttgcgacgggtataaattttttaaattttaccttatattcaaaatttcagggaaacaaaatgtatgaaatgaaggtgcggaagcagaagaggcgcaacccaaatgtagtcttccgtgactcgttcaatttgatgccatgctcactggcagccctgattcaatcctacggccttaacgtcgaggacaaacccttcttcccccatttggccaatagaccggagaactacggcagtcagatctaccctacgcctgacgactatttggccaacgggatgatgcctggaaagaggcgacaatttgatgtgtggtacgaacagcaccgtgaggagccatttattttggacgaggcattagcaag

SEQ ID NO: 76080 - DNA, 452 bp, Heterodera glycines
  Genomic contig location: Contig_ID=SeqID_12453; Location=879..1330; Strand=+
  SCN-specific regions: Sequence locations=1-128,182-270,293-406,429-452
aattattgtgatcggcgacatcagcaccggcaaaacatcgctgatccagcgattcattcacaacagcatgtcaggaaattataagcccacccttggggttgattttgccaccaagtaaaatcaatatgaaattttaaaattcaaattttcaaattttgaattatgttttttcagacttgttcagtttgaggatacgttagtccgactgcagttttgggacatttctgataagttttttgccccgaatcatgtcgaagcttaagctaaccctattaaaaaataaataaaaataccgcaatttttattccgtcacccttttaatgattaaaaattgggcagctgggtttttttttaaatattttttgatatagtatgccaatatttttcaggccaggaacgttttgcaaacatgacccgagtgtactacagggattcgcacggtgccatttgtg

SEQ ID NO: 76081 - DNA, 286 bp, Heterodera glycines
  Genomic contig location: Contig_ID=SeqID_12453; Location=396..681; Strand=+
  SCN-specific regions: Sequence locations=1-125,150-286
attttctaagaaaaataggagttttgggggcgcggcggtgccgataggcgcacccggggaaaaaaattggaaattttgatcatttataaacagtttttcactgaaaattagccaatttataggtaaaattttgaaaaattttatgggaatttaatccaattcttaggggtgtaaaagtcgcatttcgcgccaaaaagcgaaatgcgaaaagcgaaatgcgaaacgccaaaaaatgcgaataatgcgaaaggcgaaatgcgaaaagcgaaacctcggcccatccctg

SEQ ID NO: 76082 - DNA, 822 bp, Heterodera glycines
  Genomic contig location: Contig_ID=SeqID_12454; Location=868..1689; Strand=+
  SCN-specific regions: Sequence locations=1-231,253-505,560-626,648-822
atggaagaaagacctggattcaaagttgatcttggacaatgggcagccaatccccgccattttggtggccaacaaagtaattgggagcgcaaattttgtattaaaattttgggaaaaaaatcgacgaattaagtgcgacttggaaaattcgctaaacacagaaatgttggacgattatgcaagacaaggcgcattcagagctgggttggtaaatgaatgaacggataaggcaaaaaagggaaattatttaaataattgcagatttaaactgagtgccaaaacgggcgaggggattgagtcggcgatggacttccttttacggtatatatttgaataaaccgtagtactgtattgtacaaaaaagaaagataggccaactgtatgattaccgtattctaagggattatgacagataaattaatttatgaaattaaattatgtctctacagaagtgttgtcagcgcggaacgtgatggcctttatttcatgccaatggtaaacaaacaaattaattttacattttttttttacaataaaatgcttttttattttaataatagagcaccgtgaggctggctctattattcaagggggaggctttaatggagggggggggggctcttcgaattaataaagtaaataattatgccaaaatatgttccaccatatttcagctacaaagggaccaaaatttgcaccgtttgtcagcccaagaattggagcagaaaaagaaacggatgagccggaaaaattatttccaaaacgcttgttgttgaataaatacataatatgtaatttatttggcttttttttgtaatataa

SEQ ID NO: 76083 - DNA, 1186 bp, Heterodera glycines
  Genomic contig location: Contig_ID=SeqID_12457; Location=44..1229; Strand=-
  SCN-specific regions: Sequence locations=1-174,222-298,333-353,387 -413,435-517,573-602,625-769,810-875,916-960,982-982,1011-1186
agagagaattaagacagaagaagcgaagagatttcctgcagctttacagcgaaacgctaaaaatgataatggaagaagcggacaaagtgtcgctgcttttgtaccgatggggcgccatcagctggcaaaagtgggaaagtgttaaggtgaaaaggaaattcagtaaaaattgtcaaaaattaaattaaatttaaaataatgtaagattttttaaaaatataccatgtttctcgattctcgattaaaaaatgtcgtaattcctcgccctacttataaattaagtttgaaacaatagcacaaccaaaatcttcaaataaaattaaagcataaattttgtaaaaaccgagaataggatttttaagaattattatttttaattttttttagtgtaaaaacaattttcaaaatattccgaatatttagaaaaatataaataaaatcttcgacttgtccttcgaaaattgaatttgcaaaaaaatatttaatgatactttgaatttcagatcacttcttaaagtaattaaagataataaaatattaatattattttatttatttgttataatataaaaccctggaatgtttgcgtctttaaatattttaattgtgaatttaattttatttctcagttttttgtttttggtttcagaatgaatcccaagcagcgatcaaagtggaaaaagtggtgacgattttgttggatgatccgtcagcatttgatcatttttgcgtggcattattgttgtcacagcaattcaaactgttcaagtaattaactatttttttttatttttcatttttttattttagcattttttacgaatgcgccgacttcaaacagtaagccgatttcaacaaactgcaattgttgacagataaattcaataattttttaaataataaataaataatttaccgtaatatccaaccatattcctttgtgttaccgtatgcaattgattttttattttcaatgcttttgaaattaaatttattatttttttaattttcaaattacagaatgcaatttctactgcacaattttgttgccgcacttcaccaacacaacaaacagcagcagaaacaattggcggcgacaaatgggtcaaataattcggcaccgaatgtttgcccggcgccgcccattgatgaaactgagcaaataatggcaccgtttccgccgcca

SEQ ID NO: 76084 - DNA, 1107 bp, Heterodera glycines
  Genomic contig location: Contig_ID=SeqID_1805; Location=348..1454; Strand=+
  SCN-specific regions: Sequence locations=1-50,72-236,258-273,298 -299,321-922,944-947,970-1107
atggatcacaataccttttggaatagaaaaaaattaattcaatatatgggaacagaagaaaaagttgtgaaatggggttcagaccatgggtttataccaaaaactgctttttgttatgggaaatggcctaaccaacatgcaaaacaagaaatggttttcgagaatgagggcaaagtagggaatttccgatgcccaaaatgtcgtaaaaagcaatcactcttaattaatacatggtttgaaaattgccacatgcccctttctaaaattatgaggtattttaaattttttttaaaaatagattttgccaattttctatttagtataatgtactcctatgcgcacgaggagtcttacgaaaaatgcacaagggaagcagttgaaaacgaaaacggcaccttgttaggatcagatactattacagcatggttattttttacgaattcatttttattaaattggaatattaggtacaaatattgtcgtgaaatgattgtcgaccattacattgttagggagggtgagcgtgatcaaattggcggcgtaaataaactagcacaattggacgagagcaaattcgggaagcgcaagtataatcggggccgttgctctcgccccactacttgctccgtcttcgaatgctcccttttgcgaagttaaaaataaggttaccattatttctaaaactaaaataatggttttcatgttaaggaatgatcgaatacggatctgaggattttggccttgtggcttgcccggaaaagattgattcgagtgcggatgttctgattccaataattcaacaacacatcgcgcttgggaccgaaattcacattgattgttggcgcgcctatgctcgactgactgagtttggctacttgaacaaagtcgtgaatcattcagatccggaaaatcgtttcgttggtatttaaataaaaatgttaaattaggatttatttttgtaaattttatctgcggatggcacacatacacaacgtatcgaggcgagttggaggcccgcgaaggactggtttcgtgagatacgactacctgggttccattttgcagaaactttggtcgagtatcaatggcgccgggagctcaaaaata

SEQ ID NO: 76085 - DNA, 528 bp, Heterodera glycines
  Genomic contig location: Contig_ID=SeqID_1808; Location=2161..2688; Strand=-
  SCN-specific regions: Sequence locations=1-9,31-528
gtggaatttctggaccgcaaaaacgagggccaatgcttccttttcgatttggctgtagtttttctgcgcgtcgttgagggtgcatgacgcgtgctcaatgactttttctgatttgtccggaaaaatagggctgattgtggcgccaattccgtcttatgatgcgtcagcagctacgacgattggaagagacgggtcgaaatggatgagcagtagatccgacagcatgatttctttggccttttggaaggcgttttgctgttcgtcggtccattcccatttcacgtcttttcggagaagttggtccagtggttcgcggatttcgcgcatggacttaataaatcttccataataattcaatacgcctaggaatgagcgaagtgtgctcaagttatgtggtggcggcatttggcgaattgcttctgatcgtccggggtcggggccaattctttcgcagagatgacgtggccgagaaatagcaattcgggctggaggaatttgcacttttccaattggatttgaggccaaatt

SEQ ID NO: 76086 - DNA, 4159 bp, Heterodera glycines
  Genomic contig location: Contig_ID=SeqID_1808; Location=1..4159; Strand=+
  SCN-specific regions: Sequence locations=1-558,581-1535,1557 -1661,1683-2658,2680-2947,2969-4159
tgttaactcaccccattctgtacgcgtgctcgtaaagtgaccacaatacgtcgggtgtcccagtttattcggtgtgaaaaattaatcaagcaaagatcttcgctccaaaattctgaactggaacggtggtgtgaaagccgcgggacaattgggcggaaggtatgcggaaacatttgcagataatgtgccactgcttgccgaggaacattgaaccgtcgcggagacacaaaatggtggagaaattgaagcggcgggcggaggggccgtggaacacgcaaagcaggacggaacagacggtaactctgaagttgttgttgcacatgcggtggcagctgatcagcaacaacactgtacatagtgttgatctcggcgttgtcgattacctaaacgtatgtttaaaaagcattatcaggctttgttggagtgttaaagaatttgaatttggcgcccatcgattattgattaatgttgtgacgtgtcaatccctccccttattcattttgtttatttaagcactccttccttccccactttgttccttctccattcatttgctattttacattttatattttgtactgcatttctcctccgacataaattgtgtttattattttattgtgtgtccaaagttgagacacaacaattggcgcagtcagcagccgtgcttcacccattcgaagacacaccgaactgcaacccaacctcaacaaaaccaatagtcccaagacgggtgaggtccgctaaatttagcggttaaattcgacaaaaaccaatagaccctaggcgggtgaggttccgcaagacgcggttttcttcaatttcgacatccaatagtccctaggcgggtgaggagccactctgcgtggttaagtgcgatcgtcggacgagtcaaagccaatggacgccacccaactgcagcaagtgcttgatgcagtttttgcacgatttgccagaaatgcggcacctgcaaacgcggcctcatcttcattggcacacgcgactttggcaagttcattggacaaccggatcgccaaattccattacgacacggaatgcggcaacacatttgaccggtggtttaatcgatttggagtgcttatcgaagaggacggaaaggaacttcccgaagcgaccaaagttcggcttctccttggaaagttgggcgacgacgaatacagcaaatacagagacagcattagcccgacccaaccggaccaggttaaatggggcgaatcgctgacaaagctcaaggatttgttcgccgaaacccgctcacttttcgtccgccgcttcgaatgctttcaaattcgacaaaagccgagccaagacatcacatccttggtggcacacatcaacgccgcttgtgaaaatgccgacctcagcttgacgaaggagcaacttaagtgcatcatcctcgtgattgcacttcgcgacgagcaccacgatttgcgccaaaagtgcctaaaaatgctcgaagaagcacagaaaaacggcacgcaaatcacgctcaagcaaatcgaagaggagttaaggaccattcagctggtgaaggacagcgcactcactttggcaaatcctcctgttgcaacccatgccattcacacccggccacaacagtggagggacccgaaaggcaaaacaccgcaacaacccaagagggccaacaatgccaaggagcaacgcgcacgtccaccaaacaccaattacggcaaggcaagccgcggatcaccaactcatccgtgcggctcatgtggagaatcggatcattggcgtacggattgccgattcaaggacgccacatgccataaatgccaaggacaagggcacattgcaaaggcatgccgacgcagctccaaccaagcgaaaaatcgcagagagcgatccgtccacactgtcgttgtcaaatcccactgcatgggaattggaaccgcagcaggccgctggtggcgactcacgttcatcatcaatggaattaagattttgataaacatcgacactggtgctcaggccaccattctcacactcaaaacgtggaaaaagctgggttctccaaaactcgacaaagccgacattgaaacgcggaattgtaatgaagttccattcaacgtcgaaggaaaatttgtctgcaccgtttgccaaccaaatcaagcacacaaaaatttggcctcaaatccaattggaaaagtgcaaattcctccagcccgaattgctatttctcggccacgtcatctctgcgaaagaattggccccgaccccggacgatcagaagcaattcgccaaatgccgccaccacataacttgagcacacttcgctcattcctaggcgtattgaattattatggaagatttattaagtccatgcgcgaaatccgcgaaccactggaccaacttctccgaaaagacgtgaaatgggaatggaccgacgaacagcaaaacgccttccaaaaggccaaagaaatcatgctgtcggatctactgctcatccatttcgacccgtctcttccaatcgtcgtagctgctgacgcatcataagacggaattggcgccacaatcagccctatttttccggacaaatcagaaaaagtcattgagcacgcgtcatgcaccctcaacgacgcgcagaaaaactacagccaaatcgaaaaggaagcattggccctcgtttttgcggtccagaaattccaccgaatgttatttggtaggaaattcacgcttctcacggaccacaagccattgctggctatatttggctccaaaaagggaataccgatttatgcggcgagtcgtcttcaacgctgggcactgatcatgtccaattacgaattcgacataaagtacatcaacacgtcatcctttggacaagccgatgtactgtcacgcttaatcgccaattatccccggccggaagaagacattttgatagcaaatatctgcacagagacagattgctacatcaacaccatcctccaaactgcaactgatcaattgccgaccacgaaagcagaaatttcagaatggacaccaaaagatgaagtcctccgaaaaatttctgatcacaccaaaaacggctggcctcaaaagtgcaccgaccccgatctctcaccttattttcctaagcgaaaggaaatttaagagattgatggagttttgctctacggaaagcgagtgatcgttccgacccaacttcgtgaacgcatcatcaaggctctacacatggcacaccccggaattgtgcgcatgaaagccctcgcccgtcagcacgtgtactggcccggattggacttggaaatcgagcgtatggtcaggcaatgcgaagattgccagagcgcccaaaagagtccacccaaagcaccgctcgctccatggacgtcttgctcacgaccattccaacgcattcacattgatttcgccggtccatgttcagatggccactcctatttgattttgattgactcattttcaaaatggcctgaagtataccgaatggaccgaatttcgacaccagcaacgctccaagtcctccgatccattgtctaccgcctcggatttccagaagaaatcgtgtcagacaatggcactcaattccatgccgcagaatttaaggaattttgtgacgaatttggcatcaagcataccttcaccccgccgtatcatccgcaatcgaatggccaagctgagcgattcgtcgatgcgttcaaaagggccatgaagaaatgcgccaaagatggaaaattttcggcagaaaagaagcttctcgcctacaggacgacgccgaattcggcactcaacggactttcccccgatcaattgttcttcggtcgaagactttgcactcagttgtctctcgtccacccaaaggaagaacaagccgaagtcattgacccagccaaaatccgcaaatcgcaagctgattatgcgcgaaaaatggcccgtcaatttgatcaacaccacggagcaaaaccggtcgaatttctgccaaaagaccccgttttactgttgaacttcaaccgtggaaaacgattttggcttaatggaacgatcatcgaaagattggaaaaatccccgacgtatcgcgtccacgttccggcactcggaagagccgtccatcggcacgtaaaccaattgcgccaccgttatcctcttgaagagaacggta

SEQ ID NO: 76087 - DNA, 81 bp, Heterodera glycines
  Genomic contig location: Contig_ID=SeqID_1808; Location=4604..4684; Strand=+
  SCN-specific regions: Sequence locations=1-81
gcgcaatgattggacttgcgaccaaagaaatgccattgtacggaagggttggcacttatcctaacagttacggacaccgaa

SEQ ID NO: 76088 - DNA, 392 bp, Heterodera glycines
  Genomic contig location: Contig_ID=SeqID_1808; Location=4570..4961; Strand=-
  SCN-specific regions: Sequence locations=1-91,127-200,265-392
atgactccattctttgcagttgttccaattgctcaattctggccttcaacagtcgcaattcttcacagtgagtcaaatttggaaaagttgctaaaaaattttaaaattaaaattaatttttataatgtatttcaccgtttaccatgatcagtgtaaagacagcattttgttgaacacctcgaataaatgacatgattatgaaatttaagaaaaattttaattgaaatttatatgaaataaatctgaaaatattttataatttttgagaaaaaaaggcttcggtgtccgtaactgttaggataagtgccaacccttccgtacaatggcatttctttggtcgcaagtccaatcattgcgcatgttgtgtctcaatgtcggacacaataaaataa

SEQ ID NO: 76089 - DNA, 998 bp, Heterodera glycines
  Genomic contig location: Contig_ID=SeqID_1808; Location=5164..6161; Strand=+
  SCN-specific regions: Sequence locations=1-95,161-307,398-458,491 -601,650-747,769-782,829-998
atgcgatcggaaaatggagaacaaaatgaaggagttgctccactatcagcagctgatcagcagcaactgaaggcgcgtgaaaaacggagaagggcaattaattgttaaaataaataaaaatgaaaatcgaaattttattttatttattttaatttttttaggaatttcgtcaaaactttggcaaaatgcaaatggaattgcgggaaacaatcgaaaaacttgtggctaaagttggcgaattggagaagcaacaacagcgccaaaaggtcaattaaatgggagggaggggacaaagtccacaatattctaaaaatttaatttaatttgaaattttcaattttttcaatttaatatataaataaataagaatttttccattaaatattttaaaaaaaatgttatttcattcgacagaacaacgcgggagtgttcacaaaagtgaccgttgcaatggttggaaataattttaaattataataaattttaaattcagcagcaaaattgttgggatggcaccgcttgccccagagaattggaaatcattggtgccaaacgtttgatggtccaatacaaaggaaatcgcttaaaaggtaattgtcacaaattaacaaaaaaattattaaagaaatttaataattaaaattaaaatcactttaaatacgattattttaattgaaaggaagtcgctcaatgttcacaaaacgctgcattctgagcacaaattcgtccatttcttacgtcgaagtgaaaatcatcagtatgaaaatgtaaataaatcttagaaaaataaaaatataatttaaagtttataatttataataatttttaggtgcgcaatgattggacttgcgaccaaagaaatgccattgtacggaagggttggcacttatcctaacggttacggacaccgaagcgatggccttttttgggtcaacggttcctgccaaattggcagtcaaagtgccaaatttggcatcggagatgtcatcggcagtggc

SEQ ID NO: 76090 - DNA, 1816 bp, Heterodera glycines
  Genomic contig location: Contig_ID=SeqID_12458; Location=1379..3194; Strand=+
  SCN-specific regions: Sequence locations=1-248,282-682,704-1816
  Gene Ontology: Mol. function=protein binding; Biological process =signal transduction
atgatcagagccgttggaaatgtcattacagcaaaaatatctgagcaaatttcgcagtcgggtgtatttggagtgattgcggatgaaacaatggatatttccggttatgagcaattgtcaataagtgctcgaattgtgaacgagtctaatcaaattgaggaaatttttttgggatttgtcgaactcgaagatcaaacggcagttacaatttcaaagaaaataatttttcttttgcgcggtagttttagttaaaatataaaaatttaaaaaaattaattaaaggtaaatatgggcttgatttgtcaaaaattgtgggccaagcctatgatggagccagtgtgatgagcggtggtcataatggcgttcaggctattgtcagacgtgaatcagggtgggtattgtgtttatttcccctttcaaatcaacccaaattcaaaaaggcctgcggcattttatgtccattgcagtgcgcatcttttgaacttaaaactttgcgccgcattgaccgctaatcactatcacaatgtttttgactttcttggaaaattgacaaacttttttcactgctcggcaaaaagaacgaaaattctcgagcggtcaattgacgcaatttcttgttcaaaaaaacatcgcattccgactttttcggacactagttggaccgccaggcacactgtaattgaggcagtgaaagagcttttgccagcagtcattgcagcattgtgtcaaattcgcaatgaagatgcagccatgagatcggaggctgcttatttgctcgatttttttgcgcaaaatgagtttcaattttgttttatcatgattgacaaagtgatgtcagcaatgaaacccttgacacttctgttccaatccaaagaagttgatattgaaaaggtaaaatctctttttggcaaaaaaaaaaattacaaaaaatcatggccaacgcgcaatttgtctgtttaccgattcattaaacaattggattgatggtgttgggttcgggacctttgagaattgcaagaaagatgcattgctgattcggtcccaaattgtggaatcaaattatgaacgaagaaggagcggccgttttcatgtggccgagtcagattttgatgaatttgaggaaccattttttaattttttaaattcactaaggtagcaaaaaagagcttaaaaataaacaaaaaaaattttcagggaatcttttgccgaaatgttcaatgattcaacaatggaaattttaaaaagcctccagactttgcttccctggaaaatcacaaaatcaaattatggtctcttttcagccgctgccaaattttaccatgaagcaaatattttggaatgttcagaatatcaaattcaggtcatgcagtgaattgttcaaaagtgttaaatttatttagtctgaatttgaacaatggaaaaactattgctatggatttaatggaatggaaatgaatgtggccttggaacattgcgactcttcgttttttccgaatgttaaaaaactcttattagttttggctagcattccaattacttctggtaataccaaaaaaaggaaaaattaaaacaaaaactgtttagttactgctgagagatctttttcatcgctacgtcttctaaaaaattatcttcgcaataggatcaaaatagagcgtttgagttccctagcgctcgcttatattaatcgcgacatcgatttttcggttgatgatgttataaatgaatttgcaaaaaagaatcgaaaaattgattttgcacttggcaaagaacattcagcggaagagatggatgaagacgaaaacatttcgttata

SEQ ID NO: 76091 - DNA, 59 bp, Heterodera glycines
  Genomic contig location: Contig_ID=SeqID_12459; Location=289..347; Strand=+
  SCN-specific regions: Sequence locations=1-59
aggcaatgacggtcgacggaatgccaaggcatcgagtgcaccagggcagatgggacatg

SEQ ID NO: 76092 - DNA, 2243 bp, Heterodera glycines
  misc_feature (1253)..(1253): n is a, c, g, or t
  Genomic contig location: Contig_ID=SeqID_12459; Location=1923..4165; Strand=-
  SCN-specific regions: Sequence locations=1-464,490-534,557-1811,1833 -1844,1890-2067,2089-2192,2214-2243
atggtggaggaagcggcacttttggcactcagcgtactgcccgaggcgaattcgctgttgccaacggaaagccaaaaggcgctcaatcagtgcaaggagcgtggcaccaaactgttggaagaagcatgtttggcggtggagaaagcggccgagcggggcggcgtttaccccgaggcaagaggagggagcaaatttgagtgtgggaagctaacaatgaagaagggcggtcaattatgaattaaatagtctttattggtcaacgtcccttcgttgtgcaggttttgtttcgagttgcccaccattggtacgacgacctgtacttggcccatttggagaacacccagcagcagcaggcgacaacgacggcgcttccgcccccggcccatccccagccgacccaacgcattgccccgcagcagtgcgtcgtccgtctgatgatgcactccccgctgcaccactcccaccagtcgcagcagcaacagcagcacttcttccccgtccattctgccgccgcttcgacttctgctgccgttgttttttccccttccgttcccccgccgccgacgcccccgcagcaatttgttgggcccaacgttgtcatccatcctcagcagcacaacctcagcaccggcaacaacttcatacagtacagccaccatctgcagcttacgcccacagccgtcccgctgttccacggccaaacggctgccgtctcaatggcaccaatgcttcacaacggtcaggcgccatcggtttcatcctgttgttttctctcgcttccccctcctcaactacaagcagtacagccaccaacagttgtggatcataaacaaacatctcagcctcacctgcagcagtctgttgcccaatttggttcgaccattggctaccctcaccatcatcatgtcactgctcaccagccaccgctttccacgccacctcccccactgatgctgatggcattgcccggggcaaatgcagccgccagcgctttccccccgaggcacattttgcaaccgacaccagcacaacatcagcttccgaactacacacaacagcaacaacagacggcaaaccaacaatggacactgcaaaagggaatcggcaaacacagcatcggattgaatggcgagcattgcaactgtgaaagaatgcgcatcggtgcggtattgcggcaatgaacggactgcgcagcacggaaagcgcgtccgccaaattcgccaaggtctgccgaaccgttaatttggatgccncctccctcaattttctatttttctttaacagaatccgccctcttccgacgagatttgttggctgctcgacgtgtccctggagattggcgatcccgactacgtgcggctgtttctcgagaaggtgttcgcctgtgtgtactcacccttcgtcctcctccaattgctccgcggcgttttcaaagtctgccgttccgtcccctcctctttttttccaatatttgtccccgtttctcagtttttccaacatttgcccggtgctttgcgtctgctcgcctcgagcgacgtttgtcttttggcctcgcaaatggccaacagcggacaggcgaagacgtgcattcagcaggcgaagtcggccatggaattgcatccgatggccggccccgtggaggagttgctgctccacgccattctctgctgcttcaacgccgcctcccacaagtgaacgccggatgcattttctttggggtgaccaatctcattttcagactgagctacccaaacttcagtgcttccgaccaggaatatgtgagtgagaaggaaggcagaaatactattcaaattgagagatgcacccaaaaacctcgccgcaggaatttaaaatttttttaaatagaaaaaaattttcaaaaaaaaaaacttcgtaatagattaggccctaatcgttcattccccctcaaatgtggcgggtggtggaacctctcctatctctgatctgtttactttgccctttgccacgcttttgtttctcagatttgtgaattggcactggtggtgcgcgacattttccgccacattccgccgtaccatcatcctccacaccatcagcagcagcaggagaacggaaggagaaagtacatggatttgttcttggagcatttgcaggagcaaaaggcattcaaaaaccgaaagaacggagggatggcggcagtgagaaacactttgtcacaacagcagcagcagagacagctgacggacagatccgacgattaa

SEQ ID NO: 76093 - DNA, 462 bp, Heterodera glycines
  Genomic contig location: Contig_ID=SeqID_12461; Location=486..947; Strand=-
  SCN-specific regions: Sequence locations=1-63,86-408,430-462
gttcggtgtctcctccccctcctccgtcttcaaatgaatgccctcctccgcttgtgccatgtcagtatgaatatttggaccacacggccgacgttcagctccacgcgtggggccaatcgctgggcgaagcgttggagcaactgacaattgcgctttacggtgatcgcttttcgttgcttttgcgtttcattccattgtcaagggtatatgaccatcgaaattgaccgagttgagcccatttacacgatggacttctccgcttccggccacgacctttccgcattggttttggcattttttgaatttattttcgttttttaatttaatttcgcttgtaaggtttataatttgttggacaattgcctctacagtttttgtgctgagccttttttcattggacggttcgccaaatttctgaatttgaaaaaaccatcgggaaacactggcgaagaattgtcggtg

SEQ ID NO: 76094 - DNA, 725 bp, Heterodera glycines
  Genomic contig location: Contig_ID=SeqID_12462; Location=476..1200; Strand=+
  SCN-specific regions: Sequence locations=1-725
atgaagcgaaccaacgcatcaaacatcactccacctcgcgccaaacgtgcaatgccacctgcactggacctggaccaaaacactgccacactcgaagagcaagaacgccaacgcaccctggtcttcattggcctcccggaaagcaacgccatccgcccatcggagcgtgttcaggaagacagggaagccgccacaaaaatcctggaccatcttgaagttgaggccgaaccaaccgccgtctttcgactcggccggttcgacccccagcgaacaacacctcgcccgctcaaggtggtcatgccgacgcccacacaccaacatgtggcactcggaggatggaagcacgagcgtgctcggctccgttcccaacagaacctgacccgtctgttcgtccgtccggcgctgtccaaagaacaactcaaagaggaatacgaagcgcgtctccgaaaacgccaacaaaacccagctccgatggcaccggcaactcagctcccacagacaaatgccccgactcccgttgtcgaagatggaccaaaccagaagaagaccagtgatgacattcccaaacaaccggaggtttttgacgaaacaatcctcgtctgttatgaagcactaaactcatttccacccaccgacaaaattgttcaccaaattcaatcgctcaaaaaacaataccctcatcttttcaacaaatagttctaccagacctccaacaatttcttcaa

SEQ ID NO: 76095 - DNA, 1388 bp, Heterodera glycines
  misc_feature (1307)..(1307): n is a, c, g, or t
  misc_feature (1310)..(1311): n is a, c, g, or t
  misc_feature (1322)..(1322): n is a, c, g, or t
  misc_feature (1327)..(1327): n is a, c, g, or t
  misc_feature (1332)..(1332): n is a, c, g, or t
  misc_feature (1341)..(1341): n is a, c, g, or t
  misc_feature (1345)..(1345): n is a, c, g, or t
  misc_feature (1350)..(1350): n is a, c, g, or t
  misc_feature (1354)..(1354): n is a, c, g, or t
  misc_feature (1359)..(1359): n is a, c, g, or t
  Genomic contig location: Contig_ID=SeqID_12464; Location=67..1454; Strand=-
  SCN-specific regions: Sequence locations=1-554,577-835,862-936,961 -1077,1099-1216,1239-1388
  Gene Ontology: Mol. function=phospholipid binding; Cellular component= soluble fraction; Biological process=regulation of G-protein coupled receptor protein signaling pathway
atgtacgccttgaaaaagttggagaagaagcgggtgaagaaaaggcacgccgagtcactgacactgaacgaaaagcaaattctgcagcggatcaactcgccctttgtggtcagtttggcgtacgcctacgaaacgaaggacgccctttgtttggtactcactttgatgaacggaggtcggtcaactgagtcccgcggacgatggacgccttttctgatcgaattcgctttaaaggcgacctcaaatttcacctttacactttgtcccccgggggctttgatgagagaagggcccaattctacgcggcagagatcactctcggactgcagcatctgcaccgggagagaatcctgtacagagacttaaagccggaaaatattctgctggacgattacggtacccccaaattcggatactgtattgcattcattgtacagcaaatacacttcactattcttaggccatgttcgaatatccgatttgggtttagccgtcgaactgaaggacaacgagcccataaagggacgagtgggcacagtgggatatatgggtgagagggggaggagaggggggaagctaatccggagctaaaattggcatttgtagtggcaataagccaaatgggggggggtaggaaaaacaaagtaatggcacgcaagggaaaagggaaaaatgccattgaaagcaaaggaatgggagagtttttgaatgcaatgggaatttttattttttgcagcgccggaaattgtgaagaatgaacgttattcgtacggcgtggactggtggggattgggctgtttgatttacgaaatgatcgaaggaaaggtaaaaacggaaattataaaatatgtaattaataaagtgccgacattagtcatttggtgattgtttttgccttttgaggcgccgtttcgccaacgtaaagaaaaagtgaagcgggacgaagtggagcggagagtgcgcgaagacacggaaaagtacagcgacaaattcacggaggcggcacgcactttgtgtcggggattgctgcacaaagagccgactttgcggttgggctgccgccgcgtgggacggccagaggacggcgcggaggagctgaaggcacacgcgttcttcacgcagccggaccaaaagacgggcagagagccggtcccatggaggaaaatggaagccgtaaaggtgggagaagcccagggaatggtagttttggcatggcataatttgaatggttggcatttcattgtccatttgttcagctgccgcctcccttccaccccgacccccactcggtgtatgccaaagatgtnttnnacatcgaccanttcancaccntcaaagganttcntccanttanaccantccttttccatccacagaccattcctcag

SEQ ID NO: 76096 - DNA, 2439 bp, Heterodera glycines
  Genomic contig location: Contig_ID=SeqID_12469; Location=135..2573; Strand=-
  SCN-specific regions: Sequence locations=1-195,221-345,371-375,398 -441,463-1104,1130-1298,1332-2003,2025-2203,2225-2279,2301-2439
  Gene Ontology: Mol. function=receptor guanylate cyclase activity; Cellular component=integral to membrane; Biological process=receptor guanylyl cyclase signaling pathway
gaaacgcggtgaaacaacgcaaatgccttattatgtgccggaacaaatgatcgcttttgtggacatggactacggtggatcatcggtcggtggcatggcaaattaattcattatccaaatgggcatttatttaacgaacattttgatttattaattggttttatgacggtgaaagtgcaaaaataaaaattgacatttaaatttaaatcaaatgaatattttagaacatttcaatccacagctttcaccagcacttggccaaacgcgaaaaggaggaggagagaacggacgaagttcctgaagaaatttacagtcgcaaaattgcgaccattgaacagaagtgagaataattaaaattaattatttaattgaccgttttgttttcccttttagttttgtcattgtcgaaagttttcgcttacgcgagaaattgtccttcaacaaaagggacactcagcttctttttatggtcccttaacagatcaattaattagtttgttcggttttactaattaagatgaagcaggctgtccatgacaacataaacgctttcattggcttatgcgtcgaacggccgaccgacgtttgggtcatttggaggcattgcttccgcgggacgctggccgatttgctattcgtcaactgccagcacaagtggccaaaccctgcaaattctgtcgcaccttttcaaaagacaaaatttgctttagccgtcccccaccccacaattagtgctaatgatgcgattagtaaagtaatcgcagtgattaaggtcgattgagtcgcgggtgaacgacatccgtgccagtgtggcatccattgtcagcgcacaccaacagcagaggggggcggagggcgacggagcggtgccacgcagggacattttggacaacaatttcaaaagtgccttcgtcagagacattgtcaaggcaaactggggcggggtttctcattcggtttaatgtccgctttgtcccaatttgatattccagggtctcgactttctccactcgtcccccatcggttaccacggcgcgctgacttcgacgcgatgtctaattgacagtcattggattttgaaattggcaggtgcaaactgagcaaacggagaagcattggccagacgcatattcattttcaggctttggaacttctcgtcttttgtacaaatggcgacacaacggcattttgagcaatggcaatggcacagtcattcagccactgatcccaaacgaaggtcggacaacgaaaggggggagggcaaatttaaattgtcgggagggcattttgggggagtgtttttttaaacaataaataatttaaaatattttcggccttcctttagaattgcattattatgcccccgaattgcgcttaacaattcgttcagccgttgtgcggaataaacctgaagaaatggtaaatgagtgaaagggcaaaagtttatgacttttggaaaaacaattaaggaatttaccaacgaagaaggccaatcgcacgatatgtacgcattcggcgccattctctacgaaattctctaccggcggaggtttcgtttttggtttttggaatttcttcaaattttcaaccgtttttcagaattaacgatgtaacggagtccggcgacggttagcccatttggcaaatgtctgtcaatccgttaattatttatttgcccaggcgccggccctttggaaccgatggaagacgacgtcggcattttcagtgcccaagctgaagagcgcctgccgattgtgcccgaatttccgggcgaagagactgtcgccccgggcgccaacactccccggtcgatggtcagctcaattgaccgagtacaccccgatttggtggcactgatgcggcgatgttttggcacccccgagcaaaggtgccaaaaggaataatggaggaccaattgctcaacccatttttgaataatttccccaattagacccgatgcgaacatggcacggaaaatcactgacgcaactctgaaaatgtgatttggaagacattttaaaatacacaaattttcgttataggtccggaagtttggtggaccaaatgatcaaaaacatggagcagtacacgggtcggttgggcggcgaaattcgattgaattatttaattattgcgcattttctgggggattttaggcaatttggagaatttggtgaaagaacagacgggcaaattggagttggagcagcagaagattgagcagattcttctcgagttgttgccaaagtgggcaggcatttgctattccctccttttgcttttaaatccctaaacattttaaggtctgtggtcgatgagcttcgaatgggtcggcgggtggagccccaattctacgcctccgttacgataatgtacagtgatatcgttgggttcacttcgctgtgcagcgaatcgcagccgatggaagtggtcgaattg

SEQ ID NO: 76097 - DNA, 1334 bp, Heterodera glycines
  Genomic contig location: Contig_ID=SeqID_12470; Location=93..1426; Strand=-
  SCN-specific regions: Sequence locations=1-316,338-397,434-678,701 -780,802-918,940-1018,1040-1040,1062-1251,1274-1290,1322-1334
atggcacccgaaaatttggtcaccaatgttttggcattgctccaattgaccaactggcggaaagtgagtgatcaccccaaatggttccttgacccatcacgtttttctcaggtcgctttggtcacttgtccgcaatgctttaaccccactgatcagacccaagacttagctgatacggtgggccaaatgctaagtgacaaaggcatcaaattggtgggaattgttcggcttgagctgaccaatgggacgctgaacatgacgacggtgatggaacggatgggcccactcaaagacgaagcgcgaagtaacaaacaaaaacaatggcattttgacaaattgagccattaccgtacccctccggatggaatggaatttgctcaccaatgatgccccctttgttttaagctttgtgtttttcagttttgctcaccattctcggcaattccttaagtgactatgtaccgtttcttcgggcactctttgccctgggaatgcgtacggtaaaagattttgatttaatagtttaatgcatctgaatataaatgtttcagactgaatttgtgaacattgtttgcatcagtgattactcgccttctccgttggctcttccgtggctttccaatggcactatggactcggccatgttgaatttgttccatggcacaattttggcatgttttgcaaatgtatccattaattaattcatccgatggatctcaagttggtcaacgaattctacccgattagccaattggcttcatttggcactcaaattggcattgaaataagcgcaaatggagaaaatatggcacaaacggaagtgagtgttgcgaagggaactcattttggaatataaattcttttttccctttcagtctcttctgatgctttccgtccaactttacgaatgcttttgggcttatgcccttttgctgtggcggaccttccaaaaaacgggcactgtccggggcaatcgcaacggcactttgctacgggcgaacattcacacggcaccgatccaaggcaagcaaagggggaaggagaagaaaatggccaaatttggcaaagaacgaggcttttctgtttggtcaatcgatgaacggttgctttttgtaggacccttcggtccgatcagtgtggacgcccaactgaatcgggtggcgccgttcagcgcctatttggtccaatccaatacgactgatcaaccgcggccggggcttctccaatttgcgaacatttcgttgagctgttcaagtgggacaaattccaactgccaaacattggtaaaacataaaattaaaatgaaataatttattattttccaattaaataaa

SEQ ID NO: 76098 - DNA, 375 bp, Heterodera glycines
  Genomic contig location: Contig_ID=SeqID_12471; Location=93..467; Strand=-
  SCN-specific regions: Sequence locations=1-166,189-206,230-375
atgacctggactttgaacttgggggaaatcttggcctggatccagtcgaactcgagtataattggcaccgttgtttatatcgcctcactctttgagtttttcactaatgcacggcgtctgttggaaatcactcggatgggccgtgccggcgttgtgttgagcagtggagctgaagacatgctgcagcttcgtggaccatttgatgtctcaaatttgtgctctctctttgggttgacaccaaagtgcggacgtcgctttgtctcgagttggttcaactaccgctttttacatgggatggccatttgtcttcccctttttcaggcaatgccctctccgttcttttgcgttcccaaacgcgtcgtcacacagtcaaag

SEQ ID NO: 76099 - DNA, 498 bp, Heterodera glycines
  Genomic contig location: Contig_ID=SeqID_12471; Location=906..1403; Strand=-
  SCN-specific regions: Sequence locations=1-341,363-498
atgggatacgaatctgttgcaattaatgttgacataggaaaattcggcaaggaatcggacataatttgggtaattttgttgaattactgaaacaccaataagacaaattacttaattaagtcagacgaagaggacgaagtcgtatcgaagaagagaaaacgtaagaaacagaaaaagttgcacgatcgaaagagtggcgatggcaacgaaaggaccagcgaaagtgaaattgtgcctgatccgtttcttgtagacgagtccaagttggatctatcggcttttgcagttaatgggaagcgatttcgtcagtttaggcatttttcacagaattcttcaatatttatttttgtatttaatattttcagtcgtttgacggtttcaattgatgcggattctattcaccatctccaacacaataaaaaagtaaagctttacgatattattgcggttcgtgtccccgatgaacagattttgatgacattgcaaaggtactcctag

SEQ ID NO: 76100 - DNA, 773 bp, Heterodera glycines
  Genomic contig location: Contig_ID=SeqID_12471; Location=1737..2509; Strand=+
  SCN-specific regions: Sequence locations=1-148,172-268,290-773
  Gene Ontology: Mol. function=transcription factor activity; Cellular component=spliceosome complex; Biological process=Wnt receptor signaling pathway
atgacgcttccttcttgctcaaaagatggtgctgccagtctcagtccaatgtcattcaaagaaccaaatgcttgtccaatgttggaacggatgcattaccagcgaatcactggaaggttttcgttttggacaacacagcttcatttgttagttttttagattttgtgatgcatgtattttcgttaaagaccgccagttcagtgctcacagaatggttttggctgcccatagtccgtattttgattcaattttgcgtcacaacaaaattgcgaaagagaaggtaaagagcgtttgttaattggaatcctttgttatttgttattcccttcagattatagtcaattgtcaagatccgactgtgttcgatcgcattctcaattatatgtatagcggctcagtgacaattgacagagccattgttgtggaattgttaaaattggcgaataatttgctagtgggttttgcaaaattagattcccattttaaagtttttttagatgatccgcttgaaaaattactgtgctgattatctgatgcgttacattgatgttgcaaattgcttggcaattcgtgatttggcctcccgttacaatttgccgcgcttgcaaaagcatgccaacgaattcttcgactcaaatataaatgggttgttcggtctattgtgtgttaagagcaaaagccgtttcagatgtcttttggaaaatgctgatgtgcttggctgggaacccatcaaattggtcgaattgcttgaaatgacgcggcatgcgagcaac

SEQ ID NO: 76101 - DNA, 1141 bp, Heterodera glycines
  misc_feature (18)..(18): n is a, c, g, or t
  misc_feature (45)..(45): n is a, c, g, or t
  Genomic contig location: Contig_ID=SeqID_1809; Location=135..1275; Strand=+
  SCN-specific regions: Sequence locations=1-667,689-726,756-1070,1114 -1141
atgtgccaaacgaacggncgaaatattgaggaaagaacccgtccntatgcagcaaaacttttcaagatttgcgcaacaattcaaccccaacaaaagcaaaatttttcacaaagttttcaaccgcgtgaaaacactgtttgttacaattgtaatgaaccagggcacttttctcgcgaatgtcgacgaccaaagcaatattttgatggaagggctaaccaaagccatgcagtgccggccactggggccaatagttttcagatgcggccaaatggtcctgaaaagcgagcacttccacagacttcgacaaaagagtctgatcaacgtcggtcacaaaactttttgaagcaaaattgcattgttgtgcaagaagaagcaccaccggaagctttttgccgtggtgttcagctttcatcagaaatcgctgaatttttcgccaacgagttcaaagaaaggaaagacggaaacaatcagcgagaaatgagttccgacagagttggaaaaattttggtcatcaaaatcgaaacatttggtgcaaaaacggaagcgatgatcgatggtggagcgcaaatttcgttggttggcgcctcatttctgtatatgctgatcagagaaaaaggattggatttgcaaaaaacaaattttgcacgcacaaatgacagaattgccgacgtcaatgggaaggaactccgatgttttggcacactcacattgccaattctccgtaaaggctgtgaacaagtggccatacatttttacgtaaccagtgcaccgttcggattcgacatgcttttcggaacgaaggccgatcagttttggaattatggcgcttcggcaccggttacaacaccgatcacgtgaccagcgacgggaagatgacggaaaagggcctcttgatcctaagggcttgggtcatgtctcaagtgaagggaatgccaaaagaggaggctaacgagccggaaaagaaggacgaagagaggccaaaggcgggcgtgagtcaagaagaaagaggaagtgggcactttttagaatatatttctttcgtaaaagtttccataactgagcattagcggtgtcgctttggttgttgttgctggtggtgatgttgttgttgttctgctctgctggcgcgttttgttgatta

SEQ ID NO: 76102 - DNA, 993 bp, Heterodera glycines
  Genomic contig location: Contig_ID=SeqID_1809; Location=3149..4141; Strand=-
  SCN-specific regions: Sequence locations=1-211,234-993
atggattggtacgccaaaaggaacggagtgagcattcagacggcacactcgcccggcggagagaaaaaaattggccagtacactgtggacggatacatcgcggcgaccgacaccgtgattgaggtcaacggctgccactggcacgctcacgaccacccgcgtcaccgttttcagccccaaacagtgatggcgaatgggaaaacggcgcagcggatacgggaggacgatgcgcgacggctgtccttcatcacatcccaggtgcaacaagtgctcgtattttgggagtgtgaaatcaacgcggagaagcgcgacaacgacgaaatgaagcgcacctttgcgcagtacaaggacagcggccctatccgtttgaaggactgctaccatggaggacgtgtgggtccacaacgactacactacgaggtgccggaggggtggaggatgaaatattacgacgttcgttcgctctacccccacacgaatgctgtgacagcataccccgtgggtcacccaacacgagtgaacgtcattggtgaagcagagcaggcggttgactggcgacgcgccgaccaagtgccggtccgaggcattctcaaagtgttcgttgtgccgccccatcacattgatgtgcctgttctgccagtgaaatttgatcagcggcttcttttcccgctgtgccgtacgtgcgctctgcagcacccgcatggagcggtcaatgaggactacgaatgcacgcatcgcgaagatgatgagcgggggtgggtgtccactgtgacgtcaattgagttggaggaggcgcttcacaacgggtaccggtgtacggcctattatcgctccgttgagtgggacgacacgcaatggagcgaccgcgtttttcgaggctatgtcgccgagttcatggccatgaaaacgcatgccagcggcttcccggacgaaattggccaaaccgaggaagatcagcagcaattcatagaggaatgtgaggaaaaattctga

SEQ ID NO: 76103 - DNA, 2728 bp, Heterodera glycines
  Genomic contig location: Contig_ID=SeqID_1810; Location=435..3162; Strand=-
  SCN-specific regions: Sequence locations=1-75,97-953,992-1292,1318 -1631,1653-2017,2040-2728
atgcctcgtgtggtatcaactcgcacggggaaaggcgccgtgactggtaaaccaccaaacaccaccaccgtcaaaaacaaaaatagcagcagcaaaacaacaaccaccactcctacaagaaaaactgcaaaattggttgcggatgagcagttgccagtcgcaacactcctcccaacattgattcatcaaatgtgcaaggatcgccccggcgaagaaaacttttatcagcaagcagtttgctgggctctttttgcgctctatttaatggtgattgtcagcctgatccttcatcagctttgttctatctgttggttaaagaagaagaaggaggtaactgctcagtatggacagcgcgcagatttcgactattttgaggcaaagtcgggaaaccgaacgagttttccggggctgtttcccaagtgaccagctcccagcgccggacacgctacggtacccagcggcgctagttgtgaacaatgacccacactacaaacaaggatcccattggtgcgcgatttatgccccttcgaagacggaggaagcggtcatttactttgatagtctcacaaaaacaattcctactattgtaaaaacatcatttctggataaatttcaaaaaggttttgttacaaataagcacccgtaccagtccccactgactaccacatgtgcaattcactgtattgtgttcatttatcacatgtccttaggtcacccatttgacacatttctgcgtatattagacgctagtgaaagccccgacatgtattcattgtgcattctgaataaaatgattaatccgtatgtgtgtgcctgccaatttttatctccctagggcaaagcgcataagggaaatgattgattagtttattacaaaacggcgcacggtgcgcgctgttggtgccgccgcatatatatagcgaactcacgcgggaaaggctcacttttttcacaaaaataaattatcaaaataaaaataataataataaatgtcgctggaagaccacaattattgcggtgagttgggcggcaacgaaacgcccacaaagagaagaaggagaaatgacgatgatgacggggaacagaaatttcaaaaaaattgcatccgcactctgagcgccgacaaacaatacaaccaaaaattcaaagtgcagagcgtaaagtcgacttttgtcatcgaaaatttgcccgccaaccccgagtcaatgctgcgcgcattgttcgctcactgcatgtcaactgccttggacgagtcacaacagaacggcatcacaccggatcaattggttgctacaatctcttcagatcttctaaatccgagcatatggattcccatacgccgcatttccgacaacaccgccgattcaatcatgaaccgctttcttgaagtggcacagtcaaaatcgcgggagggctctctgtggggctcgccgttcactgtgaccatcacaacgctggatgttgcacagttaccgcaacgacaacaggtgcgtggcagtgggaaaaggacaccgtattcagtacaacatatcgtaaaagagagtgctcttctgagaatcaacaacagcgatgatgcatattgtcttttttacgctttggaggcaagcagaaaataccacagcaaagagatgcccagaagaaatttctgctattatattaactgtcagaacgggcaacgactggaagacgtgttcggactgatgagcggtgcaaacattcgcaccgatttgagagaatatgacgcggttgtctatgtgccgattgtcgtggactattggaatcggaaatacgccaccgcaaatcagcgatttaaggtgtacatctttggcgctacaggcacctatcggccaaaatttcaatatgggccggacaacttcaacattgaaatcccgctctaccatcacaacgaccatttcgacggaattcgatgtggggtgggcaaagcggtgtttgggcgtgactactactgtttttcgtgcgaatgcccatatgataacgccaatgatcacacgctacaatgtaagcaaagtgcataaactgcggtcgcataggagtggggcgaccgtgccgagcggatgacaacaattattacagagaatgtacagcatgcggcaaggatttcatgagccaagactgcttcaatcatcatttgtcgagcaatgtgtgtcgacaattcaacaaatgcaaacagtgcggaattgtgtggaatatcagacaaaaccgacgaaaaggacgcagcggacatgtttgcggtgagaaattctgctacacctgtaaatgctaccataagccggagcggggctgcttcatacaacagttaaaggcgcgccgccccaaaaagtacagactgatcgcctttgactgtgaaacaacacagaatacacgaattgagggcagcggcgaccgccgacttcattccgtcaacttcatctcatgccacgtcgcctgcaccaagtgcataactgaaaattcgtggcgaaattctctacaagtgccatgcagcatttgtggtcggcagcgcaccgtcaccttctcccaaagcggctacgaacggactcaaaccgatgcccaattcatcactccttgtccaatggcggcctttgctcaatggctgctcagcgaattcgatccgcgctatcccacaatgctcttcgcccatttcagggtcgttttgacaacatcatgctgtttcggcagttcttcctcaacgggttttgcccgcaaatga

SEQ ID NO: 76104 - DNA, 1086 bp, Heterodera glycines
  Genomic contig location: Contig_ID=SeqID_1811; Location=167..1252; Strand=-
  SCN-specific regions: Sequence locations=1-113,141-414,436-478,500 -856,881-1086
atggagcaatggcggaaaaggcgatacgatatacaacaacagcaacggcagccgccgccgctagtggtgcgggacctccttgcggaagcagctgcggcgccactgcccgaaagtgatgatgatgatgatgatgatgatgagtatatgctagagaatggattcgcgctacctgcaccatcgcaatactatggcgatttgcctgtgctgcccgacaatgcggaagaaattgaggaaatggacacagctcagcgcaggattgccatcagaagaaaattgaaaaaggacgaggcttacgatgatgatgatcaacgcaaaaaatataggatttatcaaccaccaccactgcctcgcgcaaaagtaaaagttgagcagccgaggcctcctacaccccggccgcgtcctaacgtcaagagagaacaacaacaaaagccaaagccagaattcaaaccgccggcgacatcaaagaaaaccggtcaccccactccggcaaaaagagtgccagagtttgttgatctcgatccacgaccatccacatcaaggcaggccgggtataacccgcctcccccgacgcccaaaataaaacatgagccgacaacaaagagacctatgccataccgtatcccaaaaagagaaccaaaagtcgaggaagcgccacaacagcaacagcctcttcctgctgccgctgttgtcgtcgaagaaatgccctatgttcctccgcctaggaggggggccaaacgtcgctaccccgtatatgaagatgatgaggtgcagataagaaaacgagtgaggcagccgagaagagtaagagtacagtactcacccgagccaggcccttcaacatctgcacaaagtgatgaacaacaacaacgacaacaacaacgcgaactgtttgccattccatcaaatcagctgaccatgactcagcgggttgaacggctatacatcaaatgcaaccattacgctgatcgtatgggcgttcgtggaaatacaattaacaccgcaaacggcaagccgttggtgcataccaatttgcgaatggccatccgctatataatagacggaaagagcgggccgccccaccattag

SEQ ID NO: 76105 - DNA, 880 bp, Heterodera glycines
  Genomic contig location: Contig_ID=SeqID_12473; Location=354..1233; Strand=+
  SCN-specific regions: Sequence locations=1-109,133-347,369-645,667 -841,867-880
atgtttggtcttagggaatatgctctggctacttttttggatgtgcggttcaaagacaaagtgctgactgaaaattccgcaacttttcgcgccagagtcactgtctggatcaaaaatgaattgaaagaattggacattgataatgacttcgaggaactacaacaaaatgaatttgtccgtcctgtaatttcaccccagcccgaaaatctgccagccaaacgacgaatgtcattttttgaacgtcttaaaaatattacaggcgcgaacacaagtgaacagggtgatttttcgtctcttaaaattaattttataatgaatttaaggtctccaaacatcgcaagacgatgacattgaaaaagaaattaaagaatttctctcagtggaaattgcgaacccagaagcaaacccgcttgatgaatggaagaaaatagctccccgattttcaatccttgccaaatttgcagaaaaatatctttcagcacccgccaccagtgtcccaagtgaacaaacattcaaagtcgcccgtgatgtttttgattatcgccgttccaaattatcacccgaaacggcagaacaacttatttttttgaacaagtctcttccccagatgaactacaattattgaaactattttttgtgcattttattaaacttgttatataatttctatatagttgatgaaatttgtgggtttttttcccaaattaacatgtaaaaattaaaatttataccaacccggacccgggcccggcaatttgaaaacccgggttgaccgggctaaccgggttgaccgggttttgagaggccgggcccggaacccggttgattctggaaaaatcagcccggcccggcccggcatttttggaaattccggtctcta

SEQ ID NO: 76106 - DNA, 1613 bp, Heterodera glycines
  misc_feature (488)..(488): n is a, c, g, or t
  Genomic contig location: Contig_ID=SeqID_12474; Location=26..1638; Strand=+
  SCN-specific regions: Sequence locations=1-78,100-489,511-619,641 -863,885-923,945-972,998-1145,1167-1171,1208-1322,1344-1358,1383-1613
atgaatgagcaggcgaacgtgctgaaggacctgcagtttctgatcacattgatcaatccctttctgtacgggtttggacggagcggcggcagcggcgccaaactgcgcggaaaagcggcggttggacagcatcggcaaaagggacggaatgcctgcggcggtgcggacggctaattaccagctgataattactgcaggcagaaagcgttcaaatgaataagcacaactttatttttgcctttatttttttagacggataaatatttaaaaatatgtctttcacagagagacaatttttcacaaattaacacaatgatgactatatgtacaacaccttggttccaaaacatcataacctattgattaattagctaattagcgcacatttccatggtcaaaccagcgcatttacaatcatgtgaatgagtttaaatatgaagacattcacaatgagaaaatgcactagtccaaacaaaggagattattanagaataaaagaggtaaataaatacataaattattcagggagcaaaagagaattttgtgctaattttgatttttgcaaagaatggctttggcatctatcatttgtgcttttatatgccatgatgtctctgcccatctctgctgttgccattttgtttctcttctctcagattaattgccattcatctgtccatttgattttacttgggttaatttgagcggctaaatgccctcctgctagtgaatggggacgggcggcattttctttgctcgcacaatggcactttgggaaaggtaacttaatcttcaaccaaaaaatgaaaaacaaaaatgaatgggtttgatttattttctctttaggccgaaagtgatcatttaaaagtgaatttttataaaaattaagcatatgtctaaataaatgaaccggataaaataattggcaattccttagaataagaatcagctaagcttataaaatctattgagaaatatttttttatattataaaattggtaatttaggcaaaatctgttaataaatctcacaaaatttttctcaattttatttacctttcttcttaatcactttttcacatttaaacgccacttttgttcatattgttctcataaatgcaaagaaagaaattttagtcaagtagacaaaatgaaaacatttaaagttaacctttttattttttcattaaaaatttctttattaaaaactaggtacctacctaaaattatctctttctaacaaattcaattaggtaatccagaaatgtttttatattccataaacaaaatgcataaatgaccttacctaattggttccgcgattgggtggtaattaattcttccatcgtatgtttgtatttgttcgtcttttacttttcttcttttggccatcccttcccttttaatttcgtccttttaaccatttcaattgaaatcccattcgtctttcatatcagctgctgaccgaagaatggagttcaaaacgctcgagaaattttctcattcagggattttgagcagtatttgtttcgggatcatttaatggacaaattgcacattttgaaatggcattcatgccgtcgtccatctgctgctgaatacctctgctgctga

SEQ ID NO: 76107 - DNA, 1331 bp, Heterodera glycines
  Genomic contig location: Contig_ID=SeqID_12475; Location=1359..2689; Strand=+
  SCN-specific regions: Sequence locations=1-150,172-213,236-727,749 -922,944-962,984-1047,1069-1331
atggtttggcttctctcataccggtggctgttcggcgacttcggctgtcgtctgtatcagtttctgtccgcatttgcctactattccaattcgaatgtcatcgtcgcaattggactggacaggcttaaggtaggatttatcggagtaaaattccttgctattttcaagaaattcacccattgcttttcctaaatttgccatttttctaactgttaaaaatcattgaaaaattgaattttttaaaccactaggccaatttgtacaaattgcttttcctttccaggttgtctattctgaccaaatgcaatgcgtttcctcctgcactcgccgcgtgcgcatttttctgctcatcgcgtggcttttggccgcactctgtgcactgccccagctgtttttctggaccaattttgagctgggcctcggctggtcccaatgcaccaccatttggcaggtccaaacttcgtcagcccgttcattttcattgctttttctaagcgggcatccgaccactaattcagtcgggactaatgcaacattttggtcctgacttggcttgtcccaacagtgccgtcagtccagtctctaatgttcctccgtttttccacgaacttgtgccttgagacattaattcctgagattaccaaaaggcatgagggataatgccagtctcgaactgatgccaatctcgagtggtcgtccatgtcaattcccagtctttcattttccatgtttggcattccattcttactcaatcattttttacagattgctgagtacactcagacgaccaatttaatttcgagaatgaattcacaacgacaatctcggacattcaacagcagaaggaagaccattcgtggagtgcccatgccaacactcagctcctctacgaattgttgcaccaggtagacggacggacaaatggtaaattaagtgaaaaattaaagcatcgaacagagcgttgaaatgaccatagaaacattggcattggcatttactacaattttgtagtagtcccattttttaatgttaagagattaggctaatctactcctctctcctcattttttatgttcaatttcaattggcggggcggggggggggggaaaatgcggcgaattggaaaaatgcgcagttgtcgattagcaactattcgatgtgggatcaatgcatcgattcgcatactttcctatcggcccgcacttttctgtccggtcgatggaatcaattagtgcggggcattagcagaggcaaatcgatgcatcggattaatggattggctgtgaacggaaaattgagcgtattggaaaattgggaatggacgcggctta

SEQ ID NO: 76108 - DNA, 301 bp, Heterodera glycines
  Genomic contig location: Contig_ID=SeqID_12478; Location=1075..1375; Strand=-
  SCN-specific regions: Sequence locations=1-34,56-301
caaaaaggaattaattggcaaaagaatttccttcacctgtcactttggtgacaggtggatgattgatgaccttcccgcggcgctgcgcggcgcgggaaaaaaacacccgcaacaatttgggaaatcggatttggtcaggcggcaacttcaaagtggtccataggttttggttttgaaacacccccccatcgtggattttttatggggcggcaaattcaaagggctgcgccttcccataggcacgggctcgtgcgggaaacacccgcaaccaacccgcaaccttttgggactatatactact

SEQ ID NO: 76109 - DNA, 641 bp, Heterodera glycines
  Genomic contig location: Contig_ID=SeqID_12478; Location=1706..2346; Strand=-
  SCN-specific regions: Sequence locations=1-58,80-151,174-298,320 -535,557-560,582-585,607-641
tttttggttgctatttatagaaggggtatataaagaagtgaaaggaccatttgattggtacattgtatcaaaaaatgcaaaaaccgataatcgtaaatataattgctctcgctaatctcggtaccggaattaaactaaactctctgacgatcaccgaatgcgaatttaagtataaccctagaaaattcaatgccgcagttataaaatgcacagctcccatcaaagccacggcattattatgggaatccgggaaaatgatatgtctggggacgaaaagtctgatagactgtgaaaatgctattaaaaattttatagaaataattaagggctcggggtgtccgggggcttcttacaccggacacacggttgaaaatattgtttcgacctttaaattcggacgtgaaattgaactgaacgagtttcgaaaaaatcgtcgtgcattttatgaaccggaaatattttgcggtttaaatttcaagcggggtaaaagcatgacagcgttaattttctggaccggtaaagtcgtaattacgggaactaaaaacaattctgaaattgaggaaatgtatcatcatattctcccctatttgaaaatggctcaaaagaatttaatgagacgataaaaatgtttatttattgag

SEQ ID NO: 76110 - DNA, 190 bp, Heterodera glycines
  Genomic contig location: Contig_ID=SeqID_12479; Location=42..231; Strand=+
  SCN-specific regions: Sequence locations=1-190
aaccgttcggcttatcaccgacgagttggacgacggcacggtcactttgctggcggaacgacccgcgcgccggcactacgcgcatacattgggtcaacgaccaacaaaaccatgcagtggcagtgaacaggatctgacggttttttatttatcttggggcgggggtctcttcggaaatgattcaccataa

SEQ ID NO: 76111 - DNA, 2900 bp, Heterodera glycines
  Genomic contig location: Contig_ID=SeqID_12479; Location=1205..4104; Strand=+
  SCN-specific regions: Sequence locations=1-195,219-919,942-989,1022 -1075,1110-1569,1592-1711,1733-1976,1998-2000,2029-2433,2465-2900
  Gene Ontology: Mol. function=lipid transporter activity; Cellular component=integral to membrane; Biological process=transport
tagacaaatgtggtgaccaatttcatcgctggcggcgtcggtggctcatgcgccgtcatcaccggccatccgttcgacacggtcaaagtgcgactgcagacaatgccaaagccggcgcccggacagccgccactgttcaccggtgcgctcgactgtgtgcgccaaaccgtggcacgggagggattttttgtgaggttttttcaaaattaaaaaatttgattttcatgtccgcttcatgcgcaaatggacagtgattcggagtgggttttttcactatatcatatcaaacccttaaaatcaagcccttttaatctggaaacaggcgcaatttggtcaaaaagtccactcttcaaattgttgtgaggtttaaacaactgacgggctgtgaaaattcggatttggtggaaatttcacgaaaaaaaatcaggaaaaattcggagagcatagttttaatggttttagggatccaaattacgaatttgacacctcattttcagcaattcatagctcaaaacgccaattaaaggcttaatataaagaatttcctttttttttggcatttcattagtgaagtttgcacaccctttaatttgccaaaaaatttatccaaatttcaaaatcatgtccctttcctcaggcactttacaaaggcatggccgccccgctcgtcggcgtttcaccactctttgccgttttctttggcggcactgcactgggcaaatggctgctgcagaacgagccgggccagcagttggacttcaagcagaatttcacggccggtgccattgccgtcgtggtcaccactgctgtgatggtgccaggttgatcattgccatttttggatcaaattttcaaaaaattaatggtaaaaatgatgatccggcggtgcagataggcgccgctggcgctgttgaaattttcatgaagcataataaaaatatgcaaaattgacaagaatttttccgcttttttctttggcgtttttcgggttataaaataaaattttataataaaattaataccggcttaaggcccagagccctgggaaatttatggttctttatcagtacatttttggaaaaaatgccattaatttccattccaaaattaatgccaattcatcatttttaggcgagcgaatcaaatgcattctccaagtgcagtccatggacggcagtgccggcacaacgcccaaatacaccgggccggtggacgtggtgcgcaagctgtacagagagggtggcattcgcagcatttaccggggcacggccgccacactgctcaggggttggtgtggggtaaagggagtaaaattcacacccaaaattggtcaaaattcattttttggcggatttggcattgctttatggcccataaatttacggaaatttcaaaaaaaaattttttgcatatattccggccagcggcgcctacattgctgtgtacgaattgcttaaagacaaattttcgggcggaaaacggcacgagctgacgcccatggcaacgttagtccgggaaattggggagggggtgtttgtaattcaatttcaatttgcccggaggcatttttgcaaatccaaagcaaaaaatacatgaacacaccgagtcaaaaaacgagacatgtgtcaataaagagagagtgcagagaaaaaaacatctctctttttggcgtactatttctttatctgtgttaatagagaaaaactgaatttacttcatgctgtttaaaattttttctacttgttaaatctgcttcaaattttgcatagagacagagaaaaaaattctgcatcgttttctctgtttgtttatagcttaaatgttgttctaaaaagttattaaaaaaataaaatttcgaagccatatatcttttttcgaactcttctaattgtttagcatttgcttacaaaaagcttctcctcatcaagggctttcgaatgatatcaagtttttccaatttggttgggaaaaaccttcaaaaataattcccaaaattcgtcattttaaaaaaaaaacaaaaaaaaaaaactcatgttgcacaacggactcgaaccaccaccctttgtccctttactatcttacaaaaaccacttcgccacacatgcaaatctttttagaactgagaggccaaaattgaaacggtgtgtgaaaaaaggggaggaaaccaactcgtacaccgtcccgacttacactgtgtcagcctaacttttatcaaagttgacctttcacaatttttttgatgaggggcacgatgatgatgacgacatccaaatttgttgcccttttcagtctgctggcggacggttttgccggcatcgccaattggtccgtgtgcattccggccgacgtgatgaagtccagcaggttggagacggcgcccgagggcaaatacccaagaaagtttttaattttttttcttttttctggcacggcattaattttcatttaaaattttttaaaaattgatcaaattgtcataattaaagtcacgccagggtaaaaactgtaggacacgtcgtcgcaaaatgcccgccgcgagagggcccctcctccctcacattttcctggccgggctttaatcatagcgaaggacatcgcaaaagtgcaacgaggaaaagaaaaatttaaagccgatctataagggcttgcttccttggcattctgtttcaattttccacctctctcacagaagtcatccgtgatgtgtgttccgcgaaatgttgcgcgaggaggggcaccgtgcgctgttccgcggcttcgtgcccgtcatgttgtgcgtgttccacgccaacgcggcctgcttctccgggcttgagcagacgctgtgggcgtttcgccaagcgggcgtttgaaaaaaacaaacaatctctttgtgtttactgtatttttcgatattaatt

SEQ ID NO: 76112 - DNA, 1498 bp, Heterodera glycines
  Genomic contig location: Contig_ID=SeqID_12480; Location=280..1777; Strand=-
  SCN-specific regions: Sequence locations=1-431,453-500,524-1472
atggtacgcaagcggaaaaaagtgtcaccgccggtgccaaccgcaggagcgggcactgctggcggcgcctccgacgccggagggtaccgtttcagcgcaccgtacgtagctcggaccgcgtcacgatgcttgaaagtaagtaaaatggataagcattgtcctttatgacacaaatcagccttggtgagcccgcatttccactaatgatataattaattagcattaattgtctcaccttccgccgatcgggcgcacttttgacaatgatcagcacagagttgtgccggctgagaatgttgtgccgacagtttggctcaattaacggacgggggaatagtgttggccagggattgatcggcaccagcggttgcagatcagtggccaacaaatttgcgacggacgaatgggacgagcccaagagttcacggacgacccaaaacaacaaagaaaaaattggtgcaaatgccataaaaaaaatttgtagcccatttattccggtaaatttggcactttttgagtccatttacccctaccgttccttgcctttctaccgtatattacactcgctaccgtacactcttcctttgctacctgtgcccgcacgtccgcttccgaccaacggaactgtgcaaagggcgtctcgaagaaatggtcggcgagtccggtgaggaacaacgccagcacaaaggagggcaacgcgagcagtgcggacaccacaaagaggccaaaaatggtagtggtggtggtgcaacttctgctgcttatgtcagctgttaaatttttttcaaattttgccggagggaattagcaaattaattagttggagtccgaattagcatatatttaatcggcccttttgcggcgtaaaatcgatatgtaaatccatactattaaccctaaacctcagttttttagatattcaattttttttttctaataacaccatcaatacaggggtaaagcagcggcggcattttgttgtggtcgccattcgccgggagccggcacagccacgagagtgggatcatcgagtgccaacggcgagcgcactgtcgccgcacgcgacggaacatggcacgcagcatcggcgccgatcactggtcacatgggtcaatatgaccctgactggacgagaccaatttttgcttctccaaaaattcaatatattccgtatgattgagtctgaaagtgcgggacaacagaacttatcatgaccagtatagaaaaatttggggaaagattttattgttttcttaattatttgttttttatctgggcgaaagctgtttttgatgtccttccccccaattcgcatggtcgatggagttgaaaatatttgttaattaaatgaaaataataacggtcattttatccgtcattaaatgaatacatatacaacacgcgtttagcataattaagtgattatttttattaggtatagtaaacacaatattaccacaaagtcaattaatataataacaataataataataataaa

SEQ ID NO: 76113 - DNA, 1484 bp, Heterodera glycines
  Genomic contig location: Contig_ID=SeqID_12480; Location=1818..3301; Strand=+
  SCN-specific regions: Sequence locations=1-152,176-221,255-313,336 -438,460-738,760-1251,1287-1356,1378-1408,1430-1461,1483-1484
  Gene Ontology: Mol. function=acetylglucosaminyltransferase activity; Biological process=gurken receptor signaling pathway
atgaacgcgttggaaagcgaggcggccgcgcatggtgacttattggtcggcgactttatggacacctatttcaacaacacgttgaaggtggttttagactggcgcgaaagaccggcgaatgcgacgccaatttaggcgctaaattcaaattgtctctctttctcatcccacctctctattcggcccactatctctttttactaatccaatctcaaaagcacttttaaatattttttctaaatttataaaaaattcctccctaaaaagtttgtccattctgtgcgctttgctcgtcactattgtgcgctgcccaattcggtgccttttgtgcttttgttggacgacgactttctgttgttcccgtggaatttaatcaccgaattgcaaaagtgccacaaaaataaataaacaattattttggcatttttatttttttaaattgtttttggcatgtcccaaatgaacgcctttacatgggctggcgctttgacacttcgccattccgttcacgactgttcaaatggagggtcggagtcaataatcaactaacttattaaaataatttgaatacagtataccaaaaaattgaaccctaaaaaacgtttgaaatttcaatttaattacaaagataaaataaagcaggctcgtcaccagtagaagccggaatcttgaaaaatacagaaaaaggatttgaaaaagctggattgaaaagcagcggaaaaaagtcctaaatttctgagaaaaactgaaatttaaataaattcgggctctaattaattaattaatcttcaattaaggtgtcgctggacgagtttccattcgccgcctttcccccgtacatcgccgctggcgcagtgctcttaacgggccaaacaattgccgaattttacgcagccattccgcacgtgcgactgtttcgcctcgacgacatttttgcgggtgggaaatttttcgtcaatagtttttgaaaacaattttttaaaattttacccattttattccgtttttatttttttgatttattatttcgacatcccatacaattgttctattgctgatttccctttccttttaggcattctctcccatttgttggccattacgcctcaacacaatgccaattttgccttctatcgccaatcatttgccgacgattcattggcattggcatcttcagaaacactcaccacattgatcgctgtgcatgactatttgcccgaagaaatgcgcgagacgtacggaaaggcagtgaaacagcaaaatcagcagaaattgaagctgctctgaccatttatttaggtgttagggcaactcgtacaatttttaatggatttggccataacttttttaggtaaacaaaattattcaaacttgatatcattcgaatgctctccaagtttagaagcgatcattaagtagaagctgagagatttcctttgtacgagtttccattgacccatttattatgattattacatacaata

SEQ ID NO: 76114 - DNA, 1215 bp, Heterodera glycines
  Genomic contig location: Contig_ID=SeqID_12481; Location=2149..3363; Strand=-
  SCN-specific regions: Sequence locations=1-280,302-422,444-791,813 -895,932-1142,1164-1215
aatttctgcggatcgttgtggaaacaaattggacaaatcgatgcaattgacgggcgcaaagtgaaatggtgaaaaaaaatttgttttttttattttgtgaaaaatttccaggtttcttggcggtgacctgtgttttctgtgggcgatcattggccattgcggttcggcaatgacagcattcccatccccagtgtgtgactgccgcagagaacgtctgatcagttcagcaaaatgccaacttcgctctgtgcaagaactggagagacaggccggtcaattcgaacagctgacccaaggcggcgacaaagcaacggcagaggctcgggctctgacgatgggcattgtttgtgcacctcttctgccgtccatcaattttgagcagatgctgttggccccattccacgtcttccaaggcctcggaaatgctctgatcaaggagttggaagcgggagaaaatgccgaaatagctcagcaattcttcagacgaatagggacaaggagggaagcgttcagaaagcgcgacttgacggggaacagcatccgcaaaatcctcgtccatgccgatcaaatggaggcccttttcgaaacggaatgggcgaaaacaatttgccaaacaatggtacatttggggaaaatccaaattttcaccaaagtaattggttttatttttttgtggaaataatttttttaatttaaggcccagccattgtctccaggtgatttggatggactggagacggcagtttaccagttcaaggcatttctcgacgaacaaccaatggtgcgaacgcttctttcaaaaaagacaaaagcccatttgctgcttcaccactttgttccgtttgcgcaccaacacggatttttgggccttttggatgagcagggtgggaccatatcatttttgggggttcaattttaaaacttgtgatttttcaggagatgaggcactgcattccgtgtgggggcgacttgagcaactttggaagacgatgccggactctgaacaaatgcgacaacagctggagcatcatttcgtcttgaattggctgctggacaccggcagactcgacgaattgaagctggtgagttgatggaaggggatttaaaattttaatccaactaattaagcgggaggaggaacaacgggagcaagcggaggaagacaaaacgaatgaagaaagtgatcaagatgccgacgtcgatatcgttgactga

SEQ ID NO: 76115 - DNA, 2075 bp, Heterodera glycines
  Genomic contig location: Contig_ID=SeqID_12484; Location=493..2567; Strand=-
  SCN-specific regions: Sequence locations=1-81,103-321,343-509,532 -863,885-1911,1937-2051,2073-2075
atgcctcaaccgttgccgctgagagacatgccgcaaattcaccatccaccgcgaaatgtgacatcaatttggatcaaattgtggttgctttttctcagtctctgggtgtttcttcaaggaattcatgttcggcaaattcaacgtgaatacgccgtaccacaatttgccgatccgccgccaaacgtgccgtatcatccaccagaaaacgttccggtaatgttgggtcttgtttttcgtgcgtttctcatatttccggatgctttttcaggcaattcaaccaatgcaacgaccgcggcagctgagagacgtgagtagtatatggccgcaaatctcggtgtaaatttatctgcgataacccctttccttcctctttagaccccgtggcactaaccatttcccttcatttttcccttctagccgtatatttgtgatgtttaaattgattgaaaaggagggaatcataattgttttttactaataaactaattgtaaaatgattgaaatgagtgaaaaaattatgaccacatatgatcaaaaataataacaggtaaaatttagtggcaaggggaatcggcaaaatagggaaaaatcataagaaaaaaaggtcatacccgggaaaagagccataagaagttcaaaaataagtcaaaattgtgtgaaaaacattgtcatagcaggtgaaaaaaggcatcagaacaggtgaaaaaatgtcataacatgtgttaaacaggtgaaaaaaatgtcataataaagttaaaaaagtgaaaaaataagaaaaatgaggaaaccgtgaaaattttgtgacatcatatggtcgaacaatgatggtttgggaagaaaacatatgaaaggtgaagagtctgaaagttgattataaataccaataaacaatttcttacaaccaaaataatggatcaaatattatcaaaagtttatttcaatctaaaatccctagctagctatgcgggaattttgaaggttttagaagaagcaagaaaagtagaccaaaatataacattagaggacgttaatacgtttcttgaaaaacaaagaacctatacaattcataaaccaatcaagaaaatatttccaagactcaagacgatacccagcgggcttcatacagattggcaatgtgatttgtgcatatttgaccagttgaaaaagcataacgtaaaaatatatagcgacagcggcttagagtttcaagcgggaaaaatgaaaaaatattttgaagaaaaacaaatacttaagcatgtaatgtatagtccagatttacatgcaggggtagtagagagggcgaatcgtacaataaaagaacgactttataaatattttacacaaaagaacactctccgatgggtcgatgtaatagacaaaataataacaaatataaacaatagtgtgaataggacactaggggtcaagccatcatttgttaattttacaaatgctagtgaaattttgaacaacatatatggcaataaaaaagagaaaataataaaacctaaatttaaaatcgggaatattgtacggatcacaaaagacaaaggaaagtttggaaaagggtattatccaaatttcacggaagaactttttgcaatttcaaacgtactatcatcaaatccgccatcttatcgcattgtagacatggagggtgatcagattaaaggtatattttacgatcaagaattagtcaagacaagtgtctgatcgaaaagccgacgcaatcgttctcgcccccataaaaaggaggtcaccaacgctcccaaattaattttttttacaatttgagttgcctttttttttgttttagaaatgtccagaccaacaaatgcgaaccttgcccgaaagaacaacctcaaaaaggcgcgaaaaattttgtttgccaaaaggagacaacgagaaattattattagaaaaataattcgaaaaaatataccgaatggaaatgaaattttttttaaattctgcaaaatgatctttataacaatcaacatcttattttttaacggtactacaaagcgaagaaacatttctaattattttgtaaatgatacatttatttcaataaa

SEQ ID NO: 76116 - DNA, 570 bp, Heterodera glycines
  Genomic contig location: Contig_ID=SeqID_12484; Location=2623..3192; Strand=-
  SCN-specific regions: Sequence locations=1-16,41-269,294-528,551-570
atggaccaaaaatcgcgaaatatggacaaaaaatggccaaaatatggacataaattttccaaattgagggtgtaagttttcaaaatttcttcgtattctctattgtaaagaataactttcaaaactgtctaaatatggtattaaaaattattttggaacaaaaaatacgataaagctaaaatttattaattccgacccccctgggcagagagatgcgcattcacataggagagaggagagaattagagaaaaagagtaaaaaaatatgcacgaaaaaacaaagaaaagcgacacccgtgctcagttggaacacgagggcttggcgaatgggcatgcgtggcacccgtgagcagttcgaatgtccctgaaaaattccgcaccaaattgggcgccccaaatccccacacccctcatcccctctcctcccccttccgcatccgttatttcagatttttcatattcaatttcaattcccctacgctaccacttttcatcctttcttctatgcagttgaaaacggcgttagttgctgccccctcccccaaattccgctcagtaattggccactaa

SEQ ID NO: 76117 - DNA, 643 bp, Heterodera glycines
  Genomic contig location: Contig_ID=SeqID_12487; Location=487..1129; Strand=-
  SCN-specific regions: Sequence locations=1-124,146-221,243-466,488-643
atgcacgtccacaacatcgacggcatcctcaacatcaactacaccggcaccgacgacgacgacaacggcaaagccaaacgaagaacaccgattggaggcgatgcggattcgacgtcgctgttcaagctggctctggccatcgctgcagccattttttattcgctgctgagtcgccgaccatccaaagactattggctgcagccgacggcaaaagaggtgtgttttaaattttaaaataaattgattattgctgtaaatgtaaacattttttgacaaattctgttagcaaatctcactcaaaattttttccggcggcgcctatcggcaccgcggggacccgccctctcccaatgtttcaaaaaagttttttgaaaaaacattgccataaaaacagcgatttaaaagcaaaaaatttaaaatacagaattttgggactcagaaaattccaagaatcccccttgaaatgaaaatttttaaaaatttcctcgaattcgacctccaaaacgaaaatacaaaattttatgggtacatagtttttgcctttttcatatattgtcatttacagacactcatccgatttggagtgcaatcgacgacatttccgattccccattgtgttgaaaaggataaattctaccaatga

SEQ ID NO: 76118 - DNA, 49 bp, Heterodera glycines
  misc_feature (17)..(17): n is a, c, g, or t
  Genomic contig location: Contig_ID=SeqID_12488; Location=156..204; Strand=-
  SCN-specific regions: Sequence locations=1-49
atgaaaactttttttanaaatactcggcccgccattcaaccctgccaat

SEQ ID NO: 76119 - DNA, 598 bp, Heterodera glycines
  Genomic contig location: Contig_ID=SeqID_12488; Location=1848..2445; Strand=-
  SCN-specific regions: Sequence locations=1-79,103-153,177-494,531-598
atgacggagtcagcaaaaggcgtcggaaagcgaatgatggcgatgaaattgacaggagatgaagcattggtaaatgcctaaaatgaaggaaaaaatgtgaaaagcattcccgaattgaaatgatcaaaaaaaacattaaaacttcacaatttgaatgccttccaaaatatttttgtcagaaaatcccaaagcccgtaaaagtgccaaatcagtcaaacaataagcaccgctttgaagtcttcaatccttgaagcgaaatgcccgccatcccaatgcaaccagcatttgaacacctttggcacatttttttaagcggagtgaaaagccatttggccaacgcttgtccatccgatgcggcggcactgtcatcgcatggaaattcggtgaagaaaccatagtcatagacattgataagccgaagcgatggacagtcgttgagaaatgacggcacgaaatgtcgcaaacggtggaaaagctaaagaacattggtcccgaaattttttttttaaattttgagtaaattattttaagggtcatccgggtcgctttggctcaatttcgaaacctgtcccagattagaacgttttagaaaaataaa

SEQ ID NO: 76120 - DNA, 525 bp, Heterodera glycines
  Genomic contig location: Contig_ID=SeqID_1813; Location=2262..2786; Strand=-
  SCN-specific regions: Sequence locations=1-61,83-219,241-288,312-525
atggcagcggtaataaaggctggaaaaggccccagaccgtttttgccagagatgtgctgggcgacatggtgggaacgtttcgaattcttcatccagcttaaaggcgtgaccgatgtcgcaacaaagcgtctgctcctgttcaccgaaatgggtcaggtgtacgaagagcttcggcgaatggcacagcctgaggatgtccgaaccatggaccttgccgaaattgaacaactgatggtggaacgatttggcgaagcaaaatcgattgccgcgtgcaggcatgaattgttttcagccaagcagcagacagggcaatcgataagggactattcggtgctattgcgcagtttgatcgccaaggcagaatggagccgcgacagcattgacatgtgtctttgtgccttgtttatcaatggcatttcaagtgatgaaattcgggtcgaattgatcaaaaaaggtgacaacaacctgaagttcaaagacgcctgtcgcgacaacgcgaaatcctaagataaaacccaaaataaa

SEQ ID NO: 76121 - DNA, 217 bp, Heterodera glycines
  Genomic contig location: Contig_ID=SeqID_1813; Location=1241..1457; Strand=-
  SCN-specific regions: Sequence locations=1-217
ccaagtttgaggtcgacacaataaacatactcttattaaaattgtgcccaacttggtctatttgcctggacgaacaccggcacgactcatcgctctccgatcggtcccgaccccctacgttcccccgaccggctactctgcgcgcctcgcccatttcatccccttcccgtccccttcaccccgcagagttcgacgcaaattttttgtcgccacgaca

SEQ ID NO: 76122 - DNA, 1887 bp, Heterodera glycines
  Genomic contig location: Contig_ID=SeqID_1813; Location=3401..5287; Strand=-
  SCN-specific regions: Sequence locations=1-219,243-1734,1756-1887
atgcaatgccggagttgcgaaagttggcaatcagcaaagaggaccaaggaagccgaggaaaagcacgggatgttgctttgggtgcggtgaaccgggacattttgcaaatgtgtgcccgaatcagaattcgacatgcagcaaatgcggaaaatgggggcattgggctgtgggttgcaaaagcaaaagcagtgatggaaatgccaaccctggtcaaaaaccaaagacagtcagcgtcattcacgaagtcaacggagtatctgccgacactggttttattcaactcttaattcaaaatggaaagctgaattttgagcttgacagctgtgcagatgtcacggtgattgacgagattgattggaaaagcatcggtaagccaaaactggaaccatccaatggattggtggcctatggcggaaaatccatcggtggcattttgggaaaggcaacgctgaatgtgaggcacaaaggaagatcgattgagtccaatattcatgtcataagtggtaagcacaaaaatatatgtggccgcgatttgatcatgggattgaaaatcgatttgaaccgagcctttggaatttcgacaatttgtgccgtgaaaaccaaaaaggacgaattcggaagaagcaagccgagaccgatgccattttcacttcgcaatgaagttgaaagcaaaatttgccaagaagaggcgccggatgagcggaaagtgccattgcacccgtgggaatcaccggaaagaccgtggcaaagaatacacattgatttttgcggaccgttttggggatcaatgtggttgatcatcattgatgccaaaagcaaatggccagaagtggtcagaatgcgcaaaacaacggcactggcaacgattgaggcgctcagaattgtgtttacagcgcatggacttcccgggcaaattgtctccgataacggacaatttagctcgaaagaattcggtgattattgcaaatcacggggaattgtccacacgacgatcgcgccatacaattcaaagtcgaatggagctgctgaaagattttttcaaactttcaagcaaggaatgaacaagctccaaaaggaggggatgaagcaggacattgcgttatctcaatttctccttaaataccgtgtcacaccgcatcctgcaacagaattggcaccttcggaaattctcttcggccgcaggcttcgaaccttgttggatttggttaaaccaacagcggcgaatgattttgaagcggccaaagtgccaaaagagtcatatgcggaacgaatgaaaaggaatttcgatcgcggggccaattcaaggaaaaaattcgaggtgaaccaacgagtgtacgcgagaaattatcgcgatggatccaaatggatccaaggacaaatcacccgacaaattggcacggccatgttcctcgttcgaacagcgagaggaatttggaaaagacatttcgatcagttgaaagagaatttgactgatcagaattcggacaattcgagttcagaaagtgaggaaaattcggactcagaggatgaagtgccgatcgaagcgatggacgatgaacagctgcaaccaccgccggaagagccgcaaccggagcagccacaacagcatgccaacgctgaacctcgacgttcaacgcggaagcgcaagaagccgaagatcttcgatccctcggcctgatcacggctttaagaaggagggacgaatgtggtgttgagagaccaatcaataagtggagtgaactttgttcactcctttcccttaggcacattccttcccacatataagcgatgccttccctccctccctcgttcattctgtcatttattccttccattgcacttcccttcgcttgaccatttatttattatatttgtgctccaaataaa

SEQ ID NO: 76123 - DNA, 182 bp, Heterodera glycines
  Genomic contig location: Contig_ID=SeqID_1813; Location=1722..1903; Strand=+
  SCN-specific regions: Sequence locations=1-54,77-89,112-155,179-182
gcacagacagagagcagcgaaagccgggtgcagtgaaaggcggtgagcgggtgccgggaaacttcggagggaaccgtttgtctcgaatctgaaatttccggaaaagtccacccctttaaatacgattttttttgcatcaaagtacgctacaatttctcattttaattaaaatatgtttttgt

SEQ ID NO: 76124 - DNA, 393 bp, Heterodera glycines
  Genomic contig location: Contig_ID=SeqID_12489; Location=55..447; Strand=-
  SCN-specific regions: Sequence locations=1-133,226-354,385-393
atggcaccgatggcattggacctgcggtatgtggcactgcacgagattggccatgcacttggccttcggcattcgacctaccggcactcggtgatgaacagttattacaggtaagcagaaaagggggggggcaagagatagagtgagaaagatagagagagagaaaagagaaaaagagagagagaccagagacaaagagagagagagagagagggagagagagagtctcattagggattagctaacattaccatttatacagacaaaatttggcacttttggatgaacaaacggaagagttcaaactgagcaaagatgataaagcggcgatttgggaattatttggggagaaatgccaccagaagaaaaagaggaggaaaagctgacaataaa

SEQ ID NO: 76125 - DNA, 402 bp, Heterodera glycines
  Genomic contig location: Contig_ID=SeqID_12489; Location=1318..1719; Strand=+
  SCN-specific regions: Sequence locations=1-97,140-402
atgctcaatcgagccaatgatcaattccttttgtggtaagtcgaaatgacagaaccccccccccccccctatcaacgtaaattaataattacttgacaatttttaaaattcaaatttaagtttcatattaaaaattaaagatgaagaggaataccaaagaaataaaatgagaccacatgaaattgaccagacacgtccagtagctgaagtaccccgcaccaaaaaatatttggaaaatgatcgagccatcaaaaatctgattgaacaatttgatcagtttggtcctgatcagcgtgatgatcaaagatggattacacatttacacgcactgtcatttcgacttaccacaaaaggaattgatcattggctcgattgagcatctttttaaaaaaacaagaaata

SEQ ID NO: 76126 - DNA, 1261 bp, Heterodera glycines
  Genomic contig location: Contig_ID=SeqID_12490; Location=456..1716; Strand=+
  SCN-specific regions: Sequence locations=1-323,346-357,379-383,423 -800,832-912,934-1035,1126-1261
atgatcagggacgtgctgcttgggcagcgttggaagctgtccaatggaccaatggcactggggtaggaaaatttttataaagctaagctttcaaaataatttttgctcaaattttttggaatttttttctatctttcctaagcatgccaaattttacaggaggtcattctgagaaaatgactattacactcatccaaaaaagtcttattccaaacattaaaaatttattcgtttgtttgacgattttcgcaaaaaataaaaaataaacaaacagcttttccttattattagcttaattaagccatatttcttcaaaagtgaacattatttctcattttgtgttttattgcattttctaaattctcattgataaatcaaaaatgtaattatacaaattaaagtaattaaaattatttaaaaatgaatgataacatatcaaaagttgtaataaaatatttggattggtaattaattggttcatttttggccaattaagttggacgttgcttttgggcccgcctgcgattatgtgttggccactgtcacgcgcattctcagtttctatcgagtgccaattttcactaatgccggcttcaggtcgcttcttcttttatttttgactttaatgaaccaccgttttttcagtgaatttttcattgaacagaagagtacagtactgctgaccagggttggaccacttcaggtgcaatcaaaatgtgattactgtatgaaaatcataaactttaattatatcacctaaatcacctactgctaaagtatgtatatgcaaaaagatgacgataaatttaaataataataataagaaaataaccctgctttttgtcatgttgttaggctggcattcatgaaaaatcacctgccaagaatattttttcgacaaatgcataaatataattggtaacacttgtaattcaaaaattttttgtttttttaccatttttcaattttaacacttttttattcaatccatatattttatacaatacatatttttaatatgtaaatttgtcatggttatttatttttttaatttttataatttttatgggaaaacctttttatttattttgtaaaataaaataaaattcaatatgtttaatttttcttccaggatcacatcagcgaattgttggaacggttgttccgtcagtttggttggctccgttcgcgcatgttctacgaaaaacagttttgggagacggaactgcacgaggccggtttctgcaaactgttgatgaat

SEQ ID NO: 76127 - DNA, 857 bp, Heterodera glycines
  Genomic contig location: Contig_ID=SeqID_12491; Location=394..1250; Strand=-
  SCN-specific regions: Sequence locations=1-259,283-481,551-614,650 -800,830-857
  Gene Ontology: Biological process=mRNA splicing
ggggtcggaaacacaatttttaattttttgaagcttaaggaatacgaagttgacaaaaatgagcgtccaatttacccacataaaattacgagcgccaaagttttggtgaatccatttgatgacattaatccgaggaaagcgacaaaggacgatgagagaaaaaggtccaaaagggagaaaaacgcaacaaatgtcgcaatggcagcgaccaaacggaacacttcgcttttgtcatttggagacgaaattgaggaggaggacgaacaaagtgaacatctgaccaaggtaattcagagctgacaataatatttgtagcccaaacgtgagcgccaaaccgtgagcgccaaaccgtgcgcgcccaactgaggtagaccggaatttttttgatttacaattaatttgccgactcagtaccaaggaaacagcaaaaaaatttcttcaaatccctgataaatgtaacaattttgagacgccccaatcgaatttaatttaattattttataatttaaaaacacttttatttgaaataatttgaaatttgattatttttcaaacacattattttgaaattgtctccagtaaattttcgagatttatgaactagaaattattccaaaatttattaacttaaaaaaattaaatatttttagtgttacatcaaccaaacacttcgtctgttgcgccgacgactgtaacgaatgcacaaaattatgcggcacaattagcagcgcaagcgcaactcgctgctgcgcaggcggctgctgcgggcgcaaacggtgattattgaagtattatttgtgaattattaatttaattgattaattaattagttgaagggtttccaaccaattaataaa

SEQ ID NO: 76128 - DNA, 2643 bp, Heterodera glycines
  Genomic contig location: Contig_ID=SeqID_12492; Location=6..2648; Strand=-
  SCN-specific regions: Sequence locations=1-44,143-281,350-465,487 -633,658-724,755-795,833-881,921-991,1013-1043,1065-1084,1107 -1170,1196-1370,1441-1528,1550-1626,1660-1890,1912-2522,2544 -2619,2641-2643
atgaaggatcgttgtgacgcggaaaaagcatgcaggtcagagccaaaaaatatttttttaattattaaaaaaaatttttatttaatttttttattttttaaagagtttttatttattaaaattttttttttaattttttttagagacccaaacccgatcatcgatggacgtaaagcaaatgtgaatttggcatatttgggagcaaagccgcgaaacaatgcgcacctggccgccttgtccaccacgataaaccaactcccacaactgcaggtcacactttgataattttaaattcaataattttttaaaaatttttttattttcctattttatttttatatttaaatttccatagaaattattaaagtttcaggattttttttattggacacatccaggctatttttttggcaacctggatttttcctgagtccaggtcaagaggtctagacaattttttggcaacctgagttttttctgggtcaggcccaatccatttggacaacctggatttttcctggacctgcctgcaattttcctgaatttttgtgcacagaaaatcctggctctgatcaaaatggaacccatgtccttgttacaagttttttcaaatgtcggactctaaaaagtgttaagaaattttttattttctttctcgaaatttatataagtattaattcggacgtccttggccgtccatatccctttaaaatccgatttaattttaattgatcaattaattaattaattaatttttctttgtaaattttaggccgcccaaatccaagcgatcattcaacttcagcagcaacaacaacaacagcaacagcttagtggacgttttgggtaggttgtcgcgcatttttggttgatttgttgtgataaaaaaattttttggaaaattttaaaaaatatattttcttcagaatttgatgggctatcaaatcaaaaaatgctattgatggaggtagtttaaagtggcgtgaatgaattttttggcatgaatgtttgagtggcgttgggcttgctggcctagagaaattttaaatgcacaaaatttttctcgaggctcatcaaatccacaaatctttcataaaatttttctcgaggctcatcaaatccacaatctttcataagattttcctcggaggctgatcacgattttaattgccaaaaaatttttaaactttttctttctcttaaaatttttagctacatatataacactaaaagtttttttgttcaatttcataatcatgaattcgtcacttattttatgttcaagatcttcttaaaccacaaatttaaataattaaaacctagtcttggatccagggcgaggtagagagagctctagtatttatgagcactttttttgtttaaaattatttttaaattcaatttttaaattcaatttctagtatttttttttaatttttagactttttttttctttatttggccccgaaatgccagcaatcccacgcatttctgtgcatggcctggtctagaatatttatcacaatatatgttgaaatttgaaaattatgaggatgttgttatgagctgaaaaatcatttgccgtgtgccactcactgactgaattcatttttatgcgcttttttcaatttttagtaatttattttaaatatttttattgaattcattagaccataaaattagttgttgttttttgacacttacacccaaaggcgcgtgtcatgtcgttttctattgttcaaacaaaagtggttgtgaatggtgatggtttctgctactgtagtattacaattactgatcaaattgatattgtaacgcattgggctaaaagtgaatgttcgaattttcaacttcagttcagaaatttttgtgtgtcttttggaaaacacatttaaattggattttttctttcataaattctataaaattggtaaaaaaaaaattgtttgtgaacttctgcaggctaaaaacagcaaattcggggttaccgaacaataaataccaagaattgaaaatttaaagaattaaaaaaaattcttggaaatttttacatcctatggccaaacagtttatacttgttggccttcactctttttgtacaagaccatttttttttaaatttttccatgttaatagagattttttcatgagcttatgtacgaacaataccaagaatatttaattttgttgaaaattaaaaagggttttggtccaaaaattcgttcggcggcattttgtccgtcgacgttttgtcctattccgcgatcgaaaatgccaagggtcgaaataccaagagttcgaaattttttctcccgcatttgcctagtgcgcgaaactttgctgggtgtgtgcctaattgtgtgcacccttttttgagggctgaagcgcttttgtggcacaaaaaaaaatgccaaatttcaaaattcgaaaaaatcgattgccgaatttttaaggcttgggtctcatctgtacctgcagaacagcccacttggaccacagtttgcagccgctgcaacaatgaacccattggctgctgtacagcttgcggccgtcgtgtcccaggctcagccgaacacgctggctgcagttgcggcacaacaagtggaacaaagacatcaatttttattatttgatttaaaatga

SEQ ID NO: 76129 - DNA, 413 bp, Heterodera glycines
  Genomic contig location: Contig_ID=SeqID_12493; Location=142..554; Strand=+
  SCN-specific regions: Sequence locations=1-20,99-195,264-280,390-413
atgacaaaatatttatgtggttttaataaaattaataatataaatattttaagggtatttaaactattaaaatcaattaaattatttttagatttatacactccaaccttttcatctgctcgactgactcctgaagcatttaaaaagtccacaagttgctcaagtgcaaaaggaatttgcaatggatttaatgcgtaaaattttataaatttttcttaatttaacgcatttttattatgaatttgtaatttatatatttatttgcatacgagaagttatgtttttttattcaaaaaaaaaaaaattaaaacaaaattgaaaaattgaaaaaacaaaaggttgtcaaaatttaatatttttaaatacaaagcttttattttattaaaaaaggcataaaaattaattttcaaaaa

SEQ ID NO: 76130 - DNA, 237 bp, Heterodera glycines
  Genomic contig location: Contig_ID=SeqID_12493; Location=619..855; Strand=+
  SCN-specific regions: Sequence locations=1-57,126-181,203-237
atgtcgcatgaagtgttgacggaaagtgagtcgtacatggtgagaaaattaattaggtaaattaatttaaacaaaaaataatttgcatataattaatttaattaattaaatttaatattttatatgtcttcagcttgtcaattttgtgtctgatgttggtggacaggctggactttggctgggcgcaagcattttaactctttttgaggtcttttaaggataattatttgctattaa

SEQ ID NO: 76131 - DNA, 454 bp, Heterodera glycines
  Genomic contig location: Contig_ID=SeqID_12493; Location=1306..1759; Strand=-
  SCN-specific regions: Sequence locations=1-69,92-204,226-454
atggtggcacaatttggaggcctttctctgaaatatgtatgcctaaggtaaattaaattaaaagctttcaaaaatatatatattttttattcccatattttcaaatttaaaaatagaagaaaaatttgaaaatttcagaaaatcatcgaaattccccataatccaataatataactttcgaaaaagctcgctctactaattatataataatttttggtttttaccatatccttcattgtcggaggtgaacctacagtaaccgcgccaaccgatggaattgaggaaactttgcgcaaacgttgttttgccgctttcttcaaacgctgactgagtgtctttgaacctgtaaaatgtcttaattttttaaaagttcgttaattagacttttaaacgaaattaaaatttaaaaaatcactctaaatgataagtgcatagtttaattgaattaaataaa

SEQ ID NO: 76132 - DNA, 1169 bp, Heterodera glycines
  Genomic contig location: Contig_ID=SeqID_12495; Location=105..1273; Strand=+
  SCN-specific regions: Sequence locations=1-394,418-511,533-536,558 -804,831-943,966-1001,1030-1117,1140-1169
atggatttctgggcatcaagcgcgggaattccgacatttttgggttcggaccgcccaaatttttccgggtctctgaacttccatccctgctggtatgtgtgtgtatgtcatcaatgtttactccctagacatacaatataacagatcagatatactgtacatccattacacacagtatataaataaatacaatcaataacaattaaaaaaaaacatattttgaacaacaatgtaattaagcattattgtaaatgatcaattgatcaaattatggtgcaattggaatcggggacggtgtactgttgctgttgtttgaggatgggtttactgtaggtgtcgatgttggcgcggtggtgccaaagttcactgctcctcctccgcctccatttgccaatgccctcgttgttgttgttgttgcggcactttcggtgccattgtttctccgccgcgcgttggctcagcgattcggcttttcgggtccgcaccacggacgggccagcaaggctaaatgcggggaaagagagggatttttagacaaaattttttttattttaattcaattcaaaaagagagcagttaagatagagcatttattttattcataattggagatggattattatattttttgaaataattcttgatggatttggttttgactatgaaaatgtgccaaaaataattttttgtccaagcaatgtgtcagtagtcaaaaaaccgactatttttgcctttttggggtcaaattttcaaaaaaaaaaaaagataaacagagggtccgatgatgccattaagctcccatggaaattttaaaaaataataattttaatgcaatttgttaagaaaattgtttgtttaaatttccaaaaaagtttccttacagagtttgggtttttcagagattcatcatgacaccattttatgagtgaatatttttagggcgaaaaaatttaattaaattttttgtgtcaattgaaaattaaaaacaaaatcacctcaccatctgaatgttgttgttgttgtgccaaatagcacgtgagcacctgaaattttgccaatttattgcaaaaaattttacacggaaactcatcaaattattagggaccaaaaaaaaatgttttcaatttaaatttaaattttgccaatgctggaaggaatttcctaaaaaa

SEQ ID NO: 76133 - DNA, 1035 bp, Heterodera glycines
  Genomic contig location: Contig_ID=SeqID_12496; Location=191..1225; Strand=-
  SCN-specific regions: Sequence locations=1-114,157-259,282-324,351 -397,448-476,498-523,673-902,957-972,1012-1035
atggcccttatttgggatttctgcgccaattttctgtgttagtcaatcaaaaaggttggcatagccaagacgatttgaaactgatcccgtctcgtttaccattgccaaactttgccataaaaaggggtaaaaatgaaataaataaatcttaaatttccgttttcccaactcctgaaaaattccgggtttttcattatatattcctatgaattttgcattcttgctggcttgagttcattacagaaaaccaaaacgaagcttattaaaaaaaaaaatatttaggtaaaggaggagaaaaacggaaaaattatccctaatactatgaaaattttaattttatttttttattagatgaaaatttgcttttacgactcataaacggaggctttgagcaatgtatttttgaaaaattattatgtaaaataaaaaaataaaaacaattttatagcattttatgtgtggattgaagaacatgaattttgggttgttgcagttgatggttcgtatgtcaagccaaaacgggtaaattattataaaaataacaaataagatttaaatttattgtaatttatttaaaattttaaaaattaaatattttataaaatttacgtgcatttttatttttttatttttttaaaattaaattcctttaaaaatttaacatttattttagtttgattcagtgctaattcatccgggtgaacgatatgatttgttaattgtttctcaacaaaatccaacgcacaatttttttcgaataattttcgaatcatttgaccgatttatgggaaatttcagcactggagaagatcggataaatgttggccttgcgaatttgatttatgaggaccaaattgttggaaatgagtcccaaaaattgggcaatttttcaaatgaaggtgtatttaaatttgaaaataaagaaaatttaaaaaaaaaattgttttttattttaaccgacactttttttccattttaaaattttaattcgtatttaaattttatattaaaggaaattctcaaatttctttttaa

SEQ ID NO: 76134 - DNA, 743 bp, Heterodera glycines
  Genomic contig location: Contig_ID=SeqID_12497; Location=149..891; Strand=-
  SCN-specific regions: Sequence locations=1-408,430-681,704-743
atggaggaaaaatcggcggaaattccaaaatggtttttgaatgctattttcgctgcgttggttgtgttcgccggcgtattttcgaaggaaaagtcaaagtgtggacaaatttggaaaagtaaaggctcaatgagtcgcaccgacgaattgaaaggacggaaagcattcggaaaattggggacaattttttcgccgaaggccggggaggaattggcggatgtcgcagccgccaatcttgaaaatttgttgaaaatcggtaaaagcctgaattttccaaatggccatcgcaggtgtgcgcaagaagctaccgctgatgaatttataaggccagatgaaaagtcggaattccgttttgtccgttgtttttacaggtctgaccctgcaacgcgactttatgccgaaccggtccactgctgacacccttgccgcccctttcaacgcccgaatgcactaccgatgagcccaaagcgctgaggacatcgcttcttagagggcgaggatgtgctaatattgtgattttaaaatatatttggcgttttgttatttaatttgtttcatttttgtttgtgatttttgtggagtgttggttgttagtttatgctgtcgcagttttcctattgattgtcctcgccctaattttatttggaattaaacgataatcatcttcggcattgggctgtattgttttgtgtttgctttgggctgttgtcttttgccgtgggcagtgcaacaacattaataaa

SEQ ID NO: 76135 - DNA, 1496 bp, Heterodera glycines
  Genomic contig location: Contig_ID=SeqID_12499; Location=628..2123; Strand=-
  SCN-specific regions: Sequence locations=1-7,185-277,306-513,536 -726,994-1074,1096-1098,1126-1235,1257-1260,1331-1496
atgaacaataataataatgttaatgatggtgaaggcggtgttgaagccaatgctggcggcggtgctgttggcggcggtgctgttgccattgttggcggcggtgctgttgctgatgttgccaatgctggagacggtgctgttgctgatgttgccaatgctggagacggtgctgttgctgatggtgccaatgctggaggcggtgctgttgctgatggtgcaaatgctggaggcggtgctgttgctgatggtgccaatgctggagccggtggaggtggagaaatttttaatttactaattttaaattagcatttaatcggggtggtcaaattttctgattaaacatattgatttttaatcaaatctgatttttttacctttttgaatacattttgtcattttacacccctaaaaatgaggttttttggtacctatttttggggtttttttagagcctagagactacctatttttgcagttttagagcctaaaatgtaatccctactgattaggtgatttaggcagcttttttgaaaaattttgccgatttatactgtttttggaaaaatactctacatatttaaaatagagaaatttgcaggtattaacattaaaaggcatgttaataatcccttaatcttaggatgtgactgcataattaaaaaatttaaaagtgcgtttttataccccgaatgaaagtttttatttaaatatgactggtgattgttaggtggtgatgctggtggacgcggtggaggacgcggtggtggtggtggcggccgcggtggtggcggtggcggctgcggtggtggcggccgcggtgctggcggtggcggccgcggtggtggcggtggtggccgcggtggtggcggtggcggccgcggtggtggccgcggtggtggcggtggcggccacggcgatggcggccgcggtggtggcggtcgcggtcgcggtggtggaagtgctgtacgtggtggaggccgtggtggcggtggtcacgccgaccacagtggcaaaagaaaagcctcagcgggtgcaaaaaagggctggaagaaggccgcaaatggacgtggaagggatgagcagaaacagggaggacttagaggcggtggagggcgaggagggggcaatgattgcggtggtgcgggcagatctgtgacaatcaattttttttgaattgttgcatttttgttaaattgttgcgatatttggtgggagttgatgatatgctgccggttaaaggctttttggcaatttttgccctaaaattatcaaaaaagtttacttttaatttcttttttaagtttagtttttaatgaaaaaaattatatttggaaaaggttttcattattttggcaaaattatgaattttgcccaaatttatttttgagttttttttgcacgtatttttgaaactaaaaaattgttcggatgcgtctcataatctaattccgaaccctctgtttaaatctgaatttccaagccaaaaattaattaaa

SEQ ID NO: 76136 - DNA, 1229 bp, Heterodera glycines
  Genomic contig location: Contig_ID=SeqID_12499; Location=872..2100; Strand=+
  SCN-specific regions: Sequence locations=1-127,155-157,179-259,527 -717,740-947,976-978,1157-1229
  Gene Ontology: Cellular component=secretory vesicle; Biological process=actin filament-based process
attgccaaaaagcctttaaccggcagcatatcatcaactcccaccaaatatcgcaacaatttaacaaaaatgcaacaattcaaaaaaaattgattgtcacagatctgcccgcaccaccgcaatcattgccccctcctcgccctccaccgcctctaagtcctccctgtttctgctcatcccttccacgtccatttgcggccttcttccagcccttttttgcacccgctgaggcttttcttttgccactgtggtcggcgtgaccaccgccaccacggcctccaccacgtacagcacttccaccaccgcgaccgcgaccgccaccaccgcggccgccatcgccgtggccgccaccgccaccaccgcggccaccaccgcggccgccaccgccaccaccgcggccaccaccgccaccaccgcggccgccaccgccagcaccgcggccgccaccaccgcagccgccaccgccaccaccgcggccgccaccaccaccaccgcgtcctccaccgcgtccaccagcatcaccacctaacaatcaccagtcatatttaaataaaaactttcattcggggtataaaaacgcacttttaaattttttaattatgcagtcacatcctaagattaagggattattaacatgccttttaatgttaatacctgcaaatttctctattttaaatatgtagagtatttttccaaaaacagtataaatcggcaaaatttttcaaaaaagctgcctaaatcacctaatcagtagggattacattttaggctctaaaactgcaaaaataggtagtctctaggctctaaaaaaaccccaaaaataggtaccaaaaaacctcatttttaggggtgtaaaatgacaaaatgtattcaaaaaggtaaaaaaatcagatttgattaaaaatcaatatgtttaatcagaaaatttgaccaccccgattaaatgctaatttaaaattagtaaattaaaaatttctccacctccaccggctccagcattggcaccatcagcaacagcaccgcctccagcatttgcaccatcagcaacagcaccgcctccagcattggcaccatcagcaacagcaccgtctccagcattggcaacatcagcaacagcaccgtctccagcattggcaacatcagcaacagcaccgccgccaacaatggcaacagcaccgccgccaacagcaccgccgccagcattggcttcaacaccgccttcaccatca

SEQ ID NO: 76137 - DNA, 1036 bp, Heterodera glycines
  Genomic contig location: Contig_ID=SeqID_12500; Location=1313..2348; Strand=+
  SCN-specific regions: Sequence locations=1-56,81-182,209-341,364 -402,431-875,902-939,968-1005,1027-1036
atgacgtcatcatggaaagtaaaaaatactccgccccttttcttgttggtcacgcccattggtttttgttttgctttgctaagaatacgactccgccttttggctttttagtttctttttttccgcctccatttttttttgctatttaaccacagtttttctaaataaaaatcattcgtgttccattttttaaaaaattccatcctccttcgttttttccgatcttcctgcaatgaattctcttaaacgctttcaactcccggagcaaggaacacgccagcaagaagagttggattccgttgaaccgaaaaacatcagcgatgtggtcaacttcaattcggccggcgttttttatgttttgggaaaagtgacaaatatgcagtaccgtgtttacaaagtccaaattaattaattaattaaattattaatttttctgtttttaggcatgcccattccgttccaaggggctcatttgtcgccgaaaattgtccgatgataacatgtgtgaggcttgcggccaaaaagcgattgcccccatccacacggtgtttgtccgtcttctgctacaggatgttgaacaagcagacattgctcaacgtgtcaccatgttttcgagtgttgccgaagagtttttgggaatgaaagctgctgaattgctcgccaaggagaaggagccggagagccttgcgaaacatttggacgatttgattgctgtgaagataattgcgaaagtcaacattaaggttgtttttttttgcaatttattacatatttgacaaaccacaacataggcgaacagtcagacttacactggatttgattggattgtcaatttgttcaagaagtgccctggaaaaaatgacagtgatgtgccaaaagaaaaagatgatgatgatggtgacgttgatgagattgctaccaaaaaaacaaagaaaaattgagagagagagagagagagagagagagataacggattcattttgttgtgagcttcaaaaaaaggatttaatgtgtcctttactttttaaaaaatcca

SEQ ID NO: 76138 - DNA, 777 bp, Heterodera glycines
  Genomic contig location: Contig_ID=SeqID_12500; Location=2554..3330; Strand=-
  SCN-specific regions: Sequence locations=1-619,640-670,692-777
atggttgctgcttttgaacgcttgtttaaacgctccaaatacataccatggacattgttgaccgaccaagggctcgaatttaaggcaaaagaggttcaggaatatttcaaaaataagaacgtgaaaaacttttttatgtacacctcgccgcgaattcacgcagggatggcagagcgggccaaccgaaccatcaaagaacgccgttatcgctatttcacggaacggggtacccaaaaatgggttgatgtgatacagcaaattgtgcatggaataaaccactcgtacaactcaagcataaaaatgcgcccagttgatgtgaattttgagaatgcagaaaagctcagaaaaaaactcaagcagaacgctgttggtgggacagcggaattaaagcggaaacaaccactaccacgtttccaggtgggtgaccgtgtgcgcattgagaagtacaaacacgtgttccaaaagggctacaccggacgcttcaccaacgaagtgttcactgttgccgaagtgcacactgaccgctttcccgtcacgtaccgaatacgtgatgacgacggttccctgatcaagggccgtttctatgccaacgatctctgtcgtgtgctagtgcgcaaaaatgatgatgatgatgatgataccctatatgacattgaaaaggtcgtccgaaagaggaaaaagcaaggtgttgaatacgttttggtgaaatggaaaggctacagtcaacggcacaacagctggattcctgcaagctccatgacatggaaaaatatataa

SEQ ID NO: 76139 - DNA, 899 bp, Heterodera glycines
  Genomic contig location: Contig_ID=SeqID_12501; Location=218..1116; Strand=-
  SCN-specific regions: Sequence locations=1-54,97-120,142-150,174 -179,201-378,400-509,531-585,650-799,832-899
atgccgcaatttgtaatgttagagccaacggatcaagtaattttatacatagtattggtttgtaaagaaataattaaaaatttgctttatgtcagggctcgggattcgggatttgttctcattttgggcttttttggagggataaaagtggaatttttgttctaaaaagaattggcgggtttttgggatttttgtggtttataaaatcattaaaagacaattgattcggcttcaagaatttaaaaaatgaggttttttatgctaatgaagactttgagaatatttaaaggctgatgcttattcctacaattttgagcaccgagctctgatagttgtaataataaaaaaccaatttttaggggcttttgcctaacacatttttgcttgcctgattttcctttttcgcagccgggcgaaatttacaagatttggaccgaactattaaaaaatttcaagaaactacaaatttttcagaattttttgggcggcgaggagtaaccgaaatagaaaaagcataatgttagcaagaaaaatcataatgttagcaagaaaaagctagttttagcaaattttattaggtaaatgatttttttagaaaaaaaagtttacaatttttaattaaatttaataaaattttatttatattttaggcaaattttactgctgtcctattgagtgagttccctgtcagttttggcgcatcaaatatcaactcacaaatcgtcacaaacattcaaaacaattcatttagtcctttattcatttattatcaaaataataatccgttgtatgtccggtgataaaatttaaataattttaattttttatttaggttccaattttaggaagaagaatttctaatggtcagcgcattggtagcatcaaattcaggcaataaa

SEQ ID NO: 76140 - DNA, 2789 bp, Heterodera glycines
  Genomic contig location: Contig_ID=SeqID_12502; Location=528..3316; Strand=-
  SCN-specific regions: Sequence locations=1-64,130-188,226-289,311 -314,354-420,529-589,632-746,772-866,888-1180,1202-1252,1275 -1496,1592-1772,1804-2095,2118-2789
atgaccgaaaatttcaatgaacaacggtccactgctctcatacaaaatggtgatatttgttttgaatatttaaatatttttaacataatattatttttgaaatttttaatattattaataacttatttagagaatttgccggattatcaacaaaatgagcaacgctctttttccattcccaatgatcgttaaaaataaatcttatttatgtttatttaaaaattacattgtatttagacttgactaatgagttgcccgaagattttaatgaacaacgttccgctttgtcagaaaatggttataatgaatttcggatttaatttttttttaattatttgtttttagataatttacaatatgatcaaaatgagcaacaacctgctgatgtcaacagacgtgcggatggtgaactaatagttgtttattattttaaatatttccttaattattataaaaaataattaaagttaattatcattaaaatttaaatgagttttttaaaattttcttataaatattgttttttttgaattgcaggaacagccacaaaatgaacaacaagcaactgtgttttttttgcaaaatggtgaaaatttaaaaaaaatgcaaatttttttaattataaaaaattcgaaaagttaaaccttagcaagaaattttgggtaaaatgtttttttgtttgagttcaattaactaattttgggtgtcatgaactgtaatttttttttcatgttccaacagaattgaaatttttatttttttattaaaaaaggcaataaatgtgaagaagctaaaatgaataatttctcggcgtttcggcaattagcaaaaatttcgaaaattaaggaaacttcatctgcgtttgcttttttgtatctttttaacatattatattcctttgttttctcgtattaaaagcttcttcagacttacaaattgcatttttcaataatacaaaaattgtacggtctgttgcaacaacaaaaaaacagttacggtaggtactataaactaaggatggtcagttggttggactcaaaacatccacccaaatagaaataattttgtcaaaattttgaaataaaaaaaaattctttttttgcaggccaaaaacaaacagatggatgaattgaagaactctcggaaataaaaaggattacactatttaaatcatgaatgtataaacataaaaccaataaaaccttgttaagcaattcgtctaaattaaattaataattgaatccttgtttacattattaaattaataaaaaaaacaattgcagaaaagttagtttttcttggcaaaacgtggccaaattccgctgaaaagctcccgagggaagcagcaaaatgagccaaaagcaattttaattgagctaattgacatttataatgagttgcaattggacgatggaattggggaaaaaaaagttgccgaaaatgtggcaaaaaggggaaagaagaaaatgggaaaatgaagaagaaaagaatgggcaaaaagaacaagaaaggaaaaggaaaaatggagaaaaaagaaaggaaaaaatggagaaaaaagaataggaaaaaatggagaaaaaagaaaggaaaaaatggacaaaagaacggcgatttttgcaattttttgagcggtcattggaaacgaaatgggacgtaaatatattttctgctacggatggacaaaatgaagatgacgattgatggtaattggaaaaagcattagctattttaaaataagtgcttttaataccaaaatatatacaaaaattcagtattttaaattaatttataaatttaaaaattgatatttggtaaattattaggtctaaaattgcctagaaagcgattattcttagtctaaatttgacctacatcccattgaaaaaaagtacgaatggcactcactccctgttttagtcaacaatcacaattttagtacatattttcatattcccatattttcagattttttgagaatttgagtttttttatttaatcttttgttttggtatatagaaaagaccaaattgtcattttaaggtggaaaatgaccatttttggcttaaaaaatatttcataaatttataacgaaaagatttttcattttgaaaacagctgagaatccattttttcatctttttgaggccgtaaatcggaagacctcacttttttgtgagaaatataagcaaatattgattttcctgcattacttattcattttaaatacataaatcattttgtgatgcaattggtcgtcgccgtcggaggcgtcgcaaacgaatgaatgcgcctgcttcaacaaattccaaccacaattcatctgatctgtttttatggatctttttaggtgtgctgttcatcgttgttgtgatttttctcaacttcaactgtcgttgttctcgtccatccgtagtcccaggcttaccacgtccaaatgttatggctttgatgccgccgcaaaatttggcttcaatgccgtcgcaaaatgttgctttgatgccgtcgcaaaaatgttgctttgatgccgccgcaaaatgttgcattgatgccaccgcaaaatgttgctttgatgccgccgcaaaatgttgcattgatgccaccgcaaaatgttgctttgatgccgccgcaaaatgttgcattgatgccaccgcaaaatgttgctttgatgccgccgcaaaatgttgctttgatgccgccgcaaaatgtggctttaatgccgtggcaaaatgtggctttaatgcggccacaaaatgtgactttaatgctgccgcttcctcaggaaattcaaa

SEQ ID NO: 76141 - DNA, 864 bp, Heterodera glycines
  Genomic contig location: Contig_ID=SeqID_12503; Location=117..980; Strand=-
  SCN-specific regions: Sequence locations=1-46,68-114,136-237,275 -347,372-431,453-797,819-864
atgagcgattggattttttggggtcgtaaaatgtgctataaaattaacttttcatcatcctaattttattaatgctttaaaaccatcgtgaattggactgcctataaatttagaaaaaattcataagaaattcataaaattttacgtttttttaataaaattctgtaaatccaatagaaaagccgatttaaattctaaatgattgctaatctttatctcttaatttccgaaccttagataaaattcaaattttagtaaaaaaaaataaaatttactgttcttttttacggatgattttcgattgttaaatttaaggcacaatttttgtttgtttgaggaagatttggtaatataatttttaaaaaattaatctcatggcgattaaattcatttgttcggcttttaaaatttttcgtagacttgaccatttccaaatttatatttttcatttttcagatcactcaattggaatgccgtctttctcaaaaatggtcacgatcacttggatcgcttttctccttccggtgccattttcaatttttgatcagtccagatcacaattttgttcattgcttttaggcaattttagcaattgagtttgatctgggcggcgccggccaacctaaaatcattcgattgaatattcttctgaaaaccgacccagccaagcgtcacgaaaccgaagtgaatgtcaacaatttttcgaaccaaaaggtacaatataaatagtatgtataaatacaggattccgtttgaatccctaaatggtaaactgggatttcatggtattttgatccagttaatctttgttttaaaaacattttcaaaacacggctttgaagaagattggcgaaattcaataaa

SEQ ID NO: 76142 - DNA, 1721 bp, Heterodera glycines
  Genomic contig location: Contig_ID=SeqID_12504; Location=1..1721; Strand=+
  SCN-specific regions: Sequence locations=1-327,353-450,472-503,526 -830,852-868,891-926,979-1333,1366-1489,1511-1721
  Gene Ontology: Mol. function=DNA topoisomerase activity; Cellular component=nucleus; Biological process=chromosome organization and biogenesis (sensu Eukarya)
ttttttaatttccaacacatttattcagggtcgaatttgccaaatggtggccaattcgctgccgttggaatggtgccgaacgaggcatttcagtcgcgaagctgcgcaaacactgctcgacaagatgaaagtatcggtttttttttttattcaattaaatgcttatcccactattttaaattttggcggggggggggggagacggactaaattaccccacatttgcgcctatgtccaaattcgggttcaacttaaattttttcaatcgctgatagcctaagcagttttatataagtgatagaaagttttgtgtctgctaatttgatgaaatttaaaaaataaacctttaaacagcagaattaatgctcctaatagactagaagattgggttttcttaatccccaggcgcaaatgtctaaacacggacggacgacgccccaataaaattagggaaaaaatgggttttagccctatctcgatttttttgttgcaatttaactgcttcacattcatttgcagaagtgcaccgctgccactctgtcatacgttttggccaatttgcacaacgtgaaaaagccggaggcattgcgcaccgtcgaaatgctcaaaatggcgtccattcggttgggcatgtccccggcgaggacaatggccgtggccgagaaattgtacacccggggaaacaccaggtttgggttgatagttttttttttgaaattgcccttcgaaaataggagcaataaaagcagtttttttaaattttgccaatccggcggaacccacgccgccgccaccgattatcccacactttgcgccgatgctcaaaatcgttttaaaaattttagttttttcgaaccagaatagcacaaataacactaaaaaattttttaaactcatttgttagtaattcatcatagaaattttcgaaattatttttttttgaaaaatttataaatttgtaaattttaaaaaaaaattcttgagggggtgggggaaacgtgctgccccttaaaaataaacagtttccctctcaacttgtgtaccgcaacaatttccccagttacccccgcacggagacgtccgcctaccatgacgagtttgagtttgagcgtgttttgtccgcgttggaacggtcgccaacatttgcccgcattgttcggcagattcgctccgatggcaaattgctgcccgaaaatgggacaaacaaaggcgaccatccgccaatcactccgctacgttcattttgtctagatggaggtgcgaaaaatcaagtcaagtcggccgttaaccgaaaaaatggtaaaaaacagttttcacattataataggaagcgaaaaaaaaaattttttttaagtaaattaaattctcgagtcagtccaaaaatgggcgaatagggaaaaaagggcgggtgtaaaaaaagggggggggtccgccggcgaagaggggaaagaggtaaaaaattttgaaattgtacaaattttcttacaaattagaaaattcattaaaaattccaacattttcttgacctcgcaaaatttgccgctgacccccccccccccctccttttcatgcgttttttgcatattattgttaataaatgaatgcttcgtagaagtggacaaatgcttgtacgaagatgcgcatgcgctttacgaacaaattgcgtaccattttctcgccacgcttatgcgcccgtgcaaatacatgctcaaaagtgtgat

SEQ ID NO: 76143 - DNA, 2354 bp, Heterodera glycines
  Genomic contig location: Contig_ID=SeqID_12505; Location=97..2450; Strand=+
  SCN-specific regions: Sequence locations=1-95,117-122,144-668,690 -729,752-827,851-935,957-999,1048-1204,1226-1529,1551-1634,1656 -2014,2035-2139,2161-2310,2332-2354
atgatttttccaaaagtatgtctcaaaattacctaaatattctgcttttttctacggcgccgaaaatttaagtcaatttttctaacttccaaattttagaaaatattagtgtaattcagaataaaattttgaaaaatcaaaaattttaccgtttaattgcaatataatccataattttgtttgttttgctatgctttgatttttatatgttaattttgaaacacaattcagctgaaagaagaaacgctcgcgttctacctgaacaaattttgcaatttcgaacaacgaattgacgacgttgaggaacaagtcagagcaggtgtccagcccatcacattagtgaactaatgagctcttaattaggacccggggtagtaggcaatttcgggttcatacatgaaaaagggggtgagatcgacagaatgtttttttggatgggagggggtccagctgccggggagaattttgtgaaattttatgctcggcttttttttggtcttgattctcggaacttttggttttcttttcatcataattatgaaactgaaaaaagctcaaaagattttctgacatccttttttgcggcgtgatttttcgaattttttttttaaatagcggtgctatttgtaaccaatttttgtccaaaaaacgaccgatttttacgatttcatgaatttttattaacaattttcactaaaacaatgtaaaaaatcgaaaaacgaatttcgattttggccaaaattttacgaaattgcctcgcaattccgtacgatttacgaaattgacccgccctcgctttgcccacctaaggagacttcccctttttgaataatattttaaaaattattttgcagaaatttttgacccggccaatccgcgccgtcaatgtttcaaatgtcgtcgtgttatgctaacggttcgagcggtgtttaatcaacagatgcagcaacacatttgtccgagctgtcaggtgtggtgaacgatagccaaaaaacaaacaaataattaaaaaaaaaattgtaattatttataaaatttgaattttttcgagaattacacaggaaattcctttaataatattaaattgaaatatacaccattcgatagcccttttaaagctctacaatttcgctcacagtgactgtttttcgctaaaaataaaccccaaatgaattaaaggcccgcgagactctttctaaatctcaaatttagtattttttggatagaatctgttatcaaacttcactcaaataagctcgccgcaaaaaaatgagaagcaaaaaagagcgtcgattgggtaaaaattgaaaattccgtccaaaaatttcttattttttagtttttcagtgggaaagaaagactttcttgttttttcagattgcccacgagttttcccgaatctcccgccattgaacagatgcaacgatttctcggcgtaaatccagcaaattgcctgatctgatcatttttcgttttactttcattggccctttcactcaatcaaataatttgtccaacaaattccacaattctttcttctttttctgttcgcttgccttcaattacttttttttactcaaattttacgatcacttattatttcactgatcactttctcagttctttttgttcaacaaaatcccaatttttgaaatcattcgcaaatcccagaagaatacacacaaaatattattaatatgtataacttttttctttgttcaccaactttatcaaatatggtatcattcgaaagctttaaatgtttagaagatatttctaagctattcgaagtgattaagcagctcaacaaaaagttgtcgcttgaaaacataaaaaggcagaattttcgaagttttttatctctatctttttttcagttcgatattctctgtaattatttataggcgaatagagcctgtgaagagctttcgaataataccaagattattggattatatcaacaatttaaaaggttatattgatttaaagttggctcagacggagttggcccgttccccccccccccccccccccgctggacgtccttcgtatggaatcgggtcgaccccgcctttgattgcatgtatctgccgacattctgacattttatggggggtggcggcataacggaaaataccgcaaatagacttatattatcttatcattacgtgatgcgacttttagttacaaaaaatcacgaaatagttaattaaaatagtgaggaaaaatacaaaaataatgacaaaatagtaaccaaaagttcgaaataatagtgatataattctcagcctttaggacacgtaaaataagaaaattttattcaaaaagcaacaaaattaagccaaaccaatgaa

SEQ ID NO: 76144 - DNA, 2697 bp, Heterodera glycines
  misc_feature (763)..(763): n is a, c, g, or t
  misc_feature (776)..(776): n is a, c, g, or t
  Genomic contig location: Contig_ID=SeqID_12506; Location=113..2809; Strand=-
  SCN-specific regions: Sequence locations=1-359,381-533,566-598,622 -751,796-1179,1201-1288,1319-1346,1369-1782,1853-1953,1976-2033,2069 -2094,2127-2501,2535-2550,2580-2697
atgtgttttatggggtcccaaattcattcagatgccactgcaattgacggcgtcgctgttggctgcctttgccatcagtgccgtgtctttagccgtccgggcactttggctaatctatgtgatgcgaagcgacgacctgaggcatttggcaatccaagccattttggtgcttgccatgaatatcaacggcattttcattgtgggtttaagtgaatttacgaaatgcgaattaccaaaaaaaaaaaaaaaatggaaatgagtaaattaatcttagacagttgatctgattattaagaacggttctttttgatacttaaaattgcgcaaaatatatacttaaataggtgttaaaaattgccaaaatattgtccaaaatatagaattttgttaaaaaaattgtaatctaaattaatttctttcgaattctagtgaattagttttttgatttctgggaaacgatttttattatccggttttcctatcagatttttatttaagtgctattttgttaaaaaaataattagttgatatccaaatttttaatttattaaaattgaaaaattttgggttgctttggtatcaaaagtgaaattaatcatgaaaaatatcctcaaacttattgttaattagaaatgcgatttccatgcttcttaactggaaagtgcaaaaaaaaaagatcatatacttcaaaatccggtctctcttaataagggattgggatgtttggcttgagaaattccaagggattctgtataatttattntaatttatttatntaatgataaatttttatttcttccttcattaattttggccaatgaatgccccgtcgtccatttcagtacattcccaccgaattggttcaacgacggacattccgcgagacgcgcaaaagcgtggagaatcggctccatttgcaccgggacaaccaaaagcaggagaacattttgctgtccgtgctgcccaaattcattgcgttggacgtgcgcaaaaacatcgaccggacggagccggcgttgcaattccgaaaaatttacatccagaagtacagcgagatctccattctgttcgccgacatttgcggcttcaccaatttggcatcgcattgcacggccgaggatttggtgggtgtgccaaaagtgggcggcacttatcactagggatgggatttttagtgataaaaaatcccaaaataattaactaaatagtgagaaaaaaatgccaaaatagtggcaaaaatagtggcgaaaaagttccaaatttaggggtgtaattttttaaatagctgttttttaatttgaaaataatttaaaattaaggcaaacaattttattcactgattccagttacaaaatattttttagcaaatattgaacaagaaaaaaaaaatttggggaagaatttttgtgaaatttttccaattcttaggggtttatttttgaaaattttttaggtcgattcttatttgttaggggtgtatttttcgtccgcagaaaaaatagttaaaaaactaaaaatcccatccctacttatcacaaaggaaaagcggtgccatttccttcaaaaatcatacaaaatgccattgataagcaattttaaatttgaaataacaaacaaatgggcaatgtaataaattgataaatttttttaaaatcaaattctaaggtgctaacgcttaatgaactgttcgcgcgttttgacaaattggcgcatgaaaaccattgcatgcgcatcaaaattctcggcgattgctactattgcgtcagcggttagttggataagaattttaattaataacaaattttaaataattaaatattttctttaaaatgtatgtttaattttattttttgtttaaggctttcctgaggcgcgtcctgaccacgcggtctgtgcagttgccatgggattggacatgattcacaccatcaagtaaaccatttttaatattgctaatttaaattaaaaaataattcaatagattttagtcactttcttaacagattgtgtccaaaaaatgacttaatgcggaatttttcagcaaaatttttatagaattaataagatggaggctattccgacgggccgaaagcagcgccgggaattttcacaaattttggatgaaatttgcgatgaaaatcacttaacgttcataagaatttattgtaaaattttcagaaatatttgcattctgtcttttaaaattttcaaaaaaatcaatgcctgtccgcggaattcaacacaaaaaatcaaatttgcgaattccgctacgggattggaactcaatttttgcgggacgagatcctgctagattaatcctgcaaaatcccagcaatttccaaaagatgcgaaattgcggactgcgattccgtgcaggatctcgtccccgcgccgggtctaattttgaagaaccatgtactactcacccgtgcttttaggttggtccgcgagctgtacggcgtcaacgtgaacatgcgcgtcggcattcacagtggcaaagcgcactgcggggtgttggggctgaagaagtggcaattcgacataatgagcaatgacgtcacgctggccaaccacatggaaagctcaggggtgccggggtaagaaacaacaaatgaaatgctgatcgcaattgattagggcttctctgagagatggcatttaaatatttggagttttggaaattcaagagtgattaaa

SEQ ID NO: 76145 - DNA, 945 bp, Heterodera glycines
  Genomic contig location: Contig_ID=SeqID_1815; Location=1258..2202; Strand=-
  SCN-specific regions: Sequence locations=1-136,160-258,322-571,597 -598,620-660,689-739,800-842,865-945
atggctgaaaatgaagccgacgacggaatattgcgcgaattcatctgtgaattggatgagcaattttcacttattattgcagtgttttcaactcacaattataagccatcattgaatttaatcaatgttgatgaggttaaaaaaataattttttttaatgaagtttacattaaaaagggtatgaatatgcatttttggtcgaaattcgccgaaaaatttcagtttgggcatcgcgaaattgggcatgttataagtttcaaaaataaaaatattttaaattgtaaaaaatgcttaacgtataatttaataattaattttaatcaatgtaaagtatttatgaattgcccattcacttacaatggcattaaaaatccttgtattatttgaaaattcattatgttgaaaactcaaaattttatacttttagatagaatatacggactcccgatattttggtgtccttataagctggggggttcgactctaaacccaagcaaaaactaatacacgtttagccctacttttaattgccaagaattgattaaatatataataagattgacaggtgtccatttatttaaaaaatatttaaatttccatttaaaagtgataatttttaagcgcagctttgataatttaaggattaaatcacatcgtaagttatttattttttttatttttaattaatgtcaaaatgaccaaatttccagctgccaaaacttcctgtcatcaaatagtctatattattttaaaaatttttaaaaatgatatcattttttacattttatttctaaatatactttttgtgttcttttgccatttcatacaaaatgggaagcataaataggggggctatttaaagaaagaattttttagaattacgcaaaaattttcgaagatagaactaaaagttatgggagaaaaaatgagccgattttaaataaa

SEQ ID NO: 76146 - DNA, 86 bp, Heterodera glycines
  Genomic contig location: Contig_ID=SeqID_1815; Location=2741..2826; Strand=+
  SCN-specific regions: Sequence locations=1-86
tagggctgtgcgagaagtgatttttacctggaaccgagaaacgagaccgagaccgagaaatgaccccgagaaacgatacgagaacc

SEQ ID NO: 76147 - DNA, 1980 bp, Heterodera glycines
  Genomic contig location: Contig_ID=SeqID_1815; Location=2295..4274; Strand=-
  SCN-specific regions: Sequence locations=1-278,300-753,775-944,966 -1039,1061-1210,1232-1408,1430-1686,1720-1926,1956-1956
atgccctctggaagtgcgatttggcaaatcgggctttataaaaaaagcaacaacaatgaatttgagtacgaatgtgctgaatgcagtaagaatattaagtgcaagcaaggcaacacctccaatgcgataaaccaccttaaatcaaaacacaaaaacagcgaatatgaggcgaagtatgaagatttgttgaagcagaagcgaggtgagaaagggacaatcgaaacacacttggtcttaggaagtggtacgttatattaaatgtgcatatgtattggttttttaaaatttttaagagggtctttcatcattcgacaaaaaagtaattcattggatcgcatgcacccaatcatctttctccgatatcaacaacccgacaacaatcgcacttttcatgggaaacaatccgttgcacaaattgaaggatgagtcaatttatcgtaaaaaaaaattttgacgatatatgggaaaacctaaaaccatcgacgtcaaagaacttcaaaaaacaaaaataatgccataaaggttaaacaaatttaatttgatgaaaaaggaattgcgaaaagaaagtgtttataaaacgatgacaaatgttcaatttgaatgcgaaattgggaaaaaaaattagacacaaatcgtactgaaattttcgtcttcctactgacatttttttctttaattaaatcatcacttgcttcaaaacttttagttttctatcacatctatttgaatctctttcctccgaccgtattatattttttaatttcaaatgtttttgcaaattattcagtttcgcgtcgcccgcccgcgattccgctgacaatgcgttggcagtggctagggttgtgcgagagtctcggttttcttaacaaaattcattaaaaatcccaaaaaaattttccccgttcaaaatttgacctaaaaattgccattttttcaatgaagtctgaagaaaaatatcaaaattttccaatatttctcacgcggcgcctatcgcggtatggggcgaactccgtctagccaactccgtttaagtagatttcaaaaattgttttctttgttgataaaactcagcaaactcgaaagctttaaatggttagaagattcgacattctctataacaaaaaaatatattgattcatttgtttagacggagttggtccgttccggtctatcggtaccgccggaccccaaaaacttaatatttttttcataaaaaattggcctttttgggtaaaatctgttactaaatcgcacaaaaaatccaattttaccggcgccgcctgtcgggtccgccggtgaagtggaagcccatcgcaaaattggctgctccccccccccccccccccctcaagactccttcgcaaaaattctggttgattgacctacccctttttaatgtgtttttgatttaaaaaagtatttttgaatcaatttcatttaaatttctcggttctcgtatcgtttctcggggtcatttctcggtctcggtctcgtttctcggttccaggtaaaaatcacttctcgcacagccctagcagcggcggcgccccttgcgcaattgacgacttgaaggagatggagctgagtttgtccggcatcagctcgaccatcatccagcagtactgtaaagccatactcaactgctacttccactacgagtcagccccaattttcattttcttattgaatatttttaattaaaaataacaaataaaaattgatttcctcccatttttgtgatggatttagtccgctttcagtgaggttgtccgtgtcaactcagcccaagtgatccggcaaacgctcgagcagggccttgtcaatgcctggcacctcggtgcccacactgatcgccatatccaccgacccgttgaccaacattcgggcacaggccgttcaaatgccctcccccgcttcttaggtctatccgctgggttggctcgtcaggccacgtataccaccactcggctgggcatttaa

SEQ ID NO: 76148 - DNA, 193 bp, Heterodera glycines
  Genomic contig location: Contig_ID=SeqID_1815; Location=4601..4793; Strand=-
  SCN-specific regions: Sequence locations=1-193
atgtgcaacaatttggtttaatgaataatttttcccattaaaattataaatccaggtcggtcgttatgctcatctcggcactccagagaaggttgttgagaagttggtgaaacacgtgacactgctgaatgcccttcacgatcgaggtgtcgaaaacaatcaagaaaatggaaataaatacccaaacttttga

SEQ ID NO: 76149 - DNA, 263 bp, Heterodera glycines
  Genomic contig location: Contig_ID=SeqID_1816; Location=289..551; Strand=+
  SCN-specific regions: Sequence locations=1-70,92-124,154-263
atggcctggacctggctggatcaggaaaaatccaagcctggatccaggtattggttgaactagtaataacatttttgaataaaaatttattagaagaaaatttttttagaagccttcaaaattcttaataattaaatatttttataatttttaccaattttccataaaatgattacaagtctttcctatgcctaattttcagataggcaatctgagaatttaaaatttggattttttttgagggttggaaaaattttttgaaa

SEQ ID NO: 76150 - DNA, 1903 bp, Heterodera glycines
  Genomic contig location: Contig_ID=SeqID_1816; Location=1777..3679; Strand=-
  SCN-specific regions: Sequence locations=1-39,63-94,123-258,290 -439,461-575,599-791,837-1903
atgggtacgcccaactgtgcagagaaaagcctagtactatctcgtcgtttctctttttctttataatttctctcactttggcgtactatctctttatttttaacaatgtaaaaaacaacttttacttttctccgtctaactttttttctatacgttaaacctacaccaaaatttgcatatcgatagagaaaaaaattctgcattattctatgctcaattattattgtctgtgctcaaactcaaaagttaagaagttcctaataaaaaatattttttaattagattttatggccaaaagaaatttaataagtaaactacagcgcaaaaaaggggcccaggaacgttggaaaaagtgggaggacaagcgggaggagagacgcgcgcgaacggccaaagcgacagaagcccgttgggccacgaaattgagtttttacattcatttttcataaaatatgcaattttcccaaatttaagccgctccccagcccaacaccgatgcagaaacaccacaaccatccgaagatgagccgccgacatcagaggcaccggcgcgggacaacgacggacgaccaccatcaactccaacaccgatgacaccgcaggaaatggacgtgccgtcggtggagatggtggacaccgatgtgcaaatcccttcaacgcctgccgatgaagaccaacaaattcaaccaatgccgtcaacatccacggcacgctgtgacctcatgtcgacaccatcgacttcaaagtgcgccggtgcctttggtctcgatgatggtgagagaaattcaaacaaaaatttagttttttttaattcatttcatttttattatttttaagtccacatgtttgacgagctgcgacggcgccacgtttggaccgaggaggaactgcagcgacagcgccggtcgaatgcctttctacggaaacagctcaaggcccagcgcgaccggtcaacaagccttgagcgatcggcttcggcatgtcgccagcgcaaggcactttccgacgtgaccaacaaccagcagggggacaacaggctgagcgcggcgaatgatctgctcatcacattggacgcgggcatctcgttcaaggcccgtgaagcgttgaagcggtctttcgccggccaaggacatgatgtttgggcaccgacgagagcagtgaagcgtctgaaggcggaactgtgcgaggcggtcaatttccattggacgggcaatggtgagacgcgtgcgctcgtttccgttgacgttcgtgcaatgatcgagggccgtcttcaggatttggtgaacagtggtgagagagagaaaaataatcgaattttaaaatgttaaatgaaggccgactgaaactccaccagcaatttgtctctcaaattgtgttggtgctgacgggtgacaaagggggcgatggagtggcggcaacgacaaagttgggactggtgatcggcaacgttgatcacccgaattcccccaaaaatctctccattttgggtatttattttgggaatgatgaccggaaaaatttggagaacaaatttggctcaatttttgcgcaattgaaccagctgaagaccgtttcagtggaaattgccgggaggaagcggaccattccagtccaaatgtaaagaaataataaatatcaggaatgttagttttaaatttcaggcttctctgtgcagacctcaaattcacttcggcactgatggggcaccagggatctgcggcaaccttcccttgtccactgtgcacagctcgaagagaccaattgtcgaacaacattgtcggtgctcgcccgtcgcctcccccactccaaaattgtacattggccctccccttgtcaacattgctttgacgaatgttgtaccgccgagtttccatcttttgcatggtgaagaaagcgaattaaa

SEQ ID NO: 76151 - DNA, 748 bp, Heterodera glycines
  misc_feature (68)..(68): n is a, c, g, or t
  Genomic contig location: Contig_ID=SeqID_1817; Location=841..1588; Strand=+
  SCN-specific regions: Sequence locations=1-75,122-258,291-453,476-748
atggaaaaaggacggagaagttttccttctccggagccgctcgggaattttccgggggtgagtcgacntgactgaaaaggaggggatggagaaggaaagggacgggaggagagtaagtgggaatctcgggatgaatggggctctcctccgctttagctgtgttacccttggcttttaaagggaacggcgggatccgatagcgagaggcggggtataatgcgattgcctaatcgaagaagaggattattggaaaatcgcgggaaagtgaaggaaaaggaaagggaaaggaatttgtaaaaggtaagggacctaagaattagaaaatgcctgtgggttacataaagaatgagctatcttcttgaaaaatgaacgtattttttgaatattttttttcagtttttgtgacatattttttccatttttgggggtttaggacatattttggttttttggcacatatatatgtgcatatttggaattttttaggacataaaatccagctctgatatgaataacaacagtaactcatcttcgtccgttaatgcatttggagagtccgaccaaatttacgtgtacaccgtatgggtgaccatcattcagcaaattttgtcactttttggcattgccctaaacagtgcactcgtctatatcaccatcaagcacaagtcagtcactagaattgtgttagcattgttttgaaatttcgttttgaattgacgacgttatttttaattctaaactttaatta

SEQ ID NO: 76152 - DNA, 316 bp, Heterodera glycines
  Genomic contig location: Contig_ID=SeqID_1817; Location=1821..2136; Strand=+
  SCN-specific regions: Sequence locations=1-110,161-316
atgaaattaggaaactccaccgaagtttcggctttctgttggccatctgttctttttgtgatgcactcactgaattggccactccattggctaccggtaaaataattaaataattttatttttattattattttttaaatttttagttctcgtttttcttcgtgtgcggattcctctgttgacttgtgtttatgcccaattttttgctttcactggaagtattaattcatttataaatctgttttggataagcgttgatcgatttgtggcattggcatttcccgttttgtaattatatcaattattattaagaaaa

SEQ ID NO: 76153 - DNA, 473 bp, Heterodera glycines
  Genomic contig location: Contig_ID=SeqID_1817; Location=2350..2822; Strand=+
  SCN-specific regions: Sequence locations=1-121,143-259,281-282,304-473
atggtctattgtgagcctggtgatatgattcaaggcgaagtatttttggttgcttctcttatcatggttatttttactttggctacaattgtcatttatattataatggggattatgttaaaaggtaattaaaattaaatgacttacggtggttgttaaaaaatgcattttgatttcccagtgatcagaagtgatcagaacaacagcaacaattcgtcccagtcccaaattgaaatcactcgtcgcattttcaaatcattggctgtgatcatggcagtgatcttttgcttttggtttttgtttgcactgatcaccaacattttggcacgaggactgatcaccattgagccatcactgcaatttcttatcattcgattagcagcgcaaatggtcacaattgctggagcgatcaatgcaccaatcctatatatttgcaggcaaatttagaattaatattaaaaaaaactttttta

SEQ ID NO: 76154 - DNA, 873 bp, Heterodera glycines
  Genomic contig location: Contig_ID=SeqID_1818; Location=33..905; Strand=+
  SCN-specific regions: Sequence locations=1-101,152-211,233-273,295 -456,539-873
atgatacaaggggaagtttatttgctcgttactcttatcgtggttatttttacgttggctacaactgtaatttatattatcatggcaattatgctgaagggtaaatttaattacttaatttctaaaataaattttaaaatagtttttaattgtcacattagtaaaacaaatgaatctttgttgctcaattttcagtgatcagaagtgatcaaaacaacagcaacaattcatcccagtcccatattgaaatcactcgtcgaattttcaagtcgttggctgtgattatggcagtgaccttctgcctttggtttttgtttgcactgatcaccaacattttggcacgaggactgatcacgagtgatccgtcactgcaatttcttatcattcgattagtgatgcaattaaccacaatagctggggcgatcaacgcacctgtgctttacttttgcaggtcaataaaataaataattaaattgaattaaaaatacccaaaataataaaatgagattaaaaaataaaataattaaattgaattaaaaatattcaactataacattcattaattgcttttcgagtgaataaaaaaacttttattttttctacgaaaaattttgttgccagaaaactgaattagtaaaaaaaatgaaaatacattaatatcactaacaaatattcaatattatttcatttttagctctgaatatcatgaaataatgaaaaatgaatttccattggccaaatttttactgtgctcaaataatcataattcgccagtcgttgttgtagctgtcgggcaacaaattctcggttctcccaacatacaagcaaatgcatcataatagaagaaattttgaaaaattttaatttgtcata

SEQ ID NO: 76155 - DNA, 1845 bp, Heterodera glycines
  Genomic contig location: Contig_ID=SeqID_12508; Location=65..1909; Strand=-
  SCN-specific regions: Sequence locations=1-934,957-1067,1090 -1131,1153-1406,1429-1845
gtcagtcctcgtgcacccacccgattcgagacgggcattcgcctgttcagcacggtgccggcctccaaagtggtggacttttttattgcattgttgcgccatgcgcggattgctgattctcgggaagacgagccaacgacggcgtattttggggatggactcggtgcggaacacgtgcttgttcaagttggtcataaaatgagcgaaagcgaaatcatcttttattttgcagagtttctttgtatggttagaaaatacggagaagcgaaaccgcaaggggttgccatcgtcaacgacggcgacaccaaatgccccagcgacaacggcagcgagtccgagcagtactgctgcagcagcgaaggtgcgactagcgaccagcgattgtgacgggttcagaccgtcgcagcgaacaccgacgccaccacggaaaggtggcggacgagcgaagcaacaacgacaccgagccgtaactgaagagcaacaacaccaaacacagttgcggtgggagaaggggacgatggtggatcagcaacagcaaaccgaatttgctaataatgatgaagacgggaaacagcacaagaggaacgagcaacaacagtccacccatttggaagcgatgagcgacaaacttcggaagattttgtgcgagaatgaacagcagcacgacgaagacggacaaaaacagggagatgaacaaacgcaattacagaagcagattgaggacgacactggggcgaacgatgctgggaatggggaggaggtaacgagaaggaactaatcagcagtactgatggagcttctggtttcaagttaggggaaaacctgacatattttactgcatagcgagtcgtcgcgaatcgaatggtatcgcctgaaactgttgatccatttcagcttagttttaaattgaaaacaaaaatttggtgtataattgaaaaaagggggagagagagggtggcccgatcgcctgacagcttacgaataaaaacgctagggccggttcggtccaacaaaaaattgtgtgggccaaattggagtttgtcgacctttgttttctcaattggtgaccttccccacccctcctctttaatctatgaattacactgtttcttcatcctgtaaaattcatgtaatccacagggcactgttcacactgctgccgctgctggcaattccatcaccaccctttcccctcaacttccctgtctgaatcgcgttctgatcacctctttccatcgcgatcagcttgtgacactgctcgccccactcagttttccgccacggacccactcaaacatttggaagacggtggtcagcgtgttggagctgaagcacgcaaaatacttgaccacttttgtcaccattgtcaaagagatggttcaccaagggcaaattgggtgagattttgtcagtttttattcatttgcacgtgtacattggcataaaatacaattaattgggcaatttgtagttttttttttttgatttcagtttcgatttactcaacttttgcctccagcatttcgctgataaaatgcatttcaacgttcaccatttggtccatgcgttgttgttgggtccattgtgcgcagcaacagttgaacaatttgcggccaatcagagcgacgactttcgggcacaatcacgtgccttactgcttgaagttgacggggcgagaaaatggcatacaaaaaaaaaatctttttgaaggctgagtcttggaaatacgatgagaacaaatggcgggctgcctccttagcttacgcacatcgaactcatgaacagttgcccgacttcaaggtgttttgctacaacgttaacacactgatgaacgagctcaacatg

SEQ ID NO: 76156 - DNA, 492 bp, Heterodera glycines
  Genomic contig location: Contig_ID=SeqID_12509; Location=249..740; Strand=-
  SCN-specific regions: Sequence locations=1-492
atgaccgcttctaccgcagtgaatccgtcgacccttttgccgttggaactgatcgacaaatgtgttggttcgaaaatatgggtgatcatgaagaacgagaaagaaattggtcagtggtcaaattttttcgaattttggctaggcttagaattggttgaagttggtgtccgcttcgtattcagtggcaaaaaagccaggggattttttgccaaatattagtttaatccattgcaaattaaaattaatgaaaatgatgctttttcagttggcactttggtgggctttgatgactacgtgaatatggtgatggaggatgttgtcgaagtgagaggcgtagaataattcatgaaaatcgatttaattgctgttaatttattcttttagtacgaacgaactcccgagggaaaacgggtgacaaaattggacacaattttgctgaatggcaatcacatcacaatgctcgtgccgggcggagaagggcccgaaatttga

SEQ ID NO: 76157 - DNA, 580 bp, Heterodera glycines
  Genomic contig location: Contig_ID=SeqID_12511; Location=46..625; Strand=+
  SCN-specific regions: Sequence locations=1-144,169-169,191-317,414 -429,470-580
atgcgctacccggacacgggagatgaggaggcagaaaacgcagcgcaaggtgaaaaaaccaaaatgaaaatgaaatttaaatttgaaaaatggaaaattatttaaaaatctaatcaaattttgcgtagaagatttgctgatcagcaagaaaaagaagagcaaggaggatcaggaacaacagcaacagcagaagggcggaaatgcctggctaaagagtcatgacccggacttgcccgcctcgctgtcggaggtggaaaacagttcatcgtcagtgatcggagcgagacgaaaagcggaagacgacacggcagagagtggggagatgggagagagtggacagcaggaggagaagaagcagagcagcagaggggaagagagtgggaaaaagcgagagggcggcaggaggaaaaagacaaaatcgaccaccacggaggaggaggaaagtgaggaagaggaggaggaggaagagagtgccacgccgttccggccacgcccttcgaccatcatcgggttccgcaccattcagccgatgggcaccggtcagtgccccgagcaaacggtgttggcgccaacatactag

SEQ ID NO: 76158 - DNA, 1315 bp, Heterodera glycines
  Genomic contig location: Contig_ID=SeqID_12511; Location=1527..2841; Strand=+
  SCN-specific regions: Sequence locations=1-436,468-656,678-914,936 -1083,1105-1315
atggcgccccacgcgacgacgacgccgcacgctgacgcgccatcgcccgccccaccgccggaccccgccgcgtcgccaccgcaaccgcagcgcttcgagacggcagccgcgtacatccggcgcaaaaaccgcgagcgacgaacgcggaacctcacagtggcggtgacggagttgtgcccggtgcggcaggacgagtggacgacgaggtgcacaagcaaaacgactggcagagaacagcatttggcacccaattaagggctaatgtgccacgttttagagctttctatagcgaattgcaatccccggcattaactgtaaaaggaattcgttgtgaaaatttattttcgtttggcatttttttaattttggtgtgccattttttctcagtttttgtgccattttctgttttccttttttttcttatgtgagaattaaaactggaggaatggggaaaacattttcaattttgaagcataaatttttcattttgattactcagatttccatctgttgaccagcccgactatcagccgacttcgccgggcggcggcggattggccaaccgacggaagggaagcgtaggaggacaaagtgaggaagggaggtaattagggacagacagattcaagacagattcattatagagcaattcattagggagggaggggaggggagtgattaattaaggaggtgtaattaggaggtggtcaattaattattaataatgtaggggataattaggaggtagtcggtcaattaattagctttatttcgtcatttaaagaattggatgctcagacatcgcccggcttgggctatcagcgtccgggttatttggacgaacgcaaatacggcggcggcgagtcgaactttccacgacaggcaaagccgacactttatcttaattgcctcaattaatgatattaaaatcatttcagaattacgtcgatcgacgaaagtctttccacgaaatgtcgccgccctcgggcgacgagccgccgtacgaccggtacgcaattgccggcggttatttcaactcattggtcggcaacacgcacgtgccaaacaacatcaggcaattaattctatttgaaaattaaaatatgagaggattttttctcccttagccgcttcgaggacgaagtgtacaacgcgttcaagcagttcggcggtggtcatggcgcatggaaccgagggcaggagaaagagcgattcgaagtgtacaaaacgatggcggaacgatcggccgaatttggacgcagcgagtaagccaatcacagcattatattccactaatagcattgcagggtcacca

SEQ ID NO: 76159 - DNA, 1438 bp, Heterodera glycines
  Genomic contig location: Contig_ID=SeqID_12512; Location=74..1511; Strand=-
  SCN-specific regions: Sequence locations=1-520,543-1270,1293-1438
atgattggtgttcgcgcattgccagagcttcgttttagtcgtaaccgtgtgttgcgtcccgacgcgcaaaaagttagtcggattatttaaaaaaaattaatcttacaattagctataatcgtttaaattgcgcttttaaagggtgactggcgccgtgacgcgggccgtgcggaatatttgaagacggaagaattggccaactggctggtgctttgtgcacgcaaccgttttgacactgcccaacagtttgtggaacgtttgggtcgcatgggcaacgaaaagggcattccgattgcggagccggagattgtggctttcaacagcccggatgtgagtaacaaattgggaacaaaactactaaaaatggcatactgttgcccagtatatcttttaacttgggatgggatatagaactcgatcccaggagtggtttatttgaatcttacaagcaaagatttcaattttttcaagccttttctggatcatcagcagatttttacaattcattacaaaacgctaatacaattgtaattttgtcttttcaccaactacattgatgctgctgtaattctgacataaaaaaagaaaaaaccgcttttcgaatttagcaatttcaactcaaatatttgtctgtctggtgattgaaaaaaggcaaccattaatttgcatgacatgttttaatgtttgttttccttgtcaagaactcggaccgagaatggatgacgatgttcgagcgatgcgtcaacaagcacatccaattcatcatgctggtggatgaaaagcgcaaggacacccacggactgctcaagctgtcggaggcaatgcacaaagtcaccacgcagcatgtgacgctggagaaagcgaatgtacggcggtttaaaaaaacgatggatttcgcaaaaactgaccgacgacaaaatggcactccctttttaaggacgttgtgcggaagaaccagcgccaaacgctggagaacatcctgaacaagctgaacatgaagaactttggcctcaactacgtgccggtgatggagccgtcggcgtgccgtcgcttttcgctcgaaagcggaaatgtgcttgtggtaagataaaagacagaacaaatatacgcaattactaaaatgggtttaacattaaaaagactccacacacactttgaatttgcggttaatttgataaattttcatgataattattctataaatcctaattaattagttactaatttttcccctttacagatcggctacgatgtcaaccatcctggtatgtgttacattattttctcaaaagaattaattgaaattctatatgatcatgtttttctaaccaaccatttgttcttcccgtacgtagctcccatgccgcaacagacccgtcgtttgttggcatcgcagggcgaatcgcaattgagctcgcttgacccgtcatgtgtcggg

SEQ ID NO: 76160 - DNA, 120 bp, Heterodera glycines
  Genomic contig location: Contig_ID=SeqID_12513; Location=1241..1360; Strand=-
  SCN-specific regions: Sequence locations=1-59,82-120
gactcagctcgccgtgaacggtcgtcgcccgacagcggtggcggtgattattacccgccggagcagcagcagcgcggcggaccaccgccgatgcgggctgaacggggcaatattggcgag

SEQ ID NO: 76161 - DNA, 751 bp, Heterodera glycines
  Genomic contig location: Contig_ID=SeqID_12514; Location=660..1410; Strand=-
  SCN-specific regions: Sequence locations=1-169,209-302,361-457,483 -559,597-751
cgaagtttttcacggggataatccgctttcggagccggaatgtgcaaatttagccggctttatgcatcagcatttgccacaaattgatgcctatttgacgctgcattcgtacagtaatgtgctgatgcatggctgtaaccacagtttgataacggaatgggttcgtttgaaatttaaaaaaaaaattaatttgttattgtattaatttgaaagattttggcaatttatttctaattgaagcccaataatttgaattgaaaaaataaaaataacttaaaaaagtttcccaaaaatcctatttgaaaatttactattaatatttgcattaaatattcttatttaaaaatataatattttttacaattagcaaagagttggaaatgaaatggccattgccatcgaaaaagcgggcggtgaacactttaaagttggctgtggtgatgaaattttatgtgcgtaattaattaatttaattaataattggatatattttttgggtttttcttcagatgccgcgaccgggagtagccgtgattatgcgcaaagtgtgaacataaagtatttaaataattaattaatttaattgtatttatttagcggtaattttttgaaagaatcattatccttaggcgtagaattttgaaaatttttattcttttgtgtttcctacattttttcttttgatatttttcaaaagttgacattttttggttaaaaaccccgaattcagcgaaatttatcatgaaataaa

SEQ ID NO: 76162 - DNA, 416 bp, Heterodera glycines
  Genomic contig location: Contig_ID=SeqID_12515; Location=551..966; Strand=-
  SCN-specific regions: Sequence locations=1-77,108-416
atgccgcgaccgggagtagtttgtgtacccggaaaagggcataaacaaattggccaaacaagtaattaaggacgaactaattaacaattaaaattataaatttttaagattttgcctgcccttcaaattttggcggaagaagttagcaaaatgacatgatgaattcattaaattagtgctgatgtgaaatgaaatacctaattatcagtgaaatatatgccctatataaaattgcacagactgtcaaaaggttgcgggtatcgctcgcccatcccgtgcctatgaaggagtacagtctttgaagtagccgccccaaccccaaacctggttttaccgcaaaagcccaagccgataggaagggagtcctttgaaccaaacctattcgactcccttatgaagttgccgccctaattaaa

SEQ ID NO: 76163 - DNA, 658 bp, Heterodera glycines
  Genomic contig location: Contig_ID=SeqID_12515; Location=518..1175; Strand=+
  SCN-specific regions: Sequence locations=1-342,373-462,502-630,652-658
cacggattagggaaaatgcccatccgaagggattttaattagggcggcaacttcataagggagtcgaataggtttggttcaaaggactcccttcctatcggcttgggcttttgcggtaaaaccaggtttggggttggggcggctacttcaaagactgtactccttcataggcacgggatgggcgagcgatacccgcaaccttttgacagtctgtgcaattttatatagggcatatatttcactgataattaggtatttcatttcacatcagcactaatttaatgaattcatcatgtcattttgctaacttcttccgccaaaatttgaagggcaggcaaaatcttaaaaatttataattttaattgttaattagttcgtccttaattacttgtttggccaatttgtttatgcccttttccgggtacacaaactactcccggtcgcggcatctgaagaaaaaacaaaaaaatatattcaattattaattaaattaattaattacgcacataaaatttcatcaccgtgtgctcatagtcgtcagggtttacagatggaatctcataaatatcaagttggtcgagaattgaatgtaatattgtcggttgcgagctaaaaaaaaatataattacttgattaaactaattaattaaacagaatc

SEQ ID NO: 76164 - DNA, 414 bp, Heterodera glycines
  Genomic contig location: Contig_ID=SeqID_12517; Location=3388..3801; Strand=+
  SCN-specific regions: Sequence locations=1-250,272-348,394-414
atgaccaccgaacaacttttaaaaggggttaagatgggaattgagctgaagtttggttggcggggggtgccgtcacggcaaatgatgcggtgggacattggcacttttggggagatttggcactctttctgcttctgatggggtgggcgagggcaagggtaagcagattatggcctaaaacatttaacggatcaccccgtggggaattggcgcaccctccgcacaaaatgggcggggaatggcaaagaatgggggaaagggagaggaaaagcagccaaacgacaagctaatcgctcaaaaacacattcttgaattgtaagttttaagtttaattataattcagagcggaaataaatttttaaaattaaaaatgattttaaaattctaaatattctttcatttttgagaatttca

SEQ ID NO: 76165 - DNA, 2400 bp, Heterodera glycines
  Genomic contig location: Contig_ID=SeqID_12517; Location=44..2443; Strand=-
  SCN-specific regions: Sequence locations=1-198,220-1113,1135 -1202,1224-1301,1323-1654,1676-1789,1836-1868,1891-1925,1960-2400
  Gene Ontology: Mol. function=protein binding; Cellular component =transcription factor complex; Biological process=regulation of transcription from Pol II promoter
agttctgacgaaagtattgtgaatgggcccaacacatcgtcggcgtcaatgtccgagtccaacggcacggcggacgggggcacggctttgtcaccgccgccgcaactgccgcgctttgacgaggacacgcagcagcaaatggtaaatggccgggggcagatcaaatcagttgatcagacagtcaaataatcacctcttctgttctgattaaaaaataattgcttctgatcagaatgtatgtccgcatttgagaaaaaaacacttcatacagtatacttttacttacaatactatcttactttcgaatttcttttcgttctcagggactttaaagtttaaacactttataagcccttttgcctctttttctgttaatacacttttctcattgttgttgatcagtccgtccgttctccatttttttccttaccaattagctgatcagcaattgcactgtcgttggcccctcttcgtcctccgaaaacgccgcccttttccccgcccatccgttcgcccattttggcacttccgtcgaccaatttgaccatactttggcccatccgtcgttggccgcttttctcgaacgctttgtgctgctccaaaatcgaacattgccaaacattctgctgacggaacagcagcagcaaaagggcgaaagtgagcagcaaaagaacggtactgaaactcctccggcggcgaatgcgacggaaaattggccaccgaaacaaacgaataacgcggacaatggcagagagggcggaaggccgggtgagttagcatcagggaaatcgaatgttaaattagaagagaaacgaacgattcaactcattggccttggcatgtaatgcaaaattattgaagaggcaaatgttttcactgctatggccaatccgacggacattggccatggctaaataccctcaaaatgattattctcttcaaatggatatgtaatttataattgttcagcgtccgacacaacgacaaaaaggcgtcgaacgcgaacaaatttcaccaattggcagctgaacgagttggaaagcgcattcgaatgtagccattacccggacgtacgaaaagccaattaaaatgcaaaaagaataaattattcaatttatttattggtcttcaaaatgcctttttaaggtttacgtgcgcgaagcacttgccattcggcttgacctgctggagtcgcgagtgcaggtggccaatttattgttttaaaatttaaattccaatttaaatctgctaaattggggggaatgaatcaccactttttatgcaaatcattttccaaattcgtcattctcttcatttctttccattgtttctcccatctcatttcttgcatttccttcactcttttaagcgaatgagtgagatttgttggggggggggggaagcgatggatgacaaattcattcaatttgatgggccattaatggatttcgaccggcaaagagttatgagtggcgaagatgcgccgaagagataaggcagcacaaatgggccaaatttagccacaaataatcgaataataagccaattggacccccggggcgaaacaatcggcggaaaaagggcaaaagatggtggcgcaaaacgccagagggggggggggggataatttatcataaatcagcagaagcaagggttataatttgaaaattggaaagcgaaatgaagcaattaggcacagtaattgaggaaaaacaaaaaaaagggaaatgcaattgcaaaatgaaagggaaaagcggcggggggggactttttttatcattttgcaaagttaaaaaattgtttaaatatttcaggtgtggttccagaaccgaaggtgagtgattttatccatttcataaattaggacgaaaagccgattaattagggcaaaatggcgcaagaaagaacactgtgggcacggattggcagcagacgaacagaaacagcagcaggaaagagtggcggagggaggcggagatgaccaaacgcagcagatggacgggacgacgagaagaagcagttcaacggggacggagagagcggcggacggaggcaaaggaaaaacgatgccattctcagttgaagcattgctggcagcttcgaggtgggcgagcgagcaatgtggcacaatcccttggcactgtcagaagagcgaccaacagatggcaacggcacaatgatatcattgtgccgtcaaactctgagtctccccccctcccgcctcatcccatgggaatttgttttaaaccattttaatgcaatgaatcatatctatcaaaatcctcccacagagtgccacggggacggcgtccgaatgccaaatacccgcgggtgcaggcgtgcaagggcatcgcccctttcatgttcccagccttcccgatcactcagccggtcggccaa

SEQ ID NO: 76166 - DNA, 1542 bp, Heterodera glycines
  Genomic contig location: Contig_ID=SeqID_12518; Location=396..1937; Strand=+
  SCN-specific regions: Sequence locations=1-230,254-460,482-508,530 -788,833-1097,1373-1392,1416-1506
atgcagggcacaggtgccggtgccgcgtgcggtgtgccattgcctgggatcaatgtgcatgccgcttggtacaacaatttggccaagaaacagtcatgtggcaatggtggtggtggtcatggaagaaatgttggcatctacgtcaatggcagaaaagtgggcgccggtgctggtggtgccattggcagcagcatagacgccagacggcgccaatcggtggcacagattggcaccactggcacggcaccaacattgaatgatcatctacagcctcatcaacggcatggaggaggacgacgagcaataagcacggtgaaccccccagcaggtagtcaaagctgctgggttttgttcaagactcttgagagcttcatacgtgaaataatttcggctattatggggctttataagaccagtgatttctgggctataaaccagcttaacacaggataaacctggatttggttattttgggcttttttatgataaatgcctgatcatgaagcctgtcctcgggttttttggatgcctgatcaaacttctatttgaccctaacaaaaaaaaaaagtcataatccagaaaatttgggttttcgacttttgttcgagttcggcttagggattagaaatttgttaaaatagatgtcagattaatgatcagggatcccaaaaagacttgggaacgagaatttcataaattattaccataaaaattttttgcaaaccaaaagggtacttccccccccccctttttttttgagggtacactctttataattaccgttagccaaatttattattaaaatccatttttaaattgaatatataaatttgtttttgttttttcagcatttcccatcgcaattgtgcgcgagtcgtcgcgctgtgttggcgttgcgcaatttcgtcgccatcaaaccgagtcgcaaccattgaaacagcaaccacaaatacatcaaaattccacagaaactgatgaaacagtggccgaagaatgtgtggtagacagaatgccaccacagcaacaaatttctaccgaagattcatttgacacaaattcatcatcaaatggtaaatattggattaaaaagtgctttcataaatttatttatattacatattttgataaataatttttattctaacaaaatttatttcaaaaatttcatgctaatatattacaaaatattttatttcaaaattttaattgaatatttataaatgttattttttttatttttaaattcaatatttattaaaactatttaaaaatgaattaatttttatttttaattattaaaaatttaaaatgaatatttataaaaaaatttttaatttttaaattaaaattgttcaaaattaaatttattaatgtttcattatcttttatagaaaattgtcgcatttgtcctgaagaagctgatcgaaaacggtccgggcaaagcattgcaagccgaatgtctgtttggagcttgcgcatcttcagcggacaatggagagtcagctcttttttttatctttaaaaaattttcattaaaatata

SEQ ID NO: 76167 - DNA, 806 bp, Heterodera glycines
  Genomic contig location: Contig_ID=SeqID_12519; Location=1039..1844; Strand=-
  SCN-specific regions: Sequence locations=1-158,203-249,280-309,333 -359,381-600,646-806
atgaaaattcggagcccacgcattgttgccaaattcatcaccagcatccaaattctccaatttgtcatctccgtttacatcttcacccacattgtgtacattaagttcacggatgtgctaccatgtgatgcgaggtgatgcaattaaacattaaatcgaaaataattttatttatttgttaaattattaaacaatttttaatggtcaaatcaaatgggatcattggaggttaaaaaagtgtggctagcgtttgcaatttgtttgtagaattttttgacatcattcgatagcccttaagtgtttttcattaaactacaaaatttcaaaaaatttcatttagtttcaaaaaaaaaaagttatgaccaataatgtttgaaaatcctgattttttgagttcttctgaccataactttttttcgaaactcaacaaaaatttgaaattttgcaggcaaatagagaatatttatggctatcgaatgatatcaagaattaaaatttgtttactcttgagctaagttatgaattatttttgtcaaaaatattaatttcacaagacaacaaggacgtccttggttggtgtcataattggcaacaaattacaataattttatttaattagtgaaatttaatttgtttttaattttagttggaatgttttgtctcttggcggtctgatgtatctttcatacctgtatttgtttgctcaattcttctacgactcatatatttcgggcaaaatgaagaagcgcagtttggcaaccaccagcagcagcaatgccatgacggaggcgaaaaaaattgaataa

SEQ ID NO: 76168 - DNA, 103 bp, Heterodera glycines
  Genomic contig location: Contig_ID=SeqID_12519; Location=2111..2213; Strand=+
  SCN-specific regions: Sequence locations=1-103
atgcactcacaaatacatgacagtgtgcacgctgaggttcaatgccaaggaccaacggcaccacgcttgtttctccgcataggttatggtggcgtagaggaag

SEQ ID NO: 76169 - DNA, 494 bp, Heterodera glycines
  Genomic contig location: Contig_ID=SeqID_12521; Location=1280..1773; Strand=+
  SCN-specific regions: Sequence locations=1-193,216-494
gaggacagtgacgagttgcgcagtgcccagtcgagcagagcgtccacctcccgccaacagtcgcaacggaaagagacggcggaaaaacattcgcaggaaaagcagccccggggacacaacgagcgggaggagcaccaattccctgcgcctcctccccattttgcgcacccttttcaattcgttttcacgaatcgacaaagcgccaacacattcagtctcagttcgggcgcaaaagtcgacgagttgagcacgccggaggaagagagtgtggtcgatgaggagggcataaaagagggagagacgacggggccgccaaaagtgccgccactgaaattggaggaattgtcgccggagggcaaatcgccgtcggaagtgaaaacattttggaaaatgtgcattatgaaaagcaatgaaacgttcagaccgatacgtataacagctcattgaacatggacactgtgctgatacgagaggaagaggaggaattaaaaaag

SEQ ID NO: 76170 - DNA, 170 bp, Heterodera glycines
  Genomic contig location: Contig_ID=SeqID_12521; Location=253..422; Strand=-
  SCN-specific regions: Sequence locations=1-11,44-66,92-170
aaaatcaaacgattatttcttaaacagttaaaaagtgttcaaaaatatcaaagatgcgatgattgattgttgttgttattgttcattattgcccttcagaatggagaatttgtgcagtccattgttcaaacacagcaatgtgtggaggcaaagaagtttgacgatagact

SEQ ID NO: 76171 - DNA, 280 bp, Heterodera glycines
  Genomic contig location: Contig_ID=SeqID_12523; Location=708..987; Strand=-
  SCN-specific regions: Sequence locations=1-124,146-249,271-280
atgacttttttggtaagaaaaaataagatatttcttgaagtattgtattaaatctgacaggaaattgtatgtaaagtttgaaatgttgataattttttctagagagcgacatttggcgaaaatacggatcaggatcaggactacggactaggcatccatacggactacagacttacggactaaaaccccggaaaacccttactccgtataagtccgtatgcaggaaaaatacggacccgtatacggatcagggttttttgaaaagtttttaatcaataaa

SEQ ID NO: 76172 - DNA, 559 bp, Heterodera glycines
  Genomic contig location: Contig_ID=SeqID_12524; Location=1..559; Strand=+
  SCN-specific regions: Sequence locations=1-9,31-276,345-400,422-559
acgggcgactgcactctttttggtgcacgaagcgaacgagtcggacgcgggcgcataccgctgcgtggcgaagaacgcgcatggcagcacgaacagcgcgtgccaagtcagcgtgaaggcattcaaggaggaggtgaagaaccatttgacacgagactcacgagcatggccataataaaatgccgtttaagccgaagaaagagggggccgagccgagcttcacccggggattggtggaccaatacatcgaaagggtaccattgggaggaaattgggataaataatatttaaataaatgatttaaaaataattttaaatgaataaaaatataattagaaaataatgttgcgaatttaatgagtgaaagtgaagaaaagttttttcgttttcttattttattgaaatgaatcaaaatttaaattacttacagaggtttatgggatttacctaatctttttccagggtgacactttggtgtttatttgcgctgtgtcgggtgatccggcgcccgaaattaaatggttttgcaacggcaaactgttgaagccgtcggacaggt

SEQ ID NO: 76173 - DNA, 1072 bp, Heterodera glycines
  Genomic contig location: Contig_ID=SeqID_12525; Location=84..1155; Strand=+
  SCN-specific regions: Sequence locations=1-762,784-821,843-929,952 -1072
  Gene Ontology: Biological process=mitotic chromosome condensation
atgcccgagttggtgtggtacaaagacggcgagcaggtcaggccgtccgagcgcgtgcagttggagcgggacgcagacggcaccgcgtatctgatcattcccaagtgcacgatggacgatgatggggtaggagtggcataattcttttgctaattagtcaactgagactaattaacgatataaaaggtgtaccgagtgatcgcaaccaacccgcacggtactgcctacgataagtgtacggtgacagtgaaaaaggcggcagcggaggagggcccgacaaagcatgagggtgccaaggagtttgaagcggccaaagcgccaaaactgttggaaccgctgcaaaatgtgaaatgcccggagggcacggagtttgtgctgcggtgccgtttctcgggcgaaccgacgcccaccgtcaaatggtgggcaaaaagagaaggggaagcggtcaaagggttgctaattatgcttttcccctttcttcaggttcaaggacggcgaccgactgtttccctacgagcgaatgcaaattgcggaaatgtcgccggatggctggtgcgaattgcgtgtgcccgcctccatgcgttccgattcgggcaattaccgatgcattgcggagaatccatacggcactgcgcgtagcgcatgcgaagtgaattatgggagggatattggcatattggtggtgaacagaaaaagccgacaaatatccatttggacaaaaaatagtgattaggaaggcaactgatcaaagtgattgatcaattagaaaaagtttaataataggagaaaacactccgttggcccaatgttgataattgattagaatttggaaaagatttgaaagtgatcaatatttttgcaaattttggttaaatttgtacaaaaaaatgggaaaaattgactggcagctcgaattttaatggaattaattacatttttattgtttgaggtgcaagtgcaacgcgaaaagaagcccaaagaggacctgaaagagttggccaaggaatttggccgtgccccgggctttacaattccattgaccgtaaaacacgccaagccgggcgacactgtg

SEQ ID NO: 76174 - DNA, 205 bp, Heterodera glycines
  Genomic contig location: Contig_ID=SeqID_12526; Location=29..233; Strand=-
  SCN-specific regions: Sequence locations=1-205
atgatgaaaaatgtaatagacgaacaaaaaaaatcatcaaatattaaaaataacgaaacacaagaaattaaaatgctattgagtttacgcaaaggatttgatccaaatcggtacaatgtccaacaaacaaatgaagttgccgcaattattgtatgtaatgcaaacgaagaaataccagctgcaaatataattgttgttgaaaaag

SEQ ID NO: 76175 - DNA, 944 bp, Heterodera glycines
  Genomic contig location: Contig_ID=SeqID_1819; Location=172..1115; Strand=-
  SCN-specific regions: Sequence locations=1-239,263-495,517-527,549 -742,768-774,798-944
atggccgaaatggaagcgcaaccgaacgtttccccgaagcagaaatatcgggacttgaagaagaagttcaaataccttgtttatgtgggtcaaaaggggaaaatcactttaaaattgaaattcaaagacaaagcgccggcaaaaaagtaggaatttatagcctttggcggtgccgatacgtcaggagatttttttgaaattttaaagatattttaaaaaatgaatcaacaattttacctattttttcttggtaattttgaataattgcgggccgagaatttatcctcccgccttaacaaacaatttaatccaggagaatgaatattaccaagaagagctaaggaacctgcagcggaaattgcttaaactgtcgcgtgacaaaaacttcctcctcgaccgtcttggccaatatgaacagctcagcgagtccagcgacgattcggacgcgtcgacgaaaacactcgaagaacgcggagtcacaaaacagaaaaggttattgtttataaaaagctgaaaattgagtggggagatgtattttggagtgaaataatttaaaaaaattaaggaagccgaagccttccaacaaccgaaaaagggcagccccaaatccgagcggagggcccacaggacaaccgaagcgaatcggcaacaaaacgacgccagcaaaatgcaaaggttcatgtttttgccatttgataacaacaaaaaaatgcaaaccaaaattggtctacatttggttcggtttttttaaaaattaaaatttttaagggaattaaaacttcaagtattttttattttaatctgaaaaagtgtcactttttcgtttccccaaaatttcctcaatttttagtttctggagacgcgattcgaaagaaatgatgcgaaatgcgatcgagccgattcgattcgcgagtgaaggaggaaacggaccgattcggaagtga

SEQ ID NO: 76176 - DNA, 1699 bp, Heterodera glycines
  Genomic contig location: Contig_ID=SeqID_1820; Location=4..1702; Strand=-
  SCN-specific regions: Sequence locations=1-722,745-853,875-1077,1100 -1185,1212-1255,1277-1555,1611-1699
atgatgcagcaacaatcgactcaggctcaacattcaaatccgtctcagcaccttcggaacactccgcaaagtcccgcagcgacggcaccgccgacgtcgagtcaaagccaacacttccaacagcgaccacacgtcgcataccatcagccaccacagcagcactatccgttgcagcaggagacgaaccaaagccaacacatccgtccccagcctggcgtaaggccggcacatccgcagcaacacccaaccgagcagcagtacccatcaatggccgggccattgttccaatcgcaaccgtcgagtgtccaagcccttcaagagcatgagattggcaatgttggacagccgaggcttgcgcagcatggccacacgcacatttctcaccaacaacaagtgatgatgggacaacgccacgcgacccatcacccgtcgcagcagcaaacactgatcagccaacagcaaagccaacacccacagcagcagcatcccaccacggcgattcgaatagaacaatccgggtacaaaaaagtggcaatttcaatgggattggaggcgctagttgcaaagcgtactcttttgaaaatttttttcactttttttggtctaaaaatttttttgtttattttgatacagaatgatgaacattaagcattaacaacacaattatggcgaataaaagtatattcacgagtttttatcaaagaaaattttgcgaaacaaaagggtcccccctttggttattggataaaattcaaaatctttcactttttaatgaccccccccccccctttggtttttggataaaattcaaaatctttcacttttttttgttggtttttttttgtcattagtaccatctgtttaaaaaaacaaattctgtatcaaaactaacaaaaaaaaaaattttgacaaaaaaaaagtgaaatttttttcaaaatctgtcactttttaactagcgccaaaattcccttaaaatgtgtgtcagaacctgcactcgagcgtgaagcggcagagagagtacgtttggttgcaggaaaattattaaggaagagagttcattatctatttgttttttgcataattaatttataaatattttgttcagaaagggttctgaaacgcaccaaattttatttacatgttagtttaggcactctgatgctttttctatcaaattgggagatgaataaaatttttaaaaatttttaattcctttttaaacaggccaaaaagtttaggcttaactttttagtgaaaattcaatcactcatttttcgagtagtgatcagaagcgcaccagattttgcaggggcctaaaaaggtcaaggaaaggcgtctctgcgttgatttagcagtagtacctatgaatttaaattttctatgaatttttaaagttttttgaaatttttttaagtgcaaaatggtggtgtctgcaaaaaattttcaccgggtttaaaaaatctaggaaaattagtaagcatttgtagtgttccgatacgtatccctgcaaaatttggtgagcccctgatcaattacaaattatttatggacgatcaaatttttagaaatttttatttatttttgcataattaattcataaatatttttttcagaaaatgctctgaaacgcaccaaattttatttacatgctagtttaggcactctgatgctttttctatcaaaaagggagatgaataaa

SEQ ID NO: 76177 - DNA, 1832 bp, Heterodera glycines
  Genomic contig location: Contig_ID=SeqID_1820; Location=4122..5953; Strand=-
  SCN-specific regions: Sequence locations=1-296,318-490,512-868,890 -965,987-1257,1281-1285,1307-1476,1500-1832
ctgttcaccgagtcccaatgccccttctgcacgcgactgcttcgagaacagatttggcaattccattcccgattccccggcattatgaatctgcaggtccttcagaaactccgtgtggccaaaagtgtgaatgatcgaattcctttcaggtgattcccttcggcaaaggcaactgcgaattcacgcgcgaccggcggatcatttgcaaatgtatgcacgggcccaccgaatgcgacctgaaccgactgcagaactgtgccatatcggtgaaaaggggttttggcaacaattcatggcattaaaacacaaaagtgccactgtttgttccattagccacattatgcagcctctgctgttcccccatattttctgtaattatcccccccccccttttcacagtatttcccacgacggcatattggcttggtgacgtgcattcaagtgagcattgattaaggggggaaagtggcatcaaataaatggcaattattaaaattgtagggactgaagaatttggacgaagcctaccggcggtgtctgtcgcggctttcgccccgcacgcaattccgactaaagcaatgcgcggaaacgcaaaccggggaggtgctcaattacgtcagcatgctgaacacgcacaggcaaaaaagaacgaatcgaactcccacaaaaaccgctgcttttcccagggccggcgttcgaatttggcccaccgcttatgtaaacggacacttttttgatcggagttatccgatggaggtaagcagaggaaaagcggacgtaacaaaaggaacattggcaatttcagaccaaaatatgcgaacacacggcatggtgctgaccggcaacttctgatcagtcgctgatcggacctttctttctgttttctgtgttttttttgtgcaatttttccgtccaaaatgctcatcgggtttcgttttttaaacgaaagtcaattaacaaatgggaaatttattacattaatgtgatttatttggttaccttttttatttttgtctatttttgttgccatttcacaacttccacctctctttttatgtacatttgattatgtcaatgatattcgtgaataaattaattttaaattcgtttatttttcttccctttgccattaaattcttggcattgccatcaatcacttttttttgccgtcctctccattcgatcagctcatcaaacgccgtcgttcttctctccccaattttttgctaattatttgcaatttctcagatcactgatcactcctccccctcccaaagtgcaattactttttgcctcttcccacactcattccccccccctctccctctgtccaccttcggcttttccttcggctttttcccatttgagtgccaccaaccatcttttaacaatgctccgatgaataattacccttaagcctgttgtgcttttgtgttgttccttttgctccctctcttttatccccgtccatataaatttttccctcttctcttccttttccatttgcttcttcctctctttgatttttaatcaaaaaatgctttcctcttcggcattcaaattgcccattcgtttcgtccttttttgcattttgtttattcctccgttctctgaggcggtttgtccccactgctcgctgatcagagtgatcagactttgttttggtcgctttgatcagcgcctattcccttgccaatgtttgtccctctcagtgcgcctccaatggcatttgcggtggcggtggatgctgtggcccggcgtgtcagccggcgccggtggcgtgtaatcccgcgagttgtcagcccggctacacgtgcggtaccgtccaatga

SEQ ID NO: 76178 - DNA, 759 bp, Heterodera glycines
  Genomic contig location: Contig_ID=SeqID_12527; Location=465..1223; Strand=-
  SCN-specific regions: Sequence locations=1-202,282-290,312-584,613-759
atggcaaaacggcaaatttcgcttctgaaaattgaagaaatttacgaacaaatgggcaatgtttatcatgctgttaaccttaacgagcttgaatgggtgaatcaatttttcgagaaaggtaaaacaaggagtcagaaaattatcttatggcatgctatctaataatataatcctttctctctaaaaaaaatcaagaatatcatttcttttttcctcaccatctcccccccccccatcttccctccctccctctgttttttctctgtttcctctccattttcaggtgtttccattcgcattgagtacatggaccgaagccaggctcccagcggcggttggcaccacgatttcctcgtcgagggcgacaaccaaccgaaactgttcttcctttaccgccccggtcactacgacattttgtaccgtcgcggtgcgccaccgaaaagcgaataaaggcacagaaattgtgagatggcaattcggaaaagcggaggaggagagacggaacagagaatggaacgcaaattgagactctattatgtttgtgttactaaatgtgaataaattgaatcttcgatgtgaatcacaaaattttatttaaatgaaatttaaaatcaaatttctaaggaagcagcaatattcggtccaaattaatcatttacggagtacagcccaggaggcatgagggactattggagtttcacgaaaaacccggtggaccaggaaaagttccggattctgatttctggaatccgagaccgg

SEQ ID NO: 76179 - DNA, 118 bp, Heterodera glycines
  Genomic contig location: Contig_ID=SeqID_12527; Location=1..118; Strand=+
  SCN-specific regions: Sequence locations=1-29,51-52,74-97
tcaaatcaaatcaaatcacaattcgattcttcacataagtcacatttattatgattctgttatttcttcgactgtgcaattgactttattattggaaaagaataaattctaaaatttt

SEQ ID NO: 76180 - DNA, 1740 bp, Heterodera glycines
  Genomic contig location: Contig_ID=SeqID_12529; Location=598..2337; Strand=+
  SCN-specific regions: Sequence locations=1-681,727-734,761-906,943 -1060,1082-1231,1265-1512,1534-1569,1591-1740
  Gene Ontology: Mol. function=structural constituent of muscle; Cellular component=striated muscle thick filament; Biological process=striated muscle contraction
atgtccaatctgacctttctgaacgatgcctccgtgctgcacaatcttcgcgcgcgttatggggcaatgctcatttatgtgggctaattttttattaaaaaagctcaagcacctgcttttagacctattccggcctgttttgtgtggtgattaacccgtacaaaagactgccaatttacacggactcagtcgcccgattttacatgggcaaacggaagaccgaaatgccgccacatttggcaagcatttaaaaaaataataaaaccaattaattcatttgttttgtaatttaatttttttgccatgagttagagcatattatgaacaaaatatagaaatgtttttctcttttattcatttaaatattaattttaagtttgctgtttcggacgaagcctaccgtaatatgttgcaaaacgctgaaaaccaatcgatgctaattactggcgagtcgggagccggcaaaacggagaacaccaaaaaggtgggcgaatttgaaaatcagccattacaatttcatcaatcggtctcatctttctctgtttctccactaatacagttctgctgatcacttgcaggtgatcgcttattttgcagcggtcggtgcgtcgcaacagcagacagccgatggcgggagcacgggtccgacgttggaggaccaaattgtgcagaccaacccggtgctggaggcattcggcaacgccaaaacggtgcgcaacaacaactcgtcacggttcggcaagttcatccgcatccacttcaacaagcagggcaaattggccagctgcgacattgagcactgtgcgtttggcatttaattgtttgtttctttatgaaaaactgcttcctctcgagaattaacaagaggcattctcgaatatcacttactaaccaatcaagttctactttaataaaataaataaatgccaaattttcttctgtacgtgtagatctgcttgagaaatcgcgtgtcattcgccaggcacccggcgagcgatgctatcacattttctaccaagtaaaaacctcaaattaataaagggtttttatcaaataacagctcccaattttgttcagattcaatccggctttttgcccgatctgaagaagcaattgttgttggatttgccggcaaaagattattggttcatcgcccaggctgaattgaccatcgacggcgtaaatgatacggaggagcaccaattgacccacgaagtgagtgaagtttaacattaattcataaaatattttttattttaatattcaacaatcactttgaatcctcacactttttattgtgaattttttaggcattcaaagtgctgaatttcacggactctgaaactcaagacgtttaccgtttggtggccggcataatgcacatgggtaagttttaaagtgatcagcaaatcatgttttgaattgcgagtattattctcatatttaaaggctaatgaaaaaaagagtaaggcttgaacgatttaggcaatatgaagttcaaacaacggccccgggaagaacaagccgaggcggacggaaccgaaggttggcattttgaagcgaatgttgcaactttaaaagaaaattttagaggccgagaaaaccgccagaatgtacggggcgaacccggaggaatttatgaaggctttgctgaagccgcgtgtgaaagtcggcacagaatgggtgagcaaaggacagaaccaagaacaggcaaggcaacccaatggcattggcatttaa

SEQ ID NO: 76181 - DNA, 1195 bp, Heterodera glycines
  Genomic contig location: Contig_ID=SeqID_12534; Location=31..1225; Strand=-
  SCN-specific regions: Sequence locations=1-31,67-83,121-122,144 -150,172-260,298-846,868-942,966-1195
atgggcaagactaagaatttctattcatctcaaaaaaagataaaaaaaataaagtttaaaatatttgtaacttattttgaacccattaaatttggtaaaataaatttactttgatattttttaacaaaagattcaatgctttttccagtcctttacattctcttcacatttataataaacaatgcatctgcaaaatgcacttcaacagaaggtttaaaaaattatggaataaatgcgatagaaaacaatggaggaaaaagtaaaaataaatattaaatatatattaataaataaaatgcaatttagaaatgatcgcaagtttctcagagcagacgatggattgggcattggccaaagggtgcgaaatggcagaaaaattgtgggaaaaggccaaattggggacaaagaccgccaatgaatgtgtaggagaagaaatggggcaaaaaatgatggaaatgtgcgcgggtggaacatcaaaagcgaaggaaattgcacaaaattgggggaaatcggcgctaattgccaccggacaatgcgttttggcacaaatgcaaacggaggaggagcaaattcaagaggaacaaaatgccgagggcatggcgaaacttgcggaatttgacgcatcgttcaaagagtgtgcgaaggcattggcacccgagcaaaaggcaaaaagtggcattgacaaactgctggaggccaaggccaaccagcagctgaagcccagcgacctggtccaaatgctgctcgacgaggcgatttttgagcacgaaattttccaaaaattcgccgaaagttttaacggcggaaaacaaaaaaattttgtacatcgacggcgaaagcgaaaaaacagaggaaaagcaaagaaagaattcggatacgacacttacatcaaactgatcttttttctggccatcaccggtcaaataagcacacttgcctttctgctccttctgttccttcttcctgaccccgtcgttgtgccaacaaaagcaaaagaaaattaaaagcgaaaagtgccaaaaagaatttgtgctttttgttgctgaagaaaatttgatgatacaaaaaaacgtccgaaagaatttttttttttttctttttagttgatgcatttattatttattgcattggtaacaaattctgtcgtatttattcggacaaaaagttttatatgaattttcatgctagcattaaa

SEQ ID NO: 76182 - DNA, 285 bp, Heterodera glycines
  Genomic contig location: Contig_ID=SeqID_12536; Location=298..582; Strand=+
  SCN-specific regions: Sequence locations=1-169,191-285
aaatttttaaaaattttccagcaaataatggaaatttttttcgaattcccccccccccaaacgaaaattaaaaagtttaataggcaaatttcgtaacaagtagcactcaaatttccaaaaattttttccggcggcgcctatcggcaccgccggacctacatttccactatttttacaagttttttgccttaaaacggccaaaatttggtcatttttagtgaaaaagtgcagttgttacccagcagtggaaaaaaagttattggttaaatagcaaaaaaaaaaaaa

SEQ ID NO: 76183 - DNA, 732 bp, Heterodera glycines
  Genomic contig location: Contig_ID=SeqID_12536; Location=1129..1860; Strand=-
  SCN-specific regions: Sequence locations=1-71,94-281,303-732
  Gene Ontology: Cellular component=microtubule cytoskeleton; Biological process=embryogenesis and morphogenesis
caataaaaaggtggagtccatgacttgggtgatcgaagacaaacgctgcgtttacttaacactcgaaaaggtttgaatacattcacattttgtgcgagtgggcaaattatcttttatatggttttactcaacagccaaaattggcaaaacgaatccaccgtttaaaaattagaaaaaacatacaaatcttttaatttaattttacatggcttttcttttgtcagatcaaccaaatgcactggtggaacaaactgatcgaaggcgacccagaaattgacactcaaaaggtggggaggggaagagaaacgcagaacggaaaaactggaagggacaaaccctttaaaaacgcaaatgcctctcattccctgcaatttttccacaattccccagggaattcgtttgctttttgtcaaataaatttcgataattttttcaggttcagccggaaaactctaaactttcggtttgtgtccctttccattggtgttatttgtaaatatgcgctctttttaaggatttggacggcgaaacgcgctcaatggtcgagaaaatgatgtacgaccagcgccagaaggagctcggcttgcccacttccgaggagaagaagaagcaggacattctgaagaagtgagtggcccgggaaaagaaggccatggaaatgaccgattgttttgacacttcaggtttatggagcagcatccggagatggacttctccaaagcgaaattcagc

SEQ ID NO: 76184 - DNA, 1590 bp, Heterodera glycines
  Genomic contig location: Contig_ID=SeqID_12537; Location=1429..3018; Strand=+
  SCN-specific regions: Sequence locations=1-699,729-813,859-915,937 -937,967-968,994-1037,1060-1139,1162-1206,1228-1249,1273-1516,1538 -1590
atgccttcggcacgacggcgcacagcgattcgaatttgcggacaatacgctgcactgctcatgcgcactccaatggatgatcaacgcaccggaggaggagcaggtgaatcggacgcaggagacggccaaaaatacaaattaattgccaattttggattattttgacaatcgctaaatggcacaattcagtggttggccgagaattactgcggtgccgaggagaacttcaaggcgctgctgtacttttcgcccgccggcgtcggctgtgccccgtgggttccgacggcgtttgtccctccggtcgctccttttccatcgtcgtcttcgactcgtcctttgcttccgagcagtccccaggatggattggcccagtcggctgaggtcgacgaatggtccgaccccgaggacgaacccttccccaatccgtcgccgcaccggcggcactcttcgcacccccttttctctgcctgccctcctcgtcatcacttggctcgtttcttttccctctgtttgtctgtctttctgccactctcctcctcctttcctatctatcttccctcttttttgctgttgtaaattttcattgacagtgcttttcattttgaccgggaacagagccaattttgaacgcatttgtcaaagcgataaaatcagtcacttctttcaaatgaattctgtgctatttccttattcaaacagaataaatattattatttttataataaaatcagaaacatggaagttatggcaaattggaaggtatcgactagagaccggcgcgggacgggatttttcactatttcgacattttttggaaaattccttaacaaaaatgcaataaaaccaaaaaatacacccctaagaatcgagcaaaaatttttcaaaatatactcctatgaaatgaaaaaaaattttctcaaaaatttactttcttggcaaaaatttttaattttaaaattttttttaggtaactattttgggttttttggtcttaaaaatcccagtcctactcatttgcaactgcaatcagtgaataaaaattatttttgctcaatttttggctgaaaattatgtcactattcgtcactatttcggactttttgacactattttgtcactattttggcatttttactcactattttagttaactatttcgggatttttcgtcactaaaagttgcgaccctacttattaatcttgttgaaattagtcaaaaaatgtaaaatctggtcaatttttgaccaagaatggttttgaaaagcaaaaaatagttaaatttatggtccattaacagatttgattctagatcctctttttaccgtctgatacattcggaaaatcttagtcgccaatgcatcccgctatcccctaaaaatttctttttcaaaatatcattattttctcttttttggaaattttttgaaatttaattgaaattttttcaaaatcccgcaatcccgcgcgggatcccgcaaattttaaatgcgggatttgcgggattaatcccgcgggatcccgtcccccaaaaaattttggattccaatcccgcagcgggatccgcataattagtgctttgagggaatgcaa

SEQ ID NO: 76185 - DNA, 1638 bp, Heterodera glycines
  Genomic contig location: Contig_ID=SeqID_12538; Location=1..1638; Strand=-
  SCN-specific regions: Sequence locations=1-124,146-232,254-280,302 -798,822-1188,1210-1249,1274-1341,1367-1391,1413-1638
  Gene Ontology: Mol. function=ATP binding; Cellular component =cytoplasm; Biological process=protein amino acid phosphorylation
ttaactaaatgccaaactcgtcgtttttcctccgttcagcatctccaacaatcgccgaacggagcgttcgccgcgccaccgcccccgtccaattcagtacagccgacgatggccccccaaattgagcaccaacaacagcagcagcccttcgttttgcttcctgaccgaccggccattcggttggactcgcgattagtgtgcaaatacgaagtgctgtccgtggtcggaaagggctcattctcccaagtgctgcgagtgcaggacagaagtgagttggaggagacgcgggcggagggagagacagcgaaaatgccgaaaatgggcaaatgagaggaaaatgccaaaatgataaaaatatataaaggaaaattgggaaaattagtggaaatgccaaatgacaaataatatataggaaaatggagtgccaacaaatttaatggaaaatggggaaaatgagttgaaaattccaaaatgataaaataatgtaaaggaaaatgggaaaatgagtggaaaatgccagaaaaaaaaggactaaaaatgaatatgtccgtcctctaaaaatgatccatctcccaaaaatggtctcatagtctcaaaatgtcaatgattggcacagtttgttccaaaaacggcattttttgatttgtcagtcagtaaacgcttctacgccgtcaagttggtcagtaccgagcaagactttggcgctgtgaacaacgagctgagcattctcagccgtgttcagcatccgtttgtcattcgacttgaggaagtgtttcgaagtgccacaaaagtaaggccgaggggaagagaaaggaaaagggcgaaaggacctcaaaaaagggcaccgaagttcagtcggttgagcattttgtggtttggaaggccgtgggttcgaattccctcggtcgaaacgccttttatgaattttatgctttgtattggaccatagtttgtgccattctcagttttattggcgccaatttgatcagactgatcagtgcgatcatcgtcccccctcattttcagctgttcatcgtcatggaaatggcttccgggggtgaaatgtacgaccgcgtggtggccaaggggcggtactcggaaagcgaagctcggatggccatcaaaatgttgctgaccgggctcgaatatctgcacaggtaagcccagagagaatgccatcatcggcataatcaatcaattaattaaataccgtaatccgtgtcccatttcccacagtatgcacataacccaccgtgacctgaagccggagaatttgctgtacagcgacacgaggcaggaggcgcggctgctgatcaccgacttcggattggcggtgagtgttgacagaaaaacaaacaaacattttgacaattcctccgagcattttccattttttaaagtgcttttcccctctttcagcaccaatcgcgttctccggacgagaaaatgacggacacttgtggcacgccggaatacattgcgccagagattctgctgcgcgtcccttactcaaatcgcgtggacctttgggcggtcggggtgatcggtcagttcatttgatcacgaatcgtggacacattgaccaccatttttatcatcagtcgaattgccatttttttgatttgccatcatttaccc

SEQ ID NO: 76186 - DNA, 221 bp, Heterodera glycines
  Genomic contig location: Contig_ID=SeqID_12541; Location=1046..1266; Strand=+
  SCN-specific regions: Sequence locations=1-94,117-221
tttttttcactccccctctccgcgccgcgcagcgccgcggaaggtcatcaatcatccacctgtcaccaaaagtgacaggtgaaggaaattcaattttttcttttgcaaatttaaatctttttgatcccaaaccttttgggccggttttattttctcaatcctgaatttttttatgatgatttttcggatcctgaaattaaaaattctttttgaaaattagc

SEQ ID NO: 76187 - DNA, 1011 bp, Heterodera glycines
  Genomic contig location: Contig_ID=SeqID_12541; Location=2692..3702; Strand=+
  SCN-specific regions: Sequence locations=1-83,148-188,470-472,494 -513,535-715,738-866,888-1011
atgcccagtggagaggggccgaggaatgtccataaatttgactttggattcaaggaacaccagcggatagggtaagtgtttttaataaaataaaattaaaatagaaaaaaactaaaataaaaaaacaataaataaatttaaaataaatacattaaatttatttaatgaagcaaaaattctttaaagaaaaaatgaaaaaaagcaacaaaaaacctaaaaataaattaaaaatattaaaaaataataatttaatgagccaaaataaataaaaattaaattttaaaaatcaaaaaaatatatattaaaaaatattaaataaataaaaaataaaatttaaaaaatcaaaaaaaattaaataataattaaagtaaagaaaaaaaagaaataattatttttaattaagcaaagcagcaaaaaaaaacagaaaaaaaaatttaaaaaataaattaaataataaagaaaaaataaatggaaataataataattttattaaggattacaaatgcggataaattttgtttgttttatgctttggtggcgtctaaattttatttggaagtgcatcgaaacatttttaatcgatttatgaacaatattatgagacagagggacgcagctattgagcttttacataattgtggaattgatattaacgaatatagctatggtgtggagcaattgccgaatgttcagaaatattgggtgggtttaaatgaaaaaatgcaaaattaataaatttttcaggatgagatttaccccggaaagtaccgggttgtggcgtttgaaaaatctgcggatccgaggaaatcgatacgtgttttgtggaaaggtcctatggggcgtgaaaatgtcgtgccgttattcttggagaatggccattgggatggtctgaagaatttcgtctgcttttttaatcgagggaggaaattctgcattgattgcgaatgtttttacgacaaggatgttaagcatgcgatggagtgccgggcgagatgttattattgcaataaa

SEQ ID NO: 76188 - DNA, 110 bp, Heterodera glycines
  Genomic contig location: Contig_ID=SeqID_12542; Location=813..922; Strand=+
  SCN-specific regions: Sequence locations=1-110
tcgatcactttctgaaaaagaaaatgccgggccgctcaacgggtaaagcggacaaaagcaccgacgaacgaatgatatttgttgatattaccctattcataggcgcatag

SEQ ID NO: 76189 - DNA, 1948 bp, Heterodera glycines
  Genomic contig location: Contig_ID=SeqID_12543; Location=6..1953; Strand=+
  SCN-specific regions: Sequence locations=1-550,576-603,626-787,814 -996,1022-1776,1798-1948
acatccaagaattttacgacaacactttgctgaacgaaagagttccgttggatatgaaaacaaccgaaactcgcaaattggccgagagatgggagcaggtgggcgccgaagtccttccatttgcctaatgagtcgctttcctccaaagagtccccccttcggcgccgtctcccgggcattcactccgtcctccttcgaccgtcctgtctttcccgccacaacaactgcaacacctcacacaaatggcttcaatggcgaaatggaaacagccataacacactcttctcattcatattcgtaccaggagcagagcaaacaattggtgaggcggagagacaattcggccgagaaagccaattcgaacctggcattccatttggcaaccattggcggcatacctgtgctaggggggggctcagccaagaggtcttactatcgactttgccccccccccatgggggggtcagagcccatttccattacgatcgaccattattccaattttttgcctgctgaagaccttttttttaaaccacttttttttgcggcgtgcttttcaaaaattttttggggaacatgggggtccggcggagaagataggcgcggccaggaaaattttaaaatttgagtgcaatttgttaacagattttcacgagaaagtgctgcatttttgcgtttttaagccaactattttaagaaaaattaaggatttttattgacgaaaggggaaaaatcgaggttagtcgatcgtagaaaaattgcaatttaatggaattttttttaaaccggcaaaatttttggggttttctacccactctcctcttacgatcgacaatttttctcacaaatcggtattagtcgatcgtaaaaatctggaatttttaatgaaatttattaagaaataaggcaattttccgaattgccaatgagaaaattttataaagtttctgtttcatgttaacgatcgacttgttcgctgactttttttctctcatcccttttcttcttccctcttcctcccttcacccccccccacctcttacgatcgactaagagaccctcctgtgcacaggtatgattggcggtaattgtccatttcttagaccaaggatggatggcatacgcaagagtaccggactcaaacggtggacgggccgagtgggtttcagacggagacagtgaccaacaacggactgattgacgaccagggaaaggcgtgggaggtagaggacgtggtgctggagaagaaccaactcggactggtcagcctgcatttgtccacaatgtccaccgttttggcctctttctgcagggtttctccatttctggcggcaatgaccacagttccggcccttatatccgtgtcactgacattgcgcctggggtactttccatttccaattgcttctgccaattcggcttacgcccttaagggtggtgtggcgagggacggacgaattcgaattggcgatgtgattctgaaggtgaacaacacggacaccgtcgacgtgccgcaccaagtgccttctcaaccgactctctctcctttctgttaatgccctttctgtgcttaggtggctgtgaatgcgttgaaagttgcgggcagtgtggtccgattagtgagttaattatcccccccccccctcgggcataagtgaacctctccaattttagctcatcaaacgaccaaagacttcccaagcgagtgcgtttcgtccctcctcggccgaaccgctctcgcgcggcagtcccccggagggtttcggtttcggtcccccaccgcccgtccccacccatcagcagtcatttggagaaagtgaggccgtgaaagagttggagcaaatgccgggagtaaggcgaatggatttgatcaaagtggagtcggacggaatacacaagggattgggcttcagcatcgccggaggaaccggaaaccagcactatccgg

SEQ ID NO: 76190 - DNA, 627 bp, Heterodera glycines
  Genomic contig location: Contig_ID=SeqID_12544; Location=1856..2482; Strand=-
  SCN-specific regions: Sequence locations=1-48,83-411,450-627
atgccttgcagaaagccaaagttgcattttatcctttctttgtgagtttgaaatgtgtataaaaatatttacttatttaatacgcaaaattcaggaactgtgtaaaagtacgataattaaaatcactacttttgttctgaaacacaaaaatttttttctatttaagcatgaaaaaataagcaagaaaaaaacatgtatacacaaacagaaaacactcaaaaatagtagctttattcataaataaaaatgcattattaacttttatctttgctattgtcaaataaatcgaaaagaaattaatttaaaaacttcaaaacttatacaaaatttctttaaatggtccaagaatgctaaatgataaagatatttagactcataatttttttttatcatttttcagcataatttggctatatttcatttaatatattattaaaaacaaaaaaattcatttaagtataaactagattttgaaaaataatggcaacataaaattgtttattgatttgccaacgaatatacgtgtttatttgcgtaatatttttatttttacaaattgttcatattattttaatctttcgctttttgcaattactaaaatcttatattaatgaaaaaaataataaa

SEQ ID NO: 76191 - DNA, 938 bp, Heterodera glycines
  Genomic contig location: Contig_ID=SeqID_1823; Location=128..1065; Strand=-
  SCN-specific regions: Sequence locations=1-30,52-539,578-938
atggtaattgaaaatcagagctatggcaataaaagcatttatttcatttccagttacatcgatcactccgtcatcgcttttcttcgttcaaatcaccaaattttcgacaaaagaggcaccaatttatatttgtggattccatcatcacactctacgaatggccagccgattttggacatttttggtcgtgaaatttggccaattttttcggcaaacattcgccatttgggctttccccatggtgatcatttggacaatttgcgtagtctcatttcgccaacaattctcactgatctcaaccaattgatttcaatctattccggtgatttgtcgcccgctgcgtttggtgatgattttgatgggccaaattcaacaatttctgctggcaaaattctgtccaaatggttgcactctccgagaaaagatggccaacccaagcgattgcattgcgaagacattaaagaacaaacgaacactgattggatcaacaatttcaaggaggtgtggtccggggggggggggggacaaaacgtagccgcaaatttttattttaatttaaaaaattatttaaaatttagttacctagcctaaatcaaaaaaaatagataaattcgaaaaaaattattaagaaaattcaaggaaatgtaaaaaagtcgtttttttatttttctggaaattcagaaaattagtttttatacgagacggcgacgttttaggggtgtacccggtctgtggatggcattctgagttattttctgaaacccgaccccaaaaaagttataaatcgaaaatttttgaaaaattccgaattttataaaaaatttcagaaatcggaattcagtgccatccctggtgtggccataattcgacccaagcgattgcgttgcgtagattacaacaaacaaacggacttagattgggtcaacaatttcaaggag

SEQ ID NO: 76192 - DNA, 631 bp, Heterodera glycines
  Genomic contig location: Contig_ID=SeqID_1824; Location=729..1359; Strand=+
  SCN-specific regions: Sequence locations=1-313,335-432,543-551,620-631
atgtgcgccagtgggaatccatcagtaaaacaatccgtcggttatggacaatctgtcagtggacaatccgtcaacaaattttttttttaattctctgacgaaatgtcctttgacggaacgtcagtctactgacgaattgttcttcactgatgaattgtccgtcactaatagaattgtcttccgaaagattatccactgacggattgtccggaatccggataccgtcaatggtgggaccgcattccgggagtttttgcgacggaattacacattccggcatttatggcttgccgaacacctccatggcatacacatttaaaaatggcattttaaggcgaaatcaaaacattcaactggctccactgctggtggtggactatcagtgccggcgccaaacaatcggaagaaaacgccaaatcaacaacaacagcaaaaaggaaacagcgaagggggaggagaaggaagagaaaatggggggaaaagagaggaaaagggaggagaaaaaggagcagcagcggaagcagaggaaaaggaaaagaaaattgcagctgaacaccatcagaaacaacaacaacaaaagcaagaagttcaagcagtacagcagcaacaacaaaagcaaattttggtgtga

SEQ ID NO: 76193 - DNA, 208 bp, Heterodera glycines
  misc_feature (166)..(166): n is a, c, g, or t
  misc_feature (171)..(171): n is a, c, g, or t
  Genomic contig location: Contig_ID=SeqID_1825; Location=19..226; Strand=-
  SCN-specific regions: Sequence locations=1-13,35-208
atgaaccgacggtaattaaattaaaagtcacaaattcgtcgtttatttgactaaactgttttcccatttcagttggatttgcaacgacgtttggatggacattttcccctcttttgaccgtcctcaactcggcctcaaattggcattgctttcgccacgtttcaantgcgnttggtggacaaacatttcaatggcaaaagcgaattga

SEQ ID NO: 76194 - DNA, 683 bp, Heterodera glycines
  Genomic contig location: Contig_ID=SeqID_1826; Location=1291..1973; Strand=+
  SCN-specific regions: Sequence locations=1-133,155-301,323-328,350 -523,547-683
atggccaaagctgagaatcgaaagctcaaaaatggcattgaaaaaatgcaggaaaaatttgataagaaagaggagcaattggagaagaatttggaggaattacagaaaaagttggtcgaaatggatcatcagcagaaagaacaacagaaaagcattgatcagatggaaaaggtgggaaaatgtgaaaaaaggaaaatgaagcaaattgatcagcacattttgaatttgattttcttttttgctaaaatgccgtaaaagatgctacagacgaacgctgatgccgaaaaggagaatgatgacaacatgaaaaataagaaaagcttgagaaaaatgtcatggcacaaattgatgtgaaagtgcagacgaaggaagttactgtcaaatagttaagggaaatgagcaatggttaattactgtacctaccgtaacattattattataattactgtcaaatattaataggatttgttccaatttaagttattactgaaaaggcaattttgattgaatcggtgaattggagggacaacaaaaacaccaaaagcagcaaggggagaaggggacaaaaggcgagttgtaattatttatttgagcaaaccacaagacaacatgtaattgcacttatagcggaaaacaaagtaatgaatacaattagaaaaatatgatatggtcaatacagtaaa

SEQ ID NO: 76195 - DNA, 410 bp, Heterodera glycines
  Genomic contig location: Contig_ID=SeqID_12545; Location=639..1048; Strand=-
  SCN-specific regions: Sequence locations=1-410
  Gene Ontology: Mol. function=transcriptional activator activity
cgcctttaccttccacccctgcgcgtcttcctggctggaccggtgcgcaaagtacgggatgttgtccgagaaccactggtaaatctcgctgagcttcagccgtccgtcaatggcacagccgagcgcgcgcgcgatcaagtccgagtaggactcctcgccccagggattcggctttttgtgtgaatgctgctgcgctgcttgaccaccactaccaacagcaccatcatctgtgacaccggtgggcgccgttccgccgtcagcggtacgtcgacggactcgcttcggcttcggcctgattagtgccatagaggatgtgccgagttgagcggtggagaatgacgatgacgcggtgacaccgcaaggaccaccggaggaggacagcaacaacgactgttgtactgcttgagaat

SEQ ID NO: 76196 - DNA, 2911 bp, Heterodera glycines
  Genomic contig location: Contig_ID=SeqID_12545; Location=251..3161; Strand=+
  SCN-specific regions: Sequence locations=1-144,166-262,288-325,347 -962,984-1188,1210-1309,1338-1517,1541-2103,2155-2207,2229-2254,2294 -2911
  Gene Ontology: Mol. function=DNA binding; Cellular component=nucleus; Biological process=anti-apoptosis
gaagatgaggatgatgccgactcatttccgggcgagttggagccccgcgggcgctgctacacatggccagtcccacagtttggagccgtatcaacagcacaacaatcgccgctttcctctctgcatcctccgccaccgaatcatcatcacctccaccaccaccatttgttttcgggtgctcctaattctgcaacaacatccgccacttcgtccaaatttccgtcattgagcagcatcattggctgtggaggtgcgggtactgcttgctcttcctcctcctgttctttgctgaccggtgtcgaacaacaacaaccatgcacttcctcatcacatcactcaccattttccgctctgtccatcgacggtcaacaacaacggcatcagcatcattctcaagcagtacaacagtcgttgttgctgtcctcctccggtggtccttgcggtgtcaccgcgtcatcgtcattctccaccgctcaactcggcacatcctctatggcactaatcaggccgaagccgaagcgagtccgtcgacgtaccgctgacggcggaacggcgcccaccggtgtcacagatgatggtgctgttggtagtggtggtcaagcagcgcagcagcattcacacaaaaagccgaatccctggggcgaggagtcctactcggacttgatcgcgcgcgcgctcggctgtgccattgacggacggctgaagctcagcgagatttaccagtggttctcggacaacatcccgtactttgcgcaccggtccagccaggaagacgcgcaggggtggaaggtaaaggcgcagctaagcgcggcgcgttcgaccccttaatctcatgccaattgcgctccctctctccctccctactgcggtgtcatgacaactcgtacaaaaacaacgcctacaatggtttagatttaagcctaagctttaggctttggcttaagctttaggctaggcttaagatttattttataaaaatgttgttattgtacgaattgccttttggtacgagttgccattgactccctgcttccctgtcttgcatttattttccgtcgatttgcagttgccaaacagtgattggttgcttatctcagaaccaaatcctttacaaccctttaagctctctatccactcacccatggtcattaagtataggatttcgttacttccacttaaaagatttagttggatggttttcaatttctttgtatttaaagaaattgaggaattttttaacactattgtttaaatgaggtctcactcaatggggtgtccttattttctcgggaatggaatgagagttcggtttataaaaattttttttttctaatattggtagggggaccaggaatttaaggaaagcctgggattcgggaccggaaacatgtcataaaatgggtcaagaattcccggtgaaaaaatcggtacttctaaaactatttggtcccggtcccgaggccttccaacttaagttgtttgtgttttgcatcatttaaaaaaaatttcactgctttcagaactccattcggcacaacctttcgctgcacagtcgcttcatgcgcattcagaacgagggggctgggaagagctcgtggtgggtgatcaacccggacgcaaagccgggccgaaacccgcgccgaagggccaacacaatggaggcggccacgaaggtggacatcagagctactgaaaatatttaataagagtcgggcggtggtcccaataagccaattttcttttttttaaatttgaaatcgttagttttgggtttctcgaataaaaaagggtcgtcggttcgtctcgccattgtgaaggagttctttcgaattcgcaacatttaaataagcattcactaattgcccccgtccggtcgcttaattgacttccttccacacttgttaattggttttaattacccataatttgatttgccatttacacctcctcctctcctcctccgcaggctgtcattgacaagaagcggcgtggtgcgcgcaaacgtgtcgaaaccctcgtccaacagaagggcagcaacggcggctgttccgcctccatggcctccattctcagcgctcagtcggccgccatgttcccctcgggcaacgacgagctcaacgagcaaccgcaacagcaacaacaacaacagcagcacatggtgctgaatgctgctgcaccgaccggggggcccaacttcgacacgttcaggtgtggtttggctggctggtggccacgaaaacattgctaaattttcaaagattaaaataatcaaattaaaaattatgatattttcgagaccgaaaatttctcgagactctaaaccaaacaccagaaaaatccgagacttttctcgagacgaaattccgaactgagaaccttggtcagcaaaaagggacttttttttattccttttagtttcctaacctaaaaaatgaagggggaaagtgctgcgccgtacggcgcctgctgagaatcaacggattccctgctccacattttcttttttcattgctaaaactacatttccaaattgcatttttcgtcatataaaatttttcaataaaaaatgcccgtttttataaacgttttgataataaggcatgctattgtgaatataggccccgtgctgagtcgacactgtccgtggtcggtgggccggcgtcctgctcgcgcctgtcgccccccaacgagtcgtccatggaatttcctctgtggatggatcaactgcagcaacagcaacaaaacggtgccgacacggcggcaacggtgccgagctgttcagctgttgtgcttccaacaacgacggcgacgacgacgacaggagcggccacggcaccgccgccggtgatgaacccgcaggtcagcgaactgctcgaccggacggaccaaatgcgactggaggcgacgacga

SEQ ID NO: 76197 - DNA, 1110 bp, Heterodera glycines
  Genomic contig location: Contig_ID=SeqID_12546; Location=749..1858; Strand=-
  SCN-specific regions: Sequence locations=1-69,91-102,124-213,235 -280,302-335,358-900,922-989,1011-1110
atgaattcaatggtaagcatcattttgttgatataatcgtcagtttagaaacttcagtaaaacttttataaaatgaaaatatctttgttagaatttatggtgttttaatatataaaaaatttactgacggattgtcatggagccaaagactgtgcccaattgtccctgtgccaaattgccgctttgccaaattgtccctgtgctaaattgtccctgctgtgcccaattgtccctgtgccaaattgccgctttgccaaattgtccctgtgctaaattgtccctgctgtgcccaattgtccctgtgcccaattgtccctgtgccaaattgctgctttgctaaattgtcccccggtcgatccctttcaggtgttggacaacaaaatcggagagggcgaagaagtgccaaatttgaatgtgattagagaagatgacccggtgaacgaattccttggctttttgcactacgatcaaaaattgggccatcacattgccaaagcgtacaacgaaacagtgttttgtgccgccaaaaatcaaattgccaaaagggttgtcgaccaaattttgcaactgaccttctcattggccattcggataatgctttgtgtgatgtgagttttgaaattgaaataatcaaaaagaacaattcctaatttttatccttattaaattttgggcttttggcacaaattttgttggcactttttccattgcaaataatccttaattaattgaatatcttatcaataatatttggcaatttaaatatatttttttcacattacaaataccatccttagttatgagaattatttctcgcgtttttatgatgtcggcgggtggcaattggaacaacttttgtccgcttttcaaattttatcggcacaaagaggcggcaccaacgaaaatgggtaaaatatttttcttccgtttttaattttgtgatttgctattaatgacttttttaaagaatttaatttaatttacagaatatttccttttcaaatcattcgcattgacgcgcaaaccaaagaacatttttgggatgaaattaaagcgaacagcgcgagagaaccgcaatttattggtgggtgaacaaagcgattaaataaa

SEQ ID NO: 76198 - DNA, 75 bp, Heterodera glycines
  Genomic contig location: Contig_ID=SeqID_12547; Location=403..477; Strand=+
  SCN-specific regions: Sequence locations=1-75
ttttcctgagctccccgtggcctgaaacgcacgaaaaccatgtttttttgggctgttgttaagctacttttcgag

SEQ ID NO: 76199 - DNA, 1505 bp, Heterodera glycines
  Genomic contig location: Contig_ID=SeqID_12548; Location=2840..4344; Strand=-
  SCN-specific regions: Sequence locations=1-303,359-507,530-868,909 -984,1009-1269,1318-1505
  Gene Ontology: Mol. function=structural constituent of muscle; Cellular component=cytoskeleton; Biological process=mitotic chromosome condensation
atgccattccaaaagccacgcggagtgaaagaggacccgaatcagacaccgcccaattttattcgcgtatgctttatccaattgttaaatattctaaaaatgctataaattcaaagcatcaaaaaattaattaatccatacattcatctctttttaagcctctccgggacaaaagggctttgatcgggcagaacattgtgctggagtgccaaattgaagctcatcctgacccggtggttaagtggctaaaggacgggcacaatgtcagccaatgcccggattataaggtcaattaaaaaaggctatttttaaatataatttttttttcattatattaaatgctattaaaattttaaatctcatgcttttggtgccgttcagatggaagaggagggcaagacgtaccggctgctgatccgtaaggcacaggctgcggactgcggtcggtttacggtgcaggcgatgaatgcggcgggcatcaaacagtccacgtgcatgctaatcgtggcacaggcaccaaccccagtgcccgggggcatgacgagcataacgtaagcacggcatattgtgttttaaccttagagaaaagccaaaaaaaccgtcgatcaggctggcatttttgaagccaatgaatggggccaggggcattgctcggatttatatttttatctaccaatttcactttaattacattcaaaaatattggtacatgttatcgtatgacaacccgccacgcacttacagtagctcacccgcgcccccacaaacgccggtgggcccttccgcgcctttgttcctcaaagagcttaagcatcagccaatgaagcccagtgaagctgcggtgttggaggcacgagtcgtcggtgtgtaatttttaaattatcttttttatttaatttaattttaatgaatttgattttcaggcgttccgttgccacaaattgagtggctaaaggacggaaaaccgataaataattataggtcattaaaagcttttaattaattttttaaaagcaatacccactctttcctgagcagaattaagacggagtacgacgcccgctcgggaatttgcgtgctgacggtgccgcaactgttcacggaggatttgggcgagtacacttgccgtgccaccaacgcaacgggcaaggctgaatcccgtgcacatatcatgccgcaggagcagtacgaccgatggtttgcggatgaaaagcgaatggtgacgcgcgaacgcaagcagcgactggtggccgcgcagcgagcgaaaacgcagccgcagcagcaacagtcgcaataccaaccgcagcagcagcagtacaggtggaaaacagagagggggggggttgatcaaatgatcgggttgattaagtcaaacaccaaactaatcaaaagaacaaacaaactaatcagagagatgaagatgatcagaaaatgaccaaaattattagttgagagtgatcaaggataaaagaaaaggattaaggagaggaggaactgctgattaa

SEQ ID NO: 76200 - DNA, 1720 bp, Heterodera glycines
  Genomic contig location: Contig_ID=SeqID_12549; Location=1123..2842; Strand=-
  SCN-specific regions: Sequence locations=1-451,473-543,565-698,732 -806,832-883,905-1484,1507-1672,1695-1720
atgtacttggatttcacgaatttttcccattatgtacttggaaattggcatccctgtacttggaaagtgagtttatccgataggaaccctcaaataattttaaaattagattagaattggaaatatgaaagaaaaaaaaattttgcatcaaaatttaatcaatattgctttcagattttttatgagtatattatagctaattctatcaaattaagcaaaaattagaatttataatggaaattactacttaaattgctgcaacttgaatgatcaatccgatgatagcatgctaatgttgatccccaatgaatgggcaattaacatgctaatgtaaatgatttttgtggctttttaattttaatttcgttttaattcattttataagttatatcaacacagagagaatttgccatttttgaacccatcgcaaaatttgaaacaaaattaattgatccccaattataaacattttccgtcatcatcatcagaggccccagatgtttgattggagaggcccgtgaaaataaaattgaaaaagtattgggaattttaaaatccaattagccaattgttacgattgagaaaaacaatgattataaaacccaaagagaaaatctgcagaaattggactcacaaatgggaaacgatgcattagacgagcagcaaatcaaagcacaacgaatcaaaaaagattttcgtaattaattttataaattttgaaaatttttaatgaattagggtattgccagagaaaattttatgagatggaaaaaagaattggtgccaaatattataaaaggagtaggatttttaaataaaaaatatttttaagcagcaaataaatatacaaatgagtacaaattaaaaatgatgaagcaatattttgaaataaaagaaagaaacccaaaaatgggtgacgaaataattgccaagaaattgggaattatgagaagatggaaaaaggaattactgccaaaataccacatcagaaaaatattaagaatctgcaaacctaaagagccaattttcttgaatggctagacaataataaaaacactcaaacaatgaacacaatatgataaactgctcgaaagcccttgataagacgatgaggggccctatatgttccgcaaatctgcctttaaaccgtacaaactttgcccatatttggcgttaattaaaaatttcagatctatttaaaattcacccattgctgtaataaatagctcatagaatcatggcaactaattaaatgcacaattcgcagtgttgccaatgataaaattgaaaattcatcaaatttatgagattctcagaagttataaatgcaagcccctattaaatgcttgtggatataaattcgtttttaaaaatcattttgtaatgtactaaagaatttcaaaaggtagacctaaagaaaacactaactagcatggcaaattttttcaaaaacctgtcccatttcttgtcgaataagtgagtataattttttgaacttttatgagtatcaaaaatttgccacccttttcaatatcgaccagtaaaatttacagtttcaatttgattctgaaaaactaatttcagaaattgcgaacccgagttgaagagatccagtttgtttttgacaatttctcttttatatcagtccaaaacaaagtggtcaaaattgcggtttaattttctctttttcaaataattagtaaacttttgagatattaaa

SEQ ID NO: 76201 - DNA, 1220 bp, Heterodera glycines
  Genomic contig location: Contig_ID=SeqID_12550; Location=139..1358; Strand=+
  SCN-specific regions: Sequence locations=1-133,155-192,236-1220
atgagcgacttcgagattggaatgctgaaagcgatgcgtcatgtcttcccgtcatgcgaacgctcgggctgcagcttccacatggcgcaagcggtgttccgaaaagccagaagcatgggcatttttaatttgttgaacgaagatgacgacgaagcaccggttcaaaggaaatccgttcacaaaacattcaggtgtctttcattagcttatgtgtatttatttgttttttcaaaatcagatctgttctctctttggcactcattctgccactttacgttcggcgcgctttttcaactattgtcagcgcggcaccgcttggagttcaaggatggctggcgtattttgccaaaacctacattgccaccactcaattcgagattgatcgcggggcggaggcatttgaaccgcatgctgatgtcggacactttcttctgcgtcgcactcgaagcacaactcgtaaatgcacctattctgtcatgaatttatgaaatttttcaattttaccgttcagtatttcccaggcatccataatgacaggcagtggaccaatacaattcggactgcattcgccacaaccttcaactccaaccattccattgtcagaagaaagcagcttgcagcttattccacgctgggaacaagacatcgtctgtcctccacgcttcccaatctcgttttggaatgtgtacaccagggctcaaatggcaattgagcgaacgaacaacggcatggaagccgcgcatggacaatttgcagtaaaaatttgtccgttggaagacacttttttgttaatttagtgtgaactcaatcatcatccgtcactgagtgatttcatcgctgcaatcatcaaggacatcgacaaacaactggacattggacgagcagaacgtctccagaaaagcacaaaacgacgacaacggtacatcatcaaagaacaaaatgtggtgcggatccttgacgaggccgactttgaatcggaagaaggattgacgaacgccttgtatctgatcgggctcgtaatgcaaggctttgtggagggacttcacgtccgtggaaatgaagatagtgagaagaaactgatgataccgatggaaattgaatttatgattttaacaatttttacttttatgatttttaaccttttacttttattttttctttggaatttaataaatatctatttgcttccgtgtatttttaggttaaatttaattattata

SEQ ID NO: 76202 - DNA, 953 bp, Heterodera glycines
  Genomic contig location: Contig_ID=SeqID_12551; Location=689..1641; Strand=-
  SCN-specific regions: Sequence locations=1-80,102-264,293-594,618-953
atgtccaccaacgaatgttttgtcgacctttcccgtcgcattatttctcatctgatttcgaagggttccgatcagaaattttggtaatatttgttagtgacggaggcattaattagccaattgtcaaatgaaataaaatcctattactatttaattcaacatttcagcaattggcattgtggcggggcagcaacggttgcagaggttgcaaaaacggtgttgaatgaagagcaccggtgagcaaattttgtattaataaaacggattaaaaatttaaaaaatatgtttttttcagtctttttctgtccggcatccgtcgtggccttttgacctttttgcacagccaacgccaattgttcgtcctctcaaatggcaccctttcgctgcgcttttggcactcggactatcagcgatttgagaaggaaattggacgagaaaaactgcgcactttccaatgccttttccaccaaaaccatccggacgggtaagagagagagagagagagcgaaatttgaacagaaaatgccatcccttgttaagatgcacaattggtccggagaagtgcccatttaaacacaattgaaggaaagaaagaaattattttttaataatttattcatcattttgcgcacattaaatcgcatttgacacacgcgaaaaatgcgtgaatgggtttgttagtgttattgggatacgattttttggctctaaaaatcatcgaaataggtgggatttaggccttaaaaatcctaaaaataggcacaaaaatgaaaattcatgaaaaataatagatgcatgcattaataagttattctaaaaaagcggcaacgtatataaaccagtttttaaaccggttaaaaatgcggaaatattgggaaacgtggtgagtcgaagtgacaaaagtgcgaatgagtgatgatcagaaggggcgggtcatttcagtacggaataaa

SEQ ID NO: 76203 - DNA, 101 bp, Heterodera glycines
  Genomic contig location: Contig_ID=SeqID_12551; Location=661..761; Strand=+
  SCN-specific regions: Sequence locations=35-101
taattatattattaattaattaaattcatttattccgtactgaaatgacccgccccttctgatcatcactcattcgcacttttgtcacttcgactcaccac

SEQ ID NO: 76204 - DNA, 95 bp, Heterodera glycines
  Genomic contig location: Contig_ID=SeqID_12552; Location=1844..1938; Strand=+
  SCN-specific regions: Sequence locations=1-55,77-95
atgcattcggcaggtggcgttcagtccggacggaagggtaaatgcatttgttgggatgaaacgttcaaaaagcggacgaatgattcctttgccag

SEQ ID NO: 76205 - DNA, 1508 bp, Heterodera glycines
  Genomic contig location: Contig_ID=SeqID_12553; Location=56..1563; Strand=-
  SCN-specific regions: Sequence locations=1-31,59-433,456-459,481 -839,868-1373,1395-1508
atggcttattcattgtctcttcaaccgtggccttcgtctgcttctgcttcttctgttttgtcagtgttcgtcttcgtcctgctcttcgcccgttgctgctcccaatcggcggatgccagcagcagcagtttttcattgcgcggctttgcctgtgcgaagaaagatgccgcagtgcacggcggcacgttcactgttgttggagagaagcggctgtgagtcgctaatcacgaatatcacattaatttcgaccaatttcgaaccccggacccgaattcgaacaaaagttgaaaattcaaatttcctttttcatttatgttttttggcatttttcagtcgtgttgatccatcgcaactgacaaccaatgaaggcaacgcaaaaattgatgcgcttcgtttggacgacgctgcggacaaacgcttggtgatgtcagtactgttcccaaatggtggcggcatcaattgcaaaacatccttcctttctcgtgttcaaatgccaaccggttgtgccgttgatgagcgcgctgttgccctcgagggacgtgcggtcagtcagtgtttttgtgttgcaaatcagtgttaattatgtacgaacaattcctaattgtttttcagggtcaagatcgcttcggagagaactgtggtcaaggcaaatgtgcgtttctgaatgtcacgtgcaaccttcttcaaatgactccggtcgatggcttgccgaatgcgcgtcatttcacaatgtctttgtggaaaaacatctcggatgatgatgacgacttggttcagtgcggatggaaagcgtttattgtccgtgtcatttcagtacttctgtgtttttgctacccgcgccccccgaaaaatattaaaaattcatattttggatttgtcaaggtctcgtctcatcaatctcacgaatgtggcgtttgttttgacatctgaacacctgctggtcatagatttaaaaaatatctatgatttttttaaatttttcgagggggggggtagcaaaacaaggaactatcgtaattttttttatttgtttaattggcaattgcacaattttttaaggacgatgtcgtggttcttctaaacaaggcggaaagcggtcctgaattgttggttgagcaatgttggcaaaagggcggtggcattttgaacttgaaggatttgcttttctacggcctcctcgggtgcgtgccaacttccgctgtttgcttgaaaatggcacaaactgttgatcccccccccccccccatcccactttcagaggtggtctcctcattttggctaccgtcctgacaattgtgattgtgctggtggttcgtcgacaacgaaagtctgcttctcatacggttgcgggtgacgatgacatcatcgatgacaaacgtgagaagaagaaaatggagagaccagcagctgcaacgagaattgtggtgcacagttgtcgcatgggacaacccgcagcggggggaaatctgagtcaaatgtcacacgaaggtgattcggatacgatttga

SEQ ID NO: 76206 - DNA, 2059 bp, Heterodera glycines
  Genomic contig location: Contig_ID=SeqID_12554; Location=955..3013; Strand=-
  SCN-specific regions: Sequence locations=1-268,320-652,678-723,746 -757,801-1223,1246-1492,1514-1790,1812-2003,2025-2059
caagacagtgattttgatgacgtaaatgaaattatggttactttaacgaaagaagaacgtaatgaaatcaaggcaaatcataaaatatatgataccgagcttgcaaaaaacaaaaaaaaatatgaacaggttgatgggaaaaaaaataaggaagatgcaccaggcttgtgcactgatttaaggtgagtttcttctttggcgggcgggttatatatatacctaaacattttttgttgggttaaaaactttaaaagaaataataaaaaattatatatatatatatatatatatatatatatatatatatatataatatatacagtatgtaaaaaaagaggactttgggtccctctcttaagaatctttcatctttttttctggttacagtcatgaatccgggccctatcaaaaataaaatcatggctattatcggctttttgggcaaaattgttgcttttaccaaactgttaattgttatttcagaaaacgggaaagcaaactcaaaggagcttcgaaatatgcaattgtgattataaatctttgtgaaacaaatcgtgaacaaacctttgcgccatttagtaaaaaaggaaaaaaggaggctgctttatatacgccagcaacaattaaaaaagtaatggaatattgaaaaaaatgcttttttgtttggttttggtggtgcaaaattttaggttcttgaagaaaatttggaatttgttacgattgaccaaaaatttacgcttacaatgatctttaggactaataaaataaaaaattctaagaatttaaaaattaaaaaaaatgcaattacgcactctgtacacgtgccgatagatgcatgtgcaaatttaccaatttttaatacaaaaaaaacatttctcatttaggacgctgatttattgaaagcatttatcaaagatgctagtaataattttgacgacgtttggacaagaaacaacgaatttataaatgatatggacggcaaagaccgggttgtacgaatgctgaccgaggacaattatgagagactgcgttgtgttttagtatattataatcatcagcatggtaatgtaattgatgatttggatcggactataacagaagaaataaaaaagaaaaaaatcccagccgacgcactcgcattgctggtaatggaaaaggctaagtgggagatttttctaaatccgctaaaatccgtcatcgaaaacaaagcaaaaaatatggactaaaaatttttaaattttttatccaaattcaaaatttttggcacgaagattttttttccttaactgtggaaggccggcctaaaacgcatgaaaacttttggtggaaatcaataattatcgctttcttttgtatttttccttttaaattgtttttttaccatgtttaactattttcgatatttttagcttaaatttaatgaaatatgaagaattttctaaaattttgccatcaatttgaaaaattcatttccatatttttcacttttatcggtataaaaaccaaatttgtgggtcaccaccgcccccgcccagtatggatggaatttcacagaaattatacaagaaaattttcattattatttcaatctggaaaaatccatttcgcatttgccaccgaagcccagaaaaaacttctagaactctgtaaaattcagagattggcccgtttggtattcattgacgcgctctatggacgaccatttctgctggcactgctgttacatgaaaagttggaacgtctgtactggtctgcatcagaacaatggccgaaaggccagaagacaccaaatgataaagtcaatgaattgagtgatgcgttcaacgacgcgtcacgcctgttcatattgcatgctccagttcagctgtgggaaattagtaaagtgtacagcgatgccatcaagaaattcaaaaaatctgaagtaagatgatcgtcaagagggttttaacaattatagggaaaattccatgttttaggtaaaacttgttgatcgtcttatggaaatcaaaatggtttttgaaaagaaaaaaaaaattgatgaggcgttcgtgataagcgg

SEQ ID NO: 76207 - DNA, 559 bp, Heterodera glycines
  Genomic contig location: Contig_ID=SeqID_12555; Location=167..725; Strand=-
  SCN-specific regions: Sequence locations=1-198,221-559
atggacaatcatcgccgaaagcgcttcactaacttttccattgaccatattctctccgagcccaaaaagccccgtcaaggcttcctgatcaatgaacatggcatagtacacttccacgactcagttcaacaagccgaaggagcatcgaaagtggccaaagactacgttaaaaaattggagaaaaacatcgagcatatggccaaattccactatgtcaaagtcaagtcaaaattcatcattaccgacttgccgagcacgcctgaggcaatgtggacctggactttcaaacattatatcgaggaggcatttgctgacagccgtgagcgcaacatcgaacctacacacctcggctgtatgatcagcagtcctctgttgaaaggcggagacatctcaaccccaatacaacaaatgacaaacaacacactcgacagcattctgtaccagtacaaaaaagtgacacagaacaatcaactgaaagatgtgacgctgtggagagaacccttcaccattaccataacgacagtggaccgaaatggactgggattgtctaagaaaaaat

SEQ ID NO: 76208 - DNA, 1047 bp, Heterodera glycines
  Genomic contig location: Contig_ID=SeqID_12555; Location=1086..2132; Strand=+
  SCN-specific regions: Sequence locations=1-217,251-300,322-452,476 -762,784-975,997-1047
atgaaacgccctaatcctttgaaccttccaacgagtgagaaaaagccaaaacttcgtcgactcctgccggctgaattgaacaacgagcagatcagtttcgtgccattagtctgcctatttgccaatgtgaagcggactccaatcggtcctgtttgttaccaattcgagtgtttccgtagtcagcgccaaaagtgctttgaatatttggtattttaccaaatttattattttattacataaattatttatagaagggtgttattgcagtattcgatgtgatgtttgaggagaaaaggacaccgaagaagaagaaagtgtggagactgcatctacaggaagaactgccgcatgagctcagccgaaatgagcttctacactacctcagttacggacgactgggaacgaatttgttcgagacttattttgtgatgagccaagcaacaaatgtaagcgaaaagttttaaatttttaatgacaacacaaaatttttagtcaattgccattgggaatttgtttgggcttctgctcgattttgcaatgagctcaccaactccttggctcatgaaacgaccaatttgctgtggaattttcttccgacaacatttgccatggattctgcaacaaccgatgaacgtaatgctttctcatggcttttttccggaggtccgaagtgatggttttgaatttttttggctgttcaacccacacttgaaaaagtatgctgggtatgtccgaattctccctgagcttagtcagcctgacaatttgcattttttccttagcattttctaagcattttacttgaccaatttattcatcattatcattacatacagatcggaatttgtcgatttttccattttctcaataaattgttgaaatgaatgaccttgtgacatatgatacacaaaaacaatacaatgtggggcacacgttgacactaattgggattgataggaacgaatattttttcttaggcccattggaaacttattcaggaatgatgacacaatgacagatggtattttttgggctaagctgtcataa

SEQ ID NO: 76209 - DNA, 439 bp, Heterodera glycines
  misc_feature (41)..(41): n is a, c, g, or t
  misc_feature (54)..(54): n is a, c, g, or t
  Genomic contig location: Contig_ID=SeqID_12556; Location=83..521; Strand=+
  SCN-specific regions: Sequence locations=1-339,361-439
atgagccaagcaacaaatgtaagcgaaaagttttaaatttntaatgacacacanaaatttttagtcaattgccattgggaatttgtttgggcttctgctcgattttgcaatgagctcaccaactccttggctcatgaagcggccaatttgctgtggaattttcttccgacaacatttgccgtggattctgcaacaaccgatgaacgtaatgctttctcatgacatttttccggaggtccgaggtgatggttttgaatttttttggctgttcaacccacacttgaaaaagtatgctgggtatgtcagaattctgcctgagcttagtcagcctgacaatttgcattttttcttcagcattttctaagcattttaattgatcaatttattcatcattattattacatacagatcaaaatttgtcgatttttccattttctca

SEQ ID NO: 76210 - DNA, 669 bp, Heterodera glycines
  Genomic contig location: Contig_ID=SeqID_12558; Location=1186..1854; Strand=-
  SCN-specific regions: Sequence locations=1-86,159-303,351-381,403 -468,492-497,532-669
atggaaatgaccagggatggcaccaaattgaaggtgaggctgctgtttgcttatatcatatcgcaatatatgtagaatattgtggcaatatttttatacaaatttcaaaaaatttattttttaaattattttttcatttttaaataaattatttaattgttgccagatgagtgcctgtgacgtggacaatgtgtaccagcattggaccttcaaggagtacaacgaggccaaggcgcgcgagtacgcaatgatcaggggcggtggcacggacaaaaatggcggaggcctttgaatttaaatggcaaaaataataattaattaacctttaattgtatttataaattttatttgtcccctccaccttctcctttttttatgttcttgttctaattacctaattaacttcattcatttcccgcattccttctttcgtactttcaccaaaatcatcacttaagaattgtgcgcataatttattattatttaattttgtattattatttatttatttattggtttttttaattatttttcatacctatattgtaataatgcctctctctatctctgtgtttgtttttatgtaattgtatgtatgttatttttgtttttcatctcattatgaagattatgataataatatgatatggttgttatgatgcaaataaa

SEQ ID NO: 76211 - DNA, 279 bp, Heterodera glycines
  Genomic contig location: Contig_ID=SeqID_1827; Location=288..566; Strand=-
  SCN-specific regions: Sequence locations=1-279
atgttgaaaaccgttgtgggtattgtccgcgaaacattggacagcgaatgggccgaaattgacgaaatggcaccggcaccgaaaaatgaaaaatcgccggagggagaggggaaagaatggcacgacgacgcagcgaatcgatgttggcacattacgaaggatggcatcgaaaagttgaaggcaatgaagctgtacgagctgctctacgagcacatccttgaaaagcatttcgacaacagcaatgacacgacaagcaaccgccaattagtggcacagcag

SEQ ID NO: 76212 - DNA, 321 bp, Heterodera glycines
  Genomic contig location: Contig_ID=SeqID_1827; Location=906..1226; Strand=-
  SCN-specific regions: Sequence locations=1-65,87-321
tttctcatccaaattaatcattcttggtattattcgaaagcattggaaaaatgctagtatcgtgcaaattttcaaaaattttttatttatgcacaaaaaaatcagagcaaaaaaaagttcgaattgctgggtttttgagttccttctggccataacttttttgaaacttaaccaaaatttttgagattttgcaaattaataataaacacatagagttatcgaacaacaccaacaattcttaatttgattgacagtgaacaaagttatggttcaaaaagtcttccgacgacgtttcggccgacgacgttttggggtgcaccg

SEQ ID NO: 76213 - DNA, 1306 bp, Heterodera glycines
  Genomic contig location: Contig_ID=SeqID_1828; Location=988..2293; Strand=-
  SCN-specific regions: Sequence locations=1-37,59-124,146-307,355 -400,422-470,504-560,617-769,791-808,835-870,902-1118,1140-1306
atgcatttggacttgaagccacaaaatttgctttatgtaaaaaaggaaaatggagaggattcagtgatgaaagccatagatttcggaactgctcaattcattgttgaagaggaggatgtacaacgacagcagatggcaaacttttgcaaatggttcgtcatcaatgacccattgaccaccaaatattacgaggcaagtgccacccacaccaaaaaaagataattggtcaattaaaccaaaacattttataattctaattggccaattaagctaaaatcttttataattctaattggccaatttagcctaaaaattataattttattttttactactaaaaaatttctaatatttcgccaattaagccaaaacattttatatttttaattggccaattgccaaaatatttataattttaattggcaattaagccaacaaaatttaatttactttatatatctatctgtttaagaaacaaacgaaaaatatttttcattctttgtgttgggcttttctccaaaatcttctttaatcctatccccctgatttctatgcgtaagaattaaaatttaattattttatcaatgaatttataaaaaaaaatatttttattttacagagccccgaacatcataagctatgcaattggggctatatgctgcataatgagcgttcgatgcggctcagttcaaaaacggacatttgggcgtttggaatcattgcctatgaaatggcatattttgggctgaactttgggcccaaattggagggaggagaacagcagaaaatatgtgccgtgactaacaacgtttgttaattaattaattaatggatgttggaaaataaaacaataaaaaaaataatgcgacaaaaatgtgtcaattaataaaatttcagaaaatagaacacaacaaattcgtcgcttggttatggactattttcagtgccgaacgcgatgatgttctgtttggaaaaaaggtggttcaaagaatgggcactcaatttatttttgccaaaatcattcaatttatccgttttaattctcaatttcaaatgctaattaatatgactcgaaattatatggactaaaaattcctgaaatatggactaaaaagctcaaaaatggccaaatatggaccaaaatatggactaaaaactgacaaaaattaaattttaaaccatcaaaattccaaaaatattcaatatttgcttaaacaaacttaatacatctcaaagaaatttttgtaataatctcattctgacgtcaatgaaaattttaggaagaagcgaaaaaatacctaataaa

SEQ ID NO: 76214 - DNA, 791 bp, Heterodera glycines
  Genomic contig location: Contig_ID=SeqID_1828; Location=1506..2296; Strand=+
  SCN-specific regions: Sequence locations=1-172,229-285,319-367,389 -434,482-643,665-730,752-791
ttttctgctgttctcctccctccaatttgggcccaaagttcagcccaaaatatgccatttcataggcaatgattccaaacgcccaaatgtccgtttttgaactgagccgcatcgaacgctcattatgcagcatatagccccaattgcatagcttatgatgttcggggctctgtaaaataaaaatatttttttttataaattcattgataaaataattaaattttaattcttacgcatagaaatcagggggataggattaaagaagattttggagaaaagcccaacacaaagaatgaaaaatatttttcgtttgtttcttaaacagatagatatataaagtaaattaaattttgttggcttaattgccaattaaaattataaatattttggcaattggccaattaaaaatataaaatgttttggcttaattggcgaaatattagaaattttttagtagtaaaaaataaaattataatttttaggctaaattggccaattagaattataaaagattttagcttaattggccaattagaattataaaatgttttggtttaattgaccaattatctttttttggtgtgggtggcacttgcctcgtaatatttggtggtcaatgggtcattgatgacgaaccatttgcaaaagtttgccatctgctgtcgttgtacatcctcctcttcaacaatgaattgagcagttccgaaatctatggctttcatcactgaatcctctccattttccttttttacataaagcaaattttgtggcttcaagtccaaatgcataat

SEQ ID NO: 76215 - DNA, 246 bp, Heterodera glycines
  Genomic contig location: Contig_ID=SeqID_1828; Location=2527..2772; Strand=-
  SCN-specific regions: Sequence locations=1-121,145-164,191-246
ctgacccacaaaatgtccagcccacgaaatgtccaagtctcgaatttgagttttttattattcagatgggcctaaggttaggcaaggggtaatataaagggtatattcgtattcagcgaccccgaaaaccctaaaaatcctaaattagactcattttgtttttataaattttgaaaaattttggacatttcgtgggtttttactcttttggacatttcgtggcttggacactttgtgggggtgcca

SEQ ID NO: 76216 - DNA, 1036 bp, Heterodera glycines
  Genomic contig location: Contig_ID=SeqID_1830; Location=76..1111; Strand=-
  SCN-specific regions: Sequence locations=1-232,254-547,569-587,616 -623,645-1036
atgtccaaagaagaaattgtgccaaaacagcaaaaattgcccatgggacagtgccattgtggacagtcaaatttatcggaaatgaatgaagcgcttgaaatgacaaatttagtggacaacgcaacaattaaacttaagctacaaaaagaagaaaagccaataggcgaaggatcattctcagaagttcgttttaataaagaatttagccgtgtctaaaactgggcttcgatctgtcctgatttatcagatttgtcctgatgtggaggtaaaggccaaaatttgttctgatttcttaaataaactcatgaactttttgaaactttatggcagaatgtcacggttttatcaaggaaatttgcgcaaaatttggtcatttttggacaaaaatctgttaaaaaatacacattaaaaattacaaatttttccctgacggcgcctatcggcgccgccggaccccatcccctcgcccattcaccaaaagttttttgaaaaatgcgccgcacaaaaatgttaaaaatctgattttttgatcccgaacgatttgctaatttcctccacaaaattattaacgatgaaaatcggaggcgaaaaaatataatttttattacattttttcgtcgaataattttaaaaataactgatttgaagcaatttcgcaaaatgttttgattgtcgaccgcaaaatttgattttttgagcccaatgttctgattttgaaaaattttcgatcgaagccccaggtctaaaagataaatatttaaatcagagtttttaatccaaataaattcaattgtttaatgtctttaattttttaagccaaattttctggctttttcatggcctaatttttttaaaggtgcagcatgccgtattgtacgcaattggtgcccgtccgtacaacaaatgtgtggcattgaaaaggacttacatagactgggaaaccagtgattggcaaaagcatgtcaaggagtggaaaattcagaaagcattcgatgcattgccaaaaaatgagcgagtcatcaaattaattgcttag

SEQ ID NO: 76217 - DNA, 1360 bp, Heterodera glycines
  Genomic contig location: Contig_ID=SeqID_1832; Location=211..1570; Strand=+
  SCN-specific regions: Sequence locations=1-30,52-266,288-315,339 -422,462-724,746-816,875-1294,1337-1360
atggattttgctaattgctcttttggcggtgccaatgttcttccccgttggatgccaaagtgtcgccacattgggcgcatttctatcataaattgtggcctgcgctccgcgttgcaacttgcccacattggttcggctgttcaaattcgtgccaaacataatcaaattggtgatctgcaccgggttgcatttgaatgcactcgattgactgagcttgaccttagtgccaatgaggtcagtttaatttgtgctagtgtaaagccttaatgttagattattttaatttgggataaatttataatttggtcacccaacaaaaaatataaataaataaatttctgtataatgccggccggataatttatgggcaaactcttctctcaatctgtaaaggggcaggcatgagcttgccaataaattggaaatatttaaataattccattaaaaataatttttttattgtgaaattttcagtttgttcgaaaaatcttgaaaaaactttattggtcactaaaaacttcaaacttaaccaaacttcaattatcctacctctattttatgacacagattgccaaaatcggtgcccacacattggcgcgatgccattttttacgtttcttggacctaagtgataatccgatgggcgagttgccggacaaattatttcaaggatgccgacgtttaaaagatttacgattggatcggcttggattacgggtgaacatttgaaaaataataattttatatctcctcagcaggatgtcgcaattggattttgattttcaaaaagaacctcttcacaacaaaagttttatgaaaattaattatttatatttttaaaataattaaatcaattttggataataaatttaatctaaaatgttcaacaatttttgtgtatagcgaagagaaagaaaaaaaatgccatgttttctctgaccataacttaaatcatggataataaattagggctaaacggttaaaccaatggagtaggactgagtaaattaattaatgatttcattagaaatccattttttttactgttttgttcagagtgtccgtgctgagctgtttctcgggctgaacgcactcaaatcgctttctctgtccggaaatccgttgtcccgcatcgatccgttcacatttttgcccgcccggtcaatccgcgctttacgcctcgacaattgcacattggcacaaatgccattggcagtcacacaatgttgcctattggacaggtgtttttttttgttttgttttagtcgccaaaattagccgttggtcttataagattaaaaaaaatttttttttcggaaatttatttttaataattcaaatgaaatgtaattaaaagtaa

SEQ ID NO: 76218 - DNA, 1681 bp, Heterodera glycines
  Genomic contig location: Contig_ID=SeqID_1832; Location=1855..3535; Strand=+
  SCN-specific regions: Sequence locations=1-229,264-471,493-495,517 -880,933-954,978-1103,1125-1310,1332-1478,1566-1622,1679-1681
atgcccgccccgctgttggcccttcttccccgcctttcccacttttccttcgccaacaatccgttgttgcagctgcccttggcacttttcctctatgagcataaccgtgccgaagaggcactgctcgaagacattgtggacaccttggtaatttgcataaatcgatcaccattttaatccttcgagaaccattaaatgattttattaacttaaaaatgaatcaatttccaatatttattattaattaattattgtttaattttgccgatcaaattgcccgtctggcgcttggagccctgcacgccctatctttggcacttccatttgcgcaatgccagctctgcggcacttcgtcgtcgaatggctgcgtggaatgcgttccgaatgcaccgcgacggtttagcgcattgtgaccaactatacgaaacgatcattgacggcattggcatttacaggcaaaaaaaaaagacgaaaaaatatgtattaatttatccaacaaatttttaaaattaaagtcctggtcatatgtttgtgatcacggatattgtcctaactttataaatggaataatttttttggtgatctgctatgaattctgtataagatgcaaaaactgcgtccagctctgttcagaatcagtagtagacgagttataagttctttaatttcccatgatatgcaaaatgatatattactttttaaaccgatttaaaaactggttaaactgattttttttttgaaaaatgccgaaacaggtcaactgatatttcaattaagctatttttgaaactaaaatcgttaagattaactaaaaactgataaagtagtgccctgtttgaagtcatcataaacatatgatcatgactgtaggaaattgaacttttattaagttattttctttttttttcttttttaatttaagaaatttatatgggtttttgtcttttcatgcgcaatttttattttaaaaatttttagactttttgtagggaacttcgtgaacacaatggttgtgaggcgactcgtcggctgcgttcagttcgcgctgatggtaaaaatgctgtgggaattcgctgcgattcggcaacaccaagcaaagcgacggaaaaggaagcaacaaaaaaccttggctttaactggcaccaaaataatgccaacaaaaaaccaaatgtcaaaaaccaagccacgtcagtaggaccatcagcatttgcctacggtccaaatggcacggatactgtcattttgggaagtgatttactgtcgactaatgcctgtcaaaccgcatacagtgtgctgccaatgggtggaagtgcaagtaaatcacatttattccgcacaaatttttttattttttgaatttccatttaattttcaacgttttcgcttttttaattttatctttttccgaattcatattttagttcatcattttttggcaaaaattcaaaggtttttatcagtttttgaaaaaaaaatgctaaattattaatttacaattttagacattattttttgaatgaaaaaattttaaaaagaaaaaaagagatatttaaatatatttttttctgcgaattttaccattttgtgtcttttttttgtatttttggtgtcataatttacgcaaataataatgatttttttcatataaatgacaattttttttatttattcataatttcta

SEQ ID NO: 76219 - DNA, 85 bp, Heterodera glycines
  Genomic contig location: Contig_ID=SeqID_12561; Location=308..392; Strand=-
  SCN-specific regions: Sequence locations=1-85
atgaacaactttgtgtcattttcaactttgcttttgctcattggtggtttcatgtcatttggtgatgttgacgggatgtataatg

SEQ ID NO: 76220 - DNA, 507 bp, Heterodera glycines
  Genomic contig location: Contig_ID=SeqID_12562; Location=246..752; Strand=+
  SCN-specific regions: Sequence locations=1-429,451-507
atggataaagtgttgatgagatggattaatgctaattgtaattcatcaagttcgaaaacttctgatttttattccggaatatgtgtattccgacagttcattctggtgccgatttgtccatatgggcgactcattttggtgataaccgtccgtgggcttggagtttcattggccggcatcatccggcaattccagccggtataaaaaaaaagccaccaaatgaaaattttcaacaaaaaactacccataactttgcttaaacccaactaaaattttaattctttatatcattcgatagccctaagagagtactctattagctctccttatttaaaaaaatttggtcgagtttgaacaaagttatggccaaaagtaaacaagcaccaaaaatttttggccataacttttttgaagtagacataccttttttgaaacttacaaattttaacaattttgcaggctagtaggaaacccagggggtatcgaatgagactcaagattatttaa

SEQ ID NO: 76221 - DNA, 224 bp, Heterodera glycines
  Genomic contig location: Contig_ID=SeqID_12563; Location=924..1147; Strand=-
  SCN-specific regions: Sequence locations=1-224
gtctgaggccgcgaagcggccttaatagcccaacaaatttagaaacgggcgcgaagcgcccgtctgaggtctcgaagctgccttaatagccaaacaaatttagaaacgggcgcgaagcgcccgtataagcccaacaaaatttaaaaaacgggcgcgaagcgcccgttcgaggccgcgaagcggccgaaaagcacaacaaaaattagaaacgggcgcaaagcgcc

SEQ ID NO: 76222 - DNA, 1242 bp, Heterodera glycines
  Genomic contig location: Contig_ID=SeqID_12563; Location=1471..2712; Strand=-
  SCN-specific regions: Sequence locations=1-1242
  Gene Ontology: Mol. function=structural constituent of epidermis; Cellular component=extracellular; Biological process=regulation of protein activity, epigenetic
tcctcttttaatcagtattgtacctcttctaatcacttttgtatcttttatcacttttgtacctctttaaatcacatttgtacctcttctaatcactgttcttcctcttttaatcactgttgtgcctcttttaatcactattgtacctcttttaatcacagttgtacctcttttaatcacagttgtacctcttttaatcactgttgtacctcttctcacactgttgtacctcttctcatcactgttgtacctcttctcatcactgttgtgcctcttctcatcactgttgtacctcttctcatcacttttgtacctcttctaatcactgttcttcctcttttaatcactattgtacctcttttaatcactgttcttcctcttttaatcactattgtacctcttttaatcacttttgtacctcttctcatcactgttgtgcctcttctaatcaatcacagttgtacctcttctaatcacagttgtacctcttctaatcactgttcttcctcttttaatcactgttgtacctctcctaatcactgttgtatgttcttatcactgttgtacctcttccatttacttttgtacctcttttaatcaccgttgtacctcttctaatcaccgttgtacctcttctgaccaatgttgtacctcttctaatcacttttgtacctcttctaatcgctgttgtacctcttctaatcactgttgtaccacttctaatcactgttgtacctcttctaatcactcttctaatcgctgttgtacctcttctaatcgctgttgtacctcttctaatcactcttctaatcgctgttgtacctcttctaatcgctgttgtacctcttctaatcactgttgtaccacttctaatcactgttgtacctcttctaatcactcttctaatcgctgttgtacctcttctaatcgctgttgtacctcttctaatcgctgttgtacctcttctaatcgctgttgtactcttctaatcactgttgtacctcttctaatcactcttctaatcgctgttgtacctcttctaatcgctgttgtacctcttctaatcactgttgtacctcttctaatcactcttctaatcgctgttgtacctcaaaatttaaaaaacgggcgcgaagcgcccgtatgagttcaacgaatttaaaaaacgggcgcgaagcgcccgtccaaggccaacaaaaattgaaaaaccgggcgaagcgctcgactgaggccgtgaagcgg

SEQ ID NO: 76223 - DNA, 316 bp, Heterodera glycines
  Genomic contig location: Contig_ID=SeqID_12563; Location=2618..2933; Strand=+
  SCN-specific regions: Sequence locations=1-316
tgattagaagaggtacaaatgtgatttaaagaggtacaaaagtgataaaagatacaaaagtgattagaagaggtacaatactgattaaaagaggaagaacagtgattagaagaggtacaactgtgattaaaagaggtacaactgtgattaaaagaggaagaacagtgattgaagaggtacaaaagtgatgagaagaggcacaacagtgattaaaagaggaagaacagtgattagaagagatacaaatgtgatttaaagaggtacaaaagtgataaaagatacaaaagtgattagaagaggtacaaaagtgattaga

SEQ ID NO: 76224 - DNA, 434 bp, Heterodera glycines
  Genomic contig location: Contig_ID=SeqID_12564; Location=649..1082; Strand=-
  SCN-specific regions: Sequence locations=1-130,170-434
atggaatgcgttgaagtgcaaattttattattcggaaaagctcgggagatggcagaatgccaggaaattcgccagattttgccgaaaagtttgaccagcacggaactttacaaccacatttttgataaagtatttttaaaatttcaaaaatacttttttatataaaaatgcaataaaataagactaattggaaaattttcgcagattttccccgctttaatgccaattcgaaattcgtgtattttggcagtgaatcatcgctattgttttgaaggaagagacgccctcggagggacagaaaatcgcatcgaattggaagaaaactccgaaattgcgataattcccccaatatcaggcggatgaaaaagcatcagctgggtaacaactgctgattggacaagccgacttttgcggattaagtaaattgaaataaa

SEQ ID NO: 76225 - DNA, 637 bp, Heterodera glycines
  Genomic contig location: Contig_ID=SeqID_12564; Location=2537..3173; Strand=+
  SCN-specific regions: Sequence locations=1-194,257-315,368-416,438 -490,512-637
atggcgctcctgggtggatcccctccacactgccgggaccactggaccaaggagagtccaagtccgtcggtgaagggccaaggagagcccgagggaccggtcttccgagggaggcggaatgtgatgccagaaggaacggagtgtgggagaaagtgggataaaggacctgagagaacctctaaaggaggcgcccgtagctcagttggttagagcacggcacggattgctggggtcgtgggttcgagtcccaccgggcgagttaccttttatgttctacattgttattaaatgtcaaccatcaaacaaataaattccaatatataataatataatttttattatttttatttcacatttttaattaaaacatagataattcttcgttttgcatgcatttccatttgaaatttcgtctttctttctcggttcatttattatttaattattgtctcttaatttgataatgaaccattaaatgaattttccgtccatttctttaaatttctctttgtcagatggcgtgccaaaaaagaagccgaatttaattgcatttgaagtacaaatgcggattcaattagcagcagcaggtgttctcggcaaattaatttcccgatttccaattaatgcatttcattga

SEQ ID NO: 76226 - DNA, 380 bp, Heterodera glycines
  Genomic contig location: Contig_ID=SeqID_12565; Location=921..1300; Strand=-
  SCN-specific regions: Sequence locations=1-222,250-380
atggctgaaagtggttgccgggacagaagtcatctgacgcttgatttaaaaggtgatttgattttgcctaattgatccgccaaagtttttgataatttggtaaccaacgtcataacggcatggtttgagtttttggagtttttgaccaattctgacaaaattgtaaggcactaaaactgggttttcagatggaaatgaattgagtatccaaatcctaaatcctaaaaaaatatataaaattttataatacaaaatctttaggcttaaagccaacgccaaataatgacagtggactttcaccaatttacacggcaatgccattgtcgccagaaaaaattcagtgtaagtatgattatgctgtgctgtgtttctatgtttaa

SEQ ID NO: 76227 - DNA, 526 bp, Heterodera glycines
  Genomic contig location: Contig_ID=SeqID_12565; Location=3196..3721; Strand=+
  SCN-specific regions: Sequence locations=1-233,257-526
atgaatttagaccgagtatttgtgaatgatagaagtaatgataatgaacagaatttggaatatgcatatgtttttgataatgattatgaagtagttgagagcagttatgatatattggaagagcataattatagtaaacggtcaagaatggatgttgttggtggcgaaagccaggtatctctgaattcagatattggtattgctggaccgtcacgtatgagtgatagtcaatttgaagaaaggagaagaactgagtatttgaaaagaaagagagaacgtgagagaatgagaagagaaaacgaatcacaaaaccagagagttttgcgtttagaacagatgcgagatagaaataatagtcaacgaacggaagaaaatgcaaatgaacgtcgtttgcgtttagaacagatgagaaatagaaataatagtcaacgaacggaagaaaatgcaaatgaacgtcgtttgcgtttagaacagatgagaaatagaaataatagtcaaagatcggaagagaatgcaaatgaacgtc

SEQ ID NO: 76228 - DNA, 679 bp, Heterodera glycines
  Genomic contig location: Contig_ID=SeqID_12569; Location=23..701; Strand=-
  SCN-specific regions: Sequence locations=1-113,138-173,209-227,249 -468,491-525,547-679
  Gene Ontology: Mol. function=microtubule binding; Cellular component =spectrosome; Biological process=body morphogenesis (sensu Nematoda)
agattgaagcccgaaccgactcattcaaacagacggccgaaacgggacaacgtctgttggacgaagacattgacgagtcggacgaaattcgacagtgccttcaggtgtggcggaaaaatatttaatatattttaaatggcataaatattaaaggcaaacaatatgtttgaatgttttttataaaacttaaattaattttaatttttaacatctcgaatatagagaaaggtttggagaatgtttataattgagtatttagcctttcaattcttaaaaacaagtgatttcgatgaattgatcaaaaatcataaatttcacaaaatcatagatctctgaagtcattctgtaaatctgatgccatattcggaaaaagtaactcaaagcaaataagaaatacgaacataattatgagacaacctaaaacatcttttaaaaaaagtaatttctgaattttttcaccgtttgatgaatttttttttaaaatttttaactcttaaatgatcatattacaaaattgaaattttggctttcattttgtctttaaaataattttttttttgtcacagaatttggccatggagcagacgagcctgaacaatctgtgggaggagcgtcgcatactgtacgaacagtgcatggacctgcagttgttctacagggacactgagcaggccgagtc

SEQ ID NO: 76229 - DNA, 1456 bp, Heterodera glycines
  Genomic contig location: Contig_ID=SeqID_12570; Location=1..1456; Strand=-
  SCN-specific regions: Sequence locations=1-218,242-601,623-743,766 -1416,1439-1456
aggcaaatgcgacactcaaaaagtggcgggaagagcacgcgcgacgctcggaagaagtcgtggaaatttgggagtttgtgctcagtcggtacgccgctgcgcttaagggcgaattgtgggcggtgttggaacaggtggggaaggaggggggggggggataacgatggggtatagcattttcaaggtttttgctaccattccgattttcaaggtttattcaaaaaggtcactgaaaagatttgatgaaagctttttgaaatctcctaacattctcaattaaattacagcagaataacaacacctttatgccgcttttcaggtgaccatcgccgcgctcgaccaggcaagacatgacttggccattgaatgcctgcagcaattgcatcgccgttttccgaagagtacccgcgtaacaaagcttcaagtttggcacttaagaaagccattccctgtcctttacatgtttaggcaatgcgtttggaagccattggcaattacgaagacgcggaagagctttaccgtcgcctgatcgaaggggacgacacgaatccggtaaataataaacggagttctcgagacttaatcatatttgactatcgcaattttatttttccctttggttgcttttctcagcttttccgcaagcgttgcattgccattctgatcgcgcgcggtgatcgccagttggccatccgcgaactgaacaaatatttggagattttcgccaacgactccgaggcgtggctgcagcagggcgaactgttccttcaggaggccgactttggccgggctgcgttttgtttcgaggaattgcttctttcaaatgttggaccgatgcctaaatttccaacaaaacgttttggaatttgtctgttctcatattttagccccaaaatcccacttatttgctcaaaatggctgaaattcgctacactttgggtggacccgacaatgtcgagattgcacgtgcctattacgagcggtcgctcgccctcgcgccaagtgcccaagccctgtacggcctaattctggtcgagttttgaaagcaagcacaaaaacattgcttttgccatcggttttccttccccaaccattctcacaatcgagtgcaacaaccaattgctgcatctgaagacgggcattggccaacaacgccgtcgtgacttggtccgttcggcattgaatgcgtgcgatcgagttggccaatttgtacgaggggaaggcgacgggcggagggggcgacgaaacaccgcgggaagactttggaaggcgattgtcggtggttgtgcaaacactgcgcgggtgtttcactgaatgaataggccgtcgagaagaaaaaagagcttcggctgatcgcactttttgattttgactatcatttaatgtgattttgtacaaaaatgccaaatgtcgaagaaataaaaaggtgaaactttggcattttgcaaaggcaccg

SEQ ID NO: 76230 - DNA, 451 bp, Heterodera glycines
  Genomic contig location: Contig_ID=SeqID_12570; Location=2069..2519; Strand=-
  SCN-specific regions: Sequence locations=1-2,24-97,119-129,151 -176,199-451
  Gene Ontology: Mol. function=electron transporter activity; Cellular component=mitochondrion; Biological process=proline catabolism
gatggggatgctggtcagctcgttcgttccctgaaggaccaaactccgttcggactgactggcgcagttttcagccaggacaagtgaaccgacatttaaagaatgttaattttttcttgttttaagggactttctttatgaagcaaaagacattctccgtgatgcagtcggtcaggataaattaaaaaaaaaaaaaatcgcttgcaaattaaggcaatttgtatttgaatgacaaatgtaccggttccgttgttggtcagcagccttttggtggagcgcgtcaatccggttagtaggctttttgtgccaattttcttatggaatcgcttaaaattaaggcactaatgacaaggccggaggcccccattacgtcctccgatggacttctgcccaagtgatcaaagagagttttgggccgcttaccgaatggcgctacccgcacatggattag

SEQ ID NO: 76231 - DNA, 414 bp, Heterodera glycines
  Genomic contig location: Contig_ID=SeqID_12572; Location=186..599; Strand=+
  SCN-specific regions: Sequence locations=1-92,114-125,147-221,243-414
atgatcgcgtgtttcagcgccgccgttgccgcactctccgcgttcactttgttcagcctcgtcagcggcgagttttcgctcgccctcagcgcggtggaaagcggcggcggcggaatgccccgcgagggggcgaagcggccgccgtcggacgcgccggtgggacggaatttggtgattctgcaacacaacacgacatgtaaacattggcaaattagttcggcattttcattttgtatttatttcaacaattcatggacgacgatcgatcccatggggacaaagacatttacttttttatcttaaattaaaaaaaaactttttcggtggtaattcgtgtgatttttaaagattttatccagaatattttttagcattgtcaaggacaacccaagaattgagctcggaaaatgtata

SEQ ID NO: 76232 - DNA, 887 bp, Heterodera glycines
  Genomic contig location: Contig_ID=SeqID_12573; Location=1814..2700; Strand=+
  SCN-specific regions: Sequence locations=1-22,51-114,137-171,194 -331,371-653,678-887
ccaaaggtatgtaaaatagaacaaaaaatataaaattttatcaattttttgagaaagctagacgaaacgacggtaaaaagcaagcaaaaaggctatacataaggctaattccgtaaaaaataattctaaaataaaacaccaaaacttcaaattcttagagttgatagtgtcacgggaccggggcgggaattcccggtcctccgaggtcccggttcccggattttgaaaatttatttcccggtagggctcccgggaaaaacaaacacgggtaagaatggggtattagcgaaaaattaatgagcgaaattgggggggaaaggaaaactttttgataaaaatcaattataaaatttattttttaaataatatacaaatggtccagtggttaatcttcctgctggtttcttacttctttcccttgtttcaatcccacttcagtaattaaatgtattttgtttttttctttttgtaatcatttttaatgtaccttcttccatcagcaatactatagtaaattaatttttaattcgaattttcccgaagatgcctatcggtattgcggcactcaaatcaagcaaaattttcatggtttagtcaaattttcaagttaccaaacaagataaggagatttatcaatatgcaacgcgaacaaaagaataaattaaattaaaacagaaataaaagttgattggactcataaagtgaagtagagccagaaattccacaagttttttcagtccgtctgctgcatgttcgctgataagtccgcctcgctcactgtgtcgcccgccctcacctgcgcagctcatgcttcattttctgtgcttgctggcgcagtcgctcgtaccgccgcttccattcctcatgtagcttggcgctcgccgtga

SEQ ID NO: 76233 - DNA, 183 bp, Heterodera glycines
  Genomic contig location: Contig_ID=SeqID_12573; Location=2542..2724; Strand=-
  SCN-specific regions: Sequence locations=1-183
aggttcaactatgaaaaaccccggtcacggcgagcgccaagctacatgaggaatggaagcggcggtacgagcgactgcgccagcaagcacagaaaatgaagcatgagctgcgcaggtgagggcgggcgacacagtgagcgaggcggacttatcagcgaacatgcagcagacggactgaaaaaa

SEQ ID NO: 76234 - DNA, 270 bp, Heterodera glycines
  Genomic contig location: Contig_ID=SeqID_12573; Location=2872..3141; Strand=+
  SCN-specific regions: Sequence locations=1-101,123-164,186-270
atgactgaactttgccaattgctgaaaagcgaaattcggcgtttggaaacgaaaatggactatggtttcaatgaactcggcaaaaaaatcagtggattggagaccaaaatcggtggattggagacaagaatcgatggattggagacaagaatcgatggattggagaccaaaatcggtggattggagacgaaaatcgatggaatggagacgaaaattggtggaatgcagacgaagatcgatggaatggatatgaaaatgaatcagtttgag

SEQ ID NO: 76235 - DNA, 1132 bp, Heterodera glycines
  misc_feature (115)..(115): n is a, c, g, or t
  Genomic contig location: Contig_ID=SeqID_12574; Location=88..1219; Strand=+
  SCN-specific regions: Sequence locations=1-506,528-758,780-1074,1096 -1132
  Gene Ontology: Mol. function=single-stranded DNA binding; Cellular component=DNA replication factor A complex; Biological process=DNA dependent DNA replication
atgggaattatcgacggggacggagtcagccgagacaatgacaagggcgagtactttcgatcaaggcgatggtcatcactgtgaagagtgaccaggccatctatcaggtcagacncaacaacaaatagactttgtatggggaaacacattaaattgaatacgatttcgacaaaggcataaatattcggacgcaaaagccaaataaaactcactttaaaccaccaattttgtgttttgccaggcgtgtcctcagcagggctgcaagaagaaagtgtccatggagggcaaccagtaccgttgcgagaagtgcgccaacactttcgacacctacaagaacataatgatgttgcaggttcttcttgttgtgcaatgcgattccccactttcctttcaggtcgaattggccgacttttctggagagacctgggcaaccatttttgaggacaaagcggaggcattgttgggggtgaaagctgaccaaatggcacagtggcagagagaggacgtgagcacaaaatttaatttcatatttatattaaagcacattttaccacggggggggaatgagtcgggtagcaattgcctattttcattgtaatttctgtgtccgaggagatttttcaatacatggacttcccttcatcgtttttcctttttgtccagcccgctcggtttgattctgcatttaatgtcattcgtttccatgagtttttgttccgcgtcggagtcaaatacgaaatgtacaatgtgagtggacaaataaatgttcaataatttttgaaactgttattttctcaagggatgctttcatacttttgcctaaattgccgtcatttatccaacacgtgcctctaattttttttcttctcttccaggacaaatcccgtctcaaatggtctgtgttcaacattcagcccgtcccattggccaagtgcaaagctttctttgagcaatcggtgcaaaaattggaaggaatttgatgccaatttcgaatttgataaaccgcaaatacacaacgtttttgcttctgatcaggcgatactcattttatccaaatatgatttcacttatttttgcaaatattttgacattaatgaatatttaaattcaaaaatgggctaaatgttattaa

SEQ ID NO: 76236 - DNA, 2009 bp, Heterodera glycines
  misc_feature (39)..(39): n is a, c, g, or t
  Genomic contig location: Contig_ID=SeqID_12574; Location=1392..3400; Strand=-
  SCN-specific regions: Sequence locations=1-183,209-584,606-682,704 -737,786-795,831-1519,1541-1574,1609-2009
  Gene Ontology: Cellular component=plasma membrane; Biological process= cell-cell signaling
cagcggcgggagctcaaaaggcaacggtcggagagggtnccgccagcggggacgagaacgccccgcaattggctgccaattgcgccacaattcgaagcggaagatcggacggatgcgacggcaccgcaccgtcggcacttgtggtgagtggtggtggagaatattcaactcgtaggatttcgatttgtttgtttgttggttggttcataaatggcgacaattaccatgtgcactaggcccattttcttttttttgccattaattgttttttattgtgttatttttgttccttcactttccatcaatttacccattttcagttgtcctgtggtctctgttcgtgctcccaatgcaaatgttcggggtttgtgtcaatttgataatttaccatcgcttttcgccctcattttccccctaatttgttcttcctcagccttccctcgtcctgcaatgggcccaattgtcccttttgcccgtcgatgtgccaatgtccgaccgaatgcggctgcgactcgatggcatcattacctccattcaatggcattcaaaacagcgaaaatggcatcgaattaggggaaagccaagtgattaaaaatatcaattattgtcgtaattaatgttaattatgtgcacgtttttttgtttaaggccgtcgaaatgcagcaacagcagtacattccgtcatggaatgagcaacagcaaatcggcacatcgcagaactattacgccgtccgtccttttattaattcataaattatttaattaaaattttttttattattttagagtcagtggaaaatattttaaatttaaacatttaataaaaaatacagcgaccctctcatatggtattttaagtttatttgtcataattactccctaaggcgccgaactttggttacggtgtcaacggtggaggttacggtggcggcacggcgcttaatgccgccttcgcctcgctgcagtgtttcagcggtgatcagttggtccggacagcccggggacccgtccgcatggatcagctccgaatcggcgatttggtgctgtccatggacgagtcattggtagacggcattaacaattaataatatctttttgccaatctgtcctgatgaacatggcaatcagttttgaatttcagtttattgagattgatcacttcttaaaattcaaaaattgatcaaatggtttaaatccgaatttcgaaaccgtttcttctgaaattcagaaggttcccaaaacaatatcattttttcatttttctaatttccgtttttcttttttcaaattccgttaagctttccttctctcccgttctgatgtttctccatcggaagccgtcagaatcggcccttttcatgcgaattttcaccgaatttggccaccaactccaactcaccgccctccatttgatttgggtcggatgcgcggggcgactgcggctaattagggccaatgaattgcgcccggggcaatgcgtttacgcattggagggaggagaaaacggcaaaatgggcgaggaaatagtgtggggaagggatggagacgggacggagagagttcggcaaacggagagacgaggagaaggagaaagaagggggcagaccaggatggcattgagccgaattgtgcacattgacaaggcaacgaggcttaattgggcctaatcaggtgtaaatggcactaattaggtgcgtggccatggcatttacgcgccattgactgccaacggaaacattttggtcaacggtgttttggccagctgtcacgccaatttggccgcgcaaacgctgcagcaaacgtttttcaattggtggcgcgccctgagggaatttggccacaattttcactacgccgctttcgccccggggctatggcaattggcgggcggcgattggtggacaaatcaacaaaacgcggaccaaatgcacgccgaaggggaggacttgccgatgggggtgcatttcttagtcacagtgttggacacgctgatgcccgaatccattctc

SEQ ID NO: 76237 - DNA, 1044 bp, Heterodera glycines
  Genomic contig location: Contig_ID=SeqID_12576; Location=102..1145; Strand=-
  SCN-specific regions: Sequence locations=1-26,53-311,348-843,865-1044
atgaaatctcatctttttcttctcataacactgaacattttggcacagatatttacaccttacaaatgtatggacagaaaaggcaaaaaaagagtagagagaacttactcaaaaggatcatttgaagacgaaagagataaggaattttatttccgagacgattcttacggtatcgaaccttaccgtattaatgtcgcgcctgagggctttcgcggcacgatccaagctatgacggcaagtaaggatgatcctgtgagagaacaattatcccaggaaatgcgttggaattcaacatttcaacaactcccaccaaaccaacaaaaagaaatgtataatttggtaaagaatgggccaaattcggcctcttctagccgaagtccacagccatttcaaagttcaaaccaattcccatcaaaccaatttgggtcaggtcagtcgaacagattctgtgcttaattagctgaaaattaactgaaatggagaaatttagctaaattacgtgcaaattaatttgctgatgttttaggcactgtgccattggggaaagcatatttgggccaacaaccattggtggcctctggttcatcaagtagaccattacaatccagcggcacctttttgagaccaaatccttcgagaacttccgtggctaaaccatcattcattgtgccaaagagcacttcgtcaaatgcttttaccagttcatcacagttcaattccagatttaactcatcaggcaccttcctagtgccacaaaacccttcttcaaatgcattcgccaattcatcacaattaaatgccagattaaatgctttaaattccttcaaaatgccacagaacgcttctttaaatgctttagacaattcatcacaattcaattccggattaaatccttcaaattccttcaatgctccgcaaaatccttcttcaaatgacttcgccagttcatcatcatatcactcactgtttgagtttgagtaccctcaagtggacactcttgaatcgttattgtttgggtgcaagaagcataaaaccgataattag

SEQ ID NO: 76238 - DNA, 1153 bp, Heterodera glycines
  Genomic contig location: Contig_ID=SeqID_1833; Location=298..1450; Strand=-
  SCN-specific regions: Sequence locations=1-102,128-193,215-321,344 -971,993-1024,1050-1153
gtccaagcagttcagagaagggctcaagaaatcggagcctctgttccgacagaccacacaataaaaaatcgaacttgcgcgatccgtaagaaaatgcgcaacaaacagaagaaagatgaggaggaggcgcaacagaaattacaaagtgaacaaattgtgcccatcccgcaacacgaacaaatccaacaacagccgtcaactttccaaacaccaacggactggagaaattcgccaacggatgacgaagatgaaatcgaaattttgggttgttatgagatcgaaagaacgaatatcagcacagaagttgaaggaaataacgagcaaaacagcgacaacaacaacattattactaccaattgtgaattggtgcattcgacgaataacgagaacaatcaggaagatgccgagaaggaaagctacgaagaaaacactgttgtggatgttgcagaagaaactgttgcaaaatcaatggaccaattagaagaaggcattgaagtggggacggtcgtcaacgaagaaatggcacagaatgtgccggaagagcccatggcatcagtgcaattggcgaagcggtcgaagccgttcaatcagaggattgtcgagaacatcggatgggtaaataaatgaggcttaatggttcaatttgcttgccactttctagcgaaaggaatttgggcgggttccaccgaaggaaagggactctttgggactgatcgaatgcattgatggcgcaacggtcggatgcaaccaacggcttctcgcttctctgaagagttcaaacccttcattgtttttgagaactgataaggcgtgactattaaaaactaaaagcaaaaaaagataatttcatttttagtttcgctcgagaaatgcgtgtggcaataaaaaaagcgaagtgagtctacaaattgatgaatttgacgaattttacaaacgatggatttcaaattatgagcaagagggagcggggaagagccacggagaggagaacagtgaacacgatgggaaggaggaaagtgaaagtggagacgaagaggaggagccaccacaaaacagccgaggacccgtgatcaaatgcccacggatgccaaagataagaatcaatttgaagcgacgtatttcaacaatttccatcgaaaaagcaaaggaatag

SEQ ID NO: 76239 - DNA, 3671 bp, Heterodera glycines
  Genomic contig location: Contig_ID=SeqID_1834; Location=1..3671; Strand=-
  SCN-specific regions: Sequence locations=1-242,264-345,375-603,626 -704,727-1369,1398-1614,1636-1943,1965-2484,2533-2694,2716-2791,2815 -3126,3148-3291,3313-3529,3551-3671
cttcggaaacaatgcattcgaggacatttgcgaaattcacatctgagatccattgtttggaggcttctcttaggagttttgcccatggaggacaggacacaatgggtcgaagtcattggtcaagaacgtcgaaattataccgaattgagacatcggattgagtcaaacccaagaattaataattcgccagaaggaaagaattttgatggtaacaatccactttcgctcagtgcagaagttggtgttttgtttaatactggtgaaatgaaattttagagtccgtggtgcagacattttgagaatcaatcaacgaggaaaaacatcgagaaagacgttgacagaacgtaaaaattattttttgtttttatataaatgagtttgacaggtgtcctgacttaaagtttttccaaatcgatgatgttaaacaaacaatggtcaatgtgctgtttttctattcaaaactcaattcgcagatttcttatattcaggtttgaaaaatgatctctttattttatttgtttctgaaagaatgcattaagggaatgcacgaacttcttggtccaattctatttgttctggattccgaccaaaaggccttccaagacatgaaagaacaggacattttaaggtaatatggtattttatcgtttttaagtccatacttccaggcctaatgggagtgatttttccgatgttgacgtccattgtttggttgtattaaatgacccagttttcttagagcacgacgcattgttagtcaatttttaattgcgcttaattttctctctgtaagtgcattgttcactcggttgatgtcgttgatccgttgcttttatctgagcgataatgcgccttcagtcaacgcaaatgtcgcaacctttaaaagtcacttagaaagagagccattctcagaaaggcattttctacgttttaaattcaattccgatatgttttcttaagtttgcctggaaagtcatctgaattgttgcgccggttggattacatttgcaatggtttactgcttgaagttgatccgcctttgcaccaccatttaagcaatttggatattttaccgcaaatttacggagtgttggtttaatttgcatttcaactctttttttgtaaaggcatcttaagataggaggtggcttcgcttgttatttggccgagaattttcgctgcccgatttattgtatttgtgggacgtaatttttgcggaatgccaccagcaacaatccctcgaaatcatcgactgtatttttgtcgctcttttggtccaaattcgaaatgtgttactaaacggtgattattccgcctgtatccattgtctgatgcgttatcctccaattgtcggtaatcttttttggactttttttattttcataattttaattttagacatccaaactttcatccattatgttcttcatttagtcgctccaaaggtataggagaggcgctttaattattgtttgattaaataacagaagttttgcgggtctcttgaaaatgtgcacaaagcataccaaacgcatttgacattggccggaaaaacgcatccgaacagaagcaaatcaccgccaatacaactgacaaggtcacgacaattggagaatgttttcaacaaaattggtacattattcaaaatgcaaatttgaaaaactgaaatgacataggatttattcatttttttatgaatttaggccgacaggcattgaccagtgcccaacaaattcacttcagcagtttaacccggaaagaacacaaaggccaagaaagccttgtaaaagaaggacaattttcgacagaattcgctagcactaaaaacatcgaagtcaaacaacagccaaatgcagcgcaatatgcggatgaaattgaactgatgaaagaacaagttgcacaactccaatcacgtcttaatgactccgatctgttgaaacaaatttgcacacagaacatcacatcattggtcaaagagctcgagaaaactgggccatttaccgaagaacagggcaaaaaaataaacaaaattcgagaaattgctgaacagctcaatcgaaggttggtgcatttaacttaatattttcaacattcattcccatttcagcagtgttccggaacaactcattccccggtatttgcatgctcttccgtcaacttctgcgactaactcaacaacgggcgaaacggaaccgattgaagttgcctctgaactgcttggtcttcgtccttccaccgcttctgaaacggtcgctcgttcacgtctttcttcgaaatctcttaacaacagcaacgaattaattgaattgcgatttgatcgaaagaagaatttctgactgtgattttttgattcgaccatttttgttttatattccaatttactcactttttgccatttttcgttgagtttgttaattttaatgtacacttggcgcaattcgaagatttaaacaaattataaatataattttctcttggaataatacctttttaaaatggtttaatttattttgttttggtttgggtcatttttgtgaattatctttttcagtatattccatgcagcaacagcggcagactttgactcactcaaatggacgagtggcgacggccatttaccgcactgctttggatgttgtgcaaaacatcagcagaattctcgacagcacggcgaacaccgcaacttcccaacaacaggtggcgatgggtgggcactttgtttacacaccgtttcaaaaaacgagagatgaacaaataaaatacaaagaaagcattctcaatttggcatgctattttatagagaagaaaagtgttgattgttttcgaaaatttagacaatcttaacgtatagtttaggtggtaccacttacaattagtatcattcggaagctctttgatgaagatttgcttagattttatgagttaaaaaatgcaatattaatcgatgtagaaattttttctttatcggtatgcaaaatttgaaatagatttaacatctcgaaaaaaaaaattaaacatcacgcattagatttggtttttctctattaacataatgaaatagtacgccaaaatggtaaatgtttttctctattttttggttcgtttctatcttttttaacctatgttcacatgtgtttttgttgttgtaaattttgagttcagtacaacattgtccctggtgattgtgtcgttgcctctgttcaaaactctaatttgactcgcgcttccatcgctccaaatttggtattttttgcattctttcgtttttactttaaaaatcattaacttagttttctccatcacacggacatttgacgaatgcacaaactatccaaaactttgcaatttctctgaatgatggtagggaattagttgatattaacaacaaatttattctcgaaaacagaattagacacctccaaaataggccaagaagacggaagtgatgacgacatcattttgcttgacacaccgaacaatcattcggaggtaaaatactctcaaattagaacaaagaatttaattcgcctcaaatccatcgtattttataggtttcggttacaaacgatgcttttgctctgcctgtcactcattcgacttcttttttgtctgatgtcgaccgttctttcgtccccccttcgccatccaccacacattttgacgctgttcca

SEQ ID NO: 76240 - DNA, 1280 bp, Heterodera glycines
  Genomic contig location: Contig_ID=SeqID_1834; Location=7407..8686; Strand=-
  SCN-specific regions: Sequence locations=1-74,97-938,960-1119,1141 -1280
atgacccaaactcatctcgtgctgggctctcctcgagagtcgctctcgactgtaagtgatttgttctgtcgctgcttttcccctttttcctccctttcttccctcagattgcggcgatgttccgttccattagccaatgttccgtcgcgtgtcgtccccatattctatccgattttgagcctcagctgcacatccttttggtcctttcttgttcggttttcccttataccctgttcctcttttcagggtctgtacgcctcctatcagcgcgactcggacaatgccgagcgacagttccgtgccgctctgaaggtcagtcggtcggcttcgtttggcccatcattaggaccaccaattaattaattgttcatttgtcagctgaagggacccaacgacgacgccgaactgagcacattggccaacctcggcctggcactgattttcctttcctccggccgagaggcccaattctacgaactgttcgactcactttcgccctcgcgcatcccttcccaagcgaattcactccgttccgcggcccatctcattcacggctttcactactttctgcacgcgcgacacaacgagtgcaagtgaggagcccaattaattaaatgaagagccattaattagtcactaattgactgttaattgaagaagccattaattagtccctaattgactcttttggcttttccaggaaacagctgatggactccattgccatctccaaggaggaggacatggcccggcttcagagcattgcgttgcttctgctcgcaaaactcctttcctccaagtgcccttctcccatttttaatcccaaatttcttcattcctctccaaagggatgtgctaaaagctgcttccgaatgggccacaaaaagtgccgacgttggccttttgctgtgggccaattcgggtgaacgccacgaagaaaaaagacaaattccattgcattttcagtgattcgttcggtcggtgacgcgagcgactcgaaaaaagcggaggaggaaatcagtgcaaaacggcgacaatttgacacggcacgggaagaaagtgcccgagaaaatgcacacgcccttctcaaggtgaaaaagatccaaatgaaccggcaaaattccaattgaaaaaattgtttttagtgggtcgacagggaaatgccgagcgcagcaacttttcgacaataagccaaagaatctcccagataattaaatttgtacacagccaagcgacatatgttttaagcaaactttattggaattaatttcataaataaa

SEQ ID NO: 76241 - DNA, 312 bp, Heterodera glycines
  Genomic contig location: Contig_ID=SeqID_12578; Location=1345..1656; Strand=+
  SCN-specific regions: Sequence locations=1-2,90-151,181-312
atgaaggaaaaagaggaggaggagaagaaaagaagagagggaaaagaaaaagagacggaaaagaagaaggaagagatgaagcagaaggacgagacggaaaccaaacgaagcctcagcgtcggaacaacgaaagacgatgaaatctcgattgtggattctgaagaaagagaaagagatgccttcgaatacccgccgaaaccgacaaacgagcgaatggcattttgggagtcgactttgaacaatgaggcaaaaaaggatttgcgagaggacaaagagaaagccttaaaaacacaggccaagctattgtcgtaa

SEQ ID NO: 76242 - DNA, 285 bp, Heterodera glycines
  Genomic contig location: Contig_ID=SeqID_12579; Location=747..1031; Strand=+
  SCN-specific regions: Sequence locations=1-285
gcttttgcttcttcacccgtcaattttattgtcgtcatttcgtttccgttgcattttgctttctccgttgtgccattcgatctgatcaatgaatttactcgtgaacaattggcattgaaaataattgacaataaccgccgttttctgctgatccgttgtccaattgcgcgagacgaaagcaaatggacaaaatgggaagaggaagcgattggctggcgaatttataaccagtggagcagtattgagattcgaatttatgatgaggatgaaatcggagacgggtaa

SEQ ID NO: 76243 - DNA, 751 bp, Heterodera glycines
  Genomic contig location: Contig_ID=SeqID_12580; Location=933..1683; Strand=+
  SCN-specific regions: Sequence locations=1-162,184-226,270-512,534-751
atggaaccggcaaaggccccgtgggatggccgttcggagtgcactcggcggaggtggcaacggtaagcaaaaaaacaatgaaatttttcaaaaattcccttaaaatttttcaaaccattttttcttgaaattttctttgtacaaaaagttttagagggattcaacttaatattttgcatatgatgattgagtctgtttttcacaaaaattttcctaaaatttgctgaaaaaattttcaaaaatattcttgtaaaaaatttattttttttcttgaaaaattctaagtttttttggggggagggaagaattaagaaattccatcatctcaacattttgtacatttgcagcctttccgcgtcgggccggcaagccgtacgagcgcgagcgtgggcgcaccggcgctgccgcgtcatcgtcgtcgagttggcgccgtcggtccgagtcgccgtcgccagtgattgacacgagtccgttcccgagcgccgccaccaccaacggcactcttcgacgggtaaaaaaaattttttttttttgatacgacaaatacacaaacagaggcccgtagaagaccaggatttcggccctggcgatgacttttttctttttttgcagcgatttttataaattggtgtgtaacctatataggcgccgcttgggaaaaatagaaatttttaccattttttaaaaaccatgaaattaattatttgtacagtaccgaatatgcagcgtaaaaatattaatttgtttgaaa

SEQ ID NO: 76244 - DNA, 1172 bp, Heterodera glycines
  Genomic contig location: Contig_ID=SeqID_12580; Location=2031..3202; Strand=-
  SCN-specific regions: Sequence locations=1-29,151-253,287-730,882 -926,950-1072,1094-1146,1169-1172
atgagaccgatcaagacacttacaaaatcagagagaaaagaagagactgatcgagaaagagagaatgccaaaagacagcgagaaatagaccgagcgagcgagagagataattgtaagctaagagaaaggagactgacagagaaagagagactgccatgaaaacttaaaaaaatggaaacacaaaaaaattttctcgaaccaattcatttttcagaaagtcggaagtctcgcgcacaaccctaacataaaatcaaataataataataatataataataataataatagtgtctgttgcgggagggtggagagatgagaggggaatgaagaaatagtactccgtttgaacaaagcaaatgatgcaaaacaaaaacaacaaaaaaaaagtgtcaaattttgtaaaatgaaatcgatgcactcggcacgtgtgccattcattggtgctacacacacacacaaaggctcatcattcattccccacgcagtgccaatgccctcctctctatccgtgtgcacaaaatccgtattcagcgccgcagatcatccatcacacatcagtagaggcggtacgagccgtacagcgagcgaccaccgccgccctgctcacgacaataattgtttttttattttgtgcaaaatgatgatgaagtgtatgggtggtggcagaagtgccattccaaaaattggacagttccgtccccctttggcataacaatcaatggcaaattgggtaaaaaatcataaaaaaactttaaaattatataaaaaaatagaaaattattttatatttttttgttgcaatttttcaaaaatatttttaaaagaaatttataaaattttaaaaaaatttgaatttttataacaaaattttttacaataaatgcattacggcactgacccatgccatttttgtctcggtcctctccgtaaaaataaatttttaaaattttcagatttttgccgggtttgggtggacggagctccagggaaaaatgcatccaacaaataatagaacagcaaaacaaacaattggcgaaacagggatgaattagcaattagaatttcaaaccaattttgacatgaaaatgccatcattcaaaaaagtcagtattcagtcatccctgggtcgcacttggcataatacaaaatgaaaaacagcaaacaaacaataaa

SEQ ID NO: 76245 - DNA, 1750 bp, Heterodera glycines
  Genomic contig location: Contig_ID=SeqID_12581; Location=536..2285; Strand=-
  SCN-specific regions: Sequence locations=1-77,100-231,253-366,388 -502,524-1029,1053-1321,1383-1414,1443-1494,1528-1568,1590-1659,1713 -1750
  Gene Ontology: Mol. function=general RNA polymerase II transcription factor activity; Cellular component=transcription factor TFIID complex; Biological process=transcription initiation from Pol II promoter
atgcaaaaaccgataatcgtaaatataattgctctcgctaatctcggtaccggaattaaactaaactctctgacgatcaccgaatgcgaatttaagtataaccctagaaaattcaatgccgcggttatcaaatgtacaactcctatcaacgccacggcattattatgggaatccggaaaaatgatatgtctggggacgaaaagtctgatagactgtgaaaatgctattaaaaaatttatagaaataattaagggctcggggtgtccgggggcttcttacaccggacacacggttgaaaatattgtttcgacctttaaattcggacatgaaattgaactgaacgagtttcgaaaaaatcgtcgtgccttttatgaacccgaaatattttgcggtttaaatttcaagcggggtaaaagcaggacagcgttaattttctggaccggtaaagtcgtaattacgggaacaaaaaacaattctgaaattgatgaaatgtatcattatattcttccctatctgaaaatggctcaaaagaatttaaagagacgataaaatttttttcatttattgggacggtccctcaatttgtggtcctgttgtgtatttttttattaatttcgctggcgggcaggtgcccgtggggcagggggttggtggggcgggggtctgagtgctcgtttcaaagttcgctggcgggcaggtgcccgtggggcaggggggttggtggggcgggggggtctgagtgctcatttcaaagctcgctggcgggcaggtgccatcgatagggaggatagtgctagtgtaattatcgattatttttatcgattaatttgcgcggcgatgcatcgcggcgcatcggcagggagtgagtggaaatgaaaaaacctcacgattttggctaattttcaaaaagaatttttaatttcaggatcaaaaaatcatcataaaaaaatttcaggattgagaaaataaaacgctaaaaggttttgaaaacaaaagattaaaatttgcaaaagttaaattgaatttcctccacctgtcactttggtgacaggtggatgattgatgaccttcccgcggcgctgcgcggcggtgaaaaaaaaagcacccgcaacaatttgggaaatcggatttggtcaggcggctacatcaaagtggtccaataggttttggaatcaaaggaatgcgcatccatcccttaggatttggttcttggcggtaaatgtccacggcggctacttcaaagggctgcgcccacgggctcgtgcgggaaacacccgcaaccaacccgcaacctttaggggtcatatactacttacatttcaatttatcatttatataactaaaatattttaaatgattaaaataatattaatttatttatagattctgcacgcgaattaacaccatttttttcaataaaccacattttctttatccattttctatcaagatcacatgaactttactatttccttaatttgtatcgcgtaaatcttataaaagatttaaataatattaattttttaagattctacaccgcgtctgaaaccttcaaatctgtaagtaaaatattttccacaaagtgctaatttttccgtttctgttgaatccattatcaaatgatttttttatcagagcattaataaatttcgatttatcatttatataaataaaatatttttaatgattaaaataatattaatttatttatagattctgaacgcgaattaacaccatttttttcaataaa

SEQ ID NO: 76246 - DNA, 919 bp, Heterodera glycines
  Genomic contig location: Contig_ID=SeqID_12583; Location=1478..2396; Strand=+
  SCN-specific regions: Sequence locations=1-188,210-870,917-919
atgggcgtacgacaaaagcaacggtactcacctagccttaccaaccccggtgaactttttctgaaccgcgacgatccattcgaaattgtcaccgccgagttgctccacgctcaaatggccgagccgaccgtcccactcagccggaagagcaaaattggagctgagaaaattgacagatggcgaattggacgaagcagcagcagaacattggcggaacaatgggacatgggaatgggagagacgagcaaaaacggacggaaaaggcgaaagaatgaggcgaaaggccggcatttctaagcagcagaaaagtgagtaaacatatggaaatggaaaaagtattgaaaggtttggtcaaacaatgaaagaaagaaaaacaaacattataaaaaatgcatttaaaagtgatagtaaggaaaagcgagtgattccctgcatcggtttcttcttctgcattagtctcgtccctcttcgcctgtcgtcaaattgcctcgcacatagcatttcgtctgaagccgaaagagaccatcttggcactttttgtactaaataataatctgatcgtctcacaatagtgttagatcagctcacatggaagcgagaaaacccaatgggtattgccaaatggtggactgttttgaagtgtttggagagtgccgagcctcgtgcatagcgagaattgcacaaatggcattcgtagggagtagggttgaaatccttgacagagagagagtcagtcgaacgggaaccgagcaattgcccccccccccgcatcgtaccccaccccgaaaaacaaatttttttttttttgaactttccggaaggttctctttgaaaacctaaaaatattcttttttaagaatttcaatcgaattttccataatattaattttcaaaaaacccaatttttcaaaaaacacaa

SEQ ID NO: 76247 - DNA, 833 bp, Heterodera glycines
  Genomic contig location: Contig_ID=SeqID_12586; Location=877..1709; Strand=-
  SCN-specific regions: Sequence locations=1-251,273-439,461-489,540 -735,768-796,818-833
atgaccgcacacattgtggacaaacacccgcaatatgcggcaaaactgttggccaaacagctcgaatttgacggaggaagctgccatttgcagcaaattgcaaaagtggaggggacggaggagacggaagtgagtggaaagggaaaaagacaaattggaaatggaagaagtgcccacaaaaataagtagctgtacaatctacataaaactgttgcatttttgctaaaatttcggcattttagctgtttaatgcccccaaaaaatccaaaaagtggacccttttgttttgtaagtttttttttgtcataagccgagaaaacatgttcacggagttttcggagcgctaaaaaccaacctgacagctatatcgaccaattccaaatcctttcacaagggtccccctttgggtttttttcgggggccctaaacagcaaaagtgccaaaaaatttttgtttttctcggaatctttgttacaaaagtctggcgattttttagctttgtttaattttaaaaaataatagtgtccaacttcaactacacctaaatgtccaactccggccaacaccgatgcgaatttgacgaccagaacaacgccgacggcaccaacaaattattcgccgtcgacggaattggacagcaacaggcgcatgggaagggacgacgacaaatgggtgacagaaaatggggctggttttgcatgagtttggcagttttcatttttaatgggaagttcgaaaattaaaatagaaaaaaatttataaaaaaacattgggttcaatcaaaaatcagagcccgactaattgttactggtgacattttttggaaaaataaa

SEQ ID NO: 76248 - DNA, 57 bp, Heterodera glycines
  Genomic contig location: Contig_ID=SeqID_12587; Location=888..944; Strand=+
  SCN-specific regions: Sequence locations=1-17,40-57
agcaattacaacatggaaaaaacagtttggcattagtcttaagagaataacggaaaa

SEQ ID NO: 76249 - DNA, 750 bp, Heterodera glycines
  Genomic contig location: Contig_ID=SeqID_12588; Location=84..833; Strand=+
  SCN-specific regions: Sequence locations=1-11,33-78,100-498,520 -725,747-750
atgaaattctgtattttattatttttatttttgattgccctaattattccaattgaatcagaaaagaaaaaacttcagcagaaatcatttgatgaaatatttggagaaaaatggcaagaaaaagaagaagaaaggcgaaatgaactcaaaaaaagagaaataattgcaaaattttataaaataaaagagaaaatcaagcaaaaaggaagaaaatactcaacaaaagaatggagtaaaataaacacgaaaatagcgaagagtttggggacaaatcgaaacaaaatttataaatggattaaagaaattggactttataaatatcacaaatcaaaaactgatgaacaaaaacgcgaaattgtgcaaaaattcattgtaatgaaaaatgaatttaaacaaaacagaaaatattcgcaaaaagaatgggagaaaaattatgccgaaatttgtaagaaaattggagtaggccgtgaaacacttagaaaatggaagaaacaatttggaatgaataaatttataacgaagaaagaaaaaatggaaaaaatgaaaaaatattggcaaacaaaaaaagaaaatccgaaaatgagtgaaagggaaattgcaaaaacattacaaattgatagaaagagcatttcaagatggaagaaccaatttggagaagaaatttgaagtattaaaaacagaagaaaaatgggataaatttgccggaaaaactatcacaaaaacaaaggaaaaatatacatttaattcata

SEQ ID NO: 76250 - DNA, 417 bp, Heterodera glycines
  Genomic contig location: Contig_ID=SeqID_12589; Location=538..954; Strand=+
  SCN-specific regions: Sequence locations=1-74,109-211,233-300,322-417
atgcttataaaaggtttttgatgagtaaggaggacccagcacccgcctatcggcacctccgcatttattacaccataaatatttttaatttaaaatttagtaatttttcaatcagaatttggcctcctatttttcgcaggtatcgcgtatttcttattttgttcgtccataataattaatttaccacaacccatcaatcgtataattcaataagagagaaaaaataaataaaatttccgggcatggcattcttccaaaagtctcaaatcaaaaattctgccaatctttcagctctaacagccacaaagacgcaggacacagtggatcgtggacttatctccgattttgtaatccttcaaagtacggccgtcctcaatctgctttcctgaaacaattttcatattagcaagagaaaaa

SEQ ID NO: 76251 - DNA, 1074 bp, Heterodera glycines
  Genomic contig location: Contig_ID=SeqID_12590; Location=47..1120; Strand=+
  SCN-specific regions: Sequence locations=1-193,236-240,262-433,455 -494,516-550,572-605,627-1019,1041-1074
atggccttcaatgcgctcgattttggctttgatttcctcgatggtattgcttggaagggcatcacggagtgtgagtgttttgccggtcatcgtttttacaaagatttgcattctatgccaattctgtgcatggaagagggaaaatgtaataaaaataatcgttagggttgggaattatatttaagaaaaatcgcaaaatatacatatacatacataaaatatgtaaaaaattcttaaaaggattattttttggggaaaaaatcatagagaagagtgaaataggcacaaatgccataaaacgaccaaaaggcttaaaatcacattttaatacttgaataattatttttttgatatctcattttttaaaacgattttttaggggtacattttcaaaaaaaattgaatttttctcgagaaattcctataaattttcgttatgttaaaatgaaaatatgtatgaaaaatacgataagtccacaatatgtagaaaacagaaaatatttattaaataaaatcccaacttttgttcgcaaacacaaaaaagaaagcgtttttcctactaattatagcattgataatataagtatttaaatgaaatccatcccaaataaaattattataaaaatccacccaccatactgctggtcaaaattttttttacgaaactcacataatacgtataagagctaaaaacaaaagtcctattcgtgttcagcgcataaaattacagtaccttagaatatttaaaatttattcaggggctcacaaaaggaataagtacccattttctatcttttcgtccataaaaaatcaatttaccaaccaatcaatcgactcaaaaggaaaatggaatgaatcgaagaaaaacaggagagaagacatagtcaaatatcgggcatggcatttcttccaaatttctcaaatcaaaaattctgccaatctttcggcactaacagccgcaaaaacgcaggacgacaaggtgaaagatgtccccatctctgatgttgtaatacttcaaagtacggccgtcctcaagtagccttcctgaaacaattttcatataaaaagcgcaaa

SEQ ID NO: 76252 - DNA, 1531 bp, Heterodera glycines
  Genomic contig location: Contig_ID=SeqID_12590; Location=1..1531; Strand=-
  SCN-specific regions: Sequence locations=1-343,378-387,415-445,467 -859,881-914,936-970,992-1031,1053-1224,1246-1531
atgcaaatccgtataaaaacattgaccggcaaaacactcacactccgtgatgttcttccaagtaacaccatcgaggaaatcaaagccaaaatcgagcgcattggaggccatccgcggggggagcaaatactgattttcggtgggcagtataggttttaagcagtgtttatttattactgaatgaggacgagtgccaagttatggatgcgtgccaaaggctcagctaattgttgtcggaatgctccaccacccacaaaagtccttccaaaactccaccgggtgaagtgacgaaagatttcttgctgttataatttttaatcggatcatatgcaggctttttaaacttcgattaaatttaaaaaatacagtaaaattttcgctcgcaactttttaaaaatataaattatttattttgcgctttttatatgaaaattgtttcaggaaggctacttgaggacggccgtactttgaagtattacaacatcagagatggggacatctttcaccttgtcgtcctgcgtttttgcggctgttagtgccgaaagattggcagaatttttgatttgagaaatttggaagaaatgccatgcccgatatttgactatgtcttctctcctgtttttcttcgattcattccattttccttttgagtcgattgattggttggtaaattgattttttatggacgaaaagatagaaaatgggtacttattccttttgtgagcccctgaataaattttaaatattctaaggtactgtaattttatgcgctgaacacgaataggacttttgtttttagctcttatacgtattatgtgagtttcgtaaaaaaaattttgaccagcagtatggtgggtggatttttataataattttatttgggatggatttcatttaaatacttatattatcaatgctataattagtaggaaaaacgctttcttttttgtgtttgcgaacaaaagttgggattttatttaataaatattttctgttttctacatattgtggacttatcgtatttttcatacatattttcattttaacataacgaaaatttataggaatttctcgagaaaaattcaattttttttgaaaatgtacccctaaaaaatcgttttaaaaaatgagatatcaaaaaaataattattcaagtattaaaatgtgattttaagccttttggtcgttttatggcatttgtgcctatttcactcttctctatgattttttccccaaaaaataatccttttaagaattttttacatattttatgtatgtatatgtatattttgcgatttttcttaaatataattcccaaccctaacgattatttttattacattttccctcttccatgcacagaattggcatagaatgcaaatctttgtaaaaacgatgaccggcaaaacactcacactccgtgatgcccttccaagcaataccatcgaggaaatcaaagccaaaatcgagcgcattgaaggccatccgcctgatcagcaaagactgcttttcgctggttgactaatttttt

SEQ ID NO: 76253 - DNA, 1877 bp, Heterodera glycines
  Genomic contig location: Contig_ID=SeqID_12591; Location=735..2611; Strand=-
  SCN-specific regions: Sequence locations=1-173,200-358,380-522,551 -763,786-886,908-945,967-979,1001-1365,1591-1750,1784-1877
atggaaatgcgcgagcaagtgcacaagaagatcatggaagagttcaatgccgaaacgggcaaaggcaatgccgatttctacctgcaaaaaatggaggcacaacgccaacacaacaagtcagttttagctttctttgtcaatcaacaatgttaattataatgaaagattttctgtttccctttttcatgtttattatttcttcgcctaataaaatttataaagttattttgttcaaaactgatgagggttctttaaatgcgtttttttgtttttgttttataaaaattgccgttattttgttcgactttctatgaaaatttactgcccgacaagggtgtatgtaagttgctgcgcgacatttttaaaattctccagccaaccccgaaaaatttttcggcgaatttcctctccgatccccgacttttctctcccggaggttatgggagcaacactaatctaaacaggtcttttttgctttttatgcctctacccattttctaaacaaatttttctgttcgcttcatattaactaatttttaattattattttcttaaaagattattcagacgaaagattttttcaatcaaatgctttttccagtgagaacagtcaaccggagccgtggagggacatgccgaacagcacacagttcctggcccaactcttcgagaaggacgccaaggatggactgccgttctccctggatttgctgctgtacaagccaagcgtggaggtccgccaagtgctggtgggcagtgccgacgaagtgccacgcaatgtgccaaagccagcgaaaggcaaagcaacggaagcggcggccttcaaattgccttatgtgagggcgatggaacgcggcaaaacggagccaattctggcggagaggtgaaattataagccaaaataattaaaatctgcgcacaatcggcacaaaatataacatgtttaagttaaaaaatacagtgctgaaaaagccaccgaggaaaaattaacaaatctaacggttttttattgtatatatttcccaacaaaatttttttgtttaagagatgttttaatgggcaaataaatttcctgataattgtgatcagattagaagatgctctgctgagttcaatcacaacaatttcaaaaattctatgaaaaaagcgccaaaaatttttaattttgcgcaatttttcgagttttttataccgtattcatagcttattttttgaattattttagcctcaatgatcagacattggccaagttgcgtgaattggtgaagccaatgatggtggagttgaacaagacggaacaagccaaggcacaccataaggaaccggtgcaggtggtggactgtgcgcaatccccggaaaagttggattaaattaaaaatatttaaattgaattaattttaataaatataaatccttatttccgtaattttaaaggctcaaaaataagtttaattctttattaattgtataaataattcatttaaaaattaaaatatgaattctctttgcttttgtttttaaatttttggtatttaaaaaaaattctgccgcaaaaataaataataaataaatttaataatttttatttaaggtgcaagcaaatgttctttgtcagcgagacggacatgctgaaggccatccatacggcacttttggacgaagtgatttcatcgggcggggacgaaattaacggggaccgattcgccgccctccggaaatttgtggaactgctcattcaggtaatcgtttcaaaaattaaaattttatttataattaataatttgttgttcgtttagcgattcccgaagaaaacatttgaacgaaacccgcaattgagtgcacatcccaaggggacggcactttcatccatcggaaag

SEQ ID NO: 76254 - DNA, 915 bp, Heterodera glycines
  misc_feature (38)..(38): n is a, c, g, or t
  Genomic contig location: Contig_ID=SeqID_12592; Location=332..1246; Strand=-
  SCN-specific regions: Sequence locations=1-869,902-915
atggccctcgtcctcctcccttctgggttgaggattgncatggcaatttgtgccattttgctatgttgttccttaccgaactcaacagaagcggcactggccgaggttggccaacagcccaagggcaacaacccgttgctgtacagtgtcgacgacccaattgttcacttggacgccgacacgtttgaggacactgtgctgcggcccaaccgggaccgggcgtacatcgtcgagttctacaaggactggtccgtccggcatcgtgtgtttgggcataggggcaccgtggagacagaacagaacagtagcagtaacagaaccatcacaccaagaggaagggcacgcgctctgccagaaaaaaaatgggatatgccaaaattgacgattttttccgtggaaatgttataaagggcaggaacccatgagcttacaggtgcactcgtaatagcaaatttcttcaaaatggcctatcttggtggccaatttctaaaatatagagaatttttttatcttattgcttcttatactagggttgggccccaactcgcgctccccgatccccgtgacaatatgccaaaggatatttttcaaaccaagtccggttcttaaggtgcggttactgtcgccgctttgcgccctatttcaaagtgctttccgaatccatcaaatcgtggccatttgtccaagtggcggccattaactgcgccgacgcatacaatgtgaaaatttgcaaggccaacgacattcctacggtgccgaaattgaaggtacagtggaatatagtacttgctacgaaacgcctttcgttttttcccaatctgagtgcctaaatcgtggtgagaggaagtttacaaaaatatcaataacagaaatatttaaattttattattattttaattttgtttgctaaataaa

SEQ ID NO: 76255 - DNA, 142 bp, Heterodera glycines
  Genomic contig location: Contig_ID=SeqID_12595; Location=436..577; Strand=-
  SCN-specific regions: Sequence locations=1-142
atgcttctgatcagatcagtcaatccgcaatctctgctctctcttctgtccttccgcctttgtcgtccatcagtcgcttcgctcactttcatccaccgattctccaaatgggcggcgactaaatcacccccgaggggaggaa

SEQ ID NO: 76256 - DNA, 2844 bp, Heterodera glycines; identical to SEQ ID NO: 12596
  Genomic contig location: Contig_ID=SeqID_12596; Location=1..2844; Strand=+
  SCN-specific regions: Sequence locations=1-357,389-407,430-551,573 -861,901-1125,1147-1975,1997-2320,2344-2564,2586-2844

SEQ ID NO: 76257 - DNA, 2655 bp, Heterodera glycines
  Genomic contig location: Contig_ID=SeqID_1835; Location=2371..5025; Strand=-
  SCN-specific regions: Sequence locations=1-506,530-706,728-996,1018 -1589,1611-1619,1641-1722,1746-1792,1814-2064,2086-2550,2572-2655
attcttcatgatttacattcgatcgcttcatttggatctgcaaattctggctcctttcgaaaacgcaacgtgcgcgtgggtgataatctttgcatggattggtggcttgtgccagacacgatgaatggtcaaggatatcctagacgcgttgaaaagcggcgacaacaccgaggagtcgttcacgcgcaaggcgatcaaatttcaccttcgttttgtgagttaaaccataaaaaaaataatttacacaaatatgtaaaatttggctttttgagcaaaagtgattcttaattctctaattggtagattttaaaaaatcctgcattaattccatcatcccaaataggagttcgtcagaataccgatttgttttttaggcattggccaattcaaaataattttcaagcaattacttaggtttgaatatcgcccaaaaatgtttcttttcaccattcaaaaaattaatataccttagcagaattgtaaaaaaattcttttcttttagctcgatgtccatcccttctgggatgcaaagacaaaaattcggcggacccaccgacccatcattaaacacacactaattgattctaattgatcggtcaattaacaaatacaatattttttccgcattttttgtgtgcgtccatccattttcttctcgatttccgtgtttccatctgttgtctcttcccagccaattatttttcacttcccttctctttcttccctgcgtcatctatcactctcttctcgcatttttttattttttgatcatataatttttgtgcgaggtaaagaataaaaatcaagtcttaggaccgtcgctgtctcgcagataaattcaaataaaatcgaatatacacattaaaaaatattccacaaaaaacagacttccattcgaatccagaaacccattttttctcgtcctgaatcccgaactatttttttatggcccaaagtcacaaaattcaattttgtcagcaaacaaactgaaagagaaggagaagaatcagcacacaccattcgccgagacataatattgccaaaaatttttaaaactgatattttaaggaaattctctaaaaaaatttttcaataatttttttcttgaaaattttcttttgtaatttctcaggcgttattttggcgcccctacaaagtgtccaagcctcgaaatgtccataagggtaaaaatacgaaatgtccaaaagtctaaaatgcacataaaaaccaggaaaacggatctaatttagggtttttggagtcgctgagtacgaatatgacatttacattgccccttgtctatcccttgatccacccgaacatgaaataagttcaagaattattttaaatgtgtgttgtactgacgactttagatttttctattcatttggaccaaatgattcgtaataagcttgaaagtcaacaaaaaaagtcggaagaagcgttatatttcagacatttcaaacacaaatgaggatgccgtgaatttggaagtggaacttggcgaaccgaatgccgtgataactttcgacaacgctgaacaacagactttgaacgaggctgaagtctcagtaatgacctttgagcgcggaaaaacaaattttgggggacattgcctatggttgaatggtacgtttgaagcgacgcaaaaaaataaactccaaatgttcaggatttcgttacacacaccactcaggggaccgttggagatgcacaattcgtagttgctcagcatgtgcaaacatcacaaacaatgacgaaattggagctactggaaccttgggtcaaaaagaacacaaccacccccagcgcctcagaaacaacaagtttgtttaaatttaaaaccaaataattaatgctgtgttaaaggcggaatcaaggcgacagaaaatcaaagaaagtgtcctggccgagccgtgtctgaagaccacgcgacttttagcaaaagtgaggcgatcagcaacagatgaagcatttgtggccatgagttcaaacaatgcgttgacccaaatgatgcggcgtgagaagagaaagttgctgggaaacgtcgacgtgcagaacccactggcctttgtcatcccagcaacgttacgcgaaaagggcggtgaggacatcgtcttgtatgacagtcgcaatgtcaggcaaggcgaaaaggacgttgtccttattttcggcagtgttaaggtacattttttggctataaaattctgtttttattggcattcctttagactctggacattttgcgccaatgtggcacgtggcacctcgacggaactttcaaatgcgctccagcgatgtgggagcagttcttcgtcattggtgcgtcagtgaatcagaaaatgtgcatctgtatgtggtgtcttctgcctgggaaacagcgacgctactacgaagaagcactgaactttctccgtgaacgcatctctccggaggtcccaagcaaaggtcaaccctttgaaatttacaaaaaaaacaaatcaaaaatgtgatttttagttttgtatgactttgaaaaggccgaatgtttgtttaaatttatgcatttggtttccaaaaatttaaatttttagctgcactcgggacaacaatttcgaccatcaactcggaacatagctatgcggcttctcccatttttattgacggcatttacat

SEQ ID NO: 76258 - DNA, 351 bp, Heterodera glycines
  misc_feature (328)..(328): n is a, c, g, or t
  Genomic contig location: Contig_ID=SeqID_1836; Location=33..383; Strand=-
  SCN-specific regions: Sequence locations=1-12,49-351
atgaatcagtggatattattctttttaattgtattatttttaattattcaaattgaaattggagcggaaaagaaaaagtttgagcaaaaaacatttgacgaaatatttggagaaaaatgggaagaaaaagaaaatgaacagaaaaagagagaaattattcacaaattctataaaattaaggagaaaatcaaacaaaaagagagaaaatattcagcaaaagtatggagtaaaattaattcgaaaatagcgaaaaaattgggcacaaatcgccaatacatttacaaatggatcaaagaattaggaatatacaaatggcacaacaaatcanaaacggatgaaacaaaaatttaa

SEQ ID NO: 76259 - DNA, 708 bp, Heterodera glycines
  Genomic contig location: Contig_ID=SeqID_12597; Location=435..1142; Strand=-
  SCN-specific regions: Sequence locations=1-119,148-320,343-708
  Gene Ontology: Mol. function=electron transporter activity; Cellular component=cytosol; Biological process=pyruvate metabolism
atggaatccttcaacgaacgtccgatcattttcgcactgtccaacccaaccagcaaatccgagtgcactgctcaggcggcgtacaaaggcacaaatgtccgttattttgggggatttacaataattttatttttcttttgctattttcgccattataaatatgttccctaattataattttggtttatttcgttttaaatttaacttaagggctccgctcttttcgcctccggcagtcccttcgcccctgtgaaattcgacgacgggcgcactttttcgcccggccaatgcaacaattcgtacattttccctggcgtcgctctcggcataattttgttccaaattgctcacattcccgacaaattgtttttgatcgctgctgtggttggcactttcttttcttttttgaatatttgtccctttttaatcattttcagcaattggctgaattcgtcactgatgatgagctctcttctggcaatttgttcccctcaatgaataaaatctgtgaaatttccattcaaattgctgtcgcaattgctgaggagtgttacaaagtgacatttgtttgaataataatagataattaattattgttatccaattaaggatggattggcccggctttaccccgagccggcggacaaagaactgtttgtccgttcccaagtttacagcacagactatgaggagctgataccgaaaatg

SEQ ID NO: 76260 - DNA, 2107 bp, Heterodera glycines
  Genomic contig location: Contig_ID=SeqID_12598; Location=66..2172; Strand=-
  SCN-specific regions: Sequence locations=1-479,501-1065,1088 -1285,1315-1320,1355-1411,1433-1476,1505-2107
  Gene Ontology: Mol. function=electron transporter activity; Cellular component=cytosol; Biological process=malate metabolism
atggagcgtagtgagccgaaacagcaacaaatttcgttgcgggaattgtacaaaacggagccaagcggaccaaacgcgggaaaaggacattcgcagctgaaggacaatcggacgaacaaagtcagtggcttttaaaggatatcagatgagaaactctgaaagttattggggtttaaaacttggaaatgctattttttgctttaattttacgaagaaaaatgcaaatacaaagtaaaaagccttcatattttttggttccagaaattttagaattatgaaaaaataacaaattgtaaatatcaaatttgaagggacttgctcattcgatggcggaacgccaattgttcggattggacggacttatgccgcaaggagtgaagtaataaaaagctaaaaagtcgtttgtcccaaatcaaaaacaattaattaatgggcgattaattaattaattagtggcaatttgtgcgattcagaagccaagaacagcaggcgcagcaggagatcaaacatttgcgggaactgaacaacgaaatggcaaaattcattcacttggaaggccttcgggtgaccgaccattagcaaattaattaacgaaagtaattaattaattgcccaaattgatttggaaaggagcggaatgagaagcttttcttccgcgtgatgaggcagtttcttggcgaactgttgcccattgtgtatacggtagaaatcataccgtaatactggttgtgaactgtttgtttgtttccatttcagcccactgttggcgatgcgtgcattcattttgagtaccgacacccaaagtaagcagcagtcccccaaattaattgtcccccatttgcgactcatttgcccaattaatcccaattaaagggcccttttcctcaacatcaattggcataattctgtcagtgaaatctgtcgcgtgctcagcaattggaaatgccaagtgagtcgaagcaaatgaatgactaatctggatttaaatgtcttcggtctttaggatgtgcgtgcgattgtcgtcactgacggagagagaattttgggattgggcgacttgggagttgggggtaaaaatagactaattattctggggggtaaaaaaaggacaaattattctaatttatttgggattggggggtaagttcataatcagcagaagaatacgaaatccacgaattctttttttacattttttagttaaatttccattaattaatgaattttaatcattttctttcattttgtgccgctcaaaatgcccacgggcaaaggacccaaaaacaaattaaatataaaaaagaaaataatattccaatagtatcttatgttgtttttggtcatttaaagtgtttccctcggttttctttgggtttttatcctttttatatttaattttgtgttatttgtctgtgggtcttttgtctctgtgatcctttgtcggtgcgtcttttgtcatgcaccttccaattgtccattttattacctgttttttaaattaatttaatacgtcttttttcttctatcaataagttaaaaagttcccacaaaattaactttttaatttatcatttttaaggtgttgaaatctccgtcggcaaattgtcgctttacgtggcgctcggcggcgttcagcccaagtggtgcctgcccattcagttggacgtcggcacggacaacgaaacgttgctgaacgacgccaactacgcgggactgagacagcggcgagtgcgcggcgaacaatacgaccaattcatcgacaatttcatggtggcatgttgcaaaaagtgtggtgcacagcccaaacccccccccccccaaaaaagtgtcaaattttgacttttttgaggttcggccacaaaatattggtccaatttgaggactttggcaagaacaatgccgaccgattgctgaagcgttaccaggacagatactgcaccttcaacgacgacattcaggtgctcggcaagcattgccaaagtgccaaaagtgtgccaattaattgcagggcaccgcttccgtttcggtggccggtcttttggcggcggtgcgaattacgggcaggaaaatttcggagtcgaagttccttttccacggtgccgggacg

SEQ ID NO: 76261 - DNA, 941 bp, Heterodera glycines
  Genomic contig location: Contig_ID=SeqID_12599; Location=1619..2559; Strand=+
  SCN-specific regions: Sequence locations=1-148,175-337,359-875,933-941
atgcgactgaatgtactgctcgcaatcctcgcccccctcctcctgctaattgcaacagcaacgctttgtggtgccaccggcaaagaagcggcggccaacaaaatcggtgtcgccgccgtcgctttgtcagaggcggacaattcgacgacgccggcgccaccgccgccgccttcgccgggtggcagcgatgacaagaaaaaggacgatgacgataagaagccggacgaggatccggcaaaaaagggcaacggaacggacacgggcgacgacggcaaaaaaacggacgaagcgggcggagcatttggcgcggggtccatttttggtgagtgattatttttggatgaattggccagaaatgtggggtcgcgaagcaagtcgaatttattcaactcgccccttttcctaagtgattgtgcggtttagggtcgctcgagactgaattttctcgacactaaaacgaagctttctcgactctatcccaatgagccaaaatttgttcagtgattagtaatatcaataaaaatcctctccaactatacatcaattggtgttaggctatgcggttaagggccgctcgagaccgaatgctcgacactaaaaacccgagactttctcgacccgatcccgagacgcccctctaccccaacgaaccaaaatttgattatatttgatcagtgattagtaataaagtcctctccaattacacctaatcaaatctgattaattgaattagcaatttaactttttagttgccattcttttcggcatggctttgatgttcggactgatcaaaatgtatgtccattgggagaagcggcgcgagtcggacccaccgaactatcagatgtattgaaaaaacatggaaagcattgggccaaaacaaacaaagatttccttatttcatttgttgttgttttttgcatcatttttatcacttctca

SEQ ID NO: 76262 - DNA, 1236 bp, Heterodera glycines
  Genomic contig location: Contig_ID=SeqID_12600; Location=413..1648; Strand=+
  SCN-specific regions: Sequence locations=1-70,94-837,860-868,890-1236
atggccaactttggcacagaaaatgccaaacatttcacagcgatcaaagaacagacaaagcaaatttgtgccactgaaaaaacacaaaaatttgacattcaaaaattaacgaatgcaataacagccgcttttgaaaaagaaggggcaaaattggtggaggccatgaaaaaaggagagcatacggtaacagtgaccgtcgacggggcatacggtactttgaccgaacttttgccaaaatcaatggaattccggccttattggaccggaataaacatgctatgcttgatgaatgaacagatggataatgggccgggcaaaaaagtgatcgcaaaatttttaaacgcgactacagtaaccggtgacggaagtgccatcgccaacactgtaatgcctagcgatttgatgaaaattatgatagaactatggcacattctcttccataacgtcacgggaatgggcaaaatcggtgggccaaaatttttgaatcaatcatttggccaaggcgcaaagagtgatcggcaggaaattccgaaacgacggaactctgatcagatcatcgttcacgggcagcaggtaaattcgggacaatgcaattcagttaactatatgtgttcatctacggtattgttcagtttggtcgtgccatccccgcaatcagtggccatccgttgcgtcgccgtcggcgacggaatttgaatattacggcacgacaaatggccaacttgttccacgcgctgactgttgtagtcttggcgctgaatttgctgcgagtagtgctccgaaatatggccgatcagttggatcagccgccgattttcatgatggtcgccctggccgcaacaattcgctatttcatgacgatggactgaatgatcttattattgacatccacccttcagtttgatcggatttttctttctttgattgggatcggaatggttcgggtattgataaaaaagggaaattctcgatttagcaatttgccctggtcataaaagaattataagtgatcaaaattgggtcccgaggtttgattgaaaagtgctgggttggtggttagacaggcacaacaaatttgccattttcggtctcggctttctaaatatttctcgagtctaaatttcgcggcaagttccggtctcgagtttcaattgatggtatttgttgatttcgagcagtagcacataacattttcctctgttaaattgttttgtactagtcagtcgagaatttata

SEQ ID NO: 76263 - DNA, 601 bp, Heterodera glycines
  Genomic contig location: Contig_ID=SeqID_12600; Location=1933..2533; Strand=+
  SCN-specific regions: Sequence locations=1-117,139-302,324-422,445-601
atgatggacaacccaccgccaccgtttcgaaaccgtaccccaccggtgagattcaacaatagcggcgcgtcattcgtgcaggaatacgatagtgccaatagagaaaagatgaaggacgaggagaagggaaagggaaagagtacggcacaaaaggcggaggagagaacggcacggccgaagaagcataatggacaagacgatgatgttaatgaggggaccatggccaaaatttggaaaatattcgcaccaaaacagcagttgaagaagcgagaagaaacagtgccaacccatgacaaagtcccaaaaaatgacaacagcagcaaaagtgttgttgacgacaacaatgtgccaatgccaattgattgtgccaactgcgccattcgcctcggaggaaattgaagacaatgttttgtaggtagaggagaagcaatttgaaattttggcacaaattgcaaattagcaaaaaatgatgcaaaacttgtgaatggaatagggaagggaccttacatcagcacacaaatgtttccttttgaatttgtaataccgtaaaagcgtaatcctttccttttcttggatactgtattagtctaaaattttgtca

SEQ ID NO: 76264 - DNA, 352 bp, Heterodera glycines
  misc_feature (25)..(25): n is a, c, g, or t
  Genomic contig location: Contig_ID=SeqID_12601; Location=125..476; Strand=+
  SCN-specific regions: Sequence locations=1-74,96-215,255-352
atgcgaaagcacacgtcggatttgngggtagccattaagaaatgtggaaacacttcggtggctgtttggttaaatagggaaaataaatatttttgctgggacataacaaattcagagaatgcgactttttacttttaaatttttcagcgtctcgaacaaagccggcaagaagacgatgacttccagcaacagctgagttcggttcgtagtgtacgaaaagcctttcaaagtttcaaataaataaaaatgttcaggtgctcagccgagtagattctgtgaggagcaaaaaaacggaaccgaaagtgaaattggagggcgatcagctttcatcgaattgagtgatacgccttaa

SEQ ID NO: 76265 - DNA, 1680 bp, Heterodera glycines
  Genomic contig location: Contig_ID=SeqID_12601; Location=933..2612; Strand=-
  SCN-specific regions: Sequence locations=1-319,341-1082,1108 -1627,1649-1680
  Gene Ontology: Biological process=neurogenesis
atgctaatccaattcaaagcgcgcgcttgtgccaaagatgacgacgaatggacagcattggaatatttgaacgagtttttgatgaacaccaaagggatggacaagcagcaggaggaaaagctgcggaaatttggcgacttaataaggcaccgacaagccgaaggtgagaacaaacggacgattaattaatggcaaaatattcccaagagggactctcttctcggacctttgaggatttccttgaacttctccagcaaaagaaggcgtcgcagcggaaaagcagcaaaacttctcagaacagtttcacttccgaatcaaatgggcagctgagaaggaaaagacggataagcgaagactccgaaaatgggaattattcgaaaagccaattgggcaaagagaacagaaacgcatggataagtgacgaggaagacgagcgtggggaagaagcggacagcgaagagacgcgaaatctgaaggattaccgccgctgcatcgtcggactaatgcgaaagggaaacggacaaccggcggagggcgagggcggaagtccgttgcgcactccgaaaacgccgccgcttctgtttaagcgcaaagaaatggcccctgcctcgaagagggcgttttcaacgaagcggttgtttttcaaatgattttcacaacgatttgtttacattttttattgtttttacgtctttttatctttggaatttaaatagccttgcatttataaggattaatttattaaagaaatacattcatcgaactcataaatgcgattccattcttctgatgtctttcgttgaagctgaaccgaatgcggacgacccgcattttttgtgggaggaattgtattcgaaggaaagggtctgccgaccagcgaaaacgctaccgtaattttgaatacgatagacgaattcagcgttttttaggttagatgagccgatatactcgaacaaggttcgtttcgtctgtataagtgacacacacaacaaattgggtgaaattctgtcgttgattccttatggcgatgtgagcatttaaacttaccccttttggttcttatcccttctcttgctaccatttttggttggtttttgttaggttttgctgcactgcggcgatttcaccaattttggagatggcgaggaattggaacagttcaactccgacattggttcactaccgcacaagtacaaaattgtcatcgctgggaaccacgagttgggttttgaggatggggaggacgtggaagggcgtcgggcggacgctttgatgtgggcgatgggctcgggtcgacgcggaacgccccggggctacgagcggtaggaggaaaagccagcggaagagaactcgaaaaccaaaaggttcagcctcaccaattgcatttatctacacgactcgtccactgaggtgctccttccgcttgtaccatcagtatcaatttggcctctttttcaggtgttcggtctcaccattttcggcacttcttggcaccctttgcccggcttttcgttctatcgtccacgaggcgttcccatccacaaagaatggatgaaaatcccaacggtacagccgaggccggtggtcgatgttctgatgactcacacccctccactcggtagtcaaatcgaatggcatttgagaaaagcaaacgggaaaaacaaaagtctccacaaatag

SEQ ID NO: 76266 - DNA, 459 bp, Heterodera glycines
  Genomic contig location: Contig_ID=SeqID_12602; Location=36..494; Strand=-
  SCN-specific regions: Sequence locations=1-374,406-459
atgaaattaatttggctgtctcttttcttttatttatgcttcgctacagtgacaagcatattgacacggaaagtttcattcagtaacatacaaaaaatacttgcaccgtaccaaaattcaacgcctccgcccgaaaatgaaaatgccgaaaaagttggccaaaacattgatggcactatgacggttgatcaacaaattgatcaaaagcacacaactaaaactgatgatagcccggcagcaatcaccacaagcaataataacgaagagaatggcggcacaacgattcgtcaaaaaaatgccaccaaaaccagcaatggcattttgccgccaaaaacgccgaaagaaatgagactgattgttggcacaacagtgccacaaaagagccaacaacaacaaccattgaaaggaaatagcagcgcaattagcaaagcgcttacttctccggcgcctaaaaagaaa

SEQ ID NO: 76267 - DNA, 1351 bp, Heterodera glycines
  Genomic contig location: Contig_ID=SeqID_12603; Location=1351..2701; Strand=+
  SCN-specific regions: Sequence locations=1-19,42-206,228-356,379 -428,450-824,851-1044,1066-1174,1196-1218,1241-1249,1272-1351
atgtcttctgcatacagaagcccaacaactgttttgttttgcaaaaaacgatcaagcatttggaaggtggatgaccaacgcacctgataggaaaattgcaacttagtaataattcattcatggttcttttctgctttaatgtcccaacaaattttttcttcaaaatttcgacttttggttcgaattcgggtccgggattcaaaaataggtgaattggctgctatgttcttaaactgacaccattaacaacccttcaaagactttgacatttttgctaaataacaaaaaacttgattatatcggggagaattaatccggcactgctttgtgagaaaaatttaatttcagtcattatgttaaaataagattaaaacattcgtttcagaaaacatttttttcaaaattcattggtattctcgctaaaaaaattccttcaaaggtcaattcttaggggtgtaataatcggatttcaaggcaaaatccgattacgattatccgattccgattatggcccaaaatccgattaattgcgattccgattacgattacgattccgattcggcacatccctggtgctcagccttctccttttgataatcttcgaaaaggcatttgtgtgatgggcaatcagtggtgcgactcagcaggcaatgattgcgttgtgtgcgaattcgtgtacgatattcacaaaactgttcgtctactttagcaatcctggcaccaaaggtggtgttgctggcacacttatgggatttgaaacggaattttcaaaagtggaaaaaaaagctaaggcaagaatggcatttgataaggcaagttgaaacataaaataaataattaattaattattgatatgcgatcagatcgatgaagacaaggacaaatcaatctcaaagaaggaggctattctgtatctgacctcattgggaaacaaaaaccttacggatcagggcctttccaaagattcgtcgtggtttgatgcaatggacaaaaaccaaaaccaaaaaatcgagccggaagaatttgatcagatactctggcataaatgataaaagaaaaaagtaacgcatccagattatttattcataatggtctttaaatcgtattttctttagaaaaattccaatcaattattatacccaaatatttttagtgaattttataagtaaaccacgcacttttcattatatgagttaatttcgtattatgtccaactacataaatattttttaatttttttgatgatgaaatgctaatgcgtttattaattaaacgcaaaatgaattcatttagtgatgtttgctgattcattcatcaatctatctaaagttatttgatggaaaaacggaga

SEQ ID NO: 76268 - DNA, 143 bp, Heterodera glycines
  Genomic contig location: Contig_ID=SeqID_12603; Location=1003..1145; Strand=-
  SCN-specific regions: Sequence locations=1-143
tcgtaatcggaatcgcaattaatcggattttgggccataatcgtaatcggttttaaaaccgtatcggatttttggccataatcggaatcggcgatttaatcggaatcggattttgtctggctcggcacatccctgatatgtat

SEQ ID NO: 76269 - DNA, 781 bp, Heterodera glycines
  Genomic contig location: Contig_ID=SeqID_12604; Location=1..781; Strand=-
  SCN-specific regions: Sequence locations=34-81,103-136,158-290,312-781
ccggtcccgggttttgaaaagctcaggtcccggcaagtcccggtcccggttttggcaaaaattcccggtcccgtggcactctactgaaaaataataattttaattacaaatccatcattggcttttcagtccgaaatgcttattccttctcccttcagatcagctatggtcactttgctcagttcgctgggcggcggttgcacttccattgtaatttcgttaattgccacccgaaagtgccaaatcgatttgctcatcgacggactgctcgcctcgctagtggccacaacagcaggttgccaactgagcaatagctgataaactagtgcatagtgctaattacctttattctttgcttcagcgtgtcattccatccgtccgttggatagcattgcggtcggctccattggttctgcccttgcattgtccgtctacccgctcattgaacggctcgaaattgacgacccggtgggcgtcatccccgtccacgtgatcggcgccacttggggttagcgatttgggcatctatttacccactgatcacttcggttggacttgaatattttcattggtggtgatcagagtggcttttcgtccatgccattttcgtcgctcggctttccctttctctctgatcgcttcccttaaggtatgctcagtgtcggcattttttcccaggaagacccgtatttgtccagcagaaatgtgagttggcacctttaatcaattgccatgcctgtgagttgcactttctgtgccgaaatgtctgttccttctctct

SEQ ID NO: 76270 - DNA, 980 bp, Heterodera glycines
  Genomic contig location: Contig_ID=SeqID_12606; Location=671..1650; Strand=-
  SCN-specific regions: Sequence locations=1-723,759-841,863-980
atgccgcccctgcatcgttatgaacagtttgtgcaccgcgtcggacgagtcgggcgctcgggaaatgttggcgaggcgtttgtgttcttcaacccggaagacccaaatgacatgtatatggccgaatttttgcgagacgtacgttttttgggaggatagggaaaaatgctttaatacaatcccattttctttggatttgttcagcaactcgtccaagtcaaacagaatgtgcccaaatggttgcacgaattggtggaaacccaacacaaatggcaaaaaaaaaccgatgaaatgttgaccatcgaaaaggaaacaattggcagcaaaaggacgacgcaacacaaagggacaacgacggggagaaggacagacggagcagcaacggtcgggggggacgaaggagtaaactcactgctccatagaatttcctgagggggaactcattcgaattttttgatttgttgcaatttttagaaaagctcatatgattttctcaaatcgtccttgctgattatatttttttactcaatttaaattttgcaggagttggacgaggatcaggacgaaatgcgcgacgatgcctcatttgccaactcggactggaattgacttgacacgaatggcacttaattctcacctttttgtgcacgaaaacactcaaaatgccaatttattattttattataccattgaatcagggagaagcagcactttttgccttggctttttaattttccttttattttagttaaaattaaccaaaaaagggcaaaaagtgcgtgcatttcattcgttcgttctttcgcctttgactttgattgtttttctcgactccctttcctttcagctttcatttgttgtttaatcttgcctttacttttattaacttattcctccgtctatttaatgttgtttttcatgataattgcaaaaagtaaacaatcggatttttgctgaatgccttgcaactttacaataaa

SEQ ID NO: 76271 - DNA, 660 bp, Heterodera glycines
  Genomic contig location: Contig_ID=SeqID_12611; Location=296..955; Strand=+
  SCN-specific regions: Sequence locations=1-115,141-147,169-478,515 -636,659-660
atgaaagctggaattggtcgctctcctatgcaaaatcccacgaaaatcaaattgttaagggagtttcaatggtacggcctgagaccgattaggagaataataaattttcatgccaattaaagaaaaaatttcaaaaatttgacaaaggaatgcctgaataaaatgggtttttgttagtggattccttacgcatgggaaaagttttggtcgagcggtgaaaaagggtgtgtctcacgagcttgagcttttaatttcacttaaatttattgagccattatttaataaaatccacataacccaaaattaagaatataaaataatgatcaacgaaatgcatgccaaatttgatgcaaattgttgccattacgtgtcaatggcctaaaacaaccctcgccgatttgaactcctcagaaattcagtgaggagaaataaaagaagaacaatttattttctggataaacaattttttagttgttggaatttttttaaaatttttttaaaattttaatttttagttttctatccgacagcataaatgttcgttggtaacccaatggttgcttgagaagaagcttggttttttattagttagccattcaattacaccattaaataactgatccttgttactcaattcaatcttttattaaacacttaaaa

SEQ ID NO: 76272 - DNA, 1132 bp, Heterodera glycines
  Genomic contig location: Contig_ID=SeqID_12612; Location=399..1530; Strand=+
  SCN-specific regions: Sequence locations=1-239,262-263,286-1132
  Gene Ontology: Mol. function=protein binding; Cellular component =lateral plasma membrane; Biological process=establishment and/or maintenance of epithelial cell polarity
tcagtcaacgtcgagcacaatgccatctccaaagtgccgtttggcatttttgccaaggccaataatctgtccaaattgaacttcaaagagaatgaattgaccgccttcccattgggtcggtttggttgaccaacggattttatatcattcaatagtatttctttccatccttcagatttcggcacttgggtgaccatcactgagctgaacgtgtccaacaacgaaatccacgaacttccgctcggtcagttttccaccttttctctctttggctttatcttttatccctttccactcattaagacattgacaaattggtcaacctcgaggtgttagttctgtccacaaaccgactcaaaaaattgccaacacaaattggaagtctgaggagattacgcgaattaggtggaggacggaaaagaatttagggatgacattttaatttcagatttggaggaaaacgaattggaagtcatcccttcagaaattgggtttctcacagcgcttacaaaactttggattcaggtaaaaccgttcgttcccttttacttacttatcaattcatcctcgtctttttttatctttggcacttttgcattttttccatccttttttctttgtttcagtccaatcagctcacttcgctgccccgcaccattggcaatttgtccaatttggttgacttcagaataggcgaaaatctgctcactttcattcccgaagaaattggtgagaagcgaataaaagtcaaatttaataatgtattatttcgaatatttcgcatttaatcgaatccaatttgtttctaaggacacttggagaatttgaagagcctttacttgaatgacatccaaacttgcacaggttcttcattcgcctgtttctgctttcgttggaatgcgttcatcttcccccccccccttcagtttgcccttcgaactcgtcctctgctcatccctcgaaataatgtccattgagaggtgtcccctgtcacaaatcccctcaggtgtgtttatctcttaatagtttgttttccaattttctttctccagatataatcgaaggcgggcccagtctagtgatccaatatctgaaaatgcatgggccctatcggggagttctcaacatgtga

SEQ ID NO: 76273 - DNA, 300 bp, Heterodera glycines
  Genomic contig location: Contig_ID=SeqID_12613; Location=1009..1308; Strand=-
  SCN-specific regions: Sequence locations=1-64,86-300
cagttcacagtgatcgctcaatacaaaagtttgctcaaaagtggtgaatatttagtgagcgcgaaattaaaaataattttttgtaagggtaatgagtgtaacggaaaagcgatttttatcagtgtcaaagatacccaatcgatgcggataaatacagtcaactcatcagtataagttaaaaattaggggcatcacatttttcaccactcattttttccgagccaacagcgccgccccgagaacgccaacgaccgcagcaccgccaaagccaacggtcagtgccaagccgagcaatccatc

SEQ ID NO: 76274 - DNA, 398 bp, Heterodera glycines
  Genomic contig location: Contig_ID=SeqID_12614; Location=701..1098; Strand=+
  SCN-specific regions: Sequence locations=1-51,73-398
gttgccgaacaattcttcaaatgggtcggtccttaccagcgcggcttcttttgtgacgacgactccatcagattgccttacaaaagcagcaccgttcccgattggctgcttctggtctatgctttgtgtgtgccaccattcgttgtcagtgctattcaaatgggcgtgggggcaattgttgggaaggcgcgggacggatggttatcccttgaaaaagttgggatggaacccccggggatcttttggctgattgcccccccccctttcttggcaaaaccatctttttcatcggctaacatttgccgatctttcagttcgcttttggagagttcatttgtttgtccaaaccgcccgctttggccattcgtcaacgtctaaatgactttgagtttggggag

SEQ ID NO: 76275 - DNA, 1682 bp, Heterodera glycines
  misc_feature (1671)..(1671): n is a, c, g, or t
  Genomic contig location: Contig_ID=SeqID_12616; Location=18..1699; Strand=-
  SCN-specific regions: Sequence locations=1-272,294-354,398-400,431 -642,678-805,840-910,933-1126,1148-1404,1473-1575,1611-1641,1663-1682
atgaatgaattaacaggaggcaacgcgtggcgacttgtattgtactttgataacagacggatggagaggtgcactgatgattttcggagacaacgattggcagtatgatgcgtatatagaaaaggttctcactttttgcggacccgaatgccggattggactcgaaattttttgccaaccctgaaaatcctacaattaaaaaaatttggtccaagaaatttctcttaatttttttcaaatggactcaaatatttaggcatcttttcgaaaatatgttaaaatatttccaaatttttgcatgatgccattagcatccctggcctcaaaattcctttaaattttgaaatttcagccttattattataaaaataatcctttttatttaaatttttaaattcatttgttgcattttaaaataaaaattcccattaattttagcgcaccaactgcgagagtttgtcatttttgttgcttcacacagcaattgttgatttaattattcaaattaataacaattgtgaaggagtaaaaagaaaaacattttatttttttaacataagcatcacttttaatggtaaaattcaaatttatttagaaggggaaagcaaatgtgagcttactttcaactcgtaagttgtacataatttaaatactttattttattattgggttttaaaattcaaaagttgctaatttttggtcaaaaaatcacaatgatctgagaattgaaagatgcaaacgaattttcagtttttcattgaacaaaagggaatctctaatatcctattttcctcacacttttccccctaatttattttagtgaggaaaatgccaaaaaaggttgttcaattgaatgaccttacacataataaattttagtccaaagtgtttacggtattcaaaactacagtatgaaatgccttcaattttccttaataaaaacgaaattttcaatgctaatttttacgcaaaaatggatgtgttgaaaacataaaatgcgattaatcacgtactttgagactgtgaaaaaaattttttgagggtttaggcaagaaaaataatattaactgagatcaaacccaagtaaattgggcaattgaaataaaaaaaatctgcatatgatttctttactctcctttcacccttattttatgcttggctaagctctcactgaccagaaatgagttttctgatcaaaatctcattctctgtaggcgctctctttggtggccgagaaggccaaagaagcggttgaattggtgaaatgcaccttttgagtaagatatattaactcattaaaattcacagcattttaacaaaacctcgagaatttctcgagttaagaatcgttcgagtcgatgatattagcacattcctttccattctagagtgaataaaagcagcaatattttgaaaaaattttttttgaatttttcatttcatttccaattttattttattttaatatttaaggaggaagcgtgcaagaaattgtgcgaaagttcgtgccttgaccagcaaaaggcgtaagttggaggtgtaatgcctaaaataaatccaaacgtttaatgattgaaaaaataaaaaacattaattaattcaaattaaatcatttagctgttactcgaaatgcggcaacacaaagcaacaatgtgatgatgagtgtaccanatgctcagtaa

SEQ ID NO: 76276 - DNA, 128 bp, Heterodera glycines
  Genomic contig location: Contig_ID=SeqID_172; Location=111..238; Strand=+
  SCN-specific regions: Sequence locations=1-128
caggagaagtccccggatcagagcgcctacatgtgagaagatgcaacaacgaccggcggatggatggacgaaacctgaagagcgagcgacctgtcagaagatgcaaagataaagaagatgtctcataa

SEQ ID NO: 76277 - DNA, 614 bp, Heterodera glycines
  Genomic contig location: Contig_ID=SeqID_173; Location=828..1441; Strand=+
  SCN-specific regions: Sequence locations=1-14,36-614
gtataaaaggcgacggttttcttcacttttcaccagtgccagccagccttcaactcaacgcaacatcaacaccagtgcgcgccaagctcgtctacacatttcgtcgcgacaactcatcacttcatcatgagcgacatgagcgcctacatgggatccggccccgccgagcctgcaccgtcgtccggcgccgcggaagcctctccatcgtcaggagtcgcgagcgcctacatgggatccggccccgccgagcctgcaccgtcgtccggcgccgcggaagcctctccatcgtcaggagtcgcgagcgcctacatgggagcctcgcccgcgtacgagccaccagcggttggtttaagggggacacgggagcaaaagcatcactaatcttttgtttttgcagcaggagaagtccccggatcagagcgcctacatgtgagaagatgcaacaacgaccggcggatggatggacgaaacctgaagagcgagcgacctgtcagaagatgcaaagctaaagaagatgtcccataatcgtgatctgtatttattgatgtattgtacatttgtatgcatatatcatttgctgtgtattatcactttatttccatctgtgttccgaa

SEQ ID NO: 76278 - DNA, 614 bp, Heterodera glycines
  Genomic contig location: Contig_ID=SeqID_174; Location=1176..1789; Strand=+
  SCN-specific regions: Sequence locations=1-14,36-614
gtataaaaggcgacggttttcttcacttttcaccagtgccagccagccttcaactcaacgcaacatcaacaccagtgcgcgccaagctcgtctacacatttcgtcgcgacaactcatcacttcatcatgagcgacatgagcgcctacatgggatccggccccgccgagcctgcaccgtcgtccggcgccgcggaagcctctccatcgtcaggagtcgcgagcgcctacatgggatccggccccgccgagcctgcaccgtcgtccggcgccgcggaagcctctccatcgtcaggagtcgcgagcgcctacatgggagcctcgcccgcgtacgagccaccagcggttggtttaagggggacacgggagcaaaagcatcactaatcttttgtttttgcagcaggagaagtccccggatcagagcgcctacatgtgagaagatgcaacaacgaccggcggatggatggacgaaacctgaagagcgagcgacctgtcagaagatgcaaagataaagaagatgtctcataatcgtgatctgtatttattgatgtattgtacatttgtatgcatatatcatttgctgtgtattatcactttatttccatctgtgttccgaa

SEQ ID NO: 76279 - DNA, 3186 bp, Heterodera glycines
  Genomic contig location: Contig_ID=SeqID_1837; Location=151..3336; Strand=-
  SCN-specific regions: Sequence locations=1-68,93-166,188-189,212 -878,900-903,925-2473,2495-2647,2669-2792,2814-3186
  Gene Ontology: Cellular component=cytoplasm
atgccaattgttgccacgaccatttccaccactcgcaacactttcatgctcacaaccgttcgcctcactctctcctccccttttctttttctgctcatccgaccgctcttttccgactcattgcattcgctgttttgtgccgtaagtttcaaatggaaaatatccgttctttcatttgtttttattccgtggaaaaaaggagggaagtgaagaaaagtgactgattgtgaaccgaaggaaaggaaatttgagctgtcttttccctttcccacattaaatcgaaacagtccgtcttttcttctaaaacatttattattttgatgagatttcatacatttattggtttgtaaaagcaaacaattgctaaccatatttacatacagattttgttaagagaacgatgctgaaaatcgtcagcttccatcgttggggtcgcacgcagcgattgcaaaatacagtagacagacggagacggaattgacggttgaaactgaaattggacggattgtccgtttttaaacccattgcttttcagctcaattatcaaaaattgttcgccgaattgacaaaatccacaccatcttcagaaaaggtttttgcgcaggaaaaactgtcaattgcaagccctgttaacactgaatatgaagcaattgcgcggatgttagctcagagagcgaagggcgttatacattttgtgaagttggccttcccggaattggtcgattgtccaacggatggcgctgacggcaaaactcttttgcatttttcttcccaggaacacaccgacgaagacaataatgcgacaaaaataacgaacgaaggagccgatgatgcggatacaatgaagtgcatttaatatattttgttgaacaattcgttttgtcattttcatttattctgcaggcaaatgactgaaactggacacgacgatgaattcgaaaaacgcgtcgttttcgacttggaccaattggcccactcacaatcagaaccgccactgctgctagacaatgatgacgcgctaaaaattggcacccccgttggggcccatttgctctttgagagtcgttttgagtccggaaatctgcgcaaggcaattcaagttggtgctgtgtcattaaaaagagatctcttgcttgaattgcaaatgaacattgtttaaaatttctgaaggtttcacccaacggttacgaattggttttggctccggacatcaaccaatgcggtgcccatttccaatggttcttcttccaagtgtctgatatgcgttctggcgttccatacacatttgaagttgtcaattgtgcgaagagtttttccatgttttctgaaggtgggggaattggattcattgacattatcagcagctttgaaaagaaacggtttttttcaggaatgcaacccgtgcttttttcggttgtagaagcagtccgttacaaaaacccatgctggtcacgcgtcggatcgtccatttgctactttcctaacccaaaattagaacacgatcgtaagcgatagtacacagaagtttttatctttccttcctttggcaatcgcaatttggacgtttcaatttattatcagtcgctaccccgaacaacgaggacatttctgcagacttccaagtagattctgtttcaagccgtactcgctcatccaatcagagtggcgaaacttcattcacttcaacaccatcggtcgcgggcaatgatttgtcctccaaaatgcaattgcgtcgacaacaaacagaaaaaaataatacccaacaaaaagaggaggcggagcacttattggatgggaaacaaagcaaagggaaaacgaaaaagacgaggacggcatcggcacacaaaatcgcagcagaaaagggggatgggaagtgagggcggaagaggggaataaaatacaaacgaaaatgtcaatacggaaaagaccaaaaaataaaggatgaatacatgcaataattaaacgacaatccatttaggaggaacttcactttgcgcttcaccatccaatttccgcatgaggccgatgtttgctacatcgcctaccacttcccctacacttattcgcgtttgcaagtccgctttcttattttatccgcttttttgtcattttccatttttaggcaactttggagcgtttcttttcttcatcgtcttctcacaacatttacatgcaccgtcaaagacttacgagcacattgtgctcaaatccggtcccattgttgactatcacagcagcaccattggaagtcaaatgccgagaatttgttctgatcaccgcaagagttcatcccggtgaagctaattcctcgtggattatgcacggtaaacttgagctaattcataacaattgcattttaagttaaggcgtcattagctttttgctctcttcccatccgctggctgttcgtgctcgcgagttgttcatcttcaaattggtcccaatgttgaaccccgacggcgttatcaatggatggtcatttttctttcttttcgatttaatttcgttattttaagtcagcgctgttctctgtccggtcatgatctgaaccgagtgtggaatgatccttcgccggcacttcatccgaccatttaccacgcgaaaggactcctacaatacatggcgtgtttcctcctaacatttctgaaataaccctttttcctttcaggacgatttggccaagaaacgaccgtttgccttcgtcgatttgcatgggcattcgcgcaagtcaaatgtgtttatgtacggcaacaatttggaagagtcgtggcgtcaatcggaccgtgacgcggccgtcgacacctccgctgtttttcgacaatccttcgcccttctcccacaaatcctagacgaagtatgccttcgccattttcttatttttttttatattcagatttccgattcttttgctctcaaagactgtgctttttccatcaccaaagccaaagaattttcggcccgagtgaccacgtgtcgtcagtttggcattgaacacgcgtacacaatggaatcaacttattgcggctttgaccagggttccaagatgggtcgacaggtatttgatgtgaatacaaagaaggtcaattaattaatcagatcaaaatggaggacatgaagctggtgggcgctgatttggtgaaagcaatggtcaaactatgggaaacccagcagccgaccgattcgtga

SEQ ID NO: 76280 - DNA, 168 bp, Heterodera glycines
  Genomic contig location: Contig_ID=SeqID_1838; Location=64..231; Strand=+
  SCN-specific regions: Sequence locations=1-51,73-168
cgtcaaaggtcatcttcgtcagtttgttcttgacatgcattcgggagttagttttattttcttttcttttaagataattggttgtttcagaaactccatcgtgagttccaccagtggcccgaccccacggaacagcccgcaccgaccaccacccaaccgccggcctcg

SEQ ID NO: 76281 - DNA, 139 bp, Heterodera glycines
  Genomic contig location: Contig_ID=SeqID_1838; Location=4270..4408; Strand=+
  SCN-specific regions: Sequence locations=1-139
atggaagtcaaattgaagccctattccgatccgtcccgttgggtggccatttacccgctgtacatcgatgcctccaagtcgttggcacagggtcgccgaattgcgaaggcgaaagcagtcaacaacccgacatgccaag

SEQ ID NO: 76282 - DNA, 1168 bp, Heterodera glycines
  Genomic contig location: Contig_ID=SeqID_1839; Location=1725..2892; Strand=+
  SCN-specific regions: Sequence locations=1-352,389-440,468-503,526 -609,631-1136,1158-1168
atgcctataaatgtactaattttacatgattttttaagcatggaaattttaagactaatattcgtgacttatttactctactgcaaaaaaaatgctaaatttgaagaatggctgcgagaatgtaaaaaaatgatttaaacacattttgagtcatagatatgaaattcgaaaatttgtatgggtggtataccctcatgggtatctgcccatgagggtacccgtggtacagaaagctgtcaattcgttgtcccctgcacagctcctagggtgtacgacagcgctggtctgagcccgaattcgtgatcggcacctttaaaaaccccttgaaactattttcattaattttgaaaacaaaaaatttcttttattaaaatatatgttaaaagtaccccgtaaactagaaaagtaccaataaccgattaaaaaaacagtaaaacaagataaatctttttaaaaatgttttttatagttggtttgtatcataatccttcggtcgctatgagcaaacaatgacaaaaaatgttgtttattattcctgatactacattattagcttccatattcatcaatttcctcaaaaacaaacatcagttcgccgccccattctcattttccaaatcaaatgaaaagtccaaatggtcatcatcactgaaaaggcgatgctcggtggaaatttgcgagagttgattgttttgatttgccccgctgacggcgagaggattttgttcacggttggtcgacaattcttcaactgattggaacaaatcctgcagccgaagttcactgtcgtcgatgccgttcacccaatgctcgccgatggaatttgacaacgaattgaaacgtgcgctgttttcgtctaaaaaagcaccggaaatgaatcatataacaatttaacgaaacccaaaaatgcgttgagcccggcgatgtcggccatttccgtgtcgtttagtaacatcccatcgcttagtgaaggtgccatcttaaaaatggaagtaaattatacagtcagatgattgattgttatgttaatcacatcttgatggacaaccggaggagttgaaagaatgttctgattctgaaattcgttgctggttgtgggctgctgatccaaaagttcggtcatcgaaggttgagtgtgtggagaattctgatgaggcagctacaagaa

SEQ ID NO: 76283 - DNA, 666 bp, Heterodera glycines
  Genomic contig location: Contig_ID=SeqID_1840; Location=2..667; Strand=-
  SCN-specific regions: Sequence locations=1-264,286-307,329-380,417-666
atggccataaaatatggaccaaaaatcgcaaaatatggacataaaatggcaaaaatctcaaaatatggaaataaatggcaaaaatgtcaaaatatggacataaatttttcaaaattgagtgcaaaatttcttcaaatttattggttgaaattgcatatgagatacatttccaaattttttgactcggtaaggcgctttgacaaagacggctttcgttttgcaattagtcggtcaacattcggaaattggtctcgaattttttcggcaattacgtgcaatcattttaaaagaaaaaaaacataaaagctaaaatttattaatttttttagcgcaaaatcaacaacaaaagcgaaattttcgcttttttgcttatttttgacataatttattaatttttaagaaaatttaaatttattcaatattctcgagaaattttggcgaaaaaatgattttttgaaaaatttttcgggttttgggctcaaaaaggctaatttagctgctgggggccgttctaatagaggtttttttgaaaaatgccaaaatatggacataaaatatggaccaaaatgccaaaatatggaaaaatatggaaatatggacataaatcgcgaaatatggaaaaatatggatatagaaatccttcctagaagcttcaaaccaagctaa

SEQ ID NO: 76284 - DNA, 155 bp, Heterodera glycines; identical to SEQ ID NO: 51421
  Genomic contig location: Contig_ID=SeqID_1840; Location=386..540; Strand=+
  SCN-specific regions: Sequence locations=1-155

SEQ ID NO: 76285 - DNA, 1076 bp, Heterodera glycines
  Genomic contig location: Contig_ID=SeqID_1840; Location=904..1979; Strand=+
  SCN-specific regions: Sequence locations=1-188,210-213,237-324,346 -661,692-827,878-915,937-1076
atggcattagcggaccagggacgtatccaggatttgggcttgggggtgggggggggtacgatccgaaaagtcaattcttaggggtgtatttttgaaaattcttcgcccgattcttaggggtgtatttttgaaaaactttcgcccgaacgacctttttttttttttgctcataccagcgaatagcggaccaattatttttcaaaaatattagggctggaaaattctcaaaaaattgataaatttattcaaaaaaacccatttcttccaaacacaactaaaaatttacaaaatcaatcaaaaaccccaaaaaatataacaccatacaaaaaaaaataaaaaaattttgttcatatggtaattttgtgaaatgctaatgctacacattatggctgcttttgcgcccatcaacttctgtttttgcggagaaatgataagaatagcctaaagagtgggtttatcaacaaaaaaaggctttaaaatatcgtagttaccaacttaccaatacattacgcattacattgatcgtaaaacgtgagttatgcaaagttcgaatggttgatcagtcattcggtggcgagtccggggttcggaattggtcaaaatgggtgtcattttcgggatcggcatccctgaaaacaccctagaaatgtgtttttacgacttttataaactataaaaatttatttaaaaagaggtgtggcagcatctaaacgattaccctcccattttcagacagaaaacttcaaagaaaaaattatttgttaagttttttgaaaatttttcaaaaaacagtaatttatcttaaaattccagaaaaaaaaaattgcttaaaaattttcaaaaattttttctttaattttttttatttcaaaattttcagaattttttccttgaaaaaattctgtttgaaaaacatattttcttttttgaaatttctgagacgagattttgggcggcgagattttgtcctgccccctatttttggacatttaatcgcaaacgtcaaaaacttcgcggtgtatttgccgcaaggggtaagacgtacgcacataaccccggggagaattctgtttcga

SEQ ID NO: 76286 - DNA, 1165 bp, Heterodera glycines
  Genomic contig location: Contig_ID=SeqID_12617; Location=1013..2177; Strand=-
  SCN-specific regions: Sequence locations=1-73,95-408,430-560,582 -632,654-755,797-900,922-1165
atgatggaagaacatcaatcaaagaatttcctagaacttttaaaccgattagttttggtggaacaaaagattgtgactgttgcctttctccttcgcagcactccgttgaatgtttttcaaactcaaaggtaaggatacaatatttatttgttttcttttttattcaaataattttttcagccttttgactcgctttttggaatttaattcaaatgtaaccgccaattattatctgctgggaccacttaaagctgagcttgggaagaagcattgtgccattgtcaaaggggatcagttagcggatgccaagcgacgtttggcgaaagttgacatttgtaacgtattctccatacagacaaagcgtactgattgtgaggtggggggcaacttttatttacaacggacagtgcaccgacagaaactcatccaacatttaagtcgctcggagatgtgttcagaacggattggtacgaccaaaaagttccctctttgagcaaaggatttctgaagaattcgaaggtaaagagcaagcaaaaatggaatatgccagggtttcgaagaaaacaaattataagcaaaaagattaactaacacacaaaaattgacataaggccattaaaactaacatatggttctaaatcattttctgaagcaggtttaaaaacattcattttttatgttttccaatgttttgttggttttaggttccgtctccgtcggaatttcgcagtctcagcccaattctgtcgccatcgaaggacaaaaaagaggaagggaaagaaatggacgaagaggacgacagagaagcagaggaaaacgcgacggaagtgaaaaaagcgacgggggcaaaaacactgatcagacggcccatttcattcacgccgatttgcaaggaggaggaacaaaggaaaaagcaaccggtgactcgcattttattatttctgcaattaggcccatttttaacaacgcaattagaaggaagaaagagaccgaccgattgggaaacaacgcatcgaaagggatgacgaaaacgcaatggcacatccgccattgaaaagaccgacggcacaaaccatcaaaagggaggcgaaagtcgcgaaaacgaaagtgacggagaacggaggaagcaaacaaacgaccttactcagctttttcaaaaaataaa

SEQ ID NO: 76287 - DNA, 126 bp, Heterodera glycines
  Genomic contig location: Contig_ID=SeqID_12618; Location=475..600; Strand=-
  SCN-specific regions: Sequence locations=1-21,49-126
aaattgtacaaaacttactagtttttaaaaaaaaaattaaaaaatttacgacttttcatcaaaaatttcggaagtcggaattccgaccccaaaaatgtcggaaatcggaagtctttccgtgccata

SEQ ID NO: 76288 - DNA, 291 bp, Heterodera glycines
  Genomic contig location: Contig_ID=SeqID_12619; Location=66..356; Strand=+
  SCN-specific regions: Sequence locations=1-291
atggccagctgcaaacaagcaccaggggagcgggtgtatgaatttgccaatcgattaagtgatgcagtcagaactgcactggccggagagagtgaggaaataatcagaaagagaatgttcgaagaatttttggagaaattgacaccggaactgcaatttgaggtcaaagctggtcggccaaccagctattctaatgcttacgaaattgctcagcattttgagcaacttttggccgcaaagaggcataatcaagtttcaattgccgattcagttgcggaattgtcgcataag

SEQ ID NO: 76289 - DNA, 1978 bp, Heterodera glycines
  Genomic contig location: Contig_ID=SeqID_12620; Location=55..2032; Strand=+
  SCN-specific regions: Sequence locations=1-499,530-788,810-1034,1057 -1341,1363-1402,1424-1978
atgctgagccgtagtctaaacgcaactgaaaaaaggaggaaaaagcgagcatatgcattcgttaacggacttaagcgggaatatgttattaatgaaacggacactactgtgacatggctcgaaccccacccagagatagaacagctccaatctgtcggattagtttactcatcgcaattggcagcacaacttacagctttaagtgccaaagtcacatttaatactcagaaattatttgccgaaacggtgcggaaaatttgcaacagccttcgatttttagctgatcagacactgacgttggcagaggcaaatccgacacttttggcacgatttttcttggctaacccttttttaactgcgagattggtgacaaaggaaatgttagagatcagtccctgttttgcgataaatgatagggaaatgcattttcaatggcaaaatggcagatgttttgaaagattgcctgtgactttttatttgcatagcagttatgaaacgaagaagcatggatttttggacccaaaaacactaatagtacatcacaattcaaaagagaatagttgtaaagaattccgatatttatatgtaccattgaaagggtcaattatgcaatatgatcagctcagcggagatgtcaaggaaattcctcccgattcagtgcggtatttggctagacaagggaaaattgattttccagaggtgcatattcaattgtttagaaataaggtactagcgaatttgtctgagctatattctcccgaaagttttgatgagactatcgaggttgcaaaaattgcaaaagaaattgcacggctgtcaaagccaaatgcttgggaatttaattcggaacgaactgataatatggccacaaatattgtttccaatgggttattttcatttttgagaggaggactgatctcaattaatcaaatgtgggtattcgtttgttgttgttatgttacacttactattctcttacaattaattgtaccagcgccattagcacaggcaatacagtatttaggagtgggaggaatactcctaaataaagtaagacaaatccgaaatcacatgggcaaaagaaaacaaagacagcccagggaggcaataaaaggtaaagctggccaatctgtcatagaaattgagaaaatagcgatggaacaaaccgctgctacacaaatgaaccgtgagaaagcagcagtgaaaagccgagaaaattcaccaattgtcgaaaagaaaaatgtaacttttgctattccacttacggagagatggccatcaccggatgtagctgcgtctacctcacagcaagctgtaagagaacagcaagcaggcaaaaatgggaaaaatgataaagtcataattgcggttgcgggaagtagtcaatgtgatgaaaagtttcgaataaatggagaagcgaatgagtggaaaatgagttttttgttagacactggcgcacatgtgactttgtgtaataaatatactgcgctgaaaatgggcatacggaaattgattgcatccgacatcacggctgttattgggatcagtgataaattagttccgattttgggaaaagcggaaattaaactgaaaatcgccgaatgtgaagtcatcacaaccgtttatgtagtggaaacaaaaattggaggcgcgggatcatacgaaatgattatcggaagaagcacccttcgccaattgccactattattggaccttcaagcgggggctttaatacgaaaaagagacatgaaagtgtttatttgtgagccaccaagtgatcgggccgatgcagaaatacaaaaaaagaggggaacaaaagacagagttggaatggtgccttgaaaagcataaggatgttttttctgtccacgattatgatcttggagaatgtaagttgaaagcacctcccatcttaacaaattcaaatgttcctgaaagagtaaagccgtatccggtcccggaaaaatatgaaaaagaa

SEQ ID NO: 76290 - DNA, 288 bp, Heterodera glycines
  Genomic contig location: Contig_ID=SeqID_12621; Location=2242..2529; Strand=-
  SCN-specific regions: Sequence locations=1-172,195-288
gagattattggcgaaattgaggatttgaagcgttccttgaaagatgcgtgtgatcttttgcagaaatatcgccaggaaaaggcggaggacgcaaaggaacaacagcagaacgaagcccaacgaacggagaacagttaacgaaatcaaaaatgaaattccgcttttcgagcttaaaagtcatattttcttcatgattaaaatacattatttttttatcggcaccgctttagctttttttgaaagcgcaattttctcaaatattttcaattgcaaatttattttaataaa

SEQ ID NO: 76291 - DNA, 277 bp, Heterodera glycines
  Genomic contig location: Contig_ID=SeqID_12622; Location=703..979; Strand=+
  SCN-specific regions: Sequence locations=1-87,116-277
atgggtctcattttcatggctcgtattaattattttcgtgctttttcttcaactgtttcaagatctttcaagcagggtaattaatccttaaaattaaattaataaaattatttatgaattttcagtaaagcataccgtccaggacaatgttacaaccattgaattagtcgatgttcctattgcgtcaactcatagagaattgaaggaatctgctgctactcaatctgtagttttctttttatattgcattagtttatttaatttatgtaatgtttaa

SEQ ID NO: 76292 - DNA, 70 bp, Heterodera glycines
  misc_feature (60)..(60): n is a, c, g, or t
  Genomic contig location: Contig_ID=SeqID_12622; Location=1..70; Strand=-
  SCN-specific regions: Sequence locations=1-70
tatggcacggaaagacttccggtttccgacatttttggggtcggaattccgacttccganatttttgatg

SEQ ID NO: 76293 - DNA, 125 bp, Heterodera glycines
  Genomic contig location: Contig_ID=SeqID_12625; Location=1612..1736; Strand=+
  SCN-specific regions: Sequence locations=1-125
atgatgctcggtgcccaggcattacgcacgaagcaaaaagcggaaaagcgggagaaggagaagcgcaagcagaagaagatgaagggactgaccaatgaacgggagaacctccagcgagcggcaaa

SEQ ID NO: 76294 - DNA, 84 bp, Heterodera glycines
  Genomic contig location: Contig_ID=SeqID_12626; Location=1434..1517; Strand=+
  SCN-specific regions: Sequence locations=1-42,67-84
atgccgtttccgtgggtggtgttgctggtgctgctcgtcaaccccgctgctgggtgctgctgggtggttgatgttattgctgct

SEQ ID NO: 76295 - DNA, 1617 bp, Heterodera glycines
  Genomic contig location: Contig_ID=SeqID_12627; Location=351..1967; Strand=+
  SCN-specific regions: Sequence locations=1-89,112-881,906-1213,1235 -1617
  Gene Ontology: Mol. function=DNA-directed RNA polymerase activity; Cellular component=DNA-directed RNA polymerase III complex; Biological process=transcription
atggaacaacaaattgtacgtcttttgggcgaacatccggaagaagggctcagcaatgcgcgacttcttcaaggtgtttgtgctgttgttttattttgctccttttttaaacgcacatttattgtcaattccgtacaaattgatacttaaaatacggggtttaatagttgacataaatatttgcgtttcttttaccacaatttaagcggttggcgatgattctgcggatggtacggatgcttcgtcctctgtcactgaacagctcggagcagccatcaaccggctgttggcccaagggaccatcgaaatgttacgtgagactgtgccaacgggcgaaggtgttggcggcgccggagggttcattttgaggctaaaacgaggcagtcagttgaacaacgccagcccggaggaacaattggtcagtcttgggaatgtattttttgccgttagtttttcctctttattttgttcgcatcctccaggtattctccatcattgaagagtcgcagcggatgggcgtttggatccgcgacattcgcgaacgttcgggcctcaacgaagtgcagctgaggcgcgttctgaaggcgcttgagcagcgaaaattggtgcgaagcattaaggcggccggcaccacaaagaaaacgtaaaattcggcgcaaaaaaacgaaacccaattaactaaaacagttaatttgcgtttaaatcgcttctatttttcaattttacaggtacattctgtccggtttggaggccgacgacacactgacaggtggcactttttactcggatcaacaactcgactcggaatttgtccaaacattgctccacgtctgcgtcaattggctgctggtacatgaacccaaaatttctataaaaacagtttcttttgtgtccttttatggttggcccgccgacttggaattgcttaatttttctcggcagttccatggcattcgaacattacttaagttctcattgtcagaaacccaacaatttttaattttaatttatcgctttttaaattttcctgcgcttttcagcagcggcgtcgcgccgcggaagagaaacacccgggcgacccttacgcgcagagggaggcgtcttttgtggagtcggacgaagtgcggaagagccttttgcacattttagtgttacctcaaaccaaaggatttctatgactaacaaaaacttattttaggcacattacttttcgctcgtctatttgttgttttttcaggtcgcccgttatatccacgaaaaaggcctttgtcgaatccaattgggcgtcgcggatgttgagaggtgtgcaataaacaaaacaattaaacaattacttctcacaatcagtgttttggacattgctgtgctggacggtaaaattgagaagcggttgaaccacacatatcggtaaatttttattatctcatattgtggcgaattttttgcattgatttcgtcacatttttcagtgcgattcgtaagcagcaactccatccgtctccgttggcttcggtgccctgtctgcaatgtccggtcagtgccgagtgcacccccggcacaggccatctcatctcgcccgaaaattgcgaatatttccgactccattttgatttatga

SEQ ID NO: 76296 - DNA, 1399 bp, Heterodera glycines
  Genomic contig location: Contig_ID=SeqID_12627; Location=2950..4348; Strand=+
  SCN-specific regions: Sequence locations=1-543,565-961,983-993,1017 -1087,1110-1266,1295-1399
atgagaggtgtgtttttctctgctctctctatttattggttcatttctcttttcgggcactgtgttaagtcaatttcgatcatttacagtattttataatttttaaatagcaatatgcttgtgcttttttttggggttgggactaatttagttgcagcgccctttaagtattgttgtcagttgtcactccctccctctgttatgccttcactgcgtcgtccataaatacccacgtcgattgacctttcccgtcattttttttcttttttaaaacttgttttctcattccattaatattttttggtttgattattcctgatttatttttttgcggatggggcaactattctcttatttcaagtctttgtttggtcatcgggaaatgcgaatactaatattgggcctcgacggtgctggcaaaacgaccattctttacaggcatttttaaaattgctacagaaaaacacaatagtgggtggattatgttttgtaatgggttggatttaaaaaaaaaacaaagtttcgaatcggtcttccactttccaatgaaattgaagaagaaatctaaacaattttttgaacatgaaatttcgaaatattaatgccttttccttgttcaggctgcaggtgggcgaagtggtgacgacaattccgaccattggctttaatgtggagcaggtcattcaatgtcgtccatttaaaataaaacagcttactttctctctttttaggtgacttacaaaaacttgaaattccaagtttgggatttgggcggccaaacgtcgatccggccctattggcgctgttactactccaacaccgatgcaatcatttacgtggtggattctgcggacagagaccgagttgggatttcaaaacaagtgagtttcgggtgacaaaccctcacaaaagtttggttgcgataattgtaattcatattcaaggaattggtgtcaatgctggaggaggaggagctgaagaacgcgatcctcatggtgctggccaacaaacaggacatccacggctgtctgtccctggcggaagttcacaaggcgttgggcttggaggtctgtcgtccaaacttatttgtattttatattttcaatttaggcgatacgaaacaggacattccaaatcttcaaaacctcagcgaccaaaggcgacggactggacgaagcaatggaatttcttgctgcttctcttcaatctgccaaatgatcagaccaatgcataattatttccaattattgtattacagatttttacgttctcaatttatttattttttgcttggtaaatacaatgtcattcaaaatgttgaattggtatttagtatatataggtataacccttttatatttaacttgtgaagagctagcgcaactaaaattctcccata

SEQ ID NO: 76297 - DNA, 257 bp, Heterodera glycines
  Genomic contig location: Contig_ID=SeqID_12629; Location=199..455; Strand=-
  SCN-specific regions: Sequence locations=1-257
atggaatctgatgaagaattcactgaagtagtcggcgttgatgaagcggaaggaggggcttcaaacactggtaacaattcattcactcatttcattataattttgttattaaggttcaattttttcggcatatgaccattcttccttctcatatctgcatttatacagacctcaaacggatgttgttgcttcactcatatatcattcagggatggaaggcgttgaccgatatgaaatatccaagcactttgggataa

SEQ ID NO: 76298 - DNA, 1519 bp, Heterodera glycines
  misc_feature (137)..(137): n is a, c, g, or t
  Genomic contig location: Contig_ID=SeqID_12630; Location=225..1743; Strand=-
  SCN-specific regions: Sequence locations=1-261,283-513,535-663,685 -1093,1115-1413,1435-1493,1515-1519
atgggcggaggaatggcactaaagcgaatggactcggaggagcgaaatcgcaacgaaaagcttttatcggttggtgtgccatgactctttttggcactttgcgcttggcccattaatttgttgtccgtctgttcacnacagtgccccgattcagtcactcgcatttccgaccgttcgatgttttacaaaacttttgaattggtctcccaaattggccaaggcaatttctccgacgtttttctcgtatttagctcggagaaaggcgaaaaatacgctgtgaaagtgcgttttttgttgccaaagaaattaaaacagtgaaatttacgccgcaggaaattgacaaagaacgaatgagaagcaaattgcattttgtggagaatgaagttgcactgctgcagcggtgccggcacagaaacatttgccgactaatcgacgcctttgagtgccgacgggcgttctttcttctgttcgattatgcccaggtgctaagagagtcaatcagcttaaaatggcactgatcatgatgtggatgaatgcctttattgaagaagggcgaccttttcgagaccatccgacgcattggccgactgtcggaacgttcggccgcgcaaatcactcggcaaatctcttcggcactcgcttttctccaccgccgccgcattgtccaccgggacgtgaagccgggtcagtgtccaacacaaacagtgccgacaataccatgttcaacttcagaaaacattctgctcggggccgactccaccgtaagcgtacttttcggctgatcggtgatcggaaattgcttaagtctgtgcctttgttttaggccaaactgacggacttcggcctcgcctgtttttttctgggcccgctttaccgcagttaaaacatttaaatcactgcttttttcatttcattttcagtctgtgggaccccaacttacgtcgcacccgaaattctcactcagaaaggtgtttccgttggccaattgtattgtaaatcccaccgaaatcgtccaaataccgtaccgtatgtctgttttttcgcttaggttacggtgtggcggtggacatttggtcgttgggcatcattctgcacatttgtaattacttttccttttcttcccattgcttttgtcgccacttaaggcttggttggctttgcgccttttcacagctcggaaagggcccaattgttccagcaaattgtccatggacaattcactttcgatcaccccaattggagtccgatcggaacaagtcaaatgaatctttattcaaaaatgaaaagtacattttcgtatttttggcagaagctaaaaagctgctgcttggaatgcttacggcggcggtggcaaaacgattggacgcggagaaagtgatcagaagcgaatgggtgatggcaatgatggcacaaagtgccgatgagaacgtatgggaagcagcaaataaaggataaaacagggaaatggaaaagtcattttattatatgattataaaaaatgataatttggaaaattaaa

SEQ ID NO: 76299 - DNA, 357 bp, Heterodera glycines
  Genomic contig location: Contig_ID=SeqID_12631; Location=467..823; Strand=+
  SCN-specific regions: Sequence locations=1-176,202-357
gaaagtgatttggtggccacgtggcaagtgccaatgagtgacaaaatgcacaaaattgaattcgaacacggcacaacgacgggaaaacgaattttgcgggtggacggaaaggttcagggcatgtgtaaagattctgaaaaataaatgcctaaaaatgccaggaaatcctacgacacgaatggatgttcaaattggtgggcagggaaatgttcgaattgaacggcgttcgctgtgcggtcagtgctaaggaaactaaggcaaatgccaaaacaaacaaaaaaacagattaacatcgatgccgcgggaatattcgcctacgaatattcgctgaccgttggcggaaaagcattcgaaaaa

SEQ ID NO: 76300 - DNA, 253 bp, Heterodera glycines
  Genomic contig location: Contig_ID=SeqID_12632; Location=381..633; Strand=-
  SCN-specific regions: Sequence locations=1-145,167-253
atgccgactttgtttcttcacggcgcaaattctacatattttctggaggacgacaaaattgcgttaagaaaaatattctcccacgcgaactttgaagaaatccccgaggcgggccattggtcagaaaaaaagtaaaaataacattttaaattttattggttaaaatttcaggctgcacgcggagcaaccgaaaaggttcatagattcggtcacaaaattcctaaagaagggctattttacttatgacgagtaa

SEQ ID NO: 76301 - DNA, 173 bp, Heterodera glycines
  Genomic contig location: Contig_ID=SeqID_12632; Location=67..239; Strand=+
  SCN-specific regions: Sequence locations=1-173
acgaaggcaccaaaacgcacttagaattggccacggggagttcggcatacattttgtcggagagcagcggtaaccgccacatcggaatggtccaccgtttgttcgtcaacgacagtttggtaaagccgagcgaattggcggacgaaggcgaagagaatgaaaaaccgaaatga

SEQ ID NO: 76302 - DNA, 1909 bp, Heterodera glycines
  Genomic contig location: Contig_ID=SeqID_12633; Location=816..2724; Strand=-
  SCN-specific regions: Sequence locations=1-221,325-625,647-666,745 -802,843-986,1012-1091,1114-1125,1147-1175,1204-1289,1314-1399,1422 -1495,1517-1616,1652-1813,1835-1909
atggttgaaaaaattaagcccagggggtactattttatgaaaaacggtatcaatgccaccatttttattagggttgcgtccccgacgtcggggtttgaaaattcggggttcggggttgtcggggttggaagtgtcggggttcggggtcggggttgccaaatcgttcggggttcggggtcggggtttttcaatttttgccttatgccaaatagtcaaaaaactttataaatttttgcttaaaaatatttaaatttcgtaataataattttatgtgctttttattattttttttatcataaatattttgtatagaattaattaaaagcacatacctaaggcatttaaaatggccaattttcagcgaaaatctgtataaatctttttttggcttttttttttgcggcgctctttttctaaagacgtttaggagaaatgggttcggcggtgccgataggcgccgccgtgaaaaattttgaaaatttggatgggcctgttaacagattttgtccaaaaaatgatagattttttcgattttgggtcaaatttttttaagaaaaaatagtttttttttgaggggccggcgatgccgataggcagcgccgggcgaattttgaaatttaaggtctattttgtaacattttttcacccaaaatttatgaatttccgttaaattttatttttttaatttttttgtaaattttcatgatttagtcaaaaaattgaatttttaatgaaaataaaattgggttcaatacgtctataaattatgccaaggatgattgattttaatgggtatttttggtttaaaaaatcttattaatcatataaaaataaattaaaaaggaaacagtcaaccagtctcgaactcataataaaagtgctatcagtgttgaagcaacaatcactaaaccacaaaaatataagaaaacatatgcaaaatttactatatttcataaaaatttgtcaagatggttaaaaaaaatcaatttttgtataaatgttttgccttttcccccacaaaaatgccattcttaggggtgaaatgtgcggttcgatggcctcaatgatttatgttcaattgttatcagaattttgaagaaaaaggacaaatcagcggaaaagtaaaaatgcatttactaattgattttgtttaattaatcaatctgtttcattcgtttaattaattaatttttttctttttaagttcatatcaatctctcatctctccggacgatgattttatggtggaaatcggtgacagaaaggtgaatattataaattcgtatttcattttatttattttttaaatttttgtgatgtttcatccgctttttcaggtgattttgtccgctgctcggcttcgctgcttctccccggtgatcgatcggatgctcagcgtggagatgagggagaagcagcagccatcggtcactttgaacgatttgggcattgacatggaccaattcatggattttcttttgtacatttcgccaaatgctctgagccaaccaattcttcccaattgtaaaatgatttttcctattatcatgaggggacatggtgttgatgaaattaaactttacatgattaatctacaagatttttcgaaataggcgtaattttgtatatttattattttgttatttttataccaaaaacgaaaaacaattaaaaaacccttaattatttcaatttttttttggttattattttaatctcgagcttattttaagaatttaattttgcatttggatgtgctcaatttgcgtgccttttcagggcaaatcatgaacatttgatgacttcgatcggcaaagaatttttgggagatttgacttggcgaatttgttgttgaattcaaattgaattttatcttatcacagacacttttcaatttaaaaagaataaa

SEQ ID NO: 76303 - DNA, 79 bp, Heterodera glycines
  Genomic contig location: Contig_ID=SeqID_12633; Location=1..79; Strand=-
  SCN-specific regions: Sequence locations=1-42,65-79
ttggtccatgtcaatgcccaaatcgttcaaagtgaccgatcgctgctgcttctccctcatctccacgctgagcatccga

SEQ ID NO: 76304 - DNA, 1818 bp, Heterodera glycines
  Genomic contig location: Contig_ID=SeqID_12633; Location=2732..4549; Strand=+
  SCN-specific regions: Sequence locations=1-167,218-248,302-506,546 -619,641-680,717-769,833-843,866-1062,1165-1397,1458-1465,1489 -1742,1765-1778,1802-1818
  Gene Ontology: Cellular component=synaptic vesicle; Biological process=synaptic vesicle fusion
atggatgggggtgactatttcaaagggggactgtattttaacaaatacggtaatcattgtctgcttttccaggtatatgttccccgtgattccgcttttgcccgtctttatgccatccgctgaacaacttttgcttgccccaaccccatacagtaaaaaacaaaatcaaataaataatgaaataaatttgttttcaataaaaatttgatatatttttgaatgttgatgggttgatgaattattctgcgatataatttttaaaaaaacgtttaaattttaacaaattaatttaattatttaaccgcggttcatctaaataaatttaactaaatacatttagtcatcggtgtgccggcttccttcttcccatgcaagggcattcaagtcccgtcagatgtgcttctggtcgatttggacactaatgagatttgtccacccaccgatccaaccattcgaataccaaaaatgccacagccggaagcaaataatttaagagtacaaaaatcaatttaaaaataataattttaaataataaaaaaaatttaggaagaatttttgcggtcattgggacggcaagctgttgaacataaatcaattgactctgaacaacaacagcaaccattgaacattgatggagaccaaattgatgtggcctgcagagtggctatggtgagaaaggcatttttttgattttttagaaattttatataaaatttcagatacatttttacaacggagcaaatatatttgcaaatttcagtgaggtgagatttatattttaatggaaaatgtataattgatataattaacaaaaaaaatagttaattaattacagtcatacccaggaaaaattcatttgggaattataagaactgaaaaaaaattttccaaaattttattgttacataagaaaaaagtattgttagtttgtccaaaaatgactcagttttaaataatattttggtcagatttttaaaatttaaggagaattagtctttcggcaaaaaaattgctatacaattttcataataaatctttttcttttatttttcaaaaagtctgtaaaaatttaaaaaaaatttttttttcattctttttttgaaaattttgggttttttaatttgtaaaaataagaaaaaaaacaatttgaaagaaatatattttcaacttttaaaactgaaaattttagtttttaacagtttttttcggtggggtggggcgagctactcaattgttggattagttttttaccttattaattaactgtagcatactcgtacaattcggctttttcctcggcctgttgttgcgcttcaggcggactcttttttgcgaagtcggccacaccaaagtgaattcatcatggatttatgcaagactcaggccgtggagtatgcaaattattttaattaatttaaaatttaagctaattaataaaaatcattttgaattaaaaacggacataaaaattttgtaaatattattaaaacagaaatttaacagatattttgctgaatgttcactttgtccagccaacgaagcatatgtacgggtccaagccgggtgtacgcaagcagtacaaattggggataaggacaatggttctcgactcgttgatgcctgtctcttttaatgtacagtttaaaaagtttttgttaaaatttggatagggtccgggattttgaaaagcctgaaaattttctaaaattccccccccccccctcttcaccgttaaacgcccaccactttctttaagaatttttcaaaccaatttcttcaaaaaaatattttaattttttaacaattttcagtgaaaaa

SEQ ID NO: 76305 - DNA, 563 bp, Heterodera glycines
  Genomic contig location: Contig_ID=SeqID_1841; Location=1052..1614; Strand=+
  SCN-specific regions: Sequence locations=1-178,200-563
atggaaaattttgggcagaaaagatgtttctcgcctacaggacgacccatattcggcactcacggatttttgcctgatcaattgttcttcggtcgaagacttcgaactcagttgtctctcgtccacccaaaggaagaacacgccgaaatcatcgacccagccaaaattcgcaaatcgcaagctgattttgcccgaaaaatggcacgtcaatttcatcagaaccacagagcaaaatcggttgagtttttgccaaaggatcccgttttgcttctaaacttcaaccgtagaaaacgattttggcttaatgggaccatgatcgaaagattggaaaagtctcccacatatcgtgtccacgttccggctctcggaagagtcgtccatcggcacgcgaaccaactgcaataccgttatcctcttgaaaaggaaggaaacggtacgataaggatcccagctgatggttacgccaatgcctgattgactaatgtccgcagcaaattgattgcgccaaaaaaacaacgcagtgactcaggtcatttggcggcgacttggctgaaaaactggaa

SEQ ID NO: 76306 - DNA, 1092 bp, Heterodera glycines
  Genomic contig location: Contig_ID=SeqID_1842; Location=133..1224; Strand=-
  SCN-specific regions: Sequence locations=1-397,451-491,513-835,857 -930,956-1092
atgaggaaagaggaaatgatgagccaggactcgaatgatctaatcatcaaattttacacaattttgaacatttatcatttgataacattgaaatgtgatttgaattaaacaattttaacattatttttgagggtcaattgatttttattttaagtcaattttttctgctgactcgaatagccttaaaatgctttaaatattttttaacatttgaagctttgagcatacatttttctttggcttttttgactatttcctaccattttggtttttaatgacttttgctctttataattttttaatgcattttttcatttttggcaataaaatgaaaatgtttttaattaagtggtttaaaaacacattgtttaagtttcaacttttgagagcaaaacactattttaatttttattactttataaatattaattttttttcatatttaaaaatcaagtaattctgatcaggtggcttatccagatgaagccgataaaagagaggaaggagagggaatattcgttagcgaagggctcaaaaattctcgcgattaaaatattttttatgcggttcaatagtcattcgaaaactctagtctagaattttttaatcctaaaatcgtcacagctaatttcactccaactcgcggatcacttccgtcccgttgtaaaacagcgcagaatttctttgatcagcgccaaatagaagagttcgagtttaattggatgtctaatgagaaaagttgggaaaaaatttttttgttggaaaatcgacatatgaacgaaccgccagtgaccagcccaacgtcaccaaaatggagatgtaaactgcaaaactcgggttggaaaatgctttgattggcaaagtgtaaatgactgaaaaaattgggaacaattgtaggggggacgaaggatttagccaatttttaatcgaccgattttgttattaatttgtatttatgtaagagtacagacagcgaaaagtcaggactgaattcatattcttataatcattttttgttttacaaatttttaaaaatcaatttttggcaaattttttgaaaaaatataaataactactagaccaaagaataaa

SEQ ID NO: 76307 - DNA, 672 bp, Heterodera glycines
  Genomic contig location: Contig_ID=SeqID_1842; Location=1369..2040; Strand=+
  SCN-specific regions: Sequence locations=1-352,381-630,653-672
atggggggaaaatgggggacgtcacaaaatggggacggcacaaaaatgggggacggcacaaaatggggaacggcacaaaaatgggggaaatgtggagaaaatgaaacggcaggggaaaacggcacaaatcggaggacggcacaatttggggacggaacgggagtggtcggctcggcacacgtcaacggcacgggacgggcggcattgagcgggcggtgtgtcaaggcggtagtcgggcacggcagggcacggattggcatggcacagaacagtcggcgcacgaacggacagggccaagagtcgacggcacgaacggacgggcggcgcagttgtcggcggctgttgtcggcacggggggaaggggagggaggaaaaggaggacgaggcaatgcctctcagaaaccgttggtgtactgattggtggggggtttgtggcctccttttataccggcagtttctgcttgaacaattgtttgccaacttggcatgtccaaatttctgtccctaacatttgccaattttactaaccttttctcattttccagtttgtgccactttagccttttccgattttctaacattttactatttctttaatatcattcaaaatttgtcccattttaacatttgtttaaaatctgttatttcttttaacgttcaaattattcataa

SEQ ID NO: 76308 - DNA, 2454 bp, Heterodera glycines
  Genomic contig location: Contig_ID=SeqID_12635; Location=641..3094; Strand=+
  SCN-specific regions: Sequence locations=1-3,25-791,814-1114,1136 -1438,1460-2055,2077-2454
atgaagcacacaaagaaaatggtggtcatggttccggaaaccgaatacattgcgcttatgaacatagtgaagagtatgggtagccgaggcgatcctatacaagatgaaaaaacatcattagactcaaatatacataaaaatttgaatgataaaacaatcggagctgatattaaaatgaaacgacactcttggctgtacaaacggagacgtcaactcaaagagctgaaggaaaataaaccacagaaagtgatcatagaaggaaacccgagttctgcaataccaaacgttgctccatatatgggaattcataaaataccaaaaatagaaacagccgtagaacaagagaataagcgacagccgatacgatcaataagagcatcacgtaaaaagaaaagtgaaaacgtgtttgaatcatcggcagattattcttcggctacagaaggtagcagtagtacgccaatacgttcccaagacgtaaaattaagtcagaaaaatttttcaaaaattatgaatattattggaaaaaatccggacaaatttggaatcgatatgcaatcaggacaggttttgaccaattttaataagccagtcaccggatcgaattatactgaatcgctgaaattattatcaggtgaagatatttcttcgcctcgaggtcatacattttttgttcaacgtttgaagagggaaccggaaattgcaaaatacttatttaatttacaacagggtaaaggaaagaagagaagaactaaaagaaaactagtccttgtccaggttaaccctataaaaacccaaggactaaatagagaaaaaccaccatttaaaccagtgttatgggcaaaactatagaaagtcaacttgaacaggtttattacaacctaaattcgccggccagctacgtaggaatgcaaaaggtgctagcagaagcgcgaaaacgtatccccaacctaaatcttcacgatgtacagaagtttcttcataaacaaaggacttacacacttttcaaaccaaaaagaaacaaattcccacggttaaaaaatataaagacatggaacaacaaaagcgaataccaaaattcaaaattggtgatatcgtaagaattacaaagagaagggagacttctccaaaggatattttccaaattttactgacgaattattcaaaattgttcgggtaaactcgaccaatcctacgtcataccgaatcagtgatttagaaggtgaaaatataaaaggaattttttacgatcaggaactagtaaagactgttgctgctgaacagacaactcatcgagcagaaattttgaaatccagggtgcgaaacggtgttaagcaacattttgttcgttggataggttattcagaaaatcacaataagtggattaaggattcagatctcgttcgttaggcatggacgatttttatattgtactgccatcaaatgttccctttccgggaaatacggcatcccattttaccgtaagacttccacataccttagagcaagactcaaactggtccgttgcgctttcctccatcatctatccacactcgttcccttccgtaggggtggatgaggacgactttgtcaacataaaacttctcaatcctgactataaaccagaggtacaggtccgactactgtaactctgaaggtaaaaattccaagcatacagtttcacagcgtagagcatatgcaaaaatcattgaacagcattattcaatcggcctatgatgtaaagtttccaaaagaaaaaagggtaaaaagagcgacggctgcttctgcagacaaagaattggaaccagaaacgcgaccagaaccggataaggaactgacacgtgaagtgtcttcatctaaaacattggataaggaactgatacgtgaagtgcctttaccagcaacatatgacattgaactaccacgtggagatgagccaaaaccattggagaaggaaataggacgtgaaacaggaccagcgcaactttctgacaaacaattgggtgaattagaaggtgaaaaaccgcaaaaggaacagatgccagccactcccattgttgaacatggtgaaatatctacgatagaccaagtgcgcatggacttagccaaacgagtaacggaacaatcgtggaaagagaccgttaaattggctgctaatgcagccgatatcgcggaaaaggctaaaacagccctcaaccgagctgaacaagcccgcaaacgggcacctaatgctccacatgtaaagaaatggttcgacaggctatcaaatatggagaattatttgcgtgaacttgtggaaaagatttcacaagagtcgaaagaggcggccgaagcaaaacggaaattagatgtacattatgattcctgcaacaattgtttagctctccaacagtctgataattttttgtatcctatatttatgtataaataatgtataaccatccataggtacaccga

SEQ ID NO: 76309 - DNA, 939 bp, Heterodera glycines
  Genomic contig location: Contig_ID=SeqID_12635; Location=3245..4183; Strand=-
  SCN-specific regions: Sequence locations=1-885,907-939
atgaacagaaacaacctgaaacgattccaaatcaagcctctttcggcagagtccaaaggctccgaggagcagccaacttcacgcacgaaaacgcttagcgaagtcaaggagttcgactcggctggcactttttttctgcgtgcaaagcttgtaagcgtgttgttttgcatttacaaggtgagatggacaataaatccctgcgaatataactcttacatcattatgcttccaatttagtcctgcccaatgagaagtaagggtattccatgtcgtaagaaactcgacagtgaagacttttgtgtttcgtgcgtccaccgtgcgaaaaagcccagccgcaatttgtacctccgtgttgtactccaagattgtgatgacgaggaatgcgagcaggaaacaacagcattttcctatgcagccatcaactttttgagcattgccagcgtggaagctttttacaacctgtcagagaacgcacctaataagttggaatcgattttgcagtcaaaaatagatcaacccgtgctcgtcaaagtcaacatcaaggtgggttcatgttttttttgctaggtgtttatcccacattagctagtccattgtgttccatgcaaaaattatgtcagctaaaagacgcatattttaaggaaaataatgatacggcgaagcttgactggattatttcttccatatctgtggaaaaaccggtgtcggtgaaggttttggatgacaaaaacaacgatgatggagttgaggaagaggcatcttcaagcgagccgcctaagaagcgaaccaaaaacaatcaagtcgagcgtgctattgatgaagatgctgacgacatccatacgattgaatgacgagtgcttgcagatgtcaccaaagtggtcagagaaaaaactgaatggattgctgagctcagcaataattgattggaaacataataaa

SEQ ID NO: 76310 - DNA, 547 bp, Heterodera glycines
  Genomic contig location: Contig_ID=SeqID_12637; Location=2071..2617; Strand=-
  SCN-specific regions: Sequence locations=1-105,127-226,250-547
atgacaatggacgcacccaaagtgaaagtgagcgaaggaacgaagtcggccagaaacgcccacgagacgaaactgctcaaaagaatggacagagagacggcgaaaccctggagaaatcagcagaaaacagtggcaaatgaaaacgaaactggggagggaccgaccaccttcagaatgttgtccgcgtatttgacgacaagcgcaatcacaagcccaccgtaagcctacaaaagcaaaagcaaacaaacaccgtaaccaaactcaccgtatacctgcagtgcgataactgtccaaattatctgaatgtttggggattacgaaaacaaacgaaaaaaaacacgagtcatgcccaattgtatccgtggaaaaagccccactgctgaagctgagcccagtcgcaaagcaaagtcattgcaaaggcaccaaacatgctgaagaacgctgaaattggaaaatgaaaagggaatttgggaagcggacggaccaagctgcaaattgcaaacccaaagttggactcgcgaagtctttaggattttctccaaataaa

SEQ ID NO: 76311 - DNA, 514 bp, Heterodera glycines
  Genomic contig location: Contig_ID=SeqID_12637; Location=116..629; Strand=-
  SCN-specific regions: Sequence locations=1-514
atgctcacattcttgcgtcattcaatcactattttcatcattgtttccgatttgcccattgcgttaaagaatcgttctgtttcttcctctttcacagaaaacaaaagttataagtgtggcaacatcattatggagaagaagatagtctacttcaaactgttgcaatttgtgctcactttgaccatcatttggcaactcatttcactgcgccaattctgcggcacttttgccgacccaaaagtcaattgcatttaaattttaaattccacataaatgatccataaatgatgtgctttttcagaccttcctctgtaaatccattggcaattgcgattatacgctcattggacaggactcggaaactggcgaatttggctcaatgttcaacaaattgtacaagcaattttttatgaacagcaccaatagacgaacaaccggagaaccgaaatacgcattattttacttcttggtctcaaaattgcctcccgccggacaccattgcattccgatcacg

SEQ ID NO: 76312 - DNA, 301 bp, Heterodera glycines
  misc_feature (300)..(300): n is a, c, g, or t
  Genomic contig location: Contig_ID=SeqID_12637; Location=3111..3411; Strand=+
  SCN-specific regions: Sequence locations=1-123,166-234,256-275,297-301
atgagagcattttgttggaaacattccctttatataggcccatatagcattgaatcggtgtgtaaacgaatggaggaaaaattaggcagtgtgagaaaatgtataaaaggcaacatttccactcttttaaaaaggggttttggttttaattagataattacttttgccaaattttcaggacttttttgaattatggcattaattttgaaaaatcaaagttttttttttcaattcgttaaacttattttctttttccaaaagtgtccattcgtcgtcatcccttcgcttattttcccccana

SEQ ID NO: 76313 - DNA, 1121 bp, Heterodera glycines
  Genomic contig location: Contig_ID=SeqID_12637; Location=1154..2274; Strand=+
  SCN-specific regions: Sequence locations=1-369,391-1121
  Gene Ontology: Mol. function=UDP-N-acetylglucosamine transporter activity; Cellular component=membrane; Biological process =extracellular carbohydrate transport
atggctgtcgtttcctctgctaaatcttcttctgcccacaaatgggtttcactgattgtgctcattggccaaacaacggcgctcgtgctgactttgcgttattcgcacacccaaaaatcgtatccctccgacgggcccaaatatttgtcgtcgactgccgttttgatggccgaaatagtcaagtttttcacatgtgtcgccgtcttagggcatcagaacggatggaattttggccgtttgttgcgcgattttgactggaaagatttgctgaatgtcggcgtgccggcgttactttatgtgaacggttgcggcttttcgtccattgtcagcagttccctccttttcaggttgtccaaaagaatttgctgtttttggccctttccaaattggacgccgccacttaccaagtcaaaaaagtgatgcatttggcgaaccgttctcccattttatttaggtcacttaccaattgaaaattctgacaacggcctttttctcggttacgatgttaaacaaaaagttggacctcatcaaatggatgtctttcattttgcttacttttggcgtcgcacttgtccaggtgactcggaatgttcctccggcacttccaaagcgcaaatgccaccaccctttgtttttaatttatgcgagtcgcttattgctaaagtattagcatttgcaattagtagctaataaccacaagggaactgctggttcggaaatgaattcgctcttcgcaaattggattttccaattttcatttgaacttaaagctcccaaaaagttttccgaaagtccgtcactcgctgccgatgaaaacgcatttggtgctgacaatcggccgcaacaatcgaccggcgatggattcgtcggactttgcgccattttggccgcctgctgctcaagcggatttgccggcgtttatttggagaaaatcctaaagacttcgcgagtccaactttgggtttgcaatttgcagcttggtccgtccgcttcccaaattcccttttcattttccaatttcagcgttcttcagcatgtttggtgcctttgcaatgactttgctttgcgactgggctcagcttcagcagtggggctttttccacggatacaattgggcatga

SEQ ID NO: 76314 - DNA, 1182 bp, Heterodera glycines
  Genomic contig location: Contig_ID=SeqID_12639; Location=160..1341; Strand=-
  SCN-specific regions: Sequence locations=1-52,90-421,444-477,499 -591,613-1057,1079-1182
atggtgagtgttaaattatcgggggttccaggaccccaatcgaggaattgcctaaattttgtataaataaaaattcccaattttttaaaagtggtgatcggggaggggctcaacggaatttcttaaaatcatctgtttttaatcctcaaatatttgtttcccaaagagtttcttccaattatgaatattctaattctttcataattgcttctgttgaaccatttctaaaatgccaaaaaaggtcatttttatggcataaaaaatcccagcccaaataccgtttttactgaattagaaccacgggggttactaattcagtaaatactgaaactaaaattgaaaaagatatccaaaaaaatattttcaaatttaaaagcacaaggcacttcacgcttcttcttctgttgttctctgaaacatttcttctccaaattgtttcttccattttgaaatggtcgatctatcaattttcatcattttggcaaattctttatcaagaatttttgaatttttgctttttattttccaataaatttttattttttccattttttcttcctccattagtcttttcttgctaatgccaaattgtttattccattttttaattatgaaatggctaactccaattttcttacaaatttcatcataattttgttgccattcgatgtgcgaatattttcttttttgcttatattcgtttgtcagtttaataaattttttgacaatttcaattttttcttcatcagtttttaatttatagcatttcgttttttgaagaccaaattctttgatccatttataaatataatttcgatttgtccccaatttcttcgctattttttgttcaatttttccccattctttttttgagaattttcttcctttttgcttaattttctcttttattttataaaattttgcaattatttctctttttttgagttcattacgtttttcttcttctttttcttgccatttttctccaaatatttcgccaaatgacttttgttgcaattttttcttttctgatccaattggaataattagggcaatcaaaaataaaaataataaaatacagaatttcattttcaagattttattttatttttcttcaattaaatggcaattcattttttgaggcatttaaatgatttttttctgattaaaaaactgaataaa

SEQ ID NO: 76315 - DNA, 465 bp, Heterodera glycines
  Genomic contig location: Contig_ID=SeqID_12640; Location=145..609; Strand=-
  SCN-specific regions: Sequence locations=1-465
atgatagataccatgaattattatttgtgtgtttatgacaagtcatgcatttttatatgtcacattattattttttatgcccacgttggcggatttacgaaatgcccacgttggcggatttacgaaacgcccacgttggcggatttacgaaacgcccatagtggcggaatttacgaaatgcccacgttggcggatttacgaaacgcccatagtggcggaatttacgaaatgcccacgttggcggatttacgaaacgcccatagtggcggaatttacgaaatgcccacgttggcggatttacgaaacgcccacgttggcagatttacgaaatgcccacgttggcggatttacgaaacgcccatagtggcggaatttacgaaatgcccacgttggcggatttacgaaacgcccacgttggcggatttacgaaatgcccacgttggcggatttacgaaacgcccatag

SEQ ID NO: 76316 - DNA, 1064 bp, Heterodera glycines
  Genomic contig location: Contig_ID=SeqID_12641; Location=396..1459; Strand=+
  SCN-specific regions: Sequence locations=1-641,665-706,755-910,932 -1064
acaaagatttacaattatttgaagccaatgcattcattgtttaagcaccaaggagcggctgagctgtgccgtcccctccctgtatacggtatgcaagcatctccgctgtaccgtaacggaggcgttggccgcgcacgcggacagtggcggcaaattggtggtgccgttgctgttggcacgggacgaggacggcattttgtacccgacccctcacacatttccctaccaattgcagatgccggcggtgcaaagcgaaaggcaaaaactaaaaaaaaatccgccaattaaaggcctcggaaaatttatcaaaaaatttggtacttttttgagggattttcggggttgctgactgattatgaatatgacatccatttagaccaattttcgaaccccggacgagaattcgaacaaaaagtcgaaactccaaattttcgactttcacacttttttgaatttttgactttttgtccgaattcgggttcggggtttgaaactagtcgaaatggatgtcatatttgtgatcagcgaccctgaaagtcattttttattcatctacataattgcgtaataaaagaatattttttttgtaaaacccgaaaaaactttttttcaattttttgctaaaaaattgaaaataaaaatgaggggatttctgagtttatcataaaaacttttcttttttttcaaaattcatcatcacgaatccaaaaataaaaatttaaaataaattggcaaaaaaaaaaaaaaaaattttgcgccatccctaaaaatttcacagaaaattcgaaaaatttcggcgcataaaaaaatgctcccccaatttttagttcagcggcgacaatgaatggtggtggtggcaccgcaaaaatttgtgctgctgattcctcggcacttgccaaaaatggcggcacattgtgcagtttggagggaaccgttccggaaaggtacaaaaaaaacaatttgaaaattcgaaaattttcatttttttcaggtttttcgcggaaaaccgcagcaacggaatcggcgaagcccaacaactgttaatgatgcacaatgccaattga

SEQ ID NO: 76317 - DNA, 116 bp, Heterodera glycines
  Genomic contig location: Contig_ID=SeqID_12642; Location=677..792; Strand=+
  SCN-specific regions: Sequence locations=1-116
gaatggtgctttgcgagcgaacattttcactgtcagagcctttgctgcccgaaacaatcaaattcatcaaggagagcttggaaaagcaaggcgaactccatttcgaattgccccat

SEQ ID NO: 76318 - DNA, 1182 bp, Heterodera glycines
  Genomic contig location: Contig_ID=SeqID_12643; Location=453..1634; Strand=+
  SCN-specific regions: Sequence locations=1-498,537-634,710-857,880 -1182
atgcgtaaacgaaattacttgtcgacaccaatcaaacaacaaattattaaagcaaaggaggcaggtcaaactgatcgagccgtctccgagcagttcaacatcagcaattcgactgtttcacgggtgtacgcgcggcacagacaaacaggcgacatcagcacaaagcccaagtctggacgtcctcgaaaaacatcggaatggcaggacagggcaatcgcaaggcaattgaaattggatccaaacaaatcggcgtctgaagtggcggcatgggcgcgtggcactttcggggtcaaaatgagcagaaggacggcatgcagaattttaaaacggcatgggctgtatggacgaaggccggcaagaaaattctcctgaccaccaacttttgtttctcaccaaaaaaaggggggttgtttgggtgatgatcaattttctcgacgacaaagagagaatatcggggcacttcctggctggacgtacagccaaatggagaaaaaatgcaattaattaattgaaataattaaaatgaaataaataatgtagagaacaagcattaattgttagcgcaattctagagttttggtctaaagttttgactttcaaaaaaacgtatgaacaccgttttggatgattatgcttttttttatcaatttgaaaaaaatattaagtcttttttagagttaaatatttttttaaattattttcttaaaatcccttttttaggtcactcggtcgcacagccacgcgccgtcctccacccgaattgaggtgctaatcgccaaaagtgacatccgtcgggcggcagtgaacgcaattagtgcaacgcctggggcaatcgttgccaatgcgctggagggcatcagcgacgcggcaaagcatcagttgccgaagattgccaatctgaaaaagacggccacccgacaaaggaagggcattggggacggagcagcgggtgagaagggaaacggactatttttcaaaattgataaaatcaaatgaaaaatggaaaaaattttcattgggattcctttcaaattaatgatcacttgacaattagttacttcctttaagaaaatccgctgccaagcagagaaacactgcgcaaaagattggtgcaaaactatcgcaacggcagtcaccgacggacaaccgttacagtaccaatgccacaaacatcgcattacg

SEQ ID NO: 76319 - DNA, 1351 bp, Heterodera glycines
  Genomic contig location: Contig_ID=SeqID_12644; Location=344..1694; Strand=+
  SCN-specific regions: Sequence locations=1-267,289-395,420-880,906 -1169,1194-1351
atgctcagttcgttcgtcagccaattggaggaggtcgacgcggtgctgcggaacagcgaacgcagcggaggcggcggcgcggaaatggcggcgcaaatgcggaaggaattagaacacatttgtgcccataaagaagatttggaggcgtatttgatggccactgaaccgatcgtggaatggatcgaatttttcgaagtgaatcatggaggaaaaggggacgagggagggagtgacaagcagggagggcggtaggtaattagcggaattaaattacccaatagcaaatgcgaggggagagggagtatttaggtgaattaaattatccattaggagatggaaggggagaggggtgttttttgaggggagagggggtgttttttcaaaattcctgaaaaagccaacaattttctccaatataaaactcgactccctctatttttttccctagatctttttttaaacattttttaagtttagctttttcccaatgttttttaattactttaatttttctttttccatcctttaatcttccggatcacttaaaacgatcactttcattcacttgcatttgcctcaagaaaacaatttccgttttaattaatatcatacataagtttatgatcattttaacagtgtccattcaattatttataataatttcaggaaagtgatcagcccaccatccatcgcgcgttgcccgcgttggcgggcattgaaagcggactgaacacgctgcgaatgttggccatccaaagttgtgacgggaatggcacaaccaataattgtcaaaccatgtccaactcggcggtgcttcagcgcgaactgtgcgaagcggcactggacgcactcgactggaacatctctccgctgaggggcgcgaagagtgagtttttacagacagcgaacggttggcatttcctgccaaatttttactcggcaaggacagcctgactcaaggaaaattattgaatattttatattgtcatttttttccaaatgccaatttaattagctgctttgactcattaataccattaagctgttcctaaactaggacagctgtgccattggagaatggaaatgggattaatgatttgcccaaactctgaatttgaacgccgaaagcattcatgcttaattaaaattttgcttgatagtgcccgcaattcattcagtcaacaagcatttgctgtgcaccgctgccgcattgaacccgagcgcgtggcgtcgtgaattgcccgcggtgttcgccaaagtcgcgcgttggacagaggaggaggtgctaatgaacgcagaaattaaaaatggaattctgctgggagttggccaacaggagaccaccgtgtag

SEQ ID NO: 76320 - DNA, 898 bp, Heterodera glycines
  Genomic contig location: Contig_ID=SeqID_12646; Location=713..1610; Strand=+
  SCN-specific regions: Sequence locations=1-898
atggagccggacagagccatggaaatgctgctattcaacacggacatagccatgaactcaagcagtagcagcaacgcaagcgaaagcgaagccaatggagccgaaacggtgccacaaacgacgggtccgaacagtggcagcagcacaaccacagcagcgattagagagggcgaggagccggaacaacaggcggagctgtactacaatgaacggttcaacttcgacgacggtgagacgcttttttgaaatggaaaatcgaaagcattcatttggagtgagtggcatggaagtgatcgagtggctggagaagggactgccctaccccatcctgcaggtggtcgagtacctcagcgtggacaggaccggctttctgtggggcaagcagtaccgactggccgggtactacactcacgccgtactgtggtgagtttggccggacaacggattgggccataaaccaaacatttggccattgtttcgctttgtcctcgagtgatcactcctactgattgatctgctctttcccattttcaggttggcatttgccatttggctgctccaaattgttcttttgggtgccctcccccaccgttttggttcggtaagctcaatttaacctttgtctcgtccatttccaatttcaaattcgcttaggtagcatttgcctgcggtttggccattttatttgctgatttcgtttacttttgtctgacccccggcgacctttttttggtcttttttggccccgacgaacgttcccatcgcctcactttccatcccgccctgtgcttttacgcccctttgggagcaggtgaaaagcccaaatgattttacgtcaattaattaatattaattgattatttcagtgaaaacttcttatcttcaataaatttaatta

SEQ ID NO: 76321 - DNA, 203 bp, Heterodera glycines
  Genomic contig location: Contig_ID=SeqID_12647; Location=1..203; Strand=-
  SCN-specific regions: Sequence locations=1-8,32-203
gggggaggagaaaagaatgaaatgaaatgccatgtaaaatttaaatttggcattttgacgacggtttgccttgacaatggactgatattttgttggcatttgtcctttctcactttacttcgtcgtcgagaggtgacagcttttttcattcagctggagcggaacaaagtcaactcactggcagaaaggtcaaacccttccgg

SEQ ID NO: 76322 - DNA, 687 bp, Heterodera glycines
  Genomic contig location: Contig_ID=SeqID_12648; Location=2370..3056; Strand=+
  SCN-specific regions: Sequence locations=1-551,597-687
atgccacaagggattattatgaacggaaaggcattggcggcaaagtcggcattggcggcgcaaaaagccaaacgcgcgagttggacgaaaactttcgtgccattcagcgacgtgtgtgccgacgacggcaaacggtggcgccggaaggcgctgaggttggtgcgtgaaaatgaaattgaaatgacatttcaaatttggacaaaaaaaaatcaattcgcaaataaatgcccccaggggaaaaaagtttttccgccaaaaattatatttgatttgcattttgagccaaattttgaaataataaataagttttaggttaaaagtgccgacaaatgtcattggtctagattaaacaatattgatatcgaaatgttttaattttttccatgtgtttcttgttaaaagatttttgggtcaatttttaaaattttagcaaatttttggggatatataaggccgcacctaaaactgacaattttatggcatatatcagttaaacctcaccagataagtaaaaattatttcccagtctgttgatcatggccaatcatcgcgctctgctgatgctgatcagcaggagaacaacaacaataacaaccgaagcagtagtggcgccgccgcaagacggcggcggcgccaaagtcggcacattgtcgcgcatgacaacgcgggggacaaaatattcaagca

SEQ ID NO: 76323 - DNA, 778 bp, Heterodera glycines
  Genomic contig location: Contig_ID=SeqID_12652; Location=42..819; Strand=+
  SCN-specific regions: Sequence locations=1-430,453-750,772-778
acggtgtcaactgatcagacgaattcggccacatctgaccctcgtcctctgcccgttgtcaccgagtcggtgccggtgagtcaatagcagttactgaaaaaatgtaaaaccctaacaattttaggaagaatcgacttacgatccgccttgggacgaccgccctctgcgtttcatcaaaaccatggctgctttgcaatcgcaccgatcaacaaatgtaattgatatctctcctatctttagttgctttttaaatgttctcaattaatagcaaatttatttttcttttattgcatttttgataaattgtgtttattttaggtgctgcccactgttccctcaacatcggccgattcggaccctcgtcctctgcccgttgtcaccgagtcggtgccggtgagtcaacagcagtttcctcaattgcaaaattttagaaaaattttcaattttgaaaacagcctttgtaaagtgtaaaaatgtttatctgttgaacaatggataattttgaatttgttttggacccgggcccagccattttatggccgtcttgtttttattgaatcgcagtgtaatttttaatctttcttttcgactattaaaatcgctcattttattttagacatccgatcttactgcccttttcgcggagtttttgcgcaccaactgtgttggacatgtgcccaaagagtttcttgtcaaccatctggaggaggccatcaaaattttgaaccttggcggcggacaaagcgacgacaattccaaaatgtccaagtttcgcaag

SEQ ID NO: 76324 - DNA, 604 bp, Heterodera glycines
  Genomic contig location: Contig_ID=SeqID_12653; Location=99..702; Strand=+
  SCN-specific regions: Sequence locations=1-146,182-221,243-604
gaagaatcgacttacgatccgccctgggacgcccgccctctgcgtttcatcaaaaccatggctgccttggaagcgcaccgatcaacaaatgtaattgatatctctcctatctttagttgctttttaaatgttctcaattagtagcaaatttatttttcttttattgcatttttgataaattgtgtttactttttggctgccctcctcaaaacggtgagtcgacagcagtttcctcagcaaagttttataaaaattgtcagattttgtaaacaaccaaaaaattactagcctaattcggtcgtgttttatttagatatcggatattgttgctcgtttgacggctgtcgtggacgccaacgagcttacgcgtttgccccccgacgttgtagggcacctggatgcggctgttacccacttggaggcatcagctcaacggctgaaccttggcggcggacaaagcgccaacactcccaaaatctcaaagttccgcaaggtattgtttcattcattactcaataatcgaacaggacgggcccaatggggttttaccgggtcgccgggtatcactttcttggaccaaccaccgggaagggccgcccgataa

SEQ ID NO: 76325 - DNA, 928 bp, Heterodera glycines
  Genomic contig location: Contig_ID=SeqID_1844; Location=249..1176; Strand=+
  SCN-specific regions: Sequence locations=1-905
atggaagtgaaaaatggtcggctcaaccaacttgttgtcctgcagaactccgatccctcaaaatgtgcaactgtttattctgcgagtctttcattgtcggtgagttatacgaacctataaaagcatttggccattcgtcattatttgctttgagggattattctgtctcctctcacaatcagtttcctagcaacgtttccttccttatgtgagggaacaattacaacattcgatttactctttataaggccttttttggaatcttattatttagcaccttgaaaaatgtggcatttcgaccaattcgtgcgctgagttggaatgcatctcatcaaaaataccccaacaattttcaacgattgcacttggcagtgacttattggacaaaaaagaggaagatgacttttctcccgaagctgctctctcatcaactccaggctcacttttggacagtctcgtaattgaccaagacgaacaagacaatgacaagggaatgaccgaaacagagaccaacaaacacgaagttatgtcacgatctttgacggtgactcggattgtccgtgaaacaccctcacttcttgccgtttagaaatcttcggttcagatgccaaatagcagaagaaatgcttctctgtcgcaaagaaatggcgcttcatcttcgtctaatgatggaacgcttgtaagaagcgtttttttacagaaccagactcacaatcagtattcatgtaaatgtaataggtatttcgagatccaacgacgcatttacaaaggccgagtcggctcataatcaatgaacataaaaatgcaagccaactttgttcaaacaacaacgacaggtatttaaaaggttcccgggacatttgtcaatggacaatccagcagaaaattgattttaagaactcaatattttattccaacattaaaaata

SEQ ID NO: 76326 - DNA, 64 bp, Heterodera glycines
  Genomic contig location: Contig_ID=SeqID_1844; Location=48..111; Strand=+
  SCN-specific regions: Sequence locations=1-64
ggcttcgattcgttgggaaccctttgaattggtttcgcagttcgacctttcgcatcagctgcat

SEQ ID NO: 76327 - DNA, 207 bp, Heterodera glycines
  Genomic contig location: Contig_ID=SeqID_1845; Location=490..696; Strand=-
  SCN-specific regions: Sequence locations=1-207
gagccttcgactcaataaaccattcaatgtgtccattcaaactcgaaaacttcggtgtgtatcttcctgcatggcataaacccgttactaaccgttacgggaaacgtaatattgagggatgggattgcggaatcaaaatgtaatgcatcttaaggtaaacgtgtggtaagagaggctgggggcatggaggtccccggagacacggag

SEQ ID NO: 76328 - DNA, 680 bp, Heterodera glycines
  Genomic contig location: Contig_ID=SeqID_1845; Location=2461..3140; Strand=-
  SCN-specific regions: Sequence locations=1-67,89-680
gtacaagcgacttctaaagcatttaccgatttgaaagaaaagacacaaaaacttgttgaagctgagcaacaaaagaaagcaaaagacatgcctaaatctcagaaagcaagcgactcccaacgacaagtgaaaactcacaatagcttcttggcaaaatatgccaccaaacgaacgcatagtccgtcgcccaatttaactaatcggctaacaaacccgtcgtctgtgccaatcaaacagcgaaaacaggcggaggatgcaacaaaattattaccgaaaaagatggttgtttcacaatcgaaagaaaggatcgaaccacatggttttaaagtctgaaactaattccatttcttgatgcttcatttattacaaattaaggaacgtgccaaagtcgagacattgtcaaaggaaaccatcaaaactgaaacctcaccgaaaaaggacctgttttacattcccaaaagaaagccgttacagggcgctccatcaatctcaccggcttcaactgctacttctactcccaagacaatttcgccacccatcgtccgtcctccttctgtggaaagcaccctccaacacagttcttcatgctcaccggaagactcatttgggtcaatgactattccaacgaaaccaacaagggactggtctcgggaatttacaatgatcctaaaccaggatga

SEQ ID NO: 76329 - DNA, 936 bp, Heterodera glycines
  Genomic contig location: Contig_ID=SeqID_12654; Location=966..1901; Strand=+
  SCN-specific regions: Sequence locations=1-279,303-506,528-746,776-936
atggcgccatcaattcttagcgaatgtccatcacttcgttttgtcattttttatgccggtgatctcttcgccgaattccctgccgatgacagtgccgcggcatcggatggacaaatgttggccaaatggcttttcactccacgtccggacgatgtgccaaaagtgctcaaatgctggttggacactgatgatgggaatttggcatcgaagattgaagccttcaaagcggtgcttactaataatttgtttatttggcactttggtggtctttgggattcgttgataaatttttataaatttttcctcattttaggcatttctcgatgcgtcttcccccgccaatttcatttttgtcatttggtttccgccgtctgctgattccgttgtgccatttgaactgatcaacgaatttactcgtgaacaattggcattggaaaggattaacaatagcgatcgttttctgctgatccgttgtccaattgtacgaaatgcgagcaaatggacaaaatgggagaaggaagcatttaattggcgaatttatgatcagcggaacagaattgacattgaaatttataatgaggatgacatcggcgatcggtcagcgaatagtttttcaaatttgtttatttcatttttatttttaggcttctcgacgaaattcccgacccgagtgatcagcagaagtgaatgaatgaattgttaagaaatgatcgaccaatttggattatggaattattgacgtgatcataaacattgttttcttttttgtaaattggactgttcatgtttggttatgttatgtcattatgatattttgtggttttctaaaacaaaacatacgcttcaattttcaatattttccccagcaaatgtgttggaatgatcaacttggatttgtgttattatgtcattaggataatttactgattttctgaa

SEQ ID NO: 76330 - DNA, 863 bp, Heterodera glycines
  Genomic contig location: Contig_ID=SeqID_12654; Location=2658..3520; Strand=+
  SCN-specific regions: Sequence locations=1-524,546-863
atgtcagaccgccgaaaagaagcggaggcaaagatggcaaaagcaatgtaaaataattaaaaatgccaattttcaatttcgattttaaattttgtttcctttttttcagtttcatttccgccgacggttggctcaaagtgttcgatttgctgccgccttcccaacttggacttgaaattgcgacgatcagccaccgttttaacgcctacgtggacgaacatttcaagacgcgaaaatgggcgctgaaatttattcaaattcgacgcgaaattggaaagaaaggcacgaagaaattggaattggccaatttggatggagaaaaattgccaattccgaaaaagccgatgccaaagaaagtggtcggatttgaagcaatttcaataaggtgagatggaagaattttgttgttttcaaatgtgtaatgccattttcacagatttgtcgacctaaataccctctcttttctgcgccgttttcgtcgtcttttcacctcctcgccaattgtttttgccatcggttcgacgagtgagcgcattttgtttttgattttggaattgatttggccaatgttcgcgaaaaacattggttcgatgtatttgatggcggacactttcatgcgtttgcgaatattcgaagcgtcatttctcagcaaatgccaatctcttcgcattgtcaaattttgcgatgacgacaatttcttcatcgaattcccggccgatgaccatgccgcggcatcggatggacaagtggtggccaaatggcttttcactgccctccctgacaatgtgccgccgaagatgttgaaatgctcgttggacaaggatgatggctttttggagtcggacattgaagacttcaaagag

SEQ ID NO: 76331 - DNA, 2942 bp, Heterodera glycines
  Genomic contig location: Contig_ID=SeqID_12655; Location=520..3461; Strand=-
  SCN-specific regions: Sequence locations=1-112,134-449,472-656,688 -972,1014-1365,1398-1408,1430-1634,1661-1711,1754-1971,1994-2142,2170- 2472,2496-2581,2624-2710,2751-2846,2883-2903,2925-2942
  Gene Ontology: Mol. function=amiloride-sensitive sodium channel activity; Cellular component=integral to membrane; Biological process=sodium ion transport
tgcacaaagcaaggcgtcaaagctgaacatcaacgtgaacgcgctcaacgccctcctgcatacactgaactacaccatgcgaccgggctgaatttgcaatgtattgcgttgtcagcatgtccataaactgtcataatgccccatattgtaattgtcaataccccggatcacttgaagccttattttagccaactctataaattgatttcggtctgatcacttggattcttaaacagaatttgctttatgagatttacgctgatcaatgcgtgcaataagttttattttcgatttattatggagagaatgctatttcgaagttctgtatcataaaaaagtatagactttttactttcaggtgccgataaaacggctctaggaaaatccgacactggaaaatccgacacaagcagataatccgacactggaaaaaccgacattacaccaactttaaatttaaaaattttttttgattgtttgggttaaactagagctgcgcgggtccgggtacccgaccgggtcccatacccggatacccggttttttcactacccggacccggttttttgaaaatccaatacccgacccggtaggaccgggttcaaccgggtataaaatagactggcaagaatgggggtctgggtgaaagttgagggaaataaaaaaattgattaatttttttttatagcaataggcttcgaaattggttttcaaaattttattacttgacaaaaatttctcttttagcttatctggtgaacttgtcgaaaaaattttgattataaaagcgaatttggaccagcttttgcttgcacctaatactcaattgcaggaagaggatgatgaagcggttgatgaggaagtgattgtcgatgaaaaccttattgaagattttggagaataatcaactgcttatttatgaagatttttgattgaaatatctttttagtttatattttaaaggcattttggtaattattttgaaaaaaaaataaattgaaaaatttttaatacccggttttacccggacccggacccggtttgaaaactggtacccggcttttcaatacccggtaatacccggacccggtttttgcccaaatacccggacccgtgcagccctattatataccacctacgcattaagagaaattctttccatttttttgtcgctgtgttttttggttccacaatgatgccgggcgatgacctgaacctgttgaatatcagccatctgactgaagtcggttggcacattccattgttggcataattttatagcgcagaccataagccttagaagcagctcccccccccctttcatatatttcctttggaaatttttttaataagaagtttgaagacaaaaaattaaaaaaaatttattgaaaatttttgatgatttacaagttttttcaaaaattcttacaaaaatcgctagaaattttttataaaatcgggtggcggggaacaacgatacagggcgaactcgtccgcgaggggggggggaacgtattggatcctgtaccggaacctatttgcttgcgaattttcattggattcgtattatttttagggggttcgacgccgtggcgaagtatcccaagctgtggtgttggcactgaagacatatgaaaccagcaacagcagcacaaatgacacggaagagcagcagatcattgagcaagccatgggctttgaggtgtaaaagatttaataaatcttttttttaattaaaaaaaagattttttttgggaattgcacgacgaaattgcgatcaaaggccaagcgcgcgaaaatctgatttttgcagtggaggaaaagccattggatgaacgggttcgcctctcgcaagccaaggacgagttgatcctcaaatgctcattcaatcaacatgactgtgatattgaaaagtgtgaatttttccaaaatttactgtaataccgtaaatgaattttctatttttttatgattaaatttatgaaaattcataccctcatcagggacttcaagttgttccacgatcccacctatggcaattgttacaccttcaattgggaccgtaatgctcaagtgacggcccatcgggcaggcgccaattacggtaaatacagtacatgcaccctattagattcttgcatgaataacaaatttaaaaaattaaacaacgtattaggccttcgtgtgctggtttacgccaacgtgtccgaatatttgcccatcacagaagctgtcggctttcgcatcactgtgcatgacaagtgggaaagattaggcggggtggggaaatagggaaataaaggcgcattaactgactaattcatgaacaattttggcattgataaattaactcaattattttgggcacttttccgattaattttggtaattgatctgctgatcaaaggtctggccatttattaatgagcctctgattaacttttggccctaataatgcttgctgatcggtgatcactttatttcccagatggactgtgccgtttgtggacgcgtttggttacaacgcacccaccggcactttatcagcatttggcgtacgtatggtatgccaaaaaaatgcttaaaaattaaaaaataaacaattaattaagaaaaaatttttccgcctcgagcacccatacggacattgccgcgaaggcggagaacgtgccgaatggtacatctacaacaaaaaagaagtaggcaaaagaattaattaataactaaatgattttaattaaaaaaattttgatgcaaaattagtaaactaataattttagaattacaattattcaatcgaaggttgtcatcgaagttgcacacaacgtgaggtgcaaaatatttgaaattagccaattaattaataaaattaattaattaatgagtatgtgtatttgtaggttgtgcgcgtttgtggttgcgcagatccaatgttcccagtc

SEQ ID NO: 76332 - DNA, 774 bp, Heterodera glycines
  Genomic contig location: Contig_ID=SeqID_12657; Location=13..786; Strand=+
  SCN-specific regions: Sequence locations=1-13,44-742,765-774
atgaacactaaaattgtgctttttcttcttctcccacttctcataattggttgggtcacgccgacaaatacgacgaacgaaaagcggaccgataagggaaaaggattacaacgaagtgcagaaggctctgcctttagcgcttatattaaatccgcttttcgtccgtataagcaaaaagacaatggcaaaaacgcgaagaatgaaactgatggccagcagcgagcggatgtgataggagacaatgagaagttgcaagcggttgcggcagaaaatgttgatgaacagcgcgcgtatacaacaggagacaatgagctgttgcgagcggtttcgacaggaaacagtgagcagtcccgagtagttgcggcacgggatgatgatcagcatagagcaatttcggcaggcggtgttgatctgcaagaaatggatgcggttgccgaacccatggacgtttcagcagatgggtcgcgcagtgcgaaaacgcaaaagccaagcggcggcggagacggaagcacgacgtcgatgcgcaaaagcggtgtaaatcagtcgtcgcttggccggcacgaggacgcgcaacagtccagcgaggcgacattatcagcggacacgccaaatgcggggaataatggcggcgccgaaaatgacgaccacgaaatggccgagcgggatggcgaatcgcagaagaaaacgccgaagaaaaggcgtttaatcaaacagaaaacaatggaaaagtccagcaaacggtccgctgccgaaaagaaaaagaatgtggacagt

SEQ ID NO: 76333 - DNA, 1919 bp, Heterodera glycines
  Genomic contig location: Contig_ID=SeqID_12658; Location=189..2107; Strand=+
  SCN-specific regions: Sequence locations=1-176,198-223,300-477,549 -890,946-1102,1126-1302,1325-1560,1582-1834,1891-1919
  Gene Ontology: Mol. function=transcription factor activity; Cellular component=nucleus; Biological process=regulation of protein activity, epigenetic
atggagcgaagtgtgaattcgaaccctttcaaaagtgcagaagatgcgccatcattagcctcaacgagccaaaacaatttgctggaagcgcaagtcaaagagcaggccgcacaaattcaaaaactgacggaagttttaaatgaactacagcaaaaagtgaatgttggcaaagaggaagggcagcagagcacacaacaacctcaaacagtagcagcatcggtggaacaacaacaacaactcctacaacaattacatctgtcccaagagccacccgaacaacttggacaacaacaacaacagttgcccatggcacaacaacaacccgttgctgatgttcctttgcagccacaaaatgccgccccattctcagttgctcaacaatcgcaaccacaaccatttgcctctgttctagacccaattactcgtcagcgtctttcagtccgaatgataacagctgggcaactgttagccgatcgtcaacaacagcaacaacaacaactacgaatacagctacaacgacgaatgcagctacaactgcaacaacaacatgagttgatgggttcgccaccggcgtcacgttcgtccagcccaaaccgactgaatatacaacatttgcagcaacagcgaccacagccagccgctagacccctgacaagttccaacgtaagcaaccggctaatgtcagacttataaaaaaatacttacaaaaaatgaaaatccccggatccggaaatgtaataatagagttggatttaaaaagtgctataataaccgcccaaaatttaaaaaaattttcactagacttccctaaatatgaaaactttcctatcaaattaaaaaattgctaaaaaaatcattgtattttaaaacgactcctgttttccctcttgtaataaatattttaattgaatattttcataaattattttttttttattaaaaaatcgggttttaaactatttatttgtttttgtttttaaattattcatgctttgttaaatttttttaacgttttgggattttttgtcaataaaagctgaatgtaatataataaaatttttcaaaatcatagctgtccccgatatcaaacgcgcgacgtgccaaggagcagcaacggaagcaacaacacgatgctggcaccagcagtgggtcggttgctggtgaagtgcaacaacaatggcaacagccgcaaggtgactatgccattgatgcaacaccgctcagagcgtctataccccttcgcgaaggacaacccaaccaagttggcacttctggtgccggtccgtcgggctacagcggtgatcagcagcagcagattcaacatctgcgcatgagtgccaatgtaggcggaaatttagtcgagagtcaaagaagacattcgagagttgaaaaggcaaaagtaatgttgttgcattggtaatttattcaattaggataaatcgttttaaaaaagtttaatagccgtcagggctttcgctttcgcaaattttgtactctcgcgtttcgcatttaggcatgaaatgcgatattacacactaagaatgagggatgaaattcccctaaaattttcaaatttggccaacaaattggcaattttcactgaaaaccttattaaaaatgggcaaaatttccaatttttcaccgatggcgtctaacggcaccgcaggaccccaaaaactcatatttttttttaccaaaatggcaaaatttggtaatttttggcggaaatctgttaaccaattgatttattttcatttcgcttttttgcttgcgcaaattacgctttttgcattttatttttcgatttggcccatccctacataaaagatgcaccaatttatgtttttaacttttattcatataagtttttttattttatttttttaaattgattcactaattgagaacagaaaatccca

SEQ ID NO: 76334 - DNA, 777 bp, Heterodera glycines
  Genomic contig location: Contig_ID=SeqID_12659; Location=46..822; Strand=-
  SCN-specific regions: Sequence locations=1-337,360-547,570-577,600 -667,690-697,720-777
  Gene Ontology: Cellular component=actin filament; Biological process =intracellular protein transport
atgaatgataaaatcgactggctcggccgcttcgcgccctcgcatcattttcttggcttttctccaatctctgggactcaacccaccagcaattcaatctctgggactcaaatctgcggcattctaaacatccaccatcatttaatcactgggactcaacccaccaacattccaatcaacgggactcaaccctccagcatttcaatcattgggactcaattctcccgaattcaaatcagtgggactcaacccaccaacattccaatcaacaggactcaaccctccagcattcaatcactgggactcaacccaccaacattccaatcaacaggactcaaccctccagcatttcaatcagtgggactcaatccaccaacattccaatcaacgggactcaatccaccagcatttcaatcagtgggactcaatccaccaacattccaatcgccgggactcaatccaccagcatttcaatcagtgggactcaatccaccaacattccaatcgccgggactcaatccaccagcatttcaatcagtgggactcaaccctccagcatttcaatcagtgggactcaaccctccagcatttcaatcagtgggactcaatccaccaacattccaatcaacgggactcaatccaccagcatttcaatcagtgggactcaaccctccagcatttcaatcagtgggactcaaccctccagcatttcaatcagtgggactcaatccaccaacattccaatcgccgggactcaatccaccagcatttcaatca

SEQ ID NO: 76335 - DNA, 830 bp, Heterodera glycines
  Genomic contig location: Contig_ID=SeqID_12661; Location=48..877; Strand=-
  SCN-specific regions: Sequence locations=1-538,624-678,700-830
atgtcgtcaacgcgttcgcgacgttcgggaattgtggattcgggtgggctgaacccatcaacgattcatttactcccaatggcaagagtcaagaaagaattagaagctcgcggtgcgcattctttttgttattaattagttaatggaccttaccattaaactttcagggctggatacaaaaggcagtgcagctgatttggcttttcgtctccaagaatatgttagacttgcaggaggatttgtgtcaaaattcgatccatcgcccgcctcagaaccaacaacacctctcaaaaagcgaaagaggaaggttcgtttatctgcttctttgcgcacaggcaatttaacatttatagttacatatttacaacaatttttgtctttctttgcttattttgacacaatttttagcaactcgatgttgaagttgatgagaatgttgctggctttgatagacaagaagcatcttcgccagttgccgccaaaacatttcgacacttttcttgggcaattgcacccccaacggcgccacaccccgtgaaagaggcgaaaaaagaagaaataatagaaagcggaaatgaggaggaaagggacgaagaggaagaagcagaaaaagagcaaaatgatcaaattcaaattggacgaaaaattgaggaaactgaacggcagcaaaagacgaaagtgggcggagaagaggagggagtggaagaagtggtccaacaaccgcaaacaacgacagaaaaacccgcggacgcaacacagccaacagcggaaccggcgaaaatccaaggcaagttggacaataatgaaaatgcgaatggcagtgccaatag

SEQ ID NO: 76336 - DNA, 463 bp, Heterodera glycines
  Genomic contig location: Contig_ID=SeqID_12661; Location=2314..2776; Strand=+
  SCN-specific regions: Sequence locations=1-234,256-353,375-463
atgcgagagctcagaggcccgcttgatgaattgctcaagaaggaggccaaatgggaatggggagctgagcaacagaaatcttttgagaaagtgaaagaaatcacttccaggccaaagttgagtaattgccgatcacggccaaagaaattgctgattcatgaaaacggacgacttccttcaaagatcagcaaattccccgctcaagaatggccacaaaaatgcacagacactgatttaatgccatttatcaaaaaagagaccaaataaccgaaattgatggctgtctcacgtatggggcgaccgtggggtcggggtcacttcggcgcggaccatttcggcgccgcaaattttgaaatgctataacttttttatttgtcagttagctttagccaatctggcatcatttgaaagctctatgtgtgctctatatttacatgtaaaaatagaaatgaatgattcaaaa

SEQ ID NO: 76337 - DNA, 504 bp, Heterodera glycines
  Genomic contig location: Contig_ID=SeqID_12662; Location=155..658; Strand=-
  SCN-specific regions: Sequence locations=1-247,273-392,414-504
atgtccgtcggttgggggtcgttaaacacagaccacctggacagtcgaccgtcacgggtgacaatttggtcgggctgtaaccaaactatggcgaggtccctgcgctccaattgggcaagtgacccaaccgaacgattggactgggagaaggaatcgtcgacgaaaaattggtcattttttctatttaaggaaaagtttcagaaaaagcaaaaataagcaatttattccagtaacaactcattcagcgccataaaaatactgaaaataaaaacggcaaaacccactcgcaaaacgccattatctcgtgataattctgactgtgcattattgtctggtattcatcaatcggcgcataatttgacgaatttgctgtggtcagtgaagaaggactgagttgtggcttaaacaatttcaaatgataggagtatgaaggcccaaaaaaggaagtgatggctatattgaattttaggctcccaattgttgtgtatttactacaacaataaa

SEQ ID NO: 76338 - DNA, 1270 bp, Heterodera glycines
  Genomic contig location: Contig_ID=SeqID_12662; Location=1..1270; Strand=+
  SCN-specific regions: Sequence locations=1-66,110-245,267-386,412 -714,736-1270
  Gene Ontology: Mol. function=calcium ion binding; Cellular component =intracellular; Biological process=digestion
gggcagcggaattcgcaagttcttgcaattatgggcattctcacattcattcctccatttgttattttattctctgctgtccttctccccatttacctgtttaataaattacttattatttgacaacatttggatttggtcgaaggtcaaacattttattgttgtagtaaatacacaacaattgggagcctaaaattcaatatagccatcacttccttttttgggccttcatactcctatcatttgaaattgtttaagccacaactcagtccttcttcactgaccacagcaaattcgtcaaattatgcgccgattgatgaataccagacaataatgcacagtcagaattatcacgagataatggcgttttgcgagtgggttttgccgtttttattttcagtatttttatggcgctgaatgagttgttactggaataaattgcttatttttgctttttctgaaacttttccttaaatagaaaaaatgaccaatttttcgtcgacgattccttctcccagtccaatcgttcggttgggtcacttgcccaattggagcgcagggacctcgccatagtttggttacagcccgaccaaattgtcacccgtgacggtcgactgtccaggtggtctgtgtttaacgacccccaaccgacggacattgagcaaggtcatcctccccaattcgcatctcgtcatgttccattgtttaggtctgcttggcaattgttggcttttgtctgcgttggctgtcattgccgaacgacccgacattctcgagaaactgttcattacgaaggagtataaccatagaggggtctacgaagttaggtttgtggcaacataattttggtcttatcggtctttattaggctttgtattgacggcatttggcaacgggttatcgtcgacgattttttcccatgtcatcggtcagatcgacgcctgatttttgcggttgggaggaaaaaccaactttgggtgtcattgattgagaaggcacttgccaaagcttatgggaattatgccattctgcgagctggacgaactgtggaaggcatcaattttaaatggttggggtaattaccataacattttgttcttcattaggactttcaactctcacgggtcagccgacactttccattgaccttgaatatttggacatggaccaacagtcccggaccgctgacttggacatcgcttgggctaagctgataagtgcgagagaagcgcgctttctgatgggatgttcttgtggtgctggtcagttt

SEQ ID NO: 76339 - DNA, 458 bp, Heterodera glycines
  Genomic contig location: Contig_ID=SeqID_12665; Location=864..1321; Strand=-
  SCN-specific regions: Sequence locations=1-122,146-458
atgaaccaaatgcgcaaaattttaaccgaaacacaacaaatggatcaatcagaatctgctcattttacggattttagtgaaagtgatgagagcgctttaaaatgtaaacaagaatgaaaaactttaatttttatttaaaattttagtggacatttggaacagtaacccaaaatctccttgctgttcatcaattacgccatcaacactttctggagaacctgcccccgccgttggcaccaaaattgaagctcaattagcgctttacaaagatgttgaacgagttggaattgatgctgacatatttttgtggtggaaggaaaggacttcgctttcctgagttggcaaaaattgctcaaattgtgcattcaattcttgaacctgatcctatcgatctcattgattatgaaaatgaaatgattaatgatgattaaaaatattgagtcatttacctgaataaa

SEQ ID NO: 76340 - DNA, 759 bp, Heterodera glycines
  Genomic contig location: Contig_ID=SeqID_12666; Location=216..974; Strand=-
  SCN-specific regions: Sequence locations=1-208,235-380,414-759
atgtctgaaatatggtctttttataaaaaatcgcaaacatcggaaacggcattatgtaacctttgtcgcaattctttttcgtgtaagaaatcgtcgactaagggattatgggatcatttaaagacgatgcataatgacgaatttgaacaatggcaaaaaaacaaaggaaacacaaataaagaagtactaaatttaaaaggttctgtgatttataaaattttttaggggcaagaaaacaaaattacgaaattttttcaacaatctgatgaccaaaagcaaaaggccgacgaattggttctgaaattaatgttgcggacaaattcatcttttttaatcaccgaatcgcctgaattgagagagctgtacagcaaagcatttcctggatttgaagttattttttctctttattattcctaaaaaaatcattttttgcagctacatagtagggaatatttccgtaaaattgttctaccaaaaatggcaaatgcaatcaaggagaaaatttgttcacaagtttcaaacgattatttcacaataacaacagatggttggagtcaaccgacttcaactccttcattattaaggttataaattctctttatgttatatttaagttaaaattttagcattactattcatcatattgacaatgaattcaaccgaaacgattttgttttggaagcgagtacctatcgaatcacgattctggcgacaacgttgccgactcaatttatgatgcacttgatgaaaacggattaa

SEQ ID NO: 76341 - DNA, 561 bp, Heterodera glycines
  Genomic contig location: Contig_ID=SeqID_12667; Location=2058..2618; Strand=-
  SCN-specific regions: Sequence locations=1-84,106-332,354-561
atgaatgaatttgggttagtttgcgaacttagcgaaataaaattgctttacattcaaattaaatgattagacccgcccctctcctccagcagattcttcagactcgagtttttcttggttaaattttgacttcagcagtataaaagaaaattgccgaaaaaatcattttaaatacaaaaaataaatatcagttttcaatcttcaaaaatgtttaaaagagctaaccatgagaaagaattgaaactgagaaagaaggaacagaaacaaagagattaaccactaagccacaggagcaattaaattttcattaatttttcattcctccaactttgctcaaaaatttgatccagaaccccattcttaccagtgtacttttggacccggacctaccgggtcgggtaccgggtttgcaacagggttgccgcaaatcacccgaaaccctacattttctcgacccgaaacgcgacccgatatttttctcgacccgcggcaaccctggtatgcaatagagagactctaaaatttatattgtctatgagtgaaattattgggccaaataaa

SEQ ID NO: 76342 - DNA, 1470 bp, Heterodera glycines
  Genomic contig location: Contig_ID=SeqID_12668; Location=2256..3725; Strand=+
  SCN-specific regions: Sequence locations=1-277,300-330,397-437,460 -543,565-580,603-727,763-854,899-1031,1053-1283,1321-1359,1384 -1387,1443-1470
atgtcctcttcggtcgcttcgacccccgcttcgcccatttctcttacggccgccccacgccgcgcctcagtttttgccgaccttttgacggtattccggcgcaagagtaccgccaccactgcgcttagcacacggcgtcgttccatttaccatgcgccggtgccgtcgtcgtacacggcacggaaccgacgcagcggagcggcaaaaaaggcggaagagatggaactgttcacggacagagacagtctccagtaaaaagcgaaaaattatagaggggaaaatataaaaggatttacaaaacaaatatgttaaatcgaacttagatttttgattaattaaaaatttgatcatataaaaaagaaaatacaaaaaaattcaaaatgatttttttttaaactatccaatccatttgcatgtgaataataaatgtcgtagaattgtttaattgtaaaattggctaattgaccaaacgatcgctaatcctaattaactaataattgagctatctaattacatccaaaaatcaattgccatttttatttgtcactttttcagtgaggctgatcgcggagaaaaggacgaggaggaggagacggccggcaaaccgttgacacggcagcatttgttgaacaaaattcgcgaaaagaaggaagtgatcaacaaactgcgctgccaggcatggaacatgaacagaaagagacgaacactaaggtgggatacggtagcaaagagaagaggaggaaaagaaaaacagtgtactgtataagcggaggaaaaggaaagaaatatgtactgtagaccaaatgtaatttaataggcgccaaaaatggaagaaatattcgcaatttttggacatttataataaatccaataatatttaaattttgttaaattatttcccaagtcaataaaatacaaaaattcagacttgcccagaaatacttggagcagaacgagtccaaagtgtccaaaacgcatttgtacaaggaggagttggtgaaacggtggcgctggttcctccgttggttgagcaacattggcatttattttgtgggaattgtgccactttttcagtgttttgtgatttattttcattttaggtcccttgggagtcgcggataaaacgaattgaaagtgaaaatttcatttaaaactgagaatttaatttaaatcaaaggccaatttggctcagtcgtgtccagttacttcacattccttcgctgggtgatcttcatcaattttattatcactgtaagttcttcccctttttcaaaatacctttgattattattattgtattaattaattatttattttttacatttcctcagtttatactaaaaaaagtaattttaagccatttttattttaattgtttttccagatcattttttattactttttaaattatttttttgtcattaaattattaatttatatttcattactattttctttcttttataaata

SEQ ID NO: 76343 - DNA, 1053 bp, Heterodera glycines
  Genomic contig location: Contig_ID=SeqID_12669; Location=566..1618; Strand=+
  SCN-specific regions: Sequence locations=1-729,751-975,997-1053
atgcgcagaaaaaatatgcaaaatcatacaacttataaccctaattataatttgttcaatttggtgaggtaataaatagtattctccaatttaccaaaaatgtttgcttcttccaactataaatgtttgctttttttccattttcctctcattataaaaaatatttctaacacaattattcccctctttgtgtgacatccttcgaaatattgcaaattgtgctaattgccacaaatgaaccgacggtttggaatttctcttcaaataaccaattttaatttagcctaactattccacaatttcagttgggtttgcagcgatgtttggttggacattttccctcattttgaccgtcctcaactcggcttaaaattggcacttctttcgaaccgttttaatgcgctggtggacaaacatttcgatggcaaaagggaattgtcaatttggagtgacattacaattggcaagatgggagcaaaagcaaaattgtctgtggagaagagcaatgccaaatctgtgcgctttccattgcccggccattcgctgcccaacaaaattcgctttaattaccttcagattgagtaaatcaaacaaaattcaaagaataattaactaataaaagcatacccttacaggtacattgattacgccgtcatcaaatttctccgtgccaaccagcaaatttttgccaaaggcaccgatttggatttgcatgtgcctttcccctataaggccaaggatgtgcagaactttgcctgtgaaatttggcccgtttttgcgacaaacattcgccatttgagtgttactgatggtcgtcatcttgaaaatttgcgtcgccacacttcgccgacaattctctccgacctcaacattaatgccatccattccgatgatttgttgcccgatgcaattgctgacgatgggccaaatgcaactgctggccaagcgctgtcaaaatggttgaacattccgagaagcgatggacagccaaaacaattgagttgttgtggtgctgtgtcaagaaccattaaattggtcaacagtttcaaagag

SEQ ID NO: 76344 - DNA, 396 bp, Heterodera glycines
  Genomic contig location: Contig_ID=SeqID_12670; Location=258..653; Strand=+
  SCN-specific regions: Sequence locations=1-274,305-396
gcatttctccatgccaccacttcttcggccagctacataattcgacttgaagattttgaaccaacggaaattgagccatttgaattggtgaacgaacggaccaacgaaatgcttacattcgagaaagaagacgaccatcaaaatactaataatgttgcttgtctgttgaagcgatttcaaattggggtgacggcgacgattcattgggtggacgaaaacctggacaatttgaacaatgtcaactttcatctttatgaatttgggtgaattgggcaacaccattttcttttgtttcaaatttcacttcattcatcaggccattgtctccaccaaaggcgggccaaatgaagtcaaaaagtcatcggaaaatgaaactcgggcccagcggacagcgaa

SEQ ID NO: 76345 - DNA, 2409 bp, Heterodera glycines
  Genomic contig location: Contig_ID=SeqID_1848; Location=31..2439; Strand=+
  SCN-specific regions: Sequence locations=1-372,422-1399,1428 -1958,1984-2037,2059-2378,2400-2409
atggcagctctggtcgcctttcgccgggaattcttcgaaatttcacggcgccaagactacgttgatgggattgacgacaaggagaaccacgacgggatcgatgtgttgcgtgagtgcatgaccatcgcaggggcatgcatgcgacacttccgcacaaaccacctgcccgacgagcacttggccattgtccccgagcgcggctatgacaacgcgcagaaccaaagcctaatcgccttacgcttcttccacgggtacgccaaggagcatggagtgcaagtgcagacagcccacgcggctggaggagagaagattgggccctactccttggatgggtggattgaggcggaaaggcgcgcaattgaagtcaatggtaattgagttaattatttttcaccattattataaaatgggcaattttaaggctgtacgtggcacgggtgcaaaaggtgttaccccaacgacaacatgctgctccccaatgggaagactgcgggacaagtgcgcgaacgggattccaagcggatggaatttctgaggggaaaggtcaaccggatggacgtctactgggaatgcgaaatccatcggatgctggagaggagcaaagaaatgcgcaaggcatttgacgactacgtcgatgatggcccgctggtgatccgcgacgcgtttatgggagggcgaactggaccactgaagctgctgcgcaaggctggaccgggagagaaaatctcctattatgacttcacatcgctctacccgtacataaagtgagcacagttaaagttgtaacaaattaacattgtttccttcacagcttcacaacccgttaccctatcggacagccaaacgtgcatgtgttgaaccaggaagtggattggcgcagtgcagcggacaacccctaccctttggcactgctcaaagtgtgggttgtgccaccccgtcgcgtcgacgtgcccgttctgccggttaaagttggagagcggctttgttttccgctctgcatcacttgtgccaaagagcatccgactggtggtgtgaatcccaactaccactgcgagcacaatgacagacagcgggggtgggtgagcacgtgcacctccattgagctcaacgaggcgttggacgagggttacctcgtcacaaaggtcttccgcgtgttggagtatgagcaaagtgacgacaagctcttccgcccgtacatcgctgagtttatggcccagaagatccaggccagtgggtttgacaacagcatcagaggcgatgcggagaaggaacaacagtttgtgcgggagtgcgcagagcagttcgacatcaccatcgacccaaccaaaatggcggtcaacaaagggaagcggtccctggccaagctctgcttgaacaacttatgtgagtactgtcgtccattattattatatatttttaaaaaattagggggtcgattttcgcttcgcaactttgggctcgctcaaacactcatcactgacgacccagcgactttggcggagtacctggacaacaaatccatcgaagtgacatcaatcgacgagttggacgagcagcacatactcatcacctatctgcagaagaaggactgggtggatgagcactcatgctccaacattggtgagacacacacactcacaataaattgttaatttttataaaatttcagtcatttcactatggaccacctcagcagcgcgcctcgttctgctcaaggcaatgcagaaggtggtcagatcaccgggctcggatctgttgtacactggtaagtcaaactacaaaaaaaattttgtgcacaaacatttattttagacactgacagcctcatcctcgtccacccggaggagcggtgcccgctgaaaactggcccccacttgggccagttcaccgacgaataccccgaccacgacattgtggaattttgcagtggcggagcaaaacaagtgcattttcagttcatttttgtttacttcaattttaccaccttttagtacggtctttgtctgcgacgcaagggcgcggaggcgggagcccaattggaacatgtgctcaaagtgcgcgggctgacgctaaattatgatgtgatcaacaaccaggggatgcgctatgagaacttcaaagaggaggtggtccgttacgcgacaagtggtgaatacgagccgataatcatcacataccccaacttccttcgtccaaacatcagggagggaggtcgggtggtttccatgcctatgcaaaaatgctatcgcccatttgtgggaaagggaatcatcggggccgatttcaatgtgctgaattttggacacacattgtaatttgtacattatctatcacacacacacacacacatatgactgtttcttttgtacctcaaattgtgtacattttatgccattttattagttttta

SEQ ID NO: 76346 - DNA, 853 bp, Heterodera glycines
  Genomic contig location: Contig_ID=SeqID_1848; Location=3380..4232; Strand=+
  SCN-specific regions: Sequence locations=1-483,506-594,621-669,691-853
atgaaaagacgcattgctcctcttactactgctactgctcctgctgagcaacataaaataattggtcccgagtcgcccaagccacatgaagagacggccaaaaatgttgagcctaaggatgagttggcaacgaagaaacgcaaagtggacgaccgagagttgtggaaattggcaaaaggcaaatttttgctgaccacctatttgtgccatggtaataattaataacaatttcatcaaattttaatttgaatccataaattttgagatgattggaatcgtctgtacaacaaccagcagaaagtgaagcgcctggagggggaccgttttgccttcggctttgagatgtgtgaggaatgcgtgtgggccaactgccgcgcaaccgaccttttggcgccaatgaagaaaaagtgaactttgaccaaaagacaataatggattttgatgatgcaatccataatttgaattaatatttaattctgcacaataaacattttttgagacagtccctcaatttccttttttgtgtttgcttcagatgaaatctggggtgatgattaattggcttgccgaatttgaatctggcaaagacactgaggggggggggggggggggagggggggcacatggataaggacaaagcgagtggaaggaccattcatgtcttattacacaaaccctctaaaatataaaatgtccccgcgcaaatcttcaattgcaccatcgctggttggaatagcaagtaatatagttttgtcaaaaaaatttttgaaccaaattgttctgttgaaggatgcggcgagtgccattcggcccggtgcagggtgtgcgaaaaactgagggaacggaattgtga

SEQ ID NO: 76347 - DNA, 1278 bp, Heterodera glycines
  Genomic contig location: Contig_ID=SeqID_1848; Location=4652..5929; Strand=-
  SCN-specific regions: Sequence locations=1-70,92-287,313-460,482 -483,506-924,946-1278
atggcggacaaccaattgcggcggaagcggatgaaaatgacgacacaattgggcaagcggtaatttttcacaagatttttcaaaaaatttattcctttaatttgaaggggaacaaattgttgcggcgggcggtggccaatcaacgcattacatcgtccggctcgcgcagcacagtctcgcgcacagcgtcgcccgcactgtcttccacttcgtcaaatgcctccagaagacagaggaaaaattacaacaaaagtggacgtgtaccggtaagaaaaaatttgaaaattcacacacaacacacacacacacacattcacttcctagataaatgtgaatgccgattgcccaaatgtgccgcccggtgtactgccgaacccaaaatcgcgccagtaccaggtcaagagcgtgttggcacagttcactcatgcatcggggaggaaatgctatttcttggagtggctcggtgagtttgatgatgaaattgaaagaaaaaatgtgtgaatgaaaaggtggacggatggataaggaaattgaaaatttattgtaaaattccaaacgtgtgccgagttaacctggtttagcttcgccactttcggaacggaataatttgagggtgtatgccgagttaacgcagtttagcttcgctacctctcgtgctatttcactttaaattttctttttccttttccattcaccaacccattttcttctctcattttttctcgcaattttaggctaccgcggccgcaactcatggtgtttgtccgaggacaccgactgtacagagtacattgaaagatttgggaccgtggcaacagtcgatgctgtactgtttgcgctattgggcgaaagcgtcccagcttcgatagctgatgagctccaggccaaccctaaatttggacaaggtgtggagagtgaggggaattaaaaattgcataattttttgttagtgttggcaaagttggatgacattgaagatgaattcatattgaggacaactcagtataatattttgttcgcaaaagggcttatggaaagccccgagggcaaaaccataattgaggatgtaaggcacacaaatgcacttttaaaaaaaaattcctttcctaaggccaagagtaaactgggacgcttcgtggccaaatgtatgagctgatgagtgatgagtgcactggccggccgaattgaaccttttcacaatttaaatttcaccatttaaattttaccatttatttcaccatttaatttcaccatttattttcatcatttaaaaataaa

SEQ ID NO: 76348 - DNA, 910 bp, Heterodera glycines
  Genomic contig location: Contig_ID=SeqID_1848; Location=7350..8259; Strand=+
  SCN-specific regions: Sequence locations=1-910
atgctgctccccagtgggaagactgcgggacaagtgcgcgaacgggatgccaagcggatggaatttctgagagagaaggtcaaccggatggacgtctactgggaatgcgaaatccatcggatgctggagaggagcaaggaaatgcgcaaggcatttgaagactatgtcgatgatggcccgctggtgatccgcgacgcgtttatgggagggcgaactggaccgctgaagctgctgcgcaaggctgggccgggagagaaaatctcatattatgacttcacatcgctctacccgtacataaagtgagcacagttaaatttgtaacaacttttaacattgtttccttcacagcttcaccacctgctaccccattggcactcccaaagtgcatgtgttgaaccaggaagtggagtggcgcagtgcagcggacaacccctaccctttggcattgctcaaagtgtgggttgtgccgccacgacgcatcgacgttcccgttctgcctgtgaaagttggagagcggctttgcttccccctgtgcatcacttgcgccaaagagcacccgacaggaggagtggacaacgactaccattgcgagcattccgacagacagcgggggtgggtgagcacgtgcacctccattgagctcaacgaggcgttggacgagggttacctcgtcacaaaggtcttccgtgtcctcgagtatgagcaaagtgacgacaaactcttccgcccgtacatcgctgagtttatggccaaaagatccaggccagtgggtttgacaacagtatcagaggcgatgcggagaaggaacaacagtttgtgcgggagtgcgcagagcagttcgacatcaccatcgacccaaccaaaatggcggtcaacaaagggaagcggtccctggccaagctctgcttga

SEQ ID NO: 76349 - DNA, 1439 bp, Heterodera glycines
  Genomic contig location: Contig_ID=SeqID_12671; Location=575..2013; Strand=+
  SCN-specific regions: Sequence locations=1-478,500-801,826-1439
atgaacgagaaaccgtcacatcttttcattttcccatcgaaatacgaatcttctctgtttctctctcacatatccacaaaattgttccgtaagtttttttccattaaaaaacattgtcctattttctctcttagccaatgctgcaagctcatcagtaccaacttcggcaaggtcatcgtcgcgtttctgctcgcagcattttggcccatttcggtttcgaattctcgaacgactaccgacttggctgcggacattacagtaaagtgtacaaaggtggagtaaggggcagagtagttgtgtattttcgcagatcaaatttatcttccaggctatttcaaggaagcgcaacgcacttttgccatcaaagtcaccgacttggaaagcgtttccgagaagttcaagcaaaagtttctgccacgtgagctggaagtttggcgggaattggaccacccgaacctcgtctatttgtacaaagatttccagtggaacaattatcagttcgcagtgatggaattggttgttggtggtgacttggtaatttcctcttttgttttatgtgtgttgcattacttcaccgtttactcttcagctttcgttcctccaaaaatgtggccacgtcagcgaaacgacctgtcacaattggatgctccaaattgttgctgctttggattatctccaccgtaagggaatcgctcatcgcgatctgaagctggaaaacgtccttctttgtgaaaacggcgtcatcaaagtcactgactacggattctctaagcaggtggtgaaaattgtttttgcttatttgaagttgattttcagagttctgatttgtcttcaacattttgcgggtcgcgttcctattcgtcaccggagattttgcttggcatcgcttatgacatgttcaaatcggacatttggtcaaactctgttgtgccatcctttttatgctgatcataatttcaggtcattaggcgtcaccgcgttcatcatgatcacaaacacaatgcctttccatgaagacttgcccaaccagcaaatcgttgactcgcagcggaagcgccgttacaaatacccgtcatggcttaacattacgaagcaatgccgcactgccatcgatgccttgctgacttaccaaccggcttttcgtccggtagagttttgcttttaattcgcttctcattttctttcccattcagaacatttccgaatgtgccaagttggaatggtttgctcaagattccgcctctttgtgttgcggtggtcgtcgtgccggtgttggagtgatgggtcaagtgcgtgggcgatgataggccatgtgatgaccaatggacagaagatacatttgataggattaaatccaagcctaagcttttcttcattttgtatgcgtatctttagtctttgtttgtacatacacacacttgttaataggaataataata

SEQ ID NO: 76350 - DNA, 170 bp, Heterodera glycines
  Genomic contig location: Contig_ID=SeqID_12671; Location=2682..2851; Strand=+
  SCN-specific regions: Sequence locations=1-170
atggccattgctcggacttcggttctgtccccgttgctcctcttcatctttcttctgttcaactgttgcctttgccagccaaatgtcttttcgcctaatgatttcgcttgcgcgaagaaaaatgccatttttcacgatggactgttcactctcactgaagacaatcgact

SEQ ID NO: 76351 - DNA, 488 bp, Heterodera glycines
  Genomic contig location: Contig_ID=SeqID_12672; Location=351..838; Strand=+
  SCN-specific regions: Sequence locations=1-40,63-284,307-333,355-488
atgcgaccacactttggcccctctctcctctcgcttttcgttttgtctcttctgatctttgccatcgcttcgttaaacgccgctgacgaaatgccgggaacagaaggggaggaaataatcatcccttgtgagtaccaaccatcaattgtccttcgtctcatccaccaatgatcatgactagggatgccaatcatatggatatccatatttttttcctggactgttgagggcctgaaacgcacgaaaaacatgtttttagcttggtttgaagcttgtaggatggatttctaaatccatatttttccatatttcgcgatttatgtccatatttccatattttggtccatattttatgtccatattttggcaattttcaaaaaaacctctattagaacggcccccagcagctaaattagcctttttgagcccaaaacccgaaaaatttttcaaaaaatcattttttcgccaaaatttctcgagaatattga

SEQ ID NO: 76352 - DNA, 155 bp, Heterodera glycines
  Genomic contig location: Contig_ID=SeqID_12672; Location=867..1021; Strand=-
  SCN-specific regions: Sequence locations=1-155
ttcttcaaatttattggttgaaattgcatatgagatacatttccaaattttttgactcggtaaggcgctttgacaaagacggctttcgttttgcaattagtcggtcaacattcggaaattggtctcgaattttttccgcaattacgtgcaatcat

SEQ ID NO: 76353 - DNA, 1662 bp, Heterodera glycines
  Genomic contig location: Contig_ID=SeqID_12673; Location=25..1686; Strand=+
  SCN-specific regions: Sequence locations=1-698,729-1224,1246 -1468,1490-1628,1651-1662
atggacgcggtggagtgcgcggtgggcaaagatttggcacgcgagttccaacggatggacgagaatccgttccaaatgcgcggcggtgcaatgcttcgactgagcggtgcgtgccgctaattagttattaattagtccaacatttaaaatgcgtaaaatgggggtggcaaacaattttccgggcacacagtttggcgccagtgaacaaaacagcgccaatttgaaaacccaccgaattttagaccaccaaaaggcggcgctgagcgcagcggacattgaggcggacatcaaagagcagttcaaaaaggagacgctgctcagggacgaacacgaagagatgtgagtggtttgttgggtatttttggaattttgaagcctaccaaaattaatttggatttggcaaatagcccccaaatgcatcgctttaagaacatgagatgtgtgaatttgcacgccttttttgcaaatttttggtgtgcaaccccaaaacaggaaagtgccggaatttttgtgccttatgttaggttcctggaaaatcctttacctcgggggtggaaggttcggctatttcctgtccgggtgctctcgataatcttacgttttaccggctaactgtttctcataattcgattgatggactctctggcgctactgtaaatgttaccgattttgaaatttttttcacttttttttcatgcaattttattttctattttttattaaaattagcattattaatcacaaaaattataattacaatgtaataaagcaacaaaagccttaaacagacatgaacatttacgtgagactcaaagcactattgtgaaaaaaacttttgtcgcgcactgttttgaatggatgacattggtgacagtgccactaaaaaaaggacttaaaaaaagatttttttcaaattacttcaaatccatcctttacaaaaattgtaaaatctcttcagaattttgggaaaaaagccatctcaaatttatatcgtccaatgttggaaaagcgatgagtgacagattgttggaatcattaatggaatatcttgaaactttaaccatttgctaaaaaaagtttaaaaagcatttatagaaaataaaattgcatgaaaaaaaagtgaaaaatttttcaaaatcggtaacttttacagttgcgctgactctctcatatctcctttcatcattggacaggcgtcgctatgtggagacgcgaattgcctccgagtgcccagcagcgttggcaatcgccgccgcaaatgccaaagagagcgccggcgacggcggtggcccatcgacggccaaaaaggtcaaagtggcgggccccgaggacgacattctgtaccgggcggccgagcaggtcaaacaccacggcagcaaacgcaacgaggaactgttgtccaaccaaatgctggtcggcatccccgaagttgacctgggcattgagtgagtgtttgttggttgtgtagcatacattaaaaaatgggtggggggtcgattttttttttttgccgggatatggggttggtggtcaatttttaccaagggtccggccatgtaaatcgacgaccttttttaaacaatttttttgcggcgcgtttttattcagaatttttgggagttgtgggtccggcggtgccccaggggaaactgcaacttttta

SEQ ID NO: 76354 - DNA, 318 bp, Heterodera glycines
  Genomic contig location: Contig_ID=SeqID_12674; Location=70..387; Strand=-
  SCN-specific regions: Sequence locations=1-102,138-289,311-318
atgccgagcaacgcgttcgccatggcacagtcacagtccgcgccgaccagcccggcggtgacggcatttgccatgtctgaacagcacccactgctgctacgacaacagcaacaacaacaacagcagcagcagcagcattggtcacagcagacgccgatgacaacggtagcaatgatggcacaacaccaacaacagtcgtcgccgtgccggcacttctccgccagcccggacggcatggaagtgccgaacatttgtgtgaccggcaccgacgggggcgacattgactgcttccaggtgcttcttttggcaattagctaa

SEQ ID NO: 76355 - DNA, 318 bp, Heterodera glycines
  Genomic contig location: Contig_ID=SeqID_12675; Location=1898..2215; Strand=-
  SCN-specific regions: Sequence locations=1-254,290-318
atgccgcaaatgtcagcgccgcaagtgtcagcgccgcaagtgtcacgccgcaaatgtcagcgccgcaagtgtcagcgccgcaagtgtcacgccgcaaatgtcagcgccgcaagtgtcagcgccgcaagtgtcagcgccgcaaatgtcagcgccgcaagtgtcagcgccgcaaatgtcagcgccgcaaatgtcagcgccgcaaatgtcagcgctgcaaatgtcgcatcacccatcctttattggccaaatgaaacatttaattatttagaattttattatataaattattgaattctactattcattgctactaataaa

SEQ ID NO: 76356 - DNA, 626 bp, Heterodera glycines
  Genomic contig location: Contig_ID=SeqID_12677; Location=442..1067; Strand=-
  SCN-specific regions: Sequence locations=1-142,164-201,223-329,353-626
atggaaaaataccataaccatctgtccgacggcatactgtacccactgcaattttcgaatcggaatcgatgtttttacgatgcgaattggaactgcgtttgctcggcaacctttcaaattgtctctcgaatgaatgatgaagctaggaattggactgacaatttcagtgcagcttttaacaattcaaataagggctggggattcccttctttcattacacttgcggtgagtttgtttcccttaattgacctaattagggacaattaaggaattgatggacccgaacaatggcttttatgacaaagacgaagacaaaggcacattggccattcatttcattataaacccaaatcagaaagctggccgtaaattccaatcacttttggacccaaaataaatcgagaaaaatttgatcagatcatctttctgctgatgaacctactttgttctatcatttgcacattttgcctagtttgtaaaatcatttttggatcaacgttttgctcaaatgtcgtggacgggtttggggtcctaacctcttaaaagcaaacaaagcggaattggtcagaataattgtttcataatatccattaaatgtgtcgcccgttcaattaaactaaaataaa

SEQ ID NO: 76357 - DNA, 1203 bp, Heterodera glycines
  misc_feature (1115)..(1115): n is a, c, g, or t
  Genomic contig location: Contig_ID=SeqID_12678; Location=339..1541; Strand=-
  SCN-specific regions: Sequence locations=1-370,392-400,431-472,494 -506,530-539,561-642,665-700,722-808,830-877,899-1055,1081-1203
atgtgcgttgtgtgcaccgattcggcagcgaggtgatgaaaccaaaacattctttaagcattcattcctccgactaatttttttttgttttcggcaattcaaaaaaaaacttaatttgccatatgtcatagaaaaaaacagccataaaaagtcatttttaacaacgaattcttaagtctaatggagctttgtttcagctctttggaatggcgttactttatttattttaaatccaggtccaagttagacaaagaaaaaagaatttggaatccctcgataatatttttagaatttgttgtttcaagcgacccttttaaaatgtatttaaatatattcttattgtcaattagatgcttttagattttctaagcaattaattaactttttcaaacgttttttctttttaaaataaatttcaaaaaaataaaaactgtaaactttaactaccgtgtttttttttaaatttcattggaaataataaaaaatattaaaagggttaataatcaaactttttgattttagaaaaacttctaagaaattttgaaaacgaaaaaattccagagctgggggggagggagctggtcctgtttttttggcttttggcgcatgccaatgtcctcggcctttaacaatctgaaaatgtttttctttttcagtttcgttgtgaccgaaagcgatcgactgccgatgactcccgcctttttctgcagaaaatgtttccgtgcttttcattacgacggggagcagcgaattggtcaattcaaagctttccattttatggaccatgccgggacggagtgaatgaattctttttgcttttatttttctcattgtcagcaaatgacacgcgtttaaattccgatcacttattttttgcataaatttaatatatattaaagttagtgccactcggtcagtcactcttgcaggggcgatggtcccagagcttggagagggagggcaccaaaaaagaaaatcggaacttttcaccatttccctcttgattatgctgctgctattcaactcactcggcctcttctcttggttttcgaaagaaaattaaacagaaaaaggagggatttgggacggaatctgttgggggtggggtcaattanatattattagtgcgtttggttttcgtgcagaatgccacacaataggcagcgttaaaagtgcgcgggatcataagtgccaaagaataaa

SEQ ID NO: 76358 - DNA, 57 bp, Heterodera glycines
  Genomic contig location: Contig_ID=SeqID_12678; Location=1..57; Strand=+
  SCN-specific regions: Sequence locations=1-57
ttataaaatatcttccaaatctcctatatttcacttatgtgaaaggacctcgggtct

SEQ ID NO: 76359 - DNA, 1088 bp, Heterodera glycines
  Genomic contig location: Contig_ID=SeqID_12679; Location=63..1150; Strand=-
  SCN-specific regions: Sequence locations=1-180,202-472,500-520,542 -730,752-1088
atgtctgctttcactacgacggcacagcgtcaattggctgaaaaacgaggtaacaaattctgtaaaatttatgaacaaaatttttgtaattcaacagttttcgctaattgtaagtgagatatttgagtgaaattagttaacagattttgtccaaaatgaccaatttttggtttcgagttaagaaaataaagaattttttgggccaccgagtattaaatcggtccctctattaaagcggccttttaatccctaatgactgaaaatttttctaaaaattaatattggatagttttctcgaaaatattaataaaaaacgtttaaaaattggaaatctgtgtcaaaaataagactaaaaatggaaaatttatgctattttttagacaattttttcaaattaataattttaactttattttgatagtttcttatacaattatttttaaacgtatttagctattttcgagatttaagcttaaatttaattaattttaaaaaatttcaagaaattttacattcaatttggaataatttatgtgcatatttttcacttttatatgcatatttcgctttaatgtataatcatgtgcatatttctcactttgatgcgcatattttgcgattttatgtccatatttttgaaaaccctattcattaatttctttaaagtgttcataaataggcaaatgcaagcagcaacatctcaacaggtcgtcgaccacaacggcacaaaaagagagccgacgacaacagacaatgaaggcacgagcaacgtggacaggggccgagcacgacgaaggcagcacaacatcacgactgctccgtgagttatgcagcagtttctgttgttgttttttttttgctattttttaattcaaaaaccaatttctaacggtttgaaaaagttttttgacatttttttgagttttaaaactcatatgtctacttttgcatgttttgccaattttgttgggtatggccttttcacagttttagaagtaaatttatttataaggttttaaaatgttcatgcgaagtgtctgttatcttcccaattaatctccttttttaaagatactgcttaaattaaa

SEQ ID NO: 76360 - DNA, 166 bp, Heterodera glycines
  Genomic contig location: Contig_ID=SeqID_12681; Location=3216..3381; Strand=+
  SCN-specific regions: Sequence locations=1-166
atgaaaaaacaattgcacaaattaagaaatgaacaagagtcaaaaattatttcccaggggcaaaattcagttaacaaatttattagaaataaattatcaaaagttaatgaaattcctacgttaattgatagtgctggaaatatgttttccagcaatgttcaaaaat

SEQ ID NO: 76361 - DNA, 1518 bp, Heterodera glycines
  Genomic contig location: Contig_ID=SeqID_12683; Location=14..1531; Strand=-
  SCN-specific regions: Sequence locations=1-342,389-407,431-737,766 -835,857-1202,1230-1518
  Gene Ontology: Mol. function=5'-nucleotidase activity; Cellular component=cytosol
atggaacaacagtacggcgttttcggctctctgttccgaagcggcacgcgcacctcatttttcgcttctcaagtgggtgttagttgaattgatgggtcatggctagggatgcgatttttagttaaatacctaaaattttgcgcatttaatacgcacagataagcacgaaaaaagcattttccacttggttttgggtgtctacgatgacttttataatacctatttttacctattttggagtttttctacctattatacctatttaaggattttcagaaaattccttaacaaaaatgcaataaaatcaaaaaatacaccactaagaattggaaaatttttcccaaaaatttatttgtttttttatgtaacaaaatttttaatttaaaatgtcaatgttttctaagaacatattaaaaatatttaaattattcgtttacaaagaaatagaaccaaaattttccccttttgtttgcttttttccactaaaaatcgttaataaaaaattttatttacctattttggaatttttgtacctatttaatacctattttgagatttttttttacctatttaagtacctattctgggatttttcttacctaaaaatcgcatccctagtcatggcatttgaatttggcatttaattacattataaaaaagtcccatggttcagcgatgccatgccaactcattcagattttttttatgaaaaccgcccccaccaaaaatgctcgaagaaaatttaaaaattttcaataaaaaattgaattcttgaaaaaatcgtcatggtttttcaaaagggaatttttattttcttttttttactagaaaaaactctaagaaatttggaaaaatttccgaagggagggcggaaaacgagtggggtacgtgttaagacatttgcggtccggacctttgcgcctcggccccgggtttgtttcgctcatattcttttcctcctcttcgttgcttccagttgggtgtgggttataaaagttttttttaaagacttgaatcggcttacttgaaaacccataaaaaatcggttaaattggatggaaaataattttctgacgtttatattttttggggtcgaaaaagctgagccgcaaatgtcgtttttggctgtggacgcaaatgtccgaccacatttgtcgggccgcaaaatgtcctataaccgtggggtattaccccccccccccaaaaaaaaaaaaaaaattttttttttactgggaaaatataaattattccgatttttaaaaactttattagggcgaggagatcccttccttgtaaaactgactaaatttcataacaaaaaaattttttggatcaatttttattttcgcccttttcaggtggaacggtatgccgatttgtatgccggctcctgcctcaacttggttcattatccggtcttctatttcttccgcgctccaatggcactgatgccgcacgaatcgacggtggaccatggggccgcaataccggacaaagggtcacgccaaaacatggacg

SEQ ID NO: 76362 - DNA, 649 bp, Heterodera glycines
  Genomic contig location: Contig_ID=SeqID_12684; Location=1172..1820; Strand=+
  SCN-specific regions: Sequence locations=1-53,76-375,412-489,542 -607,629-649
atgtcgggtaaccggattcaggtaaggaagccaagaaaataattttcttgcaacatttgttcctgcttcggcttggaaacgagggatagattcaaagaatttctaaaattaagggcaatcatacaattttttagaatttgcctcctttccgtcccctttttgccatggcgaaaaaccctaacacaaacaaaaactacaacgcactgttcgaatttgtcgaaaaagtcgacaagccgtgtgatcaggtatgcatccggcaggttgaacaatgtgttgagcacgtaaatttggcgttccgacaattgcacaaatttgttcgggtagcaatcctcaacctctttcctgaaaaaaatttttggaccgaaatatgcattgaaattttaatttaataattttcaaaaaaaaaaaattccaatttcagcgttaatatcgtaggcataacttttattacatgaaaaaaatcgggtgcaccccaaaattttgccgacgaattttttaaaaaattttcaaaattagaaaatttcaagaaattttttttttagcgccatgcgattttcctataatcatgagattttcttacaaaaaaaaatctaaaaaaattttcgcgacacttaaaaaggcataaaacgctaaaatttatggtcttaaa

SEQ ID NO: 76363 - DNA, 689 bp, Heterodera glycines
  misc_feature (19)..(19): n is a, c, g, or t
  Genomic contig location: Contig_ID=SeqID_12685; Location=1446..2134; Strand=-
  SCN-specific regions: Sequence locations=1-354,377-689
atgcatccgacttcatgcngtatccagagtccagaagattacatgagtgagtacatttgtgcggacgtcccttctatgccggacacgcgacttcagtcagcagaagaggcaaagaggatgcgtgaactctacaaaacaatcaccacaaagcatacccatacatactcagcccaacgttatcttgttgatggaaaatgcaaaaaacattttccggttggaaatccttctttgggtaaaagataatattctgtatattaaagaagccattctcttatggctatgtctactcggaaaatgcgtatccgtgttatttacgccgaccgccagcaccaaacgaaaccatgcgtcaaaagcatccacattgcatttctgaagtcgaatgactttacatttttgccaactgcgacaataggaattgctgcagaactactgtatgagggccaaacagtacataagcgaatttgcgtcgcaaacatgttgattcttcaacgccgattatcttggactacgacagacaatttgcgaacttttacgtcgaacccatggcatgaggaaagaagaacgaagaaaaatttaaggagatgagattttgagtatttttgcgttgtaagtcccattagtttcacaatgtttgtttgccttgttgcccgaaaacactcgccactttttacacagaatcactgaataaa

SEQ ID NO: 76364 - DNA, 340 bp, Heterodera glycines
  Genomic contig location: Contig_ID=SeqID_12686; Location=385..724; Strand=+
  SCN-specific regions: Sequence locations=1-239,261-340
atgacaatgagatttatgagttttcatccgagagagaacttctctaaaagattacatttaacattagtaatattctccaattctccaacgttaattatagatcttataagaagagttctggtatccaaattgttttccatataaatgctagtcctttctatatactgaaagaacttttttggaattttgcagggtaatagtgcatctgaagggctttcgaatgataccaagaatgttgaatttggttggcaaagaaaaaagttatagttcaaaaactccgccccacgcgaaatcggcccacgcgaaaacggcctggcccgtaatatgttaacagaaaata

SEQ ID NO: 76365 - DNA, 516 bp, Heterodera glycines
  Genomic contig location: Contig_ID=SeqID_12686; Location=743..1258; Strand=-
  SCN-specific regions: Sequence locations=1-346,368-516
atgactggaaaattgagtacatataattttacaaagtttatgaacaacgcaaacacaccgcgggtatacagaattaggcgttaaaagatgtatccgaccttaaaaattaacatacagtacccataaaaaaactagggcaactaaaatccaccatttcttggtatctttcagatctatgagtacaacatatgggttccctcaaaggtttcaaaacatgataacaaaaatgcgaaaaaatcgggtttttgaattctttcgttttttcctgtccaattttttatggtccggtgaatttttacggtcgggaaaactgcaatagaaccgccctcaaattctgttttccgaattttctggttttcccattttttcagctcaaaccacatacaatttcacttcacacactcaacactgctcccatctgcttcaccaaaaacgcaacgccatggtgctcttcgcattgctccctgtccagctgatgctcgtcaaatgaatatatttgaaaatttaattattaaa

SEQ ID NO: 76366 - DNA, 1861 bp, Heterodera glycines
  Genomic contig location: Contig_ID=SeqID_12687; Location=235..2095; Strand=-
  SCN-specific regions: Sequence locations=1-13,35-196,229-301,323 -839,862-864,886-1539,1562-1861
atgcaacaagccgctccagtccagcatctccaaaatgacagaaatgaacaaccacaaaatatagaaaatcggccgattaacaccgctaacactggggttgccgaaaattctgtaaacgatggcgaaattttagcacacaccatgaactacgaccaaattcttcacgccgttttgaatgttgggtcagcaaaccgacaaagtggacatggacaagatgaagaaaatgtggaaaatcaagatttggcaattcatccgaatttgacgcagcaacatggaggtttgagaatgcgtttcagacgcttgccaaatttgggagaaaacagtgaaagggaattgtggcaagctgggaacgaaaacaatagtggtcatcacagtcatcacattctaaatcgaaattttctgcgcacatcaacgcctaataacgagcacattattcatgagttgcatattcagcacccgcgtcaaaaccctcccaatattcaagcaaatcctaattttgtgcggcaaaatttgcaaaaaactgtgactgataaccagcgccaggccaacccaaacgttctaattcctccacctcaagttattcaacaaccaattgcggtatatccgccagttcagccaccaattccggaaacttattggggatatcccgcaccttactatccacatcccccaccacctatgggttacccaaatcagcaaatgtttggaaatgcgaacactaaggtgccgcaaccgacccaaattcgtcaccaaagtccaacccaaataaatggccagcaaacagctcttaacggcctcgaatgcgttttaattctggacaaattgccggacattaagggcaatgaaggaaatgacagcattaaatcttttttcaaaaaattttcacagtataccagcgattggccgaataaaaagcgcattgattccttggaatcgaaactcagtgggcgcgcagagcgagcatttaattcggctttggccaatgaaccgtttatatttgaaaacataaaaagacacattctccaacaacttgaggcgacggattgtcatgaaatggcagcatttgatgaattaatgcaaggcattcgccgaaagccaagagaagggctggatgatttggccgaccgaattgtgagcctggtgcgaagggcctatccgggactgacgcgaaatttggcggacgagtattcgattaaacacctaatccgcagtttcgataatgccgaacttgccttgagtttggagctaaatcgtcggccaggaatgagttttgatgagtttgtagctctagctgctcgtgccgaaacgacccaaaatgcggcgagaagggccaattcggacagaacgcaacaaaattttggccgtagccagccacacagacaatatgatggaccgatggccaaacaaagcacaaacgcatttgagccgaacaaattccagcgattcaatgaaaatcgaatcacgtgccaaagttgtggaagagagggacatgtggcgagaaattgttttaagcgttttgcagatcaggatcagcgtcgatattttggccaaaatcaaaatgcgaccggtgccaatagagcacaaatggcgacacattcaaatccgaatgtcagccaaaaatccgaacaaaatcagtttgaacagcgccagcaacaccagcaatcacgaaattttctaaaaaaaaatttcctggtcgaacagaacgaaaagcaagttgagtcttccaatgttcagtgtgacggtgttatcagcaatacacctgaaatgttggattttttccgaaaattttggacaaaatgcgatgaaacagtggatgacggacaaaaagaagcatttccaatcggcaaataatggcaataaa

SEQ ID NO: 76367 - DNA, 983 bp, Heterodera glycines
  Genomic contig location: Contig_ID=SeqID_12689; Location=480..1462; Strand=-
  SCN-specific regions: Sequence locations=1-106,136-187,209-402,424 -544,635-729,751-758,780-890,913-983
atggtggagcctcgccacaggagccctgccttggtgatcgcaggaactccccagccaggtaagtttaaagagcagcagcaagtccaaggaaaggaacgatggaaggatgagggggagatggggtggaaagtgggggaagagatggacagaaaaagagcgatgagaaggcactctttccacaggcacactcttttcttttccccaagagccgtgcactatttccttcccatgctcgtgtgtcctttggatgaaaacttcttcactcttttgctcgccgtctttttctctccctccaaaaggtagcaacagtcagacaaatgcacagctgggcaaaaaaaaggaagagataataggagaggagggaagacaaagaaatgggagatgtaaagagagtgtgtaaggaaaagaaaaagagaaattgagagatcgctaatttgtaagctgtgcctcgctgccatttaaacccatcacaaaagttgctcaaaattctcttctttcatatataaggaaaagctgttccgtttgttctgttcattccaaatggacatatactaaaattggaacaatacagagaagattagcatggcccctgcgcaaggatgacacgcaaattcgtgaagcgttccaaattttttgcctttttttatttcaatgccaaaatggaattcttttaattaatgtgtttttttatgacagagaagaatgaatccagaatagatttcaattataatcttttgattttttatataataattctccaaaaatgtccactattttggaatttttaccattaaaataatacgtcactatttttgccattattttggttttttagaaatttcataaaaaatgcaataaaaacaaaaaaatacacccgaagaattgaaaattgaattacggcaaaatttaaaaaactgatccctaatttcagaaatatgaatatttgatcgatttctatggcaaaaaaagaactataaaataaa

SEQ ID NO: 76368 - DNA, 1016 bp, Heterodera glycines
  Genomic contig location: Contig_ID=SeqID_1849; Location=694..1709; Strand=-
  SCN-specific regions: Sequence locations=1-1016
gacgccgtggcactgtgcgcactgctggaacttcgtcttccattgctggcacttcgacacatccgaaacaccaacatcgtggacatggatctcaaacaactggcacggcatctgcttctaagcgtatgttttggtgtaccaaatttctatttgatcattcaccattcgtttttaaggacgccgtggcactgtgcgcactgctggaacgtcgtcttccattgctggcacttcgacacatccgaaacaccaacatcgtggacatggatctcaaacaactggcacggcatctgcttctaagcgtatgtttgatgtaccaaatttctatttgatcattcaccattcgtttttaaggacgccgtggcactgtgcgcactgctggaacgtcgtcttccattgctggcacttcgacacatccgaaacaccaactcgtggacatggatctcaaacaaccggcacggcatctgcttctaagcgtatgtttgatgcaccaaatttctatttgatcattcaccattcgtttttaaggacgccgtggcactgtgcgcactgctggaacgtcgtcttccattgctggcacttcgacacatccgaaacaccaacatcgtggacatggatctcaaacaaccggcacggcatctgcttctaagcgtatgtttgatgtaccaaatttctatttgatcattcaccattcgtttttaaggacgccgtggcactgtgcgcactgctggaacgtcgtcttccattgctggcacttcgacacatccgaaacaccaacatcgtggacatggatctcaaacaactggcacggcatctgcttctaagcgtatgttttggtgtaccaaatttctatttgatcaccatgatttccgttttttaaggacgccgtggcaaaaaagcagaagggcaccgccaaaacccagatgagccaggcggcagccaaaacgcagatgagccaggccgtcaaatcgtcgatgatgagcaactccgcaaacatgcttatcgacaaatacctttaa

SEQ ID NO: 76369 - DNA, 1351 bp, Heterodera glycines
  Genomic contig location: Contig_ID=SeqID_1852; Location=661..2011; Strand=+
  SCN-specific regions: Sequence locations=1-7,30-168,190-567,590-1351
atgacgatggatgaagaagaggaagcagcggcagacgcagattttgttgaagataagaataagcaactcatattagctaaatttataatggtaagacgaatgggttttttaaaattaaattcagataagggtaaatgtagaaaagcatttgaacgcattatcatggataaacgaatgaaaaaataataatgaaaatagcggtggagcaaccacttttatactatttttttttttgaatttttttttcttcgttttcattttgtaattttttgcctatttttcaattccattttttgtgactataaaaatgtttaatttttccatttccctctcattattaaattatttccaataagatttttattcattcatttcccaaattcattttcattggtactttgtgtctcttctgttggtcggctgtggcaccattctttggttcttttgggacaacgtcaaaaaacgacgacgccccaacaaaaaagaaatgtaaaaaacaaaaattaaattaataaatcttcttttttttcagcttcatctctgccgactgttggctcgaagtgttcgctttacttccgccttctcagcttggcctcggaatcgctctgatcagtcgccgattttaccgccgcgtggacaaacatttcaaagaacgcaaatggatattggacaccgaattgcgaattcaagagaaagagctttggtttggcaggaagcaaatggaaattgtcaatgccaattgaagcgtttgccaatcccacaaaatccgttgcccaacaaagtcatcggatttaaacacattacgttcatgtaaaattgacaagtttcccattggtttgagataactttttcttgttttagttacttcgaccacaatattctcaaatttgtccgccgttttcaccgctttttcactttaattacaacatctttaggcattatgagtgaaaatgttcgcatttttgagttcttcctgtccaccatttggccaatttttggtgactccattcaattaatgtggttgaccacttctggtttccgtcgaatgcgccaattagtcccgtccattctcaacgactgtccatcccttcgtttcgtcaccttcaataatttccgcccgatggcagtgccaatgcgacggatggtcaagtggtggttaaatgtttgttcacgcctcgttcgctaaatttgctgaatttccggaaaaaaccgaaaaaccaaaatacttgatttttaaatttttgataaattttctagatttttttcctaaaattagaagaaaaaaaaatttgcggcgacgtttcggcggcgggcgacgttttggggtgtacccgggacggacggtgccgaa

SEQ ID NO: 76370 - DNA, 1506 bp, Heterodera glycines
  Genomic contig location: Contig_ID=SeqID_1853; Location=269..1774; Strand=+
  SCN-specific regions: Sequence locations=1-202,254-606,630-1176,1198 -1506
atgcccttcgggaagacaaagtgataaattgaaatagaaatggaaaatgaccggaaaaaaatttgaaatcagtcaatccaaaaaaaaaaaagtgaaaattcaaatgtgaaattaaaaacttaaaaaaaaaacggaatacaaaatacagtaaaaatacagtaggtccttcgggaagccaaagagatgattgaaaattacatacaaaaaaataaaaataaagaaaattataaaaattataaaaattaatttaaatcatatacagtatacaaaagggactacagtactcaaaaaaaaagggggaattttgccggacatgttgatgagcaaagtacgctcacagcttgcgttatcgttttggcccatctgctgagaacattgctcacttaacgttagcactgcgctctctctctttcttcccccccccccggcgctgctctcttttgtcaatcggaagatctgttgcaattcgtagcgtcttttcacattcatcccttcttcgttgctcttccttcttccccccccccccccggcgatgaagggcggaggatggcgtcgcttggccattcatttatgagacgccaataaatatgcggatttgcagcgcatttttcattcttcactaaacaccatccttcattttgtgtcattcatttacgtcccatttgttaggaatatttactaatattttcaatgtatattaatttgtttttttcattttaggcattcaaattttcaacttctaacaccaattaactcttcacttcaaatcgttgaatattggactcggcatcggcacacttctgacacaactcaacaaggacaattggcaaggacattgcgcttcggcatctctctgtgagtttacagtaataggtactgtactaattaagaggggaggatttctcaagcctttgggacccttattggactaaaaaatggtgagacttcttacaattcgtaagtcttattaatcctggtaaccctaaaatttggccaaacaaaaggtgccttttacttaatagtctctggtgataattcgactctcaaattgtaaattagtggggtccaaaaggggcataataaatcatttatattgtgctttgtgaattataggggttttaactacggtaaaccgtatgtcaagtaaatgacatttattgatatttcgaatactgtttcgggttctaccttttctggactctgctggactgtgaactgtggactgaattagcgtttgcttggacagtttggacggacaattacgcattgcttcggcatttttctgtaagtccaacagtactgagcatattgtaagttatgaattaatttttcaaatgtaagctaattaaatttattgatcgcgttaattaattaattattacagattcctaaaaccacagtaatcaaaattgggttaatcttttcaaatgtacagtaatttccctatgcttttggttttctttggtcaaatttgagtattattggttcaaaaacgatgagttagca

SEQ ID NO: 76371 - DNA, 1224 bp, Heterodera glycines
  Genomic contig location: Contig_ID=SeqID_12690; Location=242..1465; Strand=-
  SCN-specific regions: Sequence locations=1-112,134-456,579-585,607 -1200
atggactcacttcgcttcgcttctcttaatgactacgaaaaatgggctttctccgaagccatttatttggcagcagagacacaaaggtacggaagacggaaaatctgtccaaaaatgattcttttttaagatgggaaatggcacttaagctgagggaattgggcgtcgggtggccaaatgtcggcttttggatggatgcgatggaatgggccatggacagcgatgatcagcggaagttgacgcagctggtggacgagttcgggacgacattcgcaagcgaattgacaaaaaatggggagaaaggcagaatggggcgggggaacagaaacgacggaatggcacggatgggacaattggtgagaaaatgggggggggtcgaaaaggcgatcgggtcaagtaacttctttaaattagcaaaatggtgttccttttttacttcatcttctttttttctgttctctctcctctttctctctctctttctttctctctctgttccccctctattctctctctctctctctctctcccctctattctctctctctctctctcccctctattccccctctctctctagcttttccgtcttctctcctccgcgtcactctcttccgtccgttttggtgccgcgcgtgctctctcttcgctttttgcgcaactccaacggcattcgttggtccattttgagagggaactcaacgcctttttcggctcctccacggctcctccgccgtccttttctccgattttgccaattgacccgaaatttgtcgactcgcccgatctgtccgatattcgctttcgcttcagcgatggccaaattgtttatggccatcgcattgttttggtcaatgcttcggaggaatttcgccggattttgaagttacaattgaaagaatgacttttagtcgtgcacaaaaatgcgctttttatcagcagaaaacccaacggactgttggaaatgagcgaatgcgacgcgaccattttccgagtactgctcgaatttgtttatggtaacatagccaagtgcatgagcgaactgctcaaattggacattgacaagcgaatggaaatggtcaaagcagccaaacactttgggatgcggagattggacgaaagtgcgcagaaagtcactggagaggcgatcactgtggaacactttgccaaagtgtacacttttgcgcgggttatttcaacttaaatataattatttaaattaaa

SEQ ID NO: 76372 - DNA, 712 bp, Heterodera glycines
  Genomic contig location: Contig_ID=SeqID_12690; Location=1993..2704; Strand=+
  SCN-specific regions: Sequence locations=1-304,327-387,544-712
atgtttttctcttcgcatctcaccgccctcgcccctttcggctgtccaatcgctgcgcccactaattccgtttcttccattgctattgcccaattcagcggagtccatccaaaaaaatcagggaatattttcgagtcgatcggaacggccgatgatgttagttgatgcgaatggcattcagtgcccaaaagaatggcttttgtagcggcacaaaaggggagactccacgaatgatcatcagcgaaaagttgggaagcagtgggaggagggcaatcgaagtgggggagaagcaaacgagcagcccaaaaagggaggggagaagggcattaaaagtggcaaaggaaaagccaaagaaaaagccaaatggaaaagccaaagaaaaagccaaaaggaaaagccaaaggaaaggccaaaaggaaaagccaaaaggaagccaaaggaaaggccaaaggaaaagccaaaggaaaagccaaaaggaaaagccaaaaggaaaagccaaaggaaaagccaaaaggaaaagccaaaggaaaggccaaaaggaaaagcattggaaaaagggcaaaggatgataattaatcggaaaagggcgagtcagaagaccaccccacctgaacgatgtcccagggccgaattgttctcgcgcgtctctgaagtgcgtacaatacgccctttctcagccactgttccaatggcggtgccgtttttgtactga

SEQ ID NO: 76373 - DNA, 402 bp, Heterodera glycines
  Genomic contig location: Contig_ID=SeqID_12690; Location=2907..3308; Strand=+
  SCN-specific regions: Sequence locations=1-402
atgtggcaaagaattggccaaggagttgagcaattcagagacagaaacggactcggaggagaagggagcgcaatggtgcagaaagtgggaaaggagaaagtcgaaaatggcggcgaggaacagagagacctgccgatgagaggggaaagaatggcaccgaaagaatggcacggggagaagagaccttctcgtcaacaatggcaccaattcgagagtcggtcatccaccggagaaagagtccgccgtttaaatgcttcaattggcttcgatcactcagcgattgccaccgctttgactgatcagcgactgttcggacgaaatgttcggaggttttctgagcatgacgaatcgcatgccaagcaagagaagtgggcaaaaacagctgaatttggtggagagtga

SEQ ID NO: 76374 - DNA, 485 bp, Heterodera glycines
  Genomic contig location: Contig_ID=SeqID_12691; Location=146..630; Strand=-
  SCN-specific regions: Sequence locations=1-141,175-238,272-411,462-464
atgcttaagcaaaatgtaattgatgccaaacagaaaaacgaagaatttgatggaagttccaaaaaggagaaaggaagagcaaaaggcgaacaaagcgatcagagttttacacggaaaatggagcgatctatgcgaaattggttttaaaataattaaataaaaaatgaattatttcagtccaggggtagagcacgaacgtgatctgcaacatttttttgcgcagttcgcaacctttgggtttttagcataatttttaaaaatgaaaatttatcgacgcgattgtttcaaatagggttaagccccaaccccgagcccccccccccacccgagacctttttgggacctattccccgacccgacccccgacatgtcgccccccgaggtccccgacccccgactcgtcgctaccccaaatttaaaaaattcaaaaaattaaaaaaaaatcaaattttaatttatttcaggtgaaaatattaaataataaa

SEQ ID NO: 76375 - DNA, 107 bp, Heterodera glycines
  Genomic contig location: Contig_ID=SeqID_12691; Location=628..734; Strand=+
  SCN-specific regions: Sequence locations=1-107
cattgcttcttcattcaattagtgcctctaattggctcatcaattgctgtcactttgcaacttggcattggaattgatcgtctgtttggcgttatgttaccactatg

SEQ ID NO: 76376 - DNA, 2503 bp, Heterodera glycines
  Genomic contig location: Contig_ID=SeqID_12692; Location=624..3126; Strand=-
  SCN-specific regions: Sequence locations=1-775,798-901,923-1760,1782 -1853,1875-1905,1941-2423,2446-2503
atggtttctgatccaaaaagagtgcttctaatggcgaaatacgtcacaattttctccagaagaaatcctacaaagagaattaggattttggtcttctttgacccaggttcgcaagtacccatgatcaaaagtgctgtagtgcgagccgtaagcttatataaattgaaagatggccagctagaagttagcggtttccacagcgattcacttttaattttccgaataaagacctggtatggaaggaagggcagcccatttctatgagtaaatttggtgaaattttttgccacttttttagtaagctttcttttttcaatgccacgagtggacccaccaggggaaattcgtggttagacttagttttgccggcaaatgatcaaattgtaaagcaatgtactattgaaggtggtgttttttcatcggatcatttagcgcaaattttcacattgactattccaaaaacactacaaaaaacaaacttcttttacaatcgacggttttttccgtcgaatgtttctctttttaatattatggtttcttctagaattagcgctttatctaacgagcattttagtatgaacgaaaaatacaacgcctttaataatacattgctagaaaccttaaacgagtgtattccaatgaaaaaaattaccaaaaaagatttgacccctaaatatccaacgcatttattggcctccatcaaagagaaagccagactgtataggcaatgtaaaactgacccaacaaaaaaagcactttatgatagcattagtttacatataaaaatacaaacaaataaatttcactcgcaaattgagaaaaaggctatttcaaagggaagaaattccatttttaaatacctacaaaaatacgatgttaatccctttgaaataccgaatttagtctttgaaaacaaatgctatcatgatggtgatgaaaaatgtgaattattagccaacttatttgcaaattcgtttaacaattctgatgttgacccaggctacctaaacttgggcaatacttttgttaatcaatgttttatatcagatatagactttaacatcatcgagacacaaaaacttttgaaaaaacttccgaataaaaacgggacctccccggataatattagctataaaatattgaaaaactgccattcttcattagcaactgttattactgacctattcaggatttcattagactctggttctcttccagatatctggaaggaatcaatagtttttcctcttttcaaaaaaggggacaaatttaatcctgaaaattataggcctatttctataacctgctcactttgcagggttatggaaagaattcttagccaaaatatttacaactttctcctaaaaaacaataaaatttcggaataccaatttggttttgttagaaataggtctacgacaagtcaactaataacagttgtggaagattggtacgaggcaattataaatggaaaaaatgttgactgtatttatattgattttcaaaaagcatttgactcagtgccccataatttacttttatacaaattggaaaaaattggtataaagggcaaacttttaatgtggataaagggctttttgagtaataggacttttcgagttaaaattggggattctttatcctcaagtaaaaaagttacctctggcgtcccccagggctctgtcctgggccctttattatttttgatttatattaacgatcttcctgatgctttgccatcaggagtgaaaataaaattatatgctgatgatgataaattatatatttgttataaagcaagaaccgacacagagattatgcataaagcattgcataatttattcgaatgggcaaataaatggcaaataaaagtttcaatgcaaaaaacttttgtattatatttgggttcaaaaaccccaaaagaaacatataaatttgatggaaatacaataaatgctgtggatacaattagggatttaggagtaaacattgataacaaattacaattttccgatcatattaaccaaataacaaggaatgcgtatttacgtatgcgttccttgtttagaataattaaatccaaatcgtctaagatttggattacgttatataaaacttatattaggcctttattggaatacgctccagaggtttggaatccgtctcttcaaaaaaatattaaaaaaatcgaaaagtgtcaaaaatatttcaccaaaaaagtattttttaaatgtagccttccgccaattccataccaaaatcgattagaatacctgcaactgccaacacttgagaaaaggcgaaagctgtttgatctgttcatggcgcataaaattgtttatggccgaacagatctgaaactattttctatttttaatccatcagcacgctttaacatccccttttatagatttaacacaaaatacaaactgggcaaaaaattcattccctttgctgggagggtaacaaaattgtggaatcaactagataaagaactaataaa

SEQ ID NO: 76377 - DNA, 376 bp, Heterodera glycines
  Genomic contig location: Contig_ID=SeqID_12693; Location=109..484; Strand=-
  SCN-specific regions: Sequence locations=1-376
atgaaagcgtctcaattccacttcatcgttgttgacatttgccatggcattaactcagaatcgccaggaaagtgtccccaggatgaattcacggaggagaaaacggtcaaggaattgagcaccaatttggccgagaatggtaaggcaacagaagaagtgccaaaagcattggccaaattggcaatgactacgataaaattgtcaggtaccattgtggtcaacatcttcacattggactcaaaatccgacattccgacagtaatttaaacactttttgcttttatccctttggtgttcagcagcatcaaatcgccaacagagcacatcggatgctccaactctaccagaaatacttcaaccattgcttctttgttaa

SEQ ID NO: 76378 - DNA, 1525 bp, Heterodera glycines
  Genomic contig location: Contig_ID=SeqID_12696; Location=499..2023; Strand=-
  SCN-specific regions: Sequence locations=1-1281,1347-1363,1386-1525
atgtttttggcgcacgcgagtgatcatttcgtgactggaccgcccgcgtgtgatcatttggtgactgtagcacctgtgagcggtctcattatatttgtggcgtacgcgtgtgatcatttggttactggaccgcccgctagtgatcatttgttaactggagcgctcgcgagcggtcacattatgtttgtgtcgcacgcatgtgatcatttggtgactggagtgctcgcgagcgctcaattatgttcagatcacacgcgtgtgatcatttgttgaatgggccacccgcgggcggtcacattatgtttttggcgcacgcgcgtgatcatttcgtgactgaaccgcccgcgtgtgatcatttggtgactgtagcacctgtgagcggtctcattatatttgtggcgtacgcgtgtgatcatttggttactggaccgcccgcgagtgatcatttgttaactggagcgctcgcgagcggtcacattatgtttgtggcgcacgcatgtgatcatttgacgactgtaacgcccgcgaacggttacattatgttcctgtcacacgcgtgtgatcattagttgaatgggccacccgcgggcggtcacttaatgtcggatttgccctttgtgatcatttttcagcaggaacgcacgcggtcggtcgcttaatgactgggccgcacgcgtgcgatcctttatcttttgtgcttaagccgcggcgaagcgcacggctccgtgcgcccggctacagacccctcttccgggtgatcttccatcagtcgtcgacgaccggcgacccggcggcggagcgtcgtaagcagcaacgccgctccagcagacgctgtcgacaacgtctgttgcggagacgtctgagcactgaacggcagccattctggcgactgttggagcacgagtggggcgaagacgagcgccaccgggcgctggaggaggatgactggcagctgtatggcgaccagttggcgaccacccgcgacgtgatcctggccgacggccgaccattggacgactggattggtcacgacgagaccgtcgacgaatggaccccgctggaccattcggagctaaaacaactgtccgacggggtgcaccggaaggcggacgtcggggccgaagcgtgtcccatctgcatggagccgttggtggaccaggtgctgttgtgcacgggctgctgcgctcagcgcttttgcagcgtttgtttgtggacgcacgcatgccagagtcgggcgtgcccactctgtcgtcgtcatatgctgacgggcgaatcgttgaccgtcgacgccagtggtgctgacgacagcaacgacgatgtcgacagtatcgatgacgaccacggcggagctgaagcgacagtcagccctcggcagcagcagcagcacattcgtccgccagggcgtcgccgtcgacatggaccagcgacggaggccggctgttctggctacggcacctggggttcgccgtcgtccaacagcacggagggctcatttgtggagctgtccgagtggcacgacgaatga

SEQ ID NO: 76379 - DNA, 608 bp, Heterodera glycines
  Genomic contig location: Contig_ID=SeqID_12696; Location=2335..2942; Strand=-
  SCN-specific regions: Sequence locations=1-38,61-164,186-521,546-608
atggggactgacaagtccattttcggaggaagaaaattggtcttgaagtttgaattggaagtgacgcagctcctcaccgtgaaggagtgggagcggcatgatcgacccagcgagcttgcccgtgctcagccgcgcgaccgtgtccaactcaaccgtctcaacgttgtcaccagcaaggccggggccacggtcgaaaacacgttcttgttttccactacgtacgggcagttttcaaccatgaacatcatcgcgcatgccggccacggtatagttttggatagcgtgtggggatgccattcattgtcactgttgcctaattaataatccaattacagagtggacgccaacggggagcgcgccattgccacagaatgttttggcaattgcaaattttgaaggtacaatgccaacaaattattgccattatgaaccaattaacagatgggactcgagttggcacttcgggcaccgccaccgtgaatctcgcgcaacagccacaactacaaccgagaaacgaagtcgatgaaaatgaggaagatgatgatttgttcgttttctctgatgaagtccgagaagtgcgaggcgatcagcagacctcggtgagctga

SEQ ID NO: 76380 - DNA, 1188 bp, Heterodera glycines
  Genomic contig location: Contig_ID=SeqID_12699; Location=159..1346; Strand=+
  SCN-specific regions: Sequence locations=1-692,714-915,948-1124,1148 -1188
atggcacataagcaaccttctaattctaacaacgttcaagtcccttcttgggatgaattcaatttggtgcaagaggaagcaaattcaaatcggctttctgccaatggatttgaaaatgaccagcaggaaattggaccaatttacgaacctggacatgctgaagaatttggaccgaatttaccaccaggtttgttagaccgagtattttcctacattaactttaggatttgtccttggtgaattacaacaagaggattcggtttctgtcggaatgaattgtgatggcgcaaatgacgacttttctatcccaatcggtttttgcttttttattttaagttcttagttttttttagaagcttatgaccttgatgacccagaagaccccctccagggcggcgcagctgcacagaaaaaggcgaacaatttggaggttcacaatcatccattggtattgccgaaagttgtgcaccaaaaaagtggtcggtctgtcactttgcgaacagagtttagcatttcttaagacgaacaatgttcgctcccttctctgagcatttcttcggggcaattggccgattttgtgcccgtggaccaaaggccgtgcagcagttcgaccatttttcagtgcgacgatgaaaaaacttttgggccggcacttcctcccgaattcgtttctatagcgtcgcaacaatttgatggttggtgaataattaaaaagcaacgtttatcaatctattattttctaacacttttcattgtttgttttgttcagaatacgatattggaacgtcgcttccaccggatgagccgcagtgttcaatggacttggcaaagaaagtgccggaagggactaacattcatcgcaaaccaaaatcgattctcgaacggacgaacttcggcccgactttgccgagcagtagcgacgaggaagaggaagagaaaaaggaggacaaaacggaagacggaggaaacgaacattttgggaagggcgaagggactgatgagaggcgacacgacgtggggtgggaagagggggaggaagaaacggttgggccaatgccaccgatgcccgggaagacggaggaggagggacacgccgaatatctgggcagactgacagaatttgaattcaacaaacacactcaggtcatttgaggtcccaaaagaagggacaaaagcaattatgactaa

SEQ ID NO: 76381 - DNA, 2054 bp, Heterodera glycines
  Genomic contig location: Contig_ID=SeqID_12700; Location=1..2054; Strand=-
  SCN-specific regions: Sequence locations=1-346,414-1337,1360 -1991,2032-2054
  Gene Ontology: Mol. function=chaperone activity; Cellular component =cytoplasm; Biological process=muscle contraction
gttttcttcacatttggaccgtttcgaccgtaattggcgtgacgaccccttttggcgcgatttgtacccgcgttgggccgagcccatctttaaagatggcatcgacgtcaaagtaaacaaagtgccgattcattgactcactcctccattttcttctctctcagactaacatcaccaacgacagtaaccgtttcgcagtcgaaatggacacttaccaattccgcccggaggaacttcaggtgaaaacgatggacgacactttgctgattgagggacggcacgaagatgttcgagacagagacaattacaccaaaatggtatttattggaagggaaagtgacggcacaaagagagagagaagagagggttgagagagagagacgggaaagggatgatgagagagaaaaaaagagcactcttttcagtatttcgtccgcaaataccaattgccggccgatgtggagtcccactcgatcagcagtcacatcgacagttctgtgagtttgccgccccaccgcccaattagccattcccaaagggccgtctgagcgtcgaggcccaaaagcgttggcaggccgtggaaggcgaacgttccattccaattgagagcggctcgcgtcgtcagggcgggggctacgggtcgcgctcgagctcatactcgccgcgcgatcgctactacgccgactcaggccgagggtcggccaacgattattacagggctgagagccgtctgaacggagcggcgaacggcggcggtggttacctttcgccaaacccgcgatcggacggatatcgaacggaattcgagaaacgcgaggtcagccaatgtgccgggggaagggatttgactttggcaattgtagacggacgcgaacggaatgcgacacgaagcgagacgggaggaattccgcgaggaggtgggccaaatggaaaagcgacgccccccccccccgcccaaccctttcgtccgttcagttccgtcgcagcggatcggccgctaatgttcttccaccggcctcgcctatgctgcgcaccgagtcgcgtttgagcggcgcggtcggcgccaatgcgtcgtcaggcgaagaacgccgcgaatcgtcgcacttccgccgaacggcttcagccgcctcgcgcgagtatcggtcgggtggcgctttcgctggcggaggtttgttatgaagggcaattatcagccgttcaaacaaattgacagaaaatcttttgcggccggcggaggaattgggcgggcgaagttcggcatttggcactcgaaacgtgccaattcaccgtggataaagccaatgtgagggggaagcgcccgcatggacgacacataagacgaacgaacagacaaaagacgaaatcactcccccccactcactcatttgccttagagtgtcaaagggcagactgactgataaataagcccgatcactttttattgcttcaaattaaaaatgtacccattttccatgctaatttagcctcattatcagtaaggtgcttcttacaatacagtcgaaatagtggtaatatcaaaatgtgcctttgctattattgcccatggttttgcatacggcgcactgaaagcggaatttttccataaaaaatacattgaaaaaggagctccgcagggacggtcccaggattttggcttgggggggggcacctccccccgggcgacgaccttttttttttttttttgcttttcacacccgttttttatgtggcgggtttttgcaaaaaaattttggggtacagggggtccggtggtgccgataggcgccgccgggaaaatttttgcggttttaaatgcggtttgttaacagattttgtccaaaaaatgaccaaattttgtgattttgagctatttttagcagattttcattaaaaatttgtggattttttgaaaaatttagcgacatttcttggaaaatttgggcgaggccaggtctgtggggtggggggtaccagcccagcaaggaaaacctaaaattttcagccaaaatattatttttccttaaaaatttttggacccggggggctcttggggc

SEQ ID NO: 76382 - DNA, 216 bp, Heterodera glycines
  Genomic contig location: Contig_ID=SeqID_12701; Location=1099..1314; Strand=-
  SCN-specific regions: Sequence locations=1-14,36-216
atgctgacgaatttcattgtatttcatgcaatgtggacatctcactcggagcagcaggaaaaaacgcaattattcgacacatatcaacggaaaaagcacaaaaataacgcaaaggcggcaaatatcagccagggcatcgcagagtttgctagcagttcaacaacaccaacaaattcaacaaaaaatgaattacttttataaaaataagataataaa

SEQ ID NO: 76383 - DNA, 163 bp, Heterodera glycines; identical to SEQ ID NO: 55995
  Genomic contig location: Contig_ID=SeqID_12701; Location=72..234; Strand=+
  SCN-specific regions: Sequence locations=1-7,31-118,140-163

SEQ ID NO: 76384 - DNA, 1277 bp, Heterodera glycines
  Genomic contig location: Contig_ID=SeqID_12701; Location=1621..2897; Strand=+
  SCN-specific regions: Sequence locations=1-225,247-290,313-639,661 -1277
  Gene Ontology: Mol. function=scavenger receptor activity; Cellular component=plasma membrane; Biological process=cell recognition
atggcttcggatgtgagcagagttgccccaaggcattttggggcgtcggctgttcagaaaagtgcctttgtgatgcgaatggtggcttttgtaaccccaacgatggcacatgcggtaggtaaaactgccgattcgattgcctaaaattccgtgtctgacagagtgtgcgctcggattcaccggcaaaaattgtgaccaaagtgaataaatttttaatacacaaattgcataaacaatgtattttttactaataatgtcaattttaaatttcccacttaataatgcgtcgttttgttttctttttcagaatgtcctttgggcacttggggtttcaattgttcccaaaattgtcgcctttgtttgaacggtagtttgaatttccaaattttgctattctttcattttcggtacctttttttcagtgacggccaatgcaaatgtccgcctggctttgaaggcgatttgtgccagcgtcgctgttcggaatggacgtggggcgtttcgtgcatgaacaattgcacgtgcagcagcggccgaaagatttgcgacgcgtcgacgggactttgtgaatgcgcgtcgggtaaaaaagcaaaattttatcatttgggggggggggggggagggagccgagccagttttttacgaaccgatttataaacgtagtttgggttcaatttaggactgaaaggcgacaaatgcgacgagtattgcgatgacggattttgggggcctgactgtgtgaagaaatgctcttgtcgagaagggacttctgcttgccaatcagtcacagggcaatggtaaggacagaaggcagtgaatgctttacaatttgagcaatttcagtgtttgcaacaccggatatttggggaaacgctgcgagagaagtattttcaattttcaatgctttcgagtacaaagcgaaacgcgccttttgttcagcatgtcctgctgggacctttggcaaggagtgcaaacaaacatgttcaaagtgttccgagggtcaaatctgtgacccggcggtcggctgctgctctctcaactcgggactttgcggcattgcctgtacattttgatttattattccatttggcaaatgactgttcaaataacactttttcagatgctgaacagcaaggcgtccaacgctcctccgtctccgcttatcttttgccgggccttttgcttttactggttacttccgtcactttgatcgcttttgcgctttattatcgccacaaataccaaagggcgcgcgaccctccgcttccgactgttag

SEQ ID NO: 76385 - DNA, 606 bp, Heterodera glycines
  Genomic contig location: Contig_ID=SeqID_12702; Location=3857..4462; Strand=-
  SCN-specific regions: Sequence locations=1-241,264-318,373-606
caacttcggaacaattctgaaaagtgcaaaatgattaaaggattttttttccgacaaaattattgggatgccaatgtttgtcataagaatctcgaaatcattgacgacaaaagttggactgtccatcacaagggaaaggattatggtattttcgaacaatttgttattaatcattttttttcctcaaaagattggtcttccgtctttgcaaaacatccgattttgctggataataattcgtccaacattttttactatgaaatttcggtaaaaaataaaaaagggtaagaaactttatttttgagaccaaattatcagaaaattaaattattattataattattaatacttaatcctttattattaatttttcagttgggtcttcttcggattcgccttcaaacagcatataaaattggattggataattgaaaatattggcacttatgcatatgaaaatgatggcgaaattttgattaataaacaaagaaagggaataaatgccgaacattctaacggtgttggtgataccgtaggaattggcgtcaattcgccactcgcagatcatttcacaaaaaatgatcttcgtttgggttggtaaataaa

SEQ ID NO: 76386 - DNA, 1305 bp, Heterodera glycines
  Genomic contig location: Contig_ID=SeqID_12704; Location=913..2217; Strand=+
  SCN-specific regions: Sequence locations=1-29,51-187,215-338,361 -365,426-520,542-542,564-634,656-705,767-834,880-897,923-973,995-1305
atgatgcctatgtttttctttttcgtcttcatttttaattgtttctttaacaacaatggcacttttggtggggtttgcgtttcaaaatacgacccaatgataagtgagcaaatgccatcgaaaaaatatcagtcgaccaattccatgccaagaatggataacaattctcacatcaacattaatggtatttgtatattttaaaattaaatccaattattgcaaaggcttaaaatagcaaatttggaattcacgagattctcgaaatagaaatgagtgagctttggccatgatgtgtttgaccattaaacccggaatattgaaaatttagtttttaattattcaaaattcaatataattcaaatggcaaattttaaaaataattttcaaattaaaattatttaattttcttatttgaaataaaaattcagtttcattttcagatgcagttaattacgctaaaaaaaccaacacaccgggatatcaatcaccatattatacaccgacgcgaagccctattaaggttttctctcttaaaatatttgaataaataaataaataaataatttttgttaaaaaaatatttttagaatggttttccattcaatcacagagaagatttgggacaggtaaaagctaaaattacataataaaaaataatagaagatttttaattaagcagctgacaaatgattcgcttttttgaagttttaaaataaaaataaatgttttagttttttgattttatgaataattacaaaaatattttctaattgataagtgattttacatcgaacacccaaacaccaaaaatttctgaaaatgctcgtgaaaaacttttaaatattgtatttaattattcaaaatacaaatttaattttagcgtgactcattcacaccaaatgacaaagaaaaagtaaaagaggtaatttaaaaaaaatcataaaatatttctgcttcgttgggtcgtttaaacttgaatatttatttgctattatatgtacaataatcggtctacgtcagttgggcgccagcatgtttttggactataacttttttctttatcaaccaaatccaacattattggtatcattcgaaagcccttcagatgctctattagtctgcaaatttccaaaaaatttcgtcaattttgaacaaatttatggccataaaagttggaaaatctggttttttgagttgttctggccataatttttttgaaacttaacgaaatttttcaaaattttgcaggctaatagaagacacttagggctttcgaatgttaccaacaatgttgaatttggttga

SEQ ID NO: 76387 - DNA, 630 bp, Heterodera glycines
  Genomic contig location: Contig_ID=SeqID_12705; Location=712..1341; Strand=+
  SCN-specific regions: Sequence locations=1-57,95-134,158-294,316 -419,442-518,542-630
atgagcttaagccattcgggcaagtttaacagtgaacagccagaagagtcgagacaagaatcagaagaggaagaagaagaaacatcttcatctttggacgccaaaaaggtgagcaaaatttgccaaaaaataagcccaaattaagccatttgaaaaataatattcgaatttttcgaaataaaattattaaaaagggaaagttcgaaattgaaaaaatcaaggttttgaatttcaatcatgctgatcaaaatggacagtataaagagaagaacactgtgctggacagaacgaaagaagtgacaaatttacactacaaattacaaattcaatttattcgatataatgaaaaggtgtcatggcaactcgtaaactgttatacaacgataactcttacaattgcttaggtaggcctaggctttaagcttaggcttaagctttaggctaggcataggcttgcttgggcttagacttaggctttattttgtaaaatacgagttgccttttgtacgagtttattgttataaattaatattttttttatcattttaggattgcttaaccctcgactccccagctgtttttgagaagatatttgttgatgaaagaatgacggatgttagaaagaaatga

SEQ ID NO: 76388 - DNA, 601 bp, Heterodera glycines
  Genomic contig location: Contig_ID=SeqID_1855; Location=1275..1875; Strand=+
  SCN-specific regions: Sequence locations=1-196,226-262,313-534,558 -568,592-601
atggaaaaaaaggcactaaataagagaaaaatgcctgcaggtgagacaaatatttaaatgcccccggggatgaaaaatgaaaataaaaggcactaaataagagagaaatgtctaattgttgcctgcagatgtactaattgccgatggcagcacaaaataaaacgcaaaaagtgccaataattcctgcgaaaaatgcctgcagatgagacaaataaaaaggcaaaaattatgcttcggcagtttatatccctccggaggtgacaaaatacaaaaaaaaaaggaagaaaagaacaacaacaaaaagaaaagaaattgggcataataaataaagagcaaacaaaattagaggaaaacaattcataaaagcccacagaataaaaattggcttaacaaatcctaagcgccaacagagaaagaaaattgagtttaagaatcataagcgccctgaaatctcattaaaaaggaaaaactaatatttttagcagaggacaatgcctgcagatttagcaaagtcaaaaatagtagaacaaaagcaaaacggaaaaaggagagggatttggcttcggccgtaaatgagttaaaataatttgggactagcaaa

SEQ ID NO: 76389 - DNA, 438 bp, Heterodera glycines
  Genomic contig location: Contig_ID=SeqID_1855; Location=92..529; Strand=+
  SCN-specific regions: Sequence locations=1-438
aaaatggtctaagtaaaaatcgtaattacgctcaaaaagcttcttaaacaattttagcgcttccaattccttctacaatcgcctttatacatcacattatgagcgctaaaattatcagagtgccgaaaatcgcatgtgatctaagcctagaaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgc

SEQ ID NO: 76390 - DNA, 230 bp, Heterodera glycines
  Genomic contig location: Contig_ID=SeqID_1855; Location=499..728; Strand=-
  SCN-specific regions: Sequence locations=1-230
taattacgatttttacttagaccattttttctaggcttagatcacatgcgattttcggcactctgataattttagcgctcataatgggatgtataaaggcgattgtagaaggaattggaagcgctaaaattgtttgagaagctttttgagcgtaattacgatttttacttagaccattttttctaggcttagatcacatgcgattttcggcactctgataattttagcgc

SEQ ID NO: 76391 - DNA, 1017 bp, Heterodera glycines
  Genomic contig location: Contig_ID=SeqID_1856; Location=1688..2704; Strand=+
  SCN-specific regions: Sequence locations=1-262,300-402,424-548,570 -1017
atggagtacacagaccttgcggtctgtgataaaaggcttatggaaggcaaacatatgactgcgcaggcaaaaatcagtgacctttctcgggtccatgatgatgttattggtttagaagaagggatcaatcgaaacctgagggctataaataggaaagtgactcaagtagtgggccgagttagtgacatcgaagccgatgtgaatacaggttttggtacaacagcggcaagggttgacacacttggggaagtagtcatgggattggaaagcaaatttgacacatggaaaaatgagcttgagttgagagaaaatatggaattcgatgaattaaatcgaagcagtggggttcagaaaatcttaagcttaggcaagcagttgacttcgccaaggcctatctttccgccaaccccacccccaactcaaaatgcaattaatagctttggcatctttcaaagtacctctaatgtacaaaattcgaataataccgcaggcgatcctgcaaatggctccatgactaatcagtcgagactcatttcaataaatgagtcaggggaagaagatgatgtagatggtaacctgaatgccctaactgacatgaatacgtccagtacacagcctggagtgttctgtggtgaactcgcttcggcatttgatgactgggaaattaagtttagggattatgtggatgtttttggttcggcttggagtgaagcagataagttgaaccgacttaaattgcacttaggtgcgcaagcaagaactatttttgagaatttatcgcctaatgagaaaaataatttggcaaatgcactcaaaaacattagatctaagctggatagccctcactttagagaattggcttataagaaattagctgcatgttaccaaagagagggagaatcagttagtgagtttgtgaagcgcttggttcctttagtgcacacgacttcggtccatattccgtctaaggcgagaagaggtcctctgtcggtgtctcatggagaaagtgagacctga

SEQ ID NO: 76392 - DNA, 3014 bp, Heterodera glycines
  Genomic contig location: Contig_ID=SeqID_1856; Location=4091..7104; Strand=+
  SCN-specific regions: Sequence locations=1-471,493-989,1011-1022,1047- 1248,1271-2072,2101-2979,3003-3014
atgggtaaaatttggctttctgatgatggacagcttggtcttaccttcgggaactcatcaaagttaatggattgtggacagaatattactatctctgaccaggggtttggatcaactattgtgcaggcacctgagtctcatagtagaattgttcggagtgtgaagaaatccaaaacattaagtgatggaatagtcacctcatctcaattagcctcacaacttacttatttggatgcggcaatcacacaaacaatgacatttgcctttcatcactcatttcaatcattttgtcaatttattgaagacaataaacgctgggctgagtcagcattcttctcaaatccaactgatctcgctcggtctgtcttctctaatccgtatgtggtagctaaaagagcagcgagaactcttttgaaagtttggccatgcgttcctcttgatgagaatgaatacgaatttaggccaacaaaattgaaagatgaatgttttgaatatcttccaattataattaaggctgaaagtcgggaccatttggcttttgttgatcctacgacaatgatcataagtccttattccaaaaagggttcgtgtgaagaattccgaagaattgtgattcaaatcaaaaatcaaattcttgagattgaccaaattgaaggcaaaatcacttcggcgactctaagtaaaataaaagcgaatgcgccaaaattgagcatcactgaatttgttccacaaattgagtcacatgcttttcatcaattggtgcttcttaatctgactgacattaagagtcatgcatttgtcagcaatatggttagaacaagtcagatgacttatcaaataagagaaaaggacacccaaattacggcaactgtgtcgcaagagtgggaagaagttgagaatcaaatgattaaagctgttgttggtgactataggaaaaattggatgatcatcatttctgtgatcgttctgattttggctgctgatttcactattagatttggacttagcctagctgagatttatgctggaaatggtcgcctaggcaatatgttatttggcccagccattcaaaaagcgggaaaaagggtcatagaaatgcaaagcattcgtcgtttaaattctgaaagggatgaattatatgaagagccaaataatgcagcttcatggccgccacgtattaggagaacgggtaatttgttatctcagtccttgaaaaggctaaataagcacaatcccagtagaagggcaactgcaaaaccagaaaatatttttgaatgttcggcaattatgggtcaaattggggcattaatgcagcgtccaacgactgtgaccacacaggtcgcactcaatggaattcgaatgaagtgtctaactgacactgggtcaagcacttcggtggctccaaaagcactagctgaatggttaggcacaaaaacctacaaagcggaagcacgtctcatgagtgcctcgggtcacgcggttcacgttaaagaagcaactagagtaaatctgagaattgggaatgaatcggttaatatagtcattcatcttttcgaaaatgatctatcatggacaatgaaggactatgactttattttgggttgtgatgcattggcactcctgccacccatcacaattgacatcaaaaatgcaagcatgtacattaatgatgtatgcatgcctattggtaagtcagccaacaataccttgtacggactaaaagtttgtgcttcacaaacagttgagcttagtccgaatgaacaacgagtgcttaaagctgaagttagagcaccgcgtacgcttcggcatgatataatttttgagaatttggatcagagattaggtgatcaaggaattggtctaattccttctatttctaagcttaattcgggtcaaatccaaacggttttaaccaatccaacagcaacggtaaaacgaattttcaaaggaacatgcctaggcagagcaaatgagatattagcaactgaacatgattcaatttataaggaagctaatcatgatgaaacttatcaaaaattaaattccctcgggaagtctgaagtggaaattgatccaaaattcaaaataaactttgaaaaatcgtctgtaaaaggagcaaatttagacacgcttaaagcattatgtgaagaatttggggatattttcagtaaaagtcaatatgacttaggaaattgtgtggctggtgaacatgactgtcggaactctgggattccgactgccgatcaattgatcagcagaattgaagaaaggaagtggcgacccttccccctccctttcacatgccccgcgcaccccgttccactcctctgcccccatttccctccaaattgttattgtttttctgcgttccttccatgccccgcgcacaattaatgaccaatttgtcaaaaccgcaacttttctgccgccgtccccaacttggcgaatcgactccaaagaacgatgaacccccaaattcctgttttccgtcaattttgtcccctcgctcattttgtggccccgttttttatcatttccccaatttttggcccgtccccgttctgctcaatttcaccattttttgttcaattttgctcgtatttaatgcgacaaatccccaccaattcccacaatcagaagcaccagcaaaggcaagcaatgcctcttccgtccctctctcagtccccctcatttcattgtccttttcccccggcccaattgtccgttccatttctgtcattcacccggtccccctcattcaatgatcagtgattggcccttcacttctatcccatttcgctgtgatttgccccaattgtgataatttccagacccccggttttggtctttgttctgtggccccggtgcccttcaattctttcccatcccggtccccaaatcatttgtgattaatcccccggtgatggcttttttcctgtgatcaatttgtgataattttgttcaccatttcaaatatttggtttaattacccaagtttgaggctttttcccgga

SEQ ID NO: 76393 - DNA, 1331 bp, Heterodera glycines
  Genomic contig location: Contig_ID=SeqID_1857; Location=296..1626; Strand=+
  SCN-specific regions: Sequence locations=1-265,287-623,649-958,989 -1331
atgtgtaatgccatccaaagcaaggaaaccagagcgttgctaatgacgacaaaagcaacgatcttcaatccgtcacggccatccctcagcatgatgggaaccatcttcattgacccgggaagccaccgatcattcatctcgagcagtgcagctgaacaattggatctgaacgtcctcagcacggaagaatgctacttgtccagcttcggtgaacgagaaccgaagcgatacataagcgaccgcgtcgcaatcggcattttatgccccgaccaggacaggttcattttcaacctgaacgctttgaagttcctgctgaatgatttgccggtactacaactaaacgcattggataatgacgaacttcaacaaaagaagctttccctgccgaatgagtcacggcaaccggacattctcctcggaatggacgtttggcaccagctgaatgttcaaccaattgaacaactgccaagcggatttacgatttgccaatcgaaaatcggcaatatcatcagtggaacagggcgaatcgagctcaagcaaccgtccaacatctctttcgtcctaatggtcaacaacgatgaatcgccacaaagcagtaaagcggctcagaggcagaaaaacattcaacaaaaagaaaaggacgaactgagacggcatcaacgcaacaaactcttgtccagcattgcaacattgcgatcaagacggaagagagaatcggctcccatcagctcaaaatcaatcgtgattgatctttcatcagacagcgacgcatccggcattgagatcatacaaaatccagtcagggatagacaagccaaatcaccaaatgagcattcaacggcaccaattcctatggcagtgcaacggctaacaccaacaaggaagagttcatcagttgccaagcgaccagcattttcttccagcaaacaaccaaaaggaaaagcagcgaatcccgcacaaacaagccaaacaaataaactcaacagaaaaatgaaagccttgtcgccaaccgcaagtggatcaggcgccaaccatcattgcgtcgctacattggccagaagctcggactcaacaacagtaattgataagggcagtcaacagaattgcccaaacatgagctcggcaacaatcagtaagacaccatgccaacagcactcgtccgagaagacgttaaactaagctaatcaccaacaattgtccgcaatgacgttaaactagcctaagccatcaacaactgtccgaaacgctaatcacccggctgccacgagtccggaatgacgttaaactagcaaagcatcggccaacccacacaacaatcgtccgcaataaca

SEQ ID NO: 76394 - DNA, 597 bp, Heterodera glycines
  Genomic contig location: Contig_ID=SeqID_1857; Location=1867..2463; Strand=+
  SCN-specific regions: Sequence locations=1-597
atgacgtcaaacaagcaacgacaattggtccataaggacgttaaactacgtcaccaattcaagcaaaagcactcgagcatgcagctgacagcacgtttccggaagcaaattcacatgtcctcaacgattgaggaggttcagcagcgaatgaaccacaacagaccgcaaccgcggaggtcacaacagaggggactaaggccaactcaagcgcctaaaatatgccaatccgggatggcacagtacaagcagggtcgagggatccgccttcacactgcgtcttctgcaatggcactcactggaccacgacgacgactcagcgaacaacccttgcaacaagagcaaggacacgaatccagtacgtcaccagggcgagaacgcagaccacgaaagagccaactacacgccccagatcgcgtaagcacgatttggaaactcaagagcacggaaaattcacctttttgccgtcccccgccatcactcactgctcaatggctcaacctggcaattgagctcttcgcaaaaaatcatcaagcccgagcagatcacctttgcatggcattgctctgtaaaacgcaccacgaagcgttattacactaa

SEQ ID NO: 76395 - DNA, 957 bp, Heterodera glycines
  Genomic contig location: Contig_ID=SeqID_1857; Location=2534..3490; Strand=+
  SCN-specific regions: Sequence locations=1-750,776-957
atggccattcaccaggaatgcccattcgccaagtctgaaatgacgaatcacgaagcacaattgtggtcaacgaatgacgaattggaagtcaacttccctggaccaatcaccggacttttcaaaggcgaacaaatcagcacggcgacaaactgctttgctcaaccagcaacacttttcaactgtcaatatgcaaccgaattctgccaactgcccgacaactcaactctgatttggaaatcaacctgcaatggcaacgaatgccaaacatgcgactacgagaaggcggaagccatcaacggaaaattcactgcggcctacggagaatcaatggccacttggatctccgaagatcacaaaaaggcattaactttcgccaaaaatgcgccagaactcatcgcctgcgatggcacacgcatcgtcatgtccgaacagaacttcggaattgccaggagcaatacgacgacattgtcagcaccacgacaagatggaaataggcatccgaccagaacagctcgcatcacagctctcggcatcccaagtggcaacaagcgttgcgttgaatcagctctacacgcgggagtgtcagcgaaacacgagagcagccaacccaactctccaagccagacgcttactacgacagccaaacgtccaggcgcgctggatcggagaaatgacaatggaagtgtttccatgcgtcaacgtttcgctccaggacatctcctaccgaccaatgaacgattgccgtgtctacatcccagtgacagtgcatttccccgaccgagcgatagcagcatttctggatcccgaattgcgcatcatttctttgacggcgcaattggcaagctgcaacaatcaccgtttccatcatcttcaactgcgaagcaatccgaacatttggctactgatcgactcacgaaccgggattgcgcgtcaaatgccaaaggactacacgcatga

SEQ ID NO: 76396 - DNA, 2033 bp, Heterodera glycines
  Genomic contig location: Contig_ID=SeqID_12707; Location=140..2172; Strand=+
  SCN-specific regions: Sequence locations=1-12,35-219,241-301,323 -526,548-985,1007-1542,1565-2033
  Gene Ontology: Mol. function=ATPase activity; Cellular component =nucleus; Biological process=protein complex assembly
ctttcattttacaattttttaaaatatattttttcagattttcattttccacgcgtgatttggtcactttgtccgaactgcttgcaaagttttacttcaccgttggcattccattgccaatggctttgttccatgcaattgaggcaaatgtgtttgatgcggtgggtgtgctgccatcgcggctgtcatttgaccgacgtgccgtgattgatgcttgcattaaacaggtatacatgaagtccaacggtgtatggattttacactaaattcctttttgtcggcgaatttctttcggttttaaattgcaaaaaattaaattgaattccaaacactcacaaaaaaatattttgcttttttctgtgcaattaaaaattccagtttcattcattgatctccgagttggcattggacacagatgatggtcaagtaccgttcaacattgacattggcagtgagcagcaacttgaaatggacgcacacgcacttcgcattggccctttcagcattgaaagtaaaaatagtgggtagttagttatttggttttgtttttaactgctactattgtattgtaccaagaaactgatatttaccaagattttacgggagagggggggggggggggaaggtgccaatttttgaacatgtaataatcgattaaaagatattaatttaaaaaaaatcagattttgttgatgtccatcgactccccgtcggcttttctctgaacgcgcccgccactcgtcgtaatgcgttgcgtgtggcgcgtgcgcttgcctcaaccaaaccggtcatgttggaaggcagccccggggcgggcaagtcaagtctgattgttgcgctggctgccgccactgggcacaagttggttcggctgaatttgtcggaacaaacggtacgattttttttaattcaaattcttttttctaccttatgctcaaagtcaaaatttctaaaaaaaaatttttttggtatttctatcgtttaaatttttaaaatatcattgaaagatcttttttaattactgttatgatttattgtatttacctattttcattgatcaggatttgcatgatttgtttggcggtgatatgccggtgacgggtccggatggttcagcatcgttcacttggcgtgatggtccagtgcttaaggcgatcaaggaaggctgtgggatactgcttgatgaggttggggaggggaaatgtttcacttcactcttccctctgaaatttttttggaaaagaaatttttcaaaatatttcgttaggaaaaagttttataagaaatttcaagaaattaattttgaaaaaattttacgtgattttttggaaaaagttcgtaattcatcacaaaaaaaaatggaaaaacgctagaaaaatctttcaaaaacttttttttagaaatttttattttttccctcttgtttaagatgaatttggcatcccaatcggtgcttgaggggctcaactcgtgctttgatgtccgcaaacaaatttacattgctgaacttgaccgcacattcacgctggactgttcccgctgcaaattttttgcttgtcaaaatccacaccaacagggcggtgaccggcgagcgttgccaaaatcgtttctgaaccgattcatttcggtagcatttttttttttttggctttttggtcaaacaatcttcggttaattcatatttgtccaccctttttatttaaaaatcgatgtaaaaaagaaaaatttcccaaggaaaatccaccaccattgtttgaacggcagatgggcatgccaatgaaaaaattcagttcaaaattctgtcattttgtttattgatgggtggagagcagctcgtccttctccccccaaaaaatagaattttttttgtcattttataggttaaaaaattaatttttctagcctttttttcaaaaacaaaaacgttcttctttgtgtctgattctgtatatgttcgttttcacagatttttgttgaagagatgccccctatgaagacttcatctacattttatgtgaattctgcaaagccag

SEQ ID NO: 76397 - DNA, 253 bp, Heterodera glycines
  Genomic contig location: Contig_ID=SeqID_12708; Location=474..726; Strand=+
  SCN-specific regions: Sequence locations=1-112,134-253
caactgatccgaactatggaacgcttaagaatttggacgccgacatcctcacgaagaacgcgccagcaaaaccggcagcggcaccaaaggcgggaccggcgccacatggaggaggcggacaggcactgacaccaagtgaaaaaaatggcgaacattttcaaattttaattcctttttcatccccttttcagcgaccgatccgaactacgggacgcttcagaacttggacgcggaaatttttgtgaagaaatag

SEQ ID NO: 76398 - DNA, 1486 bp, Heterodera glycines
  Genomic contig location: Contig_ID=SeqID_12709; Location=1787..3272; Strand=+
  SCN-specific regions: Sequence locations=1-1150,1172-1486
atgtcatgtttaaatgtttatgtgaatattcagagtccgtatgcggaaattgaccaggacaaggctgaagtgtcgcctgaagaagtgagttgttgttgctcagctgtagcaattggataatgttttcttttccatttatattttttaagcttcgggctgcttttgtccgttgcggtggagtcaacgcacatgcatggcgtgttttggttttgttggcggagggcgacaacgagacgaccaaattcattggcaaactgttggatttcctcacggcagaagtactcgagatttgcattctttttaatcggattaacgaccacaaatttcagggaacttctgctcctccgactaattgtccaccggctgctgcgccgcccaattatcagttggccaacccccctttgcaacatcaagccgggacttctcaggtttcttatgatgaagcagtagtttgctctcgtgctcgctctttttttagcgaaatcattttttgtttaacttttaggcctcgcaatttccattctccgccgccatccattctcagtcgggcctcacgtgtcgtcaggttatctttgtgactaaaactttggtcgttgcaaaatttaagtagtcttttattcaggaggttgttagaggtatcgctggcctgaaaactcccccggatcgcatttacgacactatttcgtcatcctcgtccgccgatgattcccattcgccgcataagaaggtttaaatgagaattttttcaggaaatgcatgcttatatttagttgagcactcccccgggtcacatttaccatactgtcatgtcgacctcgtccaccgatggttcgaagcgctcttctgtcatttacgacgttcctccgactcctccaccaccggtgccgcaacatacggttttgttcagggttaatttaggttcaaaatgtgcaatttactcgcttttctcgatttcttcagggggggggagaactttttggattcattttttgaaaaggtcgcacctttttaccctactaccccaaacagcaaaatgtgtgatgagagaagttttttttgtggttttgacaatagacaatcaaattttatccggcctcgaaatgctcggacgcgaaaaaaggtcgtaattttggagacgaactgatttttgaaataaaataaaattgttcgtttttagcgcaaagagacgccgaagaaggacagcgatggaaagaattgaaggcgttcatccatttaacaactcacaaataacatcattttttttgttcactttggacgtttaatttttttgttttgttttaatttcggcatttgattcgagtattttgcccttttcatttgcattttatgtttttagttgctgaagataaaaaggctgttttattgtactgatttatgcataccattaaggtttcccaaatgctaaattgctctaaaatctgttacaggaataagcaatcccaatcagcagaaagtaccattttta

SEQ ID NO: 76399 - DNA, 174 bp, Heterodera glycines
  Genomic contig location: Contig_ID=SeqID_12709; Location=32..205; Strand=-
  SCN-specific regions: Sequence locations=1-174
ggaatcagaaagacgtgctgatcatctcatcgtcgtgcataggcgagcgtcatctcacgggcgcgtctgttgaactccgcgcggtcagtccggtacaaattggcagcttccgcattgagaggcgagttgtccgggttcgggtcattcagcagaacgatgatggagacgacaact

SEQ ID NO: 76400 - DNA, 1636 bp, Heterodera glycines
  Genomic contig location: Contig_ID=SeqID_12710; Location=1..1636; Strand=+
  SCN-specific regions: Sequence locations=1-309,331-342,364-379,401 -555,578-609,631-1064,1086-1094,1127-1199,1221-1323,1345-1351,1401 -1452,1474-1636
  Gene Ontology: Mol. function=RAB small monomeric GTPase activity; Cellular component=synaptic vesicle; Biological process=synaptic vesicle fusion
ccaacaaattattgctcaattaattagcattgtcatccctccctggtgcccctttccccatttccgggactggctgtctcagctcaaaattcacgcctacacagaggtcagtttcatagaaaaaaaaggacttgatgttgttgggctctgatttatatttcccaaaaaatcgctttgatcaaacgtgatcgatcggggcatttcggctccgtccatttcggcactgcgcggcattttaatgtttgttggtgctcaattgaatgcccttttacgtaattttcttgcttatttgagtgtctcaataatcaaaaaggaaatttaattgaaaaatttatggcgaatagcgccaaaatggcgccagaaaagccgaattttttgcggaattgtttttggcccttataagttataaccgaaatttgaaattttgtaggattaaaattgtacatacctacctagattggtcaaaactttcgaacaaaatattaatttgtcatcaaaaaacaaaacaaaattaagcttgtggcgctgaattgggcagcgccgaattgggctcctcctccccactttctgaattttttggtgccgaaatttggtccgacctccctggtaaataaaatgtttaacttcaacacagacgcccgacatcattttgtgtggcaacaaatcggacctggaaaatcggcgccaagtgaggtaaagtaaagttggtaccgtaaaaataccgtcgtattccctaaaaagagcgaaggatttcatttcaagaaaatacggtacaaaatgattttttttttaaatcccatttaagcaccgcacgtgccaaacagctcgccgatcagttggggtaagtaagattttttggtctcttctgatcggccagtggtgatcgaacaatttttgaccatttggccaattgttcagactgccctactttgagacgtccgcttgcacctcctcaagtgggttcttctgctgattagtgaaaatgttcaagaaaattttctcgctttttgtcacgagaaaaattgtaaaatgaaatcgaaaagcactgaaaataactcaatgaatttttaatttatgttttttagcaatttccgaaaataaaaaataatatatatattttaatattccgccaatttcaaagataaaaccaaataacttttatttttttctctctttctttttatatagtaaattgactaatttttaattgatttttcagcaattgcaaaaaaataaaaaaccatatttactgtatttgagcccgcccccctgaaatagagcccccccccccttttgaagggggttgaaaaatagagccctcgggggttctatttcattaaatttctttctgtatatatttttttcaaaatttcagtaaattaaaaaataaatttaatttagacgtcgaaaaatcagttgactgcctactcgacttggtgatgcaacggtgagaaaaattttaaatttacaattgccataataaaatttaacggtggcattcaattttttaaggatacaaatgtccgtcgatggggacaatttgcctacggaatacatgggtgctgggagccgaattacgctggatgaagaggtcacaaatcgggcaaccggcgcttcgtattactgcgcaaattgc

SEQ ID NO: 76401 - DNA, 636 bp, Heterodera glycines
  Genomic contig location: Contig_ID=SeqID_12710; Location=2687..3322; Strand=-
  SCN-specific regions: Sequence locations=1-68,90-541,563-574,607-636
atggctacgagctgtaccggagcaaaggtcacatttcggtcagttttttttagttttaatttaaatccaatttacaaaataattaatttcaaataccccatttcacattcattcatttcccattccaattcccacacacattatataggaccaactccgcgtgtgcatggcccgtgtgctgttcgtcatcccgttgctgcttggcacggtcgaactgttggcattccgtcactattccctccggcacaaacatcggccgaccagcgcattgcccatttgataaaatgataatgcaaattttgtgatttaactctctctctctctctcccccattttctgtttttgttcagcttaattccttcctttctatgcacagggttttttcatataaatttttgttttttccgtccattttttttcattttgtgattttttgatcatcaattataatccccgtgattgttttttttttgatcacttttaaacagttagggcttttttgtacccaaagttccattggttgtgatgattaaatccgggataattaattattgtatgtattgttacggaccgaaaatcgacaaaattttctaaaaatttatttttaggcaaacctattccttcaatgacgaatag

SEQ ID NO: 76402 - DNA, 893 bp, Heterodera glycines
  Genomic contig location: Contig_ID=SeqID_12711; Location=248..1140; Strand=-
  SCN-specific regions: Sequence locations=1-141,163-260,282-284,339 -368,396-417,449-514,536-719,741-833,855-893
atgtacggtctgttggcctccgtttgttccgcctttctgtacgcgctctccgccagtccgttggtgatcattctgttcatggtcctcgacaggtacacaccgaacagcagcagacaccagaagggaggggggggggggcgatgctgcacaactttccctcctcccccaaccgcgaaaaaaattttcaaatatgaattttaaatttttcaaaatttcttttgcgttattttgagtgattttttgttcaaaataggttttaattccattccactctccctttttacaattaaaaaaaataataaaaaatacagattttttaaaaattaaaaaaatatataggtaaactacttttgcactagataaaaacctaaatttaaaaaaaaaaaattttttaacgccaaggtagcgcactcacaaatttcatttaattattttattttgaaaaattggatttctttcaaattttcaagtttgggagggagagaaatgacttacaattagcacagaagggatgacgacccttcaaaaaatctgctcaaaaaaaatttttctcatttttttaattaaaaacattttctggaaatccaatgaattcagtgtcactgtccacgccattgccccgctgttcaacattttgttctccgaatttatagaagatgacaagcaacgctatgccagaaagtgtgtgattattagagcccggacgggaccggggccccgccgggattttaccgggacccccggtcccgggttttttgggcaaaccaccgggaccgggagtcccgtttaaaacgggagtcccggtcccggggccccgtaagggtcttaaatgcaaaaatttatacaattttgaattttttttctaacactctgacaaatttttatgtaataaa

SEQ ID NO: 76403 - DNA, 264 bp, Heterodera glycines
  Genomic contig location: Contig_ID=SeqID_12712; Location=2064..2327; Strand=+
  SCN-specific regions: Sequence locations=1-195,217-264
atggacacaacgacgataaatcggattctagcgggaaacacaaagaccagagaacactacttgggatgcttcccttgcgacaagctcccaagcaaaatcaaccagtttccttcagcgttggtagcgaacaatgatccttcgaataaggaaggatcgcattggatcgcaattttcatcaccgataattctactgcctactactttgacagttttgggcgtactccgaacagatgtattagccactttttgcggaattatgaaaaa

SEQ ID NO: 76404 - DNA, 782 bp, Heterodera glycines
  Genomic contig location: Contig_ID=SeqID_12713; Location=195..976; Strand=+
  SCN-specific regions: Sequence locations=1-241,263-285,308-631,653-782
atgttcatcgttgacgataggaccgtctactattttgatagttttggtaggaaaccgaacagatgtatcagccagtttttacggaattatgaaaaagtgatttcgaataagccagctattcagtcagtgtttagtgagaattgcggctactattgcatttattttgttcattgtatgtgctcattaggaggaagaaattatgagagtaattttgaaaaaatgacaaaaaagttgataggagaagataatccagatttgtttgtcgtgaattttgttaagaaactgataaaaagtatttaaaggaatttttcattaactcatttataaaaatggaccgtttagacacaataattgcttctcttctgaattgtcccgcacgtaacttgtgcgaccgcttaaatcacccggatgagatacaaaaagtagaaaaatacctcaaagggaaaactctacagacaacatacaaaaatcaactagatgaatacaaagattttgagtacggtggaattacaagagaaagtgcacgtaagcaaatggcttacaatggtttcaagaatgtgaccgttgaccagcatttttatgtacggcaccgcatttgtcttcgctattcaagcaatccttgcgtgatcgaaaaacacaagaatggcaatgaacgtttctacccacttgaacttgtgaaagtgaaggacaatgatataatttatttagggcaaaattttcctaaacctttaattcgtgatgataatatgtttattgatgatcaacaatatttgaattggtaa

SEQ ID NO: 76405 - DNA, 739 bp, Heterodera glycines
  Genomic contig location: Contig_ID=SeqID_12713; Location=978..1716; Strand=-
  SCN-specific regions: Sequence locations=1-78,166-173,196-255,277 -355,377-670,692-739
  Gene Ontology: Mol. function=general RNA polymerase II transcription factor activity; Cellular component=transcription factor TFIID complex; Biological process=transcription initiation from Pol II promoter
atgcaaaacccaacatcagatattctgtgcttgagacagctgctcaattgccggttgactttcagctgtgagtcaatgattaaataaagaatttaaaattaaaaatgaattataataaagttaaagttaaaatataactaaattcaatttattttagtataaatacctaaaaattttctcccattattcatttaaaatgttttttccaataatcaaaaattgcgttgctgttgtagacctcaaaataccccttgatattgaaaaaatttatttaatagcgccatctacaaaatataatccacgtaaaattcatgctgtaattatgaaagtgtataatccaaatgctaccgccctaattttctcaactggaaaattcgtatgtacaggagcagctaatgagaaagaatgtaggcaagctgcggagcaagtcaccgaacgaataaggcaatgtgggtactacgaggcacgaatccacgaatttgcggtgaagaatttgattgcgacagctgatgcgggatttcacattcaactcggacctctgtccgactttctaggcgccaaatattgttccttcactcctgaactattccccggtcttgtctatcggaataaaagccccaaagtctccatcattgttttctcgagtggaaaattgaatataaccggaagtaaatcaaagacagaaatagattctgtatttaacaaattttattcattattatgtaattttaaacattaa

SEQ ID NO: 76406 - DNA, 79 bp, Heterodera glycines
  Genomic contig location: Contig_ID=SeqID_12713; Location=2206..2284; Strand=+
  SCN-specific regions: Sequence locations=1-79
atgcaagtcgacgccgctctatccaatggtatatagcttatatacattttcccactcacagctcggaatgttcccttgt

SEQ ID NO: 76407 - DNA, 2288 bp, Heterodera glycines
  misc_feature (2243)..(2243): n is a, c, g, or t
  Genomic contig location: Contig_ID=SeqID_12714; Location=1..2288; Strand=-
  SCN-specific regions: Sequence locations=1-167,199-567,609-622,657 -830,869-920,973-1100,1132-1150,1172-1217,1252-1356,1378-1482,1535 -1714,1811-1820,1842-1851,1874-2194,2217-2288
tctcaaccaccacgaattcgccgtgtttgagcattgtgtcttttatttcttggcaaaccgtgcccaacaacaagccggctctcagggcttccatttcggagcctcaattcatccaatcgcctcaatgccgcccacatacaatgacgtaaaaaaagaacaatagggacaaatatttaaataataaactaaaataaataacgattgcccgatttaattataatatggcatttttctaatttatgaataaaaataatgacaataattaaaatttgatctttgcttatttaattttcctccgtctcagctgcgtttgtcggtcagcaaaataacaattcaacattttcatttggtaaaataaaatttcaaatttgaaaaatgtcaaattaaaaatgcctttccagaatgagtttatgcgcgatttgaacattgccggctatttggagctccgctggcacgacgaacggttgacatgggactcgcaacagttcaaagtgcagcaaattaaaatcgcgtccgccaaccatttatgggttccatttctgacgggtcaagtcagttttaaaaacctttaaaatataaataatttaaagaatttacaaaatattttactgtcgaatttaaattaattgtgttaaattaaattaatacattcaaattgtgttttttagggatatgaaacagctctgcgcaacgattacgagaacatggaggtgcgtcgggttgacgtacgaaactcgggcaatgtgacggcaattctcggcttcaaatttacgaccttttgtgacgacacggactttaagcactttcctgacgatatttacaggtcaatgttaataattaaattatgattatttatcattaataatttctcctttttcagatgttgtttctatttggaaccgatgaatcaaagggtaaacaaaaaattaaatttttcctattttctttaaatatttcttaatttttaatttagtcaattgtgcgtctcataagcgacggccaaccggtgttcactgatcccaaatatttccgcgactacggctggtctttgtccggcactgtcccactcgtttacatggacccatcgaatgtcacacaagtaaaattaattaattaaaaataaataatttagctaaacaaaacatttttagttgaatttctgcttaaatctgcagcgttcttcttcctcactgaaaactgagctgagaattccggtcattttttttttataaaaaaatgaattttaaaattcgaaatgcctttttaggcttggtcctgtggcattctgttcctttttgtgcccatcttcacaaacattcgcattcagctgatcaccaaactctttcttctgttgctccaattcttcacccttcttctcttcaccaatagagtttcgcctcaaatgggtaaaaattagaaatttttaccaaaccgctttccatctgccgttttaggctcaacagcaaatacgccgacaattagtaattattaaatattaaattaaattattaaaatactttttaattgtaattttcagtgcaaattctcgagcttggtgtcgtgcttaatgtgatttccataatgtgcaccttttgtgtgcttgctctcaccaaattgcgcatttacaaccaaccgccttgggactttctaattaagtaaaagattatcttacgcttttaaaaccattttatattagtggaaatatttcatggggtaattttatcaatttaatttatatatcaattaaaaaattaaaggtaatcgtaatctaaaaaagtgaaaatttttaaatatattatatttaaaaaatcttaattggtcagaataaactttttgatcaaaataaggaattctttttaaacaagagaaatatgctgaaataaagcaaatcttcgaaataaagatttggaatttctaaggtccaatgccgccaaaaaggcttacatttaccttatcgcttcttttcccacagattttttttgaatttttccttaatttttcaattttggtccgtttgttcagtgccagcactctcatcaatcggttcatttatatcttcgagtcggcatccgattaccaggaccttgaggcgatggagcttcataaggaaccctcggcagatggtggcccaattgagcagccaaattcgagcaaaaagccgcccctcgtggacaatcggcaattttaatcattttttgaaattgatattttcttatttgaattttagcttccgttccgattgngtcggctgcttcttggccttccatgccgttgccatctttgctctg

SEQ ID NO: 76408 - DNA, 615 bp, Heterodera glycines
  Genomic contig location: Contig_ID=SeqID_12714; Location=2152..2766; Strand=+
  SCN-specific regions: Sequence locations=1-155,206-381,403-615
atgtgggcggcattgaggcgattggatgaattgaggctccgaaatggaagccctgagagccggcttgttgttgggcacggtttgccaagaaataaaagacacaatgctcaaacacggcgaattcgtggtggttgagactttcaacatctgtttggaaaaattttgattttaattcaaaaacatttaaattttaataaaataatttcagtaaaaacctgtaacattttcgaagaattttttgcactcaatggcattgattccgctgttcagcccaaaaagtgagcttggcccaaccaagtggaaaaaaggctgcgcagagcaaaaatgagcaaagaaaaacagcgaaggcacaattagaaaagccaattgcattttgctcttaaaaatgccaacaattaaaaattgacatttaatccgagagattttctgatgtaaatttgtctatattttttattggattttttgtcaatataaattaactcaaaatgggataatgagtaattattacgtaaattggaccaaaactctctttttatgtattgcgttcagtggtgacgtcaccccgggccgatcacattcactaagaaagaagcgacccaattttgggacacataa

SEQ ID NO: 76409 - DNA, 233 bp, Heterodera glycines
  Genomic contig location: Contig_ID=SeqID_12715; Location=372..604; Strand=-
  SCN-specific regions: Sequence locations=1-233
atggcttctttttctcccgtttttattgccattttaataatcatttacacttccgctgttggagcgcaatttggtcaatttggcagtttgctgaacggctttggaggtgccaatggcggcgccaatttgatgaacggaatggcggccaattcgcgcaactttgccaatatgggtagcagttttggcggcatgatcaatcagttcaaagggatgggacgaaacttcaaaaggca

SEQ ID NO: 76410 - DNA, 929 bp, Heterodera glycines
  Genomic contig location: Contig_ID=SeqID_12717; Location=3350..4278; Strand=-
  SCN-specific regions: Sequence locations=1-21,44-164,186-200,223-929
attataactcaagtcctaaactgctgttttcttccaaaatgcgaaaactaatcattttttaatgattctaaatgcccaaattgcctttgtgcccttataaccaaaactattagcatttgaattccatcatttttcatgtgttagagacatgaaaatagtacgccaaaaggagagaaaaagaaatatggaaaaaaattgaaattaaattgaattcaattaattctgtggcttcgccggattaacgcattaacgcccaattccaatgtcgtccatcctttggacgttgacgagctgttcctgcagcacaatcggtgtcgaaatgcacagcaaacaagtgtgtgtcagggggtcgacaattaatcgctgagatttcgaacaatattcatattctcgacatttcgatttttaatttcttttttaggattggctcttccttttcgttgttttcattcgcttcttttgtgttcatggccctcgtgactttggctgaacatcccgaattccttcggaggagaaggattcccttgcggtgagaaacccataggaaggaaataattaaatgtggaatggaaatcgacgggtttatctaaatttgaacaatccaaaagagtgtggggtccctaatatttgacaaatcagagatgtattgttagtgtttttcagtgcctatcttcaaattgttggcattttcttcgtggtcagtttgctgaacaaccgcgtgctcggcttcggcctgcccttccctctgatcatcgtttttcgatcggtttgccctttcttttcgccaattacccatttattcgtcctcttttaaatgcttctcccaatgatagcttttctttatttgttcagagcactcttctcgcaaatgttctgctcagttggctgttgcaaaatcgcaccttttcccccgcccgacttttctccgt

SEQ ID NO: 76411 - DNA, 806 bp, Heterodera glycines
  Genomic contig location: Contig_ID=SeqID_12717; Location=3235..4040; Strand=+
  SCN-specific regions: Sequence locations=1-39,62-806
atgtccgtccaaaaattggtcgtcgctcttttgtccattccctgcgccgccttcgcccgtggcacttttgcggctgaacagcgtaaaaagcgcaatgccaacgctaaccaacaaaacggagaaaagtcgggcgggggaaaaggtgcgattttgcaacagccaactgagcagaacatttgcgagaagagtgctctgaacaaataaagaaaagctatcattgggagaagcatttaaaagaggacgaataaatgggtaattggcgaaaagaaagggcaaaccgatcgaaaaacgatgatcagagggaagggcaggccgaagccgagcacgcggttgttcagcaaactgaccacgaagaaaatgccaacaatttgaagataggcactgaaaaacactaacaatacatctctgatttgtcaaatattagggaccccacactcttttggattgttcaaatttagataaacccgtcgatttccattccacatttaattatttccttcctatgggtttctcaccgcaagggaatccttctcctccgaaggaattcgggatgttcagccaaagtcacgagggccatgaacacaaaagaagcgaatgaaaacaacgaaaaggaagagccaatcctaaaaaagaaattaaaaatcgaaatgtcgagaatatgaatattgttcgaaatctcagcgattaattgtcgaccccctgacacacacttgtttgctgtgcatttcgacaccgattgtgctgcaggaacagctcgtcaacgtccaaaggatggacgacattggaattgggcgttaatgcgttaa

SEQ ID NO: 76412 - DNA, 774 bp, Heterodera glycines
  Genomic contig location: Contig_ID=SeqID_12719; Location=238..1011; Strand=+
  SCN-specific regions: Sequence locations=1-70,150-371,409-716,738-774
atgaagctcatccttctgatcattgtcttaattgagtgtttttcgagcggtaattattcattaatgaaggattattaatttttaatcttttttaaatgttcttatatttttttttcattttcaaatgttttcaatttttttaatatttagcccattttctcatttgccgtgcgggagcgttcggcaccgttgatcaaccctttgttcgaaaaaagcccacaaatttttcgggtatttgtgatccaccgtttaaattttgtgggaaagaagtctgcttccgagatggcaaaggtattaattataataaagaacacacgaaaagagcatacaaattccattaaaaaagaacattgaattaaagtttttggatttttagtagcaaaaaatatcaaaaagtaattaattaatagtcggattttttgatcttagaaaattctcatttgaaaggcaagaaatttgcatttaccataaaaatcatcatttttaaattcatcattacataacatcatttgttttccagccgaagattatttgaccaattatacatgcgccattgaaacggcatttgcagcattgtgccctttttggcaatgcagtagtgcaaagcaaaaggcaacggaaacgaagaagactgtaaagaggagataaacaacaataaggacacttttatcaaaaaatacggcaattaccggtgcgaacagtgccaattaggcaaagaaaatgaagacaatggcaacgcgaatttcccggtatacaagccaaaaggtagagata

SEQ ID NO: 76413 - DNA, 1269 bp, Heterodera glycines
  Genomic contig location: Contig_ID=SeqID_12720; Location=133..1401; Strand=-
  SCN-specific regions: Sequence locations=1-54,76-135,157-258,280 -668,691-695,736-1269
atgattgctgctgaaaaggctgaaggtaagtgatcagagtgctttcgaaagaattgttttttaattaattttgacgacaaaatgtatcggaaaaagttggcattttttatattttctgtcattttttctttgttaaagtgccaaatttttcaacggcattgccaatgccaatcgttccgatcaatcagccgccgaaacaaacgctgcttttcccccatttcttcgaagatattacggcacaagaaaagtgagaaggcaaatattttaatatttaactttccaaatttaagaaatgtatccattgaaacacccgtcgattacgacgatagcgacgaaggcgaagagaacaatttaaaaagaagtgacgaaacggcaacaccaaaacaaatgccaacgatggaaatgacaacaatggcacaaaggcaaatgatggaagtgccaacgatggaaatgccaataattgcggtgccgaagatggaagtgccaacgacggaaatgccaaaaataatggtgtcaacgctggaaatgagaacaatggcacaaagacaaatgatagaagtgccgacgacgggaatgccaacaattgtggtgccaaataaagcacaaattccaacggtcgcagtgccaacgacggcactcattcaaacagtgcacactttgcattttgctacggacgaacagacgcaaattgaccaaagaagggaagaagaacaaagagaagaagaagaagaagaacaacagaacattgatgaagaattgcaaaaagaagagaaaagaacggagacgacgaaaacggcacatttaattgtgccaaaaacggaggaggagcaaaatgtagaggaaaaaggacagcaaaaacagcaaattgaagagccaaatgcagaggaagtagcggaacaaagcgacggacaacagggacagcaaacagtaccagcaacacaaccatcggttgaagaagaaacatcacaaccgaaagtcagagaagagcaacaacaacaacaacatgaacaaaaagcacaaactgaaacaatagcattggtaaaagcactgcaaacacccccaaagcgagtggcacaagaaacagcaacaacagaactggaaaatgcgcctcaacatgctcaagcagtacgtccgccgtcggaagaagcgacaaaggcgccgataaatggacaaaagtcaatgcatcagtcatcggcagaaaaagaagtgccatcgccaagcggtggccaagcggcgcatcctccgtccgccacgccgcctttccgagcc

SEQ ID NO: 76414 - DNA, 509 bp, Heterodera glycines
  Genomic contig location: Contig_ID=SeqID_12720; Location=2281..2789; Strand=-
  SCN-specific regions: Sequence locations=1-34,68-350,496-509
atgagcacatcgatggaactgttgcagaaacagcagggggaagagaaagaggaggaggaaaaggggacaacggccaaaatgagaaaagtcagcagacaaacggcggacacaacgacggcaaaagcgaaggtgccaacgactgcgacggcacaaaccgaagagagggaacctccagggatcagtccccagccaccgggtcaaacaacaaaataatcactaaaaagtcaaaataatggccaaataatttaattttgccctttttaggctttagtccaattgcgacgagttcaagcagtacaacgacaacaccaacagcgaaaatggaacggacaagcaaaggattagcaggggaagaagaagaaagagagggggaagaagaggaagaaaatggagaagaaaagagtgaaagggaagaagaaaagagggaaagagaagggaagaaaagtggacggaaaaagggagacgaagaggaaaaaagagacggaggaaaagagaccaaatattggtaa

SEQ ID NO: 76415 - DNA, 881 bp, Heterodera glycines
  Genomic contig location: Contig_ID=SeqID_12721; Location=1704..2584; Strand=+
  SCN-specific regions: Sequence locations=1-48,70-404,426-881
atgtcagacaattgcaaagaagttgaggaaaagatggcaaaagcaatgtaaaataattaaaattaaaatgccaattttcaatttctaattttaatttgttttcccttttttcagtttcatctccgccgactgttggctttgtgtgttcgatttgcttacgccttcacaacttggcctcggaatttcaatgattagccaccgatttgacttttacgtggacgaacatttcaaatcgcgcaaatggtcattggactccatggcaatttggcgcacaattggagagaatggcacaaacgaaatggaaattttcaattccgatggaaaaccattgccaattccgcaagttcaaatgccacgcaaagtcatcggattcgaacgcatcgacatttggttaaattggcaattgtgtaaaaatttttgacaacttttacccattgatttttagtttcatcaaccgaaatgccatcgcttttctccaccgttttcgtcaacttttcgccgcctgccaaattaatttgaccatccatccgacaagtgatcgaatttcggagttcattttgcgcaatatttggccaatcttcggagaaaacatttgtggcatttttttgctttcggatgtttttcgccgtttgcgcaaattggtcccatcatttctctacgattttccgtcacttcgcgttgtcaatttatgtgacgccgatctcttcattgaatttccggccgatgacaatgccatggcgtcggatggacaagcggtggccaaatggcttttcactcctcgaccggacaatgtgccaaaggtgttcacatgtctgtttcacgaggattatggaaattggtcatcgaagattgaagccttcaaagcggtgcttactaattga

SEQ ID NO: 76416 - DNA, 94 bp, Heterodera glycines
  Genomic contig location: Contig_ID=SeqID_12721; Location=1..94; Strand=-
  SCN-specific regions: Sequence locations=1-94
ttcttgactttttaatttttttatttcttgcggctagtatcttctacaataatttgtcagtttggtcggatgtgcgtcaaacggaaaaaataat

SEQ ID NO: 76417 - DNA, 1096 bp, Heterodera glycines
  Genomic contig location: Contig_ID=SeqID_12722; Location=951..2046; Strand=-
  SCN-specific regions: Sequence locations=1-37,59-607,633-669,691 -850,872-1096
atgaaactgcaatgtccacttttaccattattttttatccaaattttcttccaatttttggctgataaatccattggcattccgtcttatcaatgggactcggccgattcagtccaaaatgtgcacaaattcgtccaattcatcaacgacatttacactgattatgatcacacaggacaggactattctgtggaacaaaaacggatcattttcaatttgacatttgtgaaatatgcggcggaaatcgcaacttttcgggtgggtcggtcattgaattagactggcggattgtcatggagccaaagattacgccaaaaatgttcccccggttggtccctttttaggtgttggacaacataatcggagagggcgaagcaatgccaaatttgaatgtgatcagagcagatgacgccgtgaacgaattcctcggccttttgcactatgaccaaaaattgggccatcacattgccaaagcgtacaacgaaacagtgttttgtgccgacaaagaccaaatttccaagaaagtggtcaaccaaattttacaactgactttttcattggccattcgtattgtgctctctgtgatgtgagtttgaattgaaatatcaaataattatttatttttaattttacccttttaaagtcttgggccacacaatttgtttgcacttttttcaaatattttccttccctagttatgagaattatttcacgaattttcgtgatgtcggcgggtggcaattggaacaacttttgtcggcatttaaaactttgtcggcacaaagagacggcaccaacgaaaatgggtaaaatattcttacattttataataacttttattattttctagaatatttccctttcaaatcattcgcattgattcggaagagaaaaaacatttttggagtgaaattgattcggaagagaaaaaacattttttgagtgaaattgattcggaagagaaaaaacattttttgagtgaaattgattcggaagagaaaaaacattttttgagtgaaattgattcggacagcgcgagagaaccgcaatttattggtgggataaaaaatggaatttaaattttgaattaaataaa

SEQ ID NO: 76418 - DNA, 599 bp, Heterodera glycines
  misc_feature (36)..(36): n is a, c, g, or t
  misc_feature (49)..(49): n is a, c, g, or t
  misc_feature (60)..(60): n is a, c, g, or t
  Genomic contig location: Contig_ID=SeqID_12723; Location=965..1563; Strand=-
  SCN-specific regions: Sequence locations=1-179,201-234,257-263,328-599
atggcaattaaattatttagtaacggtccatatttngatttatatttgnaattttatctnctttttcatttcaaatttcgtcaacaaattaaatttgcaactaaggattggtaagtacaaagcaaaaaaaaaaaaaattgtgctgaagacaaattttccactgaaagatgaaaatcatcacaaaatatattaaagttaattagaggccgattatttgactgccgaaattttcagcaaattttgaaatgactttcatcatatgcatttatttagttttttaaatattttattaaaaatgattttcaatgtacaaataaataaataaatgttttcccgtaatatttttaattgaattaagctctcaactgttacgaaaatgtgttgttcttttcttccgtcgattgttcattctttccacgaataagcactattccatatttctatttgttctttaaattattcaaatttcgcttaaaatttatttgactttttctttatatacaaaatgagctgtggaaaccgtagaaaatgttcagtggggagaatgaccgtaccaagaacacactaaaaatatctaattggtcaattatcggattaaa

SEQ ID NO: 76419 - DNA, 1284 bp, Heterodera glycines
  Genomic contig location: Contig_ID=SeqID_1858; Location=1158..2441; Strand=+
  SCN-specific regions: Sequence locations=1-825,860-1284
atgaccgttctcctcttcctcatttgtctgctgatcgcaatgtttgccatgcaatccatggccaaaagtgtgccaaaggcgagggacagcgaaattatcgattatgtaagaaataaatgtttttttaaattatacaacattaatataggaggaatggaactgtggtgccaccgattttgagaaaccgttgtcccatcagttggccaaggaggactgcccgaaaaggatgtgtaagtgggggaggggggaagtgccaatggatgatgggatgggaatggcacacgaccaacaatggcacttttagttgaggcggacttgtgctgtcgagtgcacgacatgtgctacatggaggagcagaagagcagggagcaatgcgacgaggcattctgttattgcttgcagaggacggtggcacagaacgccaaccaaacggtgggaggagcgccaatttgaaatttgaaattaaattcaaatgtcaatttcagacgaacggatgtgccggggtgtccaccagtttctgcgaaattgtcaaaattttcgggggcattgcctatttgtcgtcccaagaattgagaacgaagcagcaaaaagcgatggcaaagttcgaagagaaggaaaagcagcggaaaaccatggaaatgagcagcagcacaacgccaaaaccgacgacagaatcaacgaagccaagcagtacagacagagcaagcagcataacccaaacagaacaaaccatttcaagcagcacaatccaaacagcacaagcaacttcaagcagcacagcttcaaagccaacgaatgacacaacgccaatgccaaagtaagcggaaaattttaaaatataaataagtaaatttattttgaagtgcttctccaacaacttcttttcctgctgctgtccattcgactgtttctccggcggaaattggccaatttgtgacgcataaattccccttggaatgcttcgacaacagtgaaattatattaatttaattgtccttaacgagttttaatttcataatttgtgcccatttcagcgctgtccttttgcacccgtcaattgcaccgctgcgtctccgagcagcacagccgacggaagtcggcctcatccgacggcggctcagaggacgcttttttgctcagcgttcaattggccgagtgttcctcccaattctgcgcctgctcgtcggcggagagtgcccgcgctcggttggcaagcgtgccgcggccgctgctgggcggcgagcagtgcgcgcaaagcttggcacaaatttgctcacaatttga

SEQ ID NO: 76420 - DNA, 372 bp, Heterodera glycines
  Genomic contig location: Contig_ID=SeqID_1860; Location=742..1113; Strand=+
  SCN-specific regions: Sequence locations=1-188,210-372
atgctgtccaccaaattgttcgtcgcttcatgccttctcaccgttttcctcttcaattgtctgctggtgggacaaactcaggcatattggtggccatactacggtatgtctttaatggcgcctaattacgataatacagtatattcgatccgtgttttaaattatgcaggaagtagttatggcagtatgggaggctatggcggcatgggtggttacgggggcatgggcggctatggcggtatgggctacggcggtatgggttacggtagcggacttggatacggcggcatgggttacggtggcatgggcgtgggcaagagggaggccgcgtttgtggcatcgccaccggctccgccgccaaagggacaatga

SEQ ID NO: 76421 - DNA, 251 bp, Heterodera glycines
  Genomic contig location: Contig_ID=SeqID_1861; Location=2232..2482; Strand=+
  SCN-specific regions: Sequence locations=1-77,163-251
atggcatcattttgccatacctttggcgttggctttgctgccgcattcgcagctgttgccgccgtaagtcgcgcgagtgttgaagttacagttgttgttattgtgggtcgtactgtagtttccgttgttgttacggtcactgttattggtggtggtgttgtttcgcttatactgctactaatagtcgaagaaatcgtcgagaatttggtgaattcgtcaaattgaaagttttcgctctattaattacaaaa

SEQ ID NO: 76422 - DNA, 2122 bp, Heterodera glycines
  Genomic contig location: Contig_ID=SeqID_12724; Location=20..2141; Strand=-
  SCN-specific regions: Sequence locations=1-103,125-597,619-981,1003 -1295,1335-1337,1360-1648,1670-2122
atggagtcaaccggttttcagcaaagatataatttccgagtgcgccggccgataaattatatggaacaagaggaatcgtcgcattctcgccacagccgacgaaatggcactgaacaaaacaatggtttgaatttggcccctcaaaacattttggacaatgtgcaaaacccaaatccatttccgcgaaatttcgaaaacagtatccctcagcaagtgggagtgcaacaaaatgtcgaagaacaaatgcagctcgcagtgttccgacctcccaaccaaaatgttgcccaaagtttcggaaatccccgggctcattcaacccctcaaaatggttcaccacacatttcatacaatgggggacaacaaaatttcgagcaaaaccaaaatcggaatccggatgcgaaccgatttggtaatgagattcatggacaaaatatgcaatttcatcgccgccaaaaccctcgaattttcgtcaactcacaaatgacgaacaaccatcagttttccgcactaaattttgaacaaaatcgggaattaagagcacaaccggttcggcatgctcataatttcggatatgaagaaatgcttggtgagcaaaaccaaaactttccaaatccaaattatggtcgagaaattggggtgaatcacccaattcagaatacaagagattttggaaatggacccaattttcaaaattttcatccggttcggaatatcaatcaaccaaattatcaacagcgaccgaatccaaattttgaaaatttggcaccacaacccaatcactttccgaacgttcaaaatttcgagtttgtccctcagcaaaatttccaacaaaatcaaattcctgatattgtaatggaattacataaagttactctgtcaaaccaatacgcaaatacgctccgagaaattccgaacctatacggaacggaaggtcgggacaaaattaaggatttcttcctaaatgttcaaatgtgtgccggagagtggagaccagaaaagcaaaaagagttgctacagacaaagttgaaagggaaagctttgaaagcgtatcatattgcgctgaacaaatttggaaatgaggcgacatttggcattctaaaaaccgaaataatgtccattttgagagagacagactacaaagaggcaaacgcattttccgaattgacacagaatggtaaaagaaaaccaaatgaagacattataaagtttggtgagcgaattcaacggttggttaattgctcatacattggtctggacgaaaaccagttggatgaggtgtcaaaaaagcacttcatttcaaacataaatgatgtgaatttggccagatttttggaatgccagaccaaagcaaaccaaacctttgatgagcttttgatgatggccaaccgtttgagtcttattgaggacggaaaaaaccgagaacgaaacgaatcagttggaattcctgttcagtttcagcaaaccggcccacagcaaaaccgtacagtcccatttcaaaacccaaattacggacaacgttttgaaagaaattttccaaattttgggatgggagcgcaaaataatttcaggccaaaccgacaaagtggtttcaaaaaccaaaccttccaacaggaaaaccgaaattattgccccaataagaattttgatcattttcaaaaccaaaatttggtcccttatcaaacttatggcccgaaaaatcaatgggtatccgacccacaaaatggctttcaaaacgatattttttatgagagcaacccaaattcccggccaagtcaacgttttgtccattttcaaaaccaaaattccgatcaccaacaagacgtcaatgatcataaaatcgaggcgatcagcgcaaatagaacccagttcgattcaaatcaacaatcaaatccaatggcaacgcagaacatggagttgaatatgattaaggtgaaaggaaaaggaactgaaaaatgcgaaaagaaatcagtcaaaattagtcacatcgaacacagcgaaccgcccgcctacgaaaaatttttcaattcattaatcgcccattcactgaatttccccctcacaaaccgacacaaatatcaaattcagaatgtttttgtgttagagtgaacgttgctggattaaa

SEQ ID NO: 76423 - DNA, 417 bp, Heterodera glycines
  Genomic contig location: Contig_ID=SeqID_12725; Location=2129..2545; Strand=+
  SCN-specific regions: Sequence locations=1-17,43-180,217-417
atggaagtggtaaattttgaaaattttaatgaattttatttaacaaattagttattttcgtgtttaaattgaacatcaattttaaaagcatttgatttcctgcagtttatccgccagcattttgttagttcgacaagaaaatcattaatgcaaaaaaagtttgcttaagtgaatgatctctaatattttttttcacaaataataatttttaattttcagatttgctcaattggattaaccaaagcgatgccattggacggatggacaaaaacgatggcaattttcgacaaatgagtgtgaaaatggacaactgaatttttcttgtaatcggtgtggcattaattttaccactcaacggataattttgacaaagaatggccaagttggactattccgagtttctacaaatattaaata

SEQ ID NO: 76424 - DNA, 674 bp, Heterodera glycines
  Genomic contig location: Contig_ID=SeqID_12725; Location=2772..3445; Strand=-
  SCN-specific regions: Sequence locations=1-85,148-183,207-255,327 -528,553-674
atgatcagaagaaaattttggaaaaaatcagtgaaatggagaagcagcgagaagtatagtcaaaaggcgatgagaaattaaaacgaaaattaaatttatcaattttaaatgtttccttttatatttaaaaattaatttgatttttaagcactgcggatcaattttcaaaaatacaaaatgatcagaagaaaattggggaaaaaattagtgcattagagcaagaaccaaagcaaagaaaggtaaattaaggggtagaaatatatttttaaatattattttcattaattgtatatttaatcaatttatttacaaatgaattattttaaggcatcttcaaatttccgacaaaattattgggatgccaatgtttgtcatgagaatctcaaaataattggcaacaaaagtctcaatgtccattataagagaatgagcttcggatttgcagtcaaacagcagaacaaattggatggaacaattcgaaatgaaaagggcacttatgcatttgatagtgatggcaaaatctggattaatggaaaagaaaaggaacaaatcgtgaatattcctacggtgaaggtgatactgtaggaattggcgacagttcggccactcggcagatcattttcaccaaaaatggacttcgtttgggttgtcaaataactatataatttattaaa

SEQ ID NO: 76425 - DNA, 304 bp, Heterodera glycines
  misc_feature (148)..(148): n is a, c, g, or t
  Genomic contig location: Contig_ID=SeqID_12726; Location=2..305; Strand=-
  SCN-specific regions: Sequence locations=1-58,135-172,197-244
atgaattgccgcattactacgaacagagtaattttgttcattaatattttaatccagctttttaaatatttttctaatcatttttttaaaaatattcccttttatgttattttatttaatcaattttttaaaaacttagtctcattanatagactgaaattttctcaaagtgatataattttaaaattttaattttcagttgctttattgcagtcaggtaatgtgatacatgccatgggcaaccattattacaattaattattatttattaataataattaatttcaataattaaacaaataaa

SEQ ID NO: 76426 - DNA, 642 bp, Heterodera glycines
  Genomic contig location: Contig_ID=SeqID_12726; Location=2451..3092; Strand=+
  SCN-specific regions: Sequence locations=1-642
atgtcgggatccctaaatgcgatatccccgtgtccctatatttcgggatccctaaatgcgatatccccgtgtccctatatgtcgggatccctaaatgtgatattcccgtgcccctatatgtcgggatccctaaatgcgatatccccgtgtccctatatgtcgggatccctaaatgtgatatcaccgtgcccctatatgtcgggatccctaaatgtgatatctccgtgcccctatatgtcgggatccctaaatgtgatatctccgtgtccctatatgtcgggatccctaaatgcgatatccccgtgtccctatatttcgggatccctaaatgcgatatccccgtgtccctatatgtcgggatccctaaatgtgatatccccgtgcccctatatgtcgggatccctaaatgcgatatccccgtgtccctatatgtcgggatccctaaatgtgatatcaccgtgcccctatatgtcgggatccctaaatgtgatatctccgtgtccctatatgtcgggatccctaaatatgatatccccgtgcccctatatgtcgggatccctaaatgtgatatctccgtgtccctatatgtcgggatccctaaatgtgatatccccgtgcccctatatgtcgggatccctaaat

SEQ ID NO: 76427 - DNA, 2232 bp, Heterodera glycines
  Genomic contig location: Contig_ID=SeqID_12728; Location=75..2306; Strand=+
  SCN-specific regions: Sequence locations=1-1324,1346-2232
  Gene Ontology: Mol. function=extracellular matrix structural constituent; Cellular component=extracellular
atgggcaaaaaaagagtgaatactcctaaaatccgacctaataaaaagcctaacactcggaggggacaaatcgcggcggaaataacgacaataaccaccacaactgctattccacctattattagccctagcacaactgttattccaccgaccgctcgcaccatcaccactgctattccaccgacaactcgcaccatcaccactgctatgccacctattactcgcccaagcacaacggttattccaccgacaactcgcaccatcaccactgctatgccacctattactcgcccaagcacaacggttattccaccgacaactcgcaccatcaccactgctatgccacctattactcgcccaagcacaacggttattccaccgacaactcgcaccatcaccactgctattccacctattactcgcccaagcacaacggttattccaccgacaactcgcaccatcaccactgctattccacctattactcgcccaagcacaacggttattccaccgacaactcgcaccatcaccactgctattccacctattactcgcccaagcacaactgttattccaccgacaactcgcaccagcaccactgctattccacctattactcgcccaagcacaactgttattccaccgacaactcgtaccaccaccactgctattccaccaattattagccctagcacaactactattccaccggttactcggcctagcacaaccgttattccaccaattactcgcgtaaagaccgaagaaatccccaatatcacgattgaaaccattgagaagctcatcaagagacttgagaaaatgacaggaatacgggagaaccgtgtgaaaccaactccatttttgatgccggaggacgttgaagaagaaagtccgaccacagtagtgagcaaaagggacgctccggaagaagattcagagaaatggtggcaacagcgaaatctggatcatgaaaactcacggctgaattatcttggatggcgcagtcatttaactaatttacaaaattcgcgggacaaatggttcagcgactgcaatgaaagaaaaaacgcccttgcggtggcaaaggctttggcacgacaaatgcctgaagatgcagcgcggtctttgtacagaagagatgatatcacagctttttgggcaaagtcgacagcattgaatccaatgtggacaattactttatgcaagcaaatcaaagcagaaaatattttgtgggaccaaaaagttggcaacaaatgttaccgggaattgcccataatagcgtccaaggaagttttgtttgtgaaagtcggcacaagagacttaaagaaggaaggaaaagaaatacagtgcaacaatgatggaagtaatccttgggcttcgaattttaatgtaaccacagagggactacaaccatcgatggaacatcgtttcgctcctgaacaattcacaaatcggcaaaatccatttctattcttcacaaaagggtccattttcgagtcggaacaattacgactcgaacagagcttaaaagacatgtccaatcggatgacacgacccgaattagatttcactgacgttggactaatgaacataaatataactgaggaacacggggattcagtggccggaattttttcaattggtgaaattctggtagaaaatgcgcaagtcgaaggagaaaaactgagaaagaaagccgaagaaacaattgaaagaggaaaagcatggattgaggatcccattggaatcataaagtacattaaatggaccggcattacgatcgtcactatttaattcttgttggagtcgcggttctctttgtcaaaattaaaatctatacaacagcactcatggcaccgttgcgaattattcgttccatattcaattcaatcatcgggtgttttaccacggggaaggaattaaccgatcgaataagacaccccgtggtgatggaagtcgagctggaggagagggtcacaccatcagcacccactgaggaatgcatgctggaacagaaggcatatgtgttaaattatatgcctaaaatataccaagttcatcaaactgaacgaaaaaggaagagatgctatgtgaatttaaccataaacgggaaggacgtaagggcattatttgacactggcgcggatgtaacttatgttgggaattcgacggcaaataagtgccttctcaatgttcgccgaggggacttcccacaagcgagggcagcca

SEQ ID NO: 76428 - DNA, 138 bp, Heterodera glycines
  Genomic contig location: Contig_ID=SeqID_12729; Location=1182..1319; Strand=+
  SCN-specific regions: Sequence locations=1-138
atgaacagacagcacggggaattggactatgttggccaacatttggccaattttcaaaacaaaatctctctgacaatgtccaatgtgccaatgcatgaagctgtgctcgcggcacgcgttctgagcagcgtacaaacg

SEQ ID NO: 76429 - DNA, 128 bp, Heterodera glycines
  Genomic contig location: Contig_ID=SeqID_12730; Location=301..428; Strand=-
  SCN-specific regions: Sequence locations=1-77,108-128
gtcattaaaaatctgttgaaaaataatccccccgtctccattaaaggccctgtctccaattatgtccccctttctaaagaggttgaaaaataatccccccggggccttaattagagaaaatacggtat

SEQ ID NO: 76430 - DNA, 1035 bp, Heterodera glycines
  Genomic contig location: Contig_ID=SeqID_12730; Location=1497..2531; Strand=+
  SCN-specific regions: Sequence locations=1-452,474-1035
  Gene Ontology: Mol. function=protein binding; Cellular component =nucleus; Biological process=muscle development
tcttgagaaaaacgtgccgcgaaaaaagcggtgttgaaagcaaaaaaggtcattgatttacattaatttacatggccggagaccccttcgcaaaattggaaaattggccgctgatcccttgttttgcaataatctgaattttgaggtctacatctgaattttagtgttctttatcctgaatttgaaaaaaaacttggtcaccctcaatatacatatacttctgaacaattctaatgctaaaaaacaggcactcgcgcgaaaactgaataaaaattttgtatttgaaaaattttgtccaaaaatttttacgttggaaaattaccggtttttaccggtaccggtaccggtaccggtggaaaaagttggtaccggtaccggtaccggtttttgcattaccggtcagtaccggtaccggttttttaacaattaccgattaccgagcaactctaatataaagttaaattaaattaaatggacgcttcgcgaaaaagttgttgtgaggtcgggcgataatttgcattttgtcaccactcccccctcccaccgaaaatcccttcattccactaattgccttaattaaggacaatttcaatgaattgtacgcctttttgggaacccacaaattcgcacgacaaacgcatccaaaactgcagaaaatttggtgggacgttcatttttttgaggtcgaaaaaacgcaggggaacaggtgaaaatgaggaaaattagcgataaaaacatgaaaattcgaaatttaagctgggttttaagcccacttagcgcattggaaaagtacaaagtgcgcgaaaagtatccgttgccgccgacaatttgggacggacaacggaaaaatggcttctttagcgaaaatacggtgaaaatgaaccgatgaaaagcattggtatatttgggacacaatatcccatccccccatttcgcagatgacactgcttaatgagcaattcgcggaaagtcaatacttgcccccgcccgatatatgggcacttgcggaagccacaggcctttcggagacgcaag

SEQ ID NO: 76431 - DNA, 67 bp, Heterodera glycines
  Genomic contig location: Contig_ID=SeqID_12730; Location=1219..1285; Strand=-
  SCN-specific regions: Sequence locations=1-67
gtctccattaaaggccctgtctccaattatgtccccctttctgaggatgttgaaaaataatcgcccc

SEQ ID NO: 76432 - DNA, 772 bp, Heterodera glycines
  Genomic contig location: Contig_ID=SeqID_12731; Location=789..1560; Strand=-
  SCN-specific regions: Sequence locations=1-772
atggctgtcctacggggaacagcgatttcaggtcggtgagacatgcgattttgaactcctcgggtttccgttcaatgacctccctggatatacaattcaatgtgaaatgtaagtaaataatgagacagtactttctgaatgccatcagaacggaagaaggcgagagaaggacgggtccgtcgggcaaagtcctggacccctgggcgaagttctgcaggtacgttttcgtgtagtgggactgtccaatggcacgcgaagacaaataaaccatttgatatcttaaaaggcgaatgacggtattctagctaaaaacaattgtttttttaatgttctacccgttctttttgatgccagtatacagctctgcaaccccggaatgggcccaagtgccaccaattgctggaatgacatggccaagcacgtcgctctttgtgattgtgccgtcgatatccgagatgaccaatttgtcataccatttgagcaaataaatgtgacaagaacaccaagcagttccctaaaacaaaatgcataattaaaaatgacccctttctgtgcgcattgaattgaatcccatttttgaatttatcagttgaatccctaatcacccccttaatttttgcctgatattttgttgtgatgctgaaccgcgcgtcgttcgacccgtagttcaagttcaacaggtccaattggtcacgggagagacgcaacgaccgcttctcttttgccttctcctcaaacagttcgaagtccctaaatatttgtgtataataaa

SEQ ID NO: 76433 - DNA, 516 bp, Heterodera glycines
  Genomic contig location: Contig_ID=SeqID_12731; Location=2517..3032; Strand=-
  SCN-specific regions: Sequence locations=1-114,136-422,444-516
atgagtgtagcaaatggcaataccaatgctttgatgcgcattttgctgaacatttcgttgtgcgcaccgcacaacgaatggccgacagagagaagccatgcgcagtttttgtcgacattttggcaatggactgaaaaagcagtcgaattaggagaagaaaaagtcgaaattaagggacacaccgcaatttggggaatgcaattcgaccaaattgaccaaaagggcgacgcactgatagccaatggactcggcggagggaaagtcgaaaaagcggaggcaatgggaaaggcaaagggacagaacggagtcggaagggaaggcacgaaactcgctgaaaagggggcaacgaaatgtgggtttgaaaagggattgaaaacgtacagcaaaaccgaactgatccgggtgagaagcgttgagcaacggaggacacgaggcgcatcagctgaacaacggagggactcatcgacgacgaggcaaatgcaatggtcggtcaaaaaggctaatcagagaaattaa

SEQ ID NO: 76434 - DNA, 549 bp, Heterodera glycines
  Genomic contig location: Contig_ID=SeqID_12734; Location=1363..1911; Strand=+
  SCN-specific regions: Sequence locations=1-127,149-390,412-472,508-549
atgctcaaatgcttatgcatattaagcgaactgctgggaatcagaagagggacaattgaaagagtggtgagcgaagaagaagctgatggaccaactcacagtcaaaattcaaaaaagtgatttttagttggaaagccaacttcttttaaactaattgactttcaaatgaatgaatattttgagatttttttaaatttaattttgaatgaaaagcaactgaataataaataataccaggggatctaatttgtacttttttatccatttggtttgaacttctatgatcaattttcaatgcctatttttgcctattttgccttttttagaaactattttcaggatttttggaaatatccttaataaaatgcaataaaaatgagaaatacaccccaaagaaataactgaaaaattttcagaaaatgctctaagaattgaaaaattttcttgataaaaagtcgttaatttaaaaaccttaaaatattttaattatttcatttaaattaatttgttgtttaagttttttatgtgttttgctacctaaaaggttta

SEQ ID NO: 76435 - DNA, 1153 bp, Heterodera glycines
  Genomic contig location: Contig_ID=SeqID_12735; Location=623..1775; Strand=+
  SCN-specific regions: Sequence locations=1-189,212-431,479-621,643 -834,856-1050,1078-1153
  Gene Ontology: Mol. function=metabotropic glutamate, GABA-B-like receptor activity; Cellular component=integral to plasma membrane; Biological process=embryogenesis and morphogenesis
atggccggctgtcagaagaagtcgagccccgtagtggccatcgtcgggccggcgaagtcgtccacaacaattgcggtgcagaatctgctccaggtgttccgcattccgcagattggctactcggcaacgaccacggatttgagtgacaaggagcagttcggatactatctgaggtgcaaaatgctcgaattttcatgacaaatcccaaaaagatgggttttggaaagcattagttgaaaggatgggattatatctattggggagacataaatattgaacaaattaattcataaaagtgaatttttggttacgaaaaaagcaaatacctgtgcaggtacgtacagaggtcaagcgaggaattcagcatgtcaaatgcagccttttttttcaaaatgacgaccgaactttaaaaaaagtcattattagtgatgtaattttttgaatataattatttgtttaataattacaaataattattcagagttgttccatctgatgcttggcaagcaatggcaattaatcagttgctaatgcacttcaattggacatacatcgccgttgtgtacagtgccggtgaaaaattattattgaaactgtctaattacctttaattacacttcaaaattttaaggaaattatggagagaagggttttgaagcgatggaacgtctgacgcgcaacggcggaagcgaagtttgtattgcgcacgcacagaaagtgaagagtttaggggagccgacggagtacagaaacgcacttttggcactgaatcggctaactccacgcccccaagtggtgggcacggcaaaattggagaaactgggagggaaaagcacaaaattaacaaaaattaagggataaagcacagtttaaatgccaaaaatgaaataattaatgtttacagattgtgtgtttttgcgaagggatggcactgaaaagaatgtttttggcacaaaaggcacttcgccaagaagcggcgaccgaagcagcggaagggacggaaaacggaaataacacaacgaaaagccgagtgaaaggacgccgaaaactgagacagcagcagcaacaacaacagtaccatcatcagaatgtgaatgcattccaatggatcggaagcgacggatgggccgaccgattggacgtggtacggtag

SEQ ID NO: 76436 - DNA, 2686 bp, Heterodera glycines
  Genomic contig location: Contig_ID=SeqID_12736; Location=900..3585; Strand=+
  SCN-specific regions: Sequence locations=1-116,138-592,615-907,929 -1178,1214-1414,1453-1477,1498-1499,1539-1713,1744-1744,1766 -1783,1805-2011,2034-2147,2170-2686
atgactgcccaaattccagaaatatggaaaaagtcaattatttgccctgtcccaaaaattcaaaatccggtaaacccagtcgactttcgtccgatttctctgctttgttctgtttccaaaattttggaagaaaatatagcaggaaaaataaaaaattttgttgaaaaaaataatttgttaccaaattgccaacatggttttcgtaaagcacattctgttaccactcaacttcttgaagtggtggatgattttagttttgctttagaaaataaaaaatcaattgatgtaatttattttgatttagctaaagcattcgacacggttccacataaccggctaatatctaagctaaaaagcattggtataaataattccttattaaaatggattcaaaattacttagaaaaccgaaagtttttcgtcaaaatcgggtctgatttctctgacgaatatccctgtctcagtggtgtgccgcaaggctcaatattgggaccactgttatttcttatttacatttacgatttaccaaaattctgcgaaactgaaaatgttaaaattaaactatttgccgatgatcttaaggcctatcatgttctttcaaatatttccttttctccactccaaaattttattaacaaatttaatcgatactgtaaattaaacggccttaaaatcgcttcaaataaatgtttaactttacatttaggacacaaaaaccaaaaaataaattattttattgatgactttcaaattcctaaaaatcccggaaacgaaccagtcagagaccttggcatttattttactaatgatttgaaatgggcacaacatattgacattatctcgaaaaaagcattacgatctgctttcgctatactaaagtcaatcaaaactcgtgatacgaaaatacttgtaaatttgtttaatatttattgcagaccaattttagaattcggatctccaattttcaatccttatttaaaaaaggatatagaaaaattggagaatgttcaaaaaacttttttgagagtaatatttagacgtaacaattatactgttgatttacctaattatgctgaattgttaaacatttatgatcaaaagtcgcttgagagtcgtaggttaaaaatagacttaaaactttttcatgaaataattttaggtaaaataaatttacaaaataatgaatccttttctttttccaaaacccctgtaaaaaatgaattcattataagaacagcttattgctcaaccaatgttagatacaactcgttctttattcgaacctctcgtctctatagacttttacctaaagagacgagattactaaatccaaatgagtttgccaaacttcttgaaagatctgatcttaatttgttgatttctttgccaccccaactccaaaagtgaccaattgattgttttgatattattatttcattatttctttatttttcggcgtcacgcttttgcgtataaatgattgattgattgattgatagttaaatttgattaatttttttttaaattaatatttttaagttatttgaattaagcccgttcttttaattgttttactttcacaacatttgacgccacatatatcatcattttgacaaaaattgcctaaggacaaaacgccaaaaaaccccactaatttaaaaattttgccgagattttcccttgtaaaaatggaagagccgatctcgagttagaaaatatactttcaaaaaacaaaatagaattcgatagatggggtcaaaaaactagcctaggcaaaatttcaagaaaatctgacccgaggaaaatttttttgaccctagtgaaaatttcaataaatttctatcatttttaagctaaaaatggtcttgacgcgcaaaaaaagcgaaaatttaaagagtatgagcaattctggtgtagacgcaagacgaaaacggaaggaatggcgccgggatctgggtcgcagtgttggttcaacaccaaaaagtggcgaaattttgataaaaatttcatttcaattaaaaatcaaatttttacaggtccacgacaaaccacaaaagctccatcaacaaccggagagggaacatcgaccgagacaatgccatcgacttcgaatgccgagccccgtaagtgcaaaaatcacaatttttgagataattttcattttaaggccaacggccaagtccacggccactttcaacaacgccgatcaggcgtcatgtccgcacgcggccaacaactaccgaccaaacaaccggcaccgattttcgagcaacagtccagtcaacccaaacggttttagaaaccgccgatggtgccacccagacagaaacaggtaaaatcagtgatcagattttctaataaattttatcccccataatttcattttcagagcaagggccaattcaaaggctgtgcacggagctgaacaaggcgaaacgcagaattgggacgctggaacgacagctgcagaagaaaactgaagaggtgaacctgctcaaaaagcgaccagcagtggaaaacaagggcaaactcaagagggtcagttcattggacgatttgtcaagacgaagccgcacaaaacgtgctaaggaaatagcgcggaacctcagccatctcttccgacccggtcgattacttcctaattcttatttttataatatgtttgattagatttgatcagttggga

SEQ ID NO: 76437 - DNA, 2073 bp, Heterodera glycines
  Genomic contig location: Contig_ID=SeqID_12737; Location=199..2271; Strand=+
  SCN-specific regions: Sequence locations=1-638,663-997,1019-1180,1202- 1209,1231-1661,1684-1924,1946-1994,2016-2035,2057-2073
accatttctgaggtaaaccattcattatgattggtgagagggttgtcgccgctggcgactgaacgcgtagaaattggaggacagcccggaggaccgctcggaggaaagaaataaggaagtccagaagaggaccggaagaacattctcgaatgttccctcgtgactctcatctttgcatttccataatattatttcgtcctttgattgtgcgctattccgacaaataaactacttgtctaagaagttttttgttccgaaggtgttcctttttctctacggtctcgacattccaggaactcagagttccatgtttgcagttgtctaaactattgtcccgaagtccaccaggacagtccaactaagtctaaaggggctgtccattccacaagtcccattccaagagcggaaaccacgtcaagcgtagccagacagtgcactatttcctttctttttctcaccccttccctttcccacaaacaatgctgctgtacagctagcgcacggctgcttactgtctgcccttccacccgccgcagcctcacgtagacagataagtacactatttcttccttctctctagtggctatgcggaagaatccgggaagaatctgcctgctggctacgctttgaaaaatttcgacccaaaagggggacccaaacccgactagtaccggtgagagcgattctctaccactaattccttcagattaaaattgtctcacaaaaatactacaagttggctaatgttgattaaaaaaaattcaaactttggccccaaaacggaaaagtaccgaatttttaactaaaaacaacgtgaaaaatgaacttgcgctttttaagtgccgaggggcaaagggaaggatgggaaactcataggggggagaggggggggggcactccctaagagcgcaaatgaccaactcgaaatggcatttaaaaagatggaaatcacagagatatgaaggaaaacataaaaatcatctccatatttcgcgattttattttttgtttccatattttggtacccctatttattaattataatgcatccctatgagttcaaattggacgcgatactcggaaaatcggagttacccattgagaaaatagaaaatcacgcgtggaatccggaggaccggtcgttgaatttgtacgtgacgtgctgacgatgcaccgacatccggtggcccaaagcacagacggaatgcgggaaaaagtgagggagggacaaagggacaaaaacgccggggaagaaacagtcattttgatggataattagttaactaatagttaattaaatattaatgggaaatgaaacggaaaccaaaaaagggaaagtggggatcgaaccattaatagcggtcactttcaaattggtgcctttgtaccctctcggctctgccaatgctttcgtctcttaaggttggctacacgcgcggcttccacgtctggcagctgaattggccggtcaaccaacgcggcacccacgcggtcgtcggcgtggccaccaaagacgcgccgctgcacgccccgggctatgtgtcactgattggggcggacgcggagggcttcggctggaacattggtgggcaaattgcgcaatttgtgccacaaaaacgctgaaaatgccaattccgtcgccagtggagaacaaatgctaccacgacgcacagaacacaaagccatggtccttcccttatgagcagccattcgtcgcgccggagaagcttttctgcgtgttggacatggacgagggccaattggccttcgccaccgactccaaatatttgggcgtcgccttccgcggcctcaaaggcaaaaaactgtacccggccgtcagtgcggtgtggggacactgcgaaatcactctcagatatttgggcggattggaccgtaagtccacaaggattaaatttattggcaaaaaatacaatttaaatctttttagcagaaccacgacagttgatggatatctgtcggagatcgatacgactaagtgttggaaaagcaagaatcgaacgcatttctgagcttaacctaccaccaagccttagacattacctcttgtacaaa

SEQ ID NO: 76438 - DNA, 1031 bp, Heterodera glycines
  Genomic contig location: Contig_ID=SeqID_12737; Location=2392..3422; Strand=-
  SCN-specific regions: Sequence locations=1-86,108-452,474-515,538-1031
atgggaaatggatcgaatttgaatgaattgacttccgtcgtcagtgttgagaatgagacaattaccaatttggaggaagaagcggatttaattatcaaagcttttggcgctgactttgaagaaaagaacgcgagacaatgcccgggctgcggagtaaaaaaaacgaatcgaacgagggaataccatttttgtaaaatcccttcccattgcaggaaatctacgcgcagaaaattggctgtaactatgtacgctgtcccaatttgcaatgcaacacgtggttctgttggggttgcggcaaggacgacatcagctggatgcattttctgggtgaacggagtcactcatcgatttggaaataattccgactgcccaattttagtaaaaagatgcaagcccggctacgaggatatcctgaaggccctctatccgttgaagttcttcgtgatgatgggagctattaccactttgttcatcactccgtcgatgttcctcattctttatttgagtttcatccgaacattccctcatttcccctccaatttctcctcttttaggtgtttctcccgttgagtgtcaattttggagtgccggcatatttcgccaaacgcacacagataaactccgttttagtcgtaataggccatttattccaccccttaatcattgttcactcactctcattgtcagaagatctgtctgttcgtcgttctcctcccaatcggttccgctttgtccgttctctcgctgtttccaatcactttcatttggctcttttatttggccctttctttcgtcaaactcattcccattgttggccaggtaatattggctctctctctcctctctctttctttctattcccttttcagatttcgatgctcttcgagttcgccgaatacatcaccagcttcttcggctacggggattggttcggttcctacaaacgcgccgaggaaggccgacgtgcggagagagcgcggaacagactgcaccgccttgaacaacgcaagcgacggattaaaacaccataa

SEQ ID NO: 76439 - DNA, 1741 bp, Heterodera glycines
  misc_feature (51)..(51): n is a, c, g, or t
  misc_feature (54)..(55): n is a, c, g, or t
  misc_feature (60)..(61): n is a, c, g, or t
  misc_feature (65)..(69): n is a, c, g, or t
  misc_feature (71)..(71): n is a, c, g, or t
  misc_feature (92)..(92): n is a, c, g, or t
  Genomic contig location: Contig_ID=SeqID_1863; Location=1..1741; Strand=+
  SCN-specific regions: Sequence locations=22-618,922-1085,1115 -1336,1365-1713
tataaattaatttataatttacacttaattaacgaaaaccctctaaggagnaannaaatnntaannnnngnagagaaaccttaaagggaggnaatgggatgggctttctgatggaaccatgtgtgaacacggagctggtcatcaacagcaacaaatttcatggcatccaaaatgtagctttgctggtccgaaatgcacggtacaaacattttttatttaatgcgtcatactgtaatttttctaattttttttccaatttgaatacggtagataaccctaggcatcgatatttctcaaaatttctttgtttcatatagggcctctattgttgaaatgactaagaaatattgattaaaattatcaaaaagtatggtatatgggacgaaggttacagtatcacaatttttttacctttcaaaattattaattttgtctaattaatttattaacaagcagatggcctcatttgtccgcgctgccggctcgtgtacaaatagcaaaaaatgacatcaaaatgaacactgcgcaattcattgtttccattggtcttaatgaggatgcgccggaacaatcattagtgttcaatcaacaaaatgaagcaattaaattttaaccttgttatttaaattattatataaaaaagttaaaattattgaaaatttaaatctttattttttccctttttcactaattgcttaaatgaattatttattaaaaattattatttttttaaaattttttctaaataatctatgtatgtttaatgaattatttttattattctaaatttcctttcattaattaattttatttaaaatttaaatcttattaattttctttcactattttttcctttatctaaatgaattatttaatttaaaaaaagtaaattattaagaatgtttaatttttcttttttttcggtgcgcggcaacacggtgctgaacccgttcccattcttgaagccacgttcaacaccatatgcagcgttggtggtctcgtccagcaatgtgctaatccggcacaactgttttcgcaatcaaaatgccgattttgaaattggtgagaaaaaaaagtcttatatcaatttttattttttttttattttattattgctcaacctgatcggggtcaaaaaaaatggatttcctgcatccaggtcccccccccccattcatggtactaaaaaaggaaaatttttggaaaaaattatcattgatttgctcaatgtgatcaaattttacatttcattgttaatatcctttttttaattgtctaaaaaatttcaaaaattactttaaattacaaaccagagcagatagattttcgaacattaaattttattggatatttttctaatttttgctgctaatatatgaaactatttaggtgtattgaatgatgcctaagaattaaaaatttcgttgattttgagtaaagtattttctattagactttttctacaaaagtggatattttttgtacccccccccccctccggaaaaattgctaaaataagattttttttaattcataagtttcaaatttctctaatataaaatacaatttcgtaatatttaattaggaacagaactgatggaacacgcgaaacgaattgatgcgcgagaaaacaattggggcgatccgcaggcccacaattttatgcaccgaatttttgaccaattcaaccgttactcattggccaccattgaggcaacaaatttccaattaaaattaaata

SEQ ID NO: 76440 - DNA, 2451 bp, Heterodera glycines
  Genomic contig location: Contig_ID=SeqID_1864; Location=90..2540; Strand=+
  SCN-specific regions: Sequence locations=1-203,225-283,305-651,694 -1033,1098-1145,1199-1199,1221-1231,1279-1342,1373-1618,1672 -1760,1782-2140,2213-2451
  Gene Ontology: Mol. function=serine-type peptidase activity; Cellular component=extracellular space
aggaaaaatattatttttattaagattaatccttatgctgctgtttgtaatcaacgtgctccagcgcttacttttctgcaacaattctttcgacaatttcggcatcaaaattccccatttttggtcggtggcactgtatttgaaaacaatgacttgccggctggaaaatatatcgtacaggtccttccttgtttgatgtactgtattattaaaagtaattatttttatcccttaaatacatgtcataattattgaaaaatactatcatttcggcatttcatagatttattattttttataactatagtatattcatacagtacagtaatgcctgtagccattcccccgaaatgaaatttaagaaaaaaaaatgggcattttttgaaattgcaaaaaatttttcccggcggcgcctaacggcaccgccagccagacccatcatgttttttgaaatttgaccccaaaaattgcaaaaattggtcatttttggcgaaaagcggctataccttttatatggcgtgttgaaattgtgaaaatttgcaaaaaaaaaaattcaggacgatttgcacattacacctggcgcaaagctgaccctagcgccgggcacaaccttggaattcatgagtggcatcggaatgcttgtccaggtagaattttttttttgaaattttcatttaaaattttaaaaattttccagggtgaattgttgcgcaatgatatttcaagtgccggtccattcttgccaattgtgttcacaggcaaagcattgggccgaaatctgccgaagcttgaacatgttcgacttgtggacgaatttggcgacgaaaatgtgttggcagggcgtctagaagtgcggcaaataatttccattttgaatttgtgccaatttaatggaatttctatttttttttaattgaaagcgaaatgaaattttggacacttttttaataaaagaatcaactaagccaatttttaagcataaaaaaatttctgaaaaaatatgaaaaattttgaaattgttgttttcgatttctttttataaattaattaacatgtaaatttttgtttttatataaaaattattttaaaattttattgttttgttagagaaaataaaattttggcactttttttacgattaagcgaaattttaattaaaaaaaattcttaaaaacatatgataaacttataaatttttcttttccattcttttataaatttgttggcgttgtaaatttttttttctatttttataaattattattttgaaatttttatcgttttgttcaaaaaatccctaagtaaattttgattttgattttttaaattttggacggattggataattaattatatttaattttaaaaaattgctaacaatttccacaaggttcgtcttgagcccgatggacagtggggtacggtatgtaaccgttcctggacggcacaccatgcgcagctcgtgtgcaatcagcttggccttaccatggacccgcaacactttgaaaattggcgcattttcccgtcgcatggccaattcccaattgtgatggacaacattcgttgtgaagagcgtgaatgggacatcaccaagtgtgtaaagaataataatgatgggataattaaaataataataaaatatattttaaaaatttagtaattatttaaaaaggtttaattaggtctaattaggtcttttaagatttttcaaattttggctttcgtttttatttgcgcaaaaatagtctatttggaaaatttcttttatttcttcgatttttatgaaaatttattgcccgatcagtgtgttgatgctcccctacatttttttaaatacccatccatcccggacaaattttttgtacgggaatttccaccctacgaaccccgacttttctctacccctagggttggggataggcgtcgcccaggaaataaaaatttttgtgaaaattgtcaacaattttattgtttaaagcgaattaaaaaaaaacaagtaattttattggcaggcatttcaaaatattttttgaaaaactaaaaaattcagaatttttcttaagaattttcataataattatgcatttatgaaatggaaaaaatcaaatttaagttttgtgaatacagcaaaaacttatccaaaaataaaaaaaaattaattaataaaaattttcaaaaaaataattggaattttttttatttttcattaaaagaatttgatggagagttcaggtgccgtcatgacggagcgttgcacaatgtgcgttcgtcatgccgcccaacagaagtggtcgggttacggtgtgccccaccgtattgggccggtgtacggtactcattgttggccaacccacccacaatgaccggtcaaccgacaatgagcaactgggtactggaaaaggctggcctgtttgacttcaggacatcaacattcagtccagcattgcaggt

SEQ ID NO: 76441 - DNA, 1134 bp, Heterodera glycines
  Genomic contig location: Contig_ID=SeqID_1864; Location=3512..4645; Strand=+
  SCN-specific regions: Sequence locations=1-3,58-111,133-136,158 -203,236-640,673-742,774-883,905-907,946-1105,1129-1134
atgaaaattaaaatatttttattcattttatttcttaaaaatttaaataaaatttatgctggtggaataaaggaagaaaaaagctttgacgaaatatttggccaaagatgggaagaaaacgaggaggaaaatttagagaatgaaactgatcaaaatggaagaattgaacaaatggatggccaaaatgaggcaaaaaatgatcaaatttttgatgaacattttgaagtgaaagaaaaggatagtgaagaaatgtccacaaatggtgaagaattggaacaaatgtcaagaaatattgaagaaatttgtgatcaaaatcgaattttcaatgaaaaacagaagagagaaattgttgaaaaatttcataaaattaaagagaaaattatgcaaatggaaaagaaatattcaagaaaagaatggaaaaaaatagaaagaaaaattgcaaaaaaattgggtgaaaatcggaagaaaatttacaaatggaaaagagaatttggaatgatgaagaacaaaaattattcagttgaagaaaaaagaataatgttaaagcaatttgatcaaatatatggcaaattaaaaacgaaattaaatggaaaattggaaggaaaaaggacaaaatgccaaaaaataatagcaaaacatttgggcacaaatatcaaaacaattttttattggaagaaacaattaaaagatggaaaattgattaaaaatcaaaataaagatgagcaaaaaagagaaattgttgaaaaatattttaaaataaaaattaaatttatgcaaaatggaaaacattcacgaaaagaatgggaagaatttagagcagaaattaaacaaaattttcgtgtggcttatacggcaattgaaaaatgggccgagaaattaaagataaatcaaaacatttcaaaaagtgaattttaaataatgttttaaaaaatttttgttttttttcaatttacagagcgaaacatgttatcaattgctgaaaaaatggaaaagattaaaaaatattatcaaatcaaaaaacagaatccaaatctatccgatattaaaattgctgatattttaaacattccaacaagttcattacgcaaatacaaagctgaatttggcattaaaccaaaaaacaaattgctataa

SEQ ID NO: 76442 - DNA, 1220 bp, Heterodera glycines
  Genomic contig location: Contig_ID=SeqID_1864; Location=4879..6098; Strand=+
  SCN-specific regions: Sequence locations=1-15,113-120,142-211,316 -419,441-457,480-569,592-1220
atgagtaaatatggcaaaaaaaagtaaatttttagagaaaaattaattaattaaattcaataaaggcaatttttaaccaaatatttttatcaataaaaaataattaaattttgggaccaattttttagaaaatcttttcattcttaagggagtttttttcaattttcaagtagaatttgctgattgtgagtgaagttatgcagtaaatccgaataaattgaagaataaaaccaattataaaaagatttatattcattttaatgattttttattcagaaatctgaaaattaaaataatatttttaatattaattttcataaatgcaattggtaacatttatgctagaaagataaacgatgaaaaaaactttgatgaaatatttggccaaaaatgggacgaaaaattggaggaaaacggagagaatgaaactgatcaaaatgtaataattggacaaacggatggccaaaatgaggcaaattatggtgaaaatatttctcgatttaatcaaatttttgatggaaatttggaaatgaaggaagaaattgcaacaatttatgattcattggaacaaatgcatttttcaaatgcaattgacaaaacgaaacgagaaattatcgaaaaatttaataaaattaaagagaaaattatgcaaatggaaaagaaatattcaagaaaagaatggacaaaaattgaatgaaaaattgcaaaaaaattgggtacaaatcaaacgaaaatttacaaatgtaaatcaaaaacagatatcggatgatgaaaagcgtaaaatattaaagcaatttgatcaaatatatggcagattaaaaatgaaattcaatgaaaaattggagggaaaaagagaaaaatggaaaaagcaaaaaactgatgagcaaaaaagagaaactgttggaaaatatttaaaaacaaaaaatgaatttatgcaaaatgggaaaaagcttttcgagaacttttcaatcgtgtcgccaaatccaaaatcagtgactacagatggcaaacagatcggctgtactccaagaagcttcgagaaggcggcgttctcaccaaggaattatgtcttgaacgtgttgaggttggacgacggccggtgcagcaccagcaaccgcagctgagttattgaagtgacataaacataatgacacataattcaaaacgcatctcccgataagggtagaagaggaatattatagatatatgattgcacttta

SEQ ID NO: 76443 - DNA, 1252 bp, Heterodera glycines
  Genomic contig location: Contig_ID=SeqID_1865; Location=1634..2885; Strand=+
  SCN-specific regions: Sequence locations=1-107,129-600,641-690,724 -757,784-871,902-1081,1103-1130,1160-1192,1228-1252
atgaaatatttggcctgggacgaaaaatcggaggaaaatggagggaatgaaactgatcaaaatggaacaattggacaaaaggatggccaaaatgtgacaaaaaatgatcaaatttttgatgaaaatttggaaatgaaggaagaaagtgcaagaaattgtgatcaattggaaaaatgcatttttcaaatgcaattgacaaaaagaaaagagaaattgtgaaaaaatttcatagaattaaagagaaaattaagcaaatgggaaagaaatattcaaagaaagaattgcaaaaaattgaaagaaaaattgcaaaaaaattgggagtaaatcaaaggaaaatttacaaatggaaaagagaatttggaatgatgaagaaaaaaaatcattcagttgaaaaaaaaataataatgttaaagcaatttgatcaaatatatgcaaaattaaaaacgaaatttaatgaaaaattggaagaaaaaagagaaaaatgcaaaaaaataatagcaacacatttgggcataaatatcaaaactatttataaatggaagaaagaattaaaaaatgggaaatcgttgaaaaatcaaaaaactgatgatgaaaaaagagaaattattgaaaaatattttaaaataaaaaatgaatttttgcaaattgggaaacattcacgaaaggaatgggaagaatttcatgaaaaaattaaacaaatgtttggaatttattttagaacaattgaaagatgggcaaaaaaaataaaaaatcaatcaaaatgtttcaaaaggtgaatttaaagatttattaacgtattttttttaatttacagagagaaaaatgttatcaattgatgaaaaaatggaagtgattaaacaatattatcaaatcaaagaacaaaatccaaaattcaaagaatacgaaattgccgcaaaattgggaattccaatgagctcattagacaaatacaaaaccaaatatggcaatgaatccaaaaacaaattgctataatgaggacaattattattattatcccaagaagattaaatgaaaaattacaatgaaaaaaatttgaaactttcaatttttttcttgagaatttgtttaaatttgagtttgtgataaaagtttaatctctttttttcatctgtttacaaaaatattttaatcattaaaagcgtcgaatggtctaatgttttaggtgattaagtttaaaattatattaaatgttcatattattttaatcttgaaaaattgacaaaatatgtaa

SEQ ID NO: 76444 - DNA, 226 bp, Heterodera glycines
  Genomic contig location: Contig_ID=SeqID_1865; Location=1..226; Strand=+
  SCN-specific regions: Sequence locations=1-36,58-226
atggtgaagaaactgcgtggaacgatgatgccaaccatgaacaaacacaaagctgttgtagtagatgtagaaaaaaaaactgtggtatcatcacgctattattgttgtgtaaaaaacgatccgtttttacctcttttcgggaaaaaactggaaaaaattcacaaaaaaaatctcacattgtgcacccttttctatcatttgtggagtaaagaattttcgggaaaga

SEQ ID NO: 76445 - DNA, 4060 bp, Heterodera glycines
  Genomic contig location: Contig_ID=SeqID_1865; Location=1..4060; Strand=-
  SCN-specific regions: Sequence locations=1-87,195-406,428-440,494 -755,810-971,1236-1268,1298-1325,1347-1526,1557-1644,1671-1704,1738 -1787,1828-1889,1912-2234,2258-2299,2321-2417,2440-2457,2547 -2681,2739-3014,3036-3085,...
  SCN-specific regions: Sequence locations=...3115-3117,3144-3163,3186 -3332,3372-4003,4025-4060
agcagctggtgtacgatagcaaattgccagaattacggctaattgacggtcccacgggtcaggcaaggccgtctgcaggcaaatttctttaatattttttttcaaaaaataatttatgaaatttaataaaagttcgttttcaattaaaaatgttttttttataaaaaaaaacattgagttaaaaataaaaaatacgaggtttacattttaaagccatttaaaataattgtctaattgagctgaaattttacaaaaaaaaagacttttgatcaaaaataaaaaaagcgtatttttcagaattttttcattgtcatcaagatttgatcaatgttggaattttttgaaattaactatgaatgttacagtctaaaaaaactaataaaaaaattttcgtttaccactaaaatgattcttaaatgattttttcatctttttgttccaaaaaattaaaaattgtaattaagtaacaaaaaaaaaattaaatttttaatttcgtaacgcctttttatcatttaaacttaattttaaaaatgcgtaatacattttttgaaaattttttttttgattagattcgctttcgggaccgttggcgttccgtctgtacccaaatgacaaattggaccagcattgacacgggcaccgcgtgccgtaccatgggctatgatgacggcgcattttggcgcttttttcggcgcaacaacgacacttacccatttgaaatgccggcgcccaaatgtacacaacgccaaagtgggaaaattaaaaaattttaatgccaaatttaattttatttattttttgaaatttaagactctctgtggaactgtccaggctttgaggacaaagaacagattccgttgtccgaaaatttgtgccaaggtgaggacgacattggcatttattgttggggaaggccaactttcactggatgggctcgccattggaaaggtaaaatagaaaaaatgggttagaatttaatttaaattaattaattttatattattggatgggtgcattaagttcaatttcaattaaaagcaataatttatattattagatgggtgcattaattcattaatttaagtttaattaaaactattaatttaattgagtgagtttaatttggtataaattttttttttactttttaattgattgaattatcaattttttatttacatattttgtcaatttttcaagattaaaataatatgaacatttaatataattttaaacttaatcacctaaaacattagaccattcgacgcttttaatgattaaaatatttttgtaaacagatgaaaaaaagagattaaacttttatcacaaactcaaatttaaacaaattctcaagaaaaaaattgaaagtttcaaatttttttcattgtaatttttcatttaatcttcttgggataataataataattgtcctcattatagcaatttgtttttggattcattgccatatttggttttgtatttgtctaatgagctcattggaattcccaattttgcggcaatttcgtattctttgaattttggattttgttctttgatttgataatattgtttaatcacttccattttttcatcaattgataacatttttctctctgtaaattaaaaaaaatacgttaataaatctttaaattcaccttttgaaacattttgattgattttttattttttttgcccatctttcaattgttctaaaataaattccaaacatttgtttaattttttcatgaaattcttcccattcctttcgtgaatgtttcccaatttgcaaaaattcattttttattttaaaatatttttcaataatttctcttttttcatcatcagttttttgatttttcaacgatttcccattttttaattctttcttccatttataaatagttttgatatttatgcccaaatgtgttgctattatttttttgcatttttctcttttttcttccaatttttcattaaatttcgtttttaattttgcatatatttgatcaaattgctttaacattattatttttttttcaactgaatgattttttttcttcatcattccaaattctcttttccatttgtaaattttcctttgatttactcccaatttttttgcaatttttctttcaattttttgcaattctttctttgaatatttctttcccatttgcttaattttctctttaattctatgaaattttttcacaatttctcttttctttttgtcaattgcatttgaaaaatgcatttttccaattgatcacaatttcttgcactttcttccttcatttccaaattttcatcaaaaatttgatcattttttgtcacattttggccatccttttgtccaattgttccattttgatcagtttcattccctccattttcctccgatttttcgtcccaggccaaatatttcatcaaagcttttttcttcgtttatctttctcgtataaatattaaaaattgcatttatgaaaattaatattgaaaataatattttaattttcatatttctgaataaaattaataaaaaaattctttttctagttggttttattctcaaatttttgctaattatttaagcaaattctacttatttttttataatgatgtttcaaaattctacttagggctttcttgtaatcatactttgatgaaaatccaaggaaatcaatttattttttaaggttttttgtaattataaattatattcattttatattaattttcatatttctgaataaaaccattaaatttggaaatagaaagagaaacttcaacaaatagtgatcaaattgaacaattgccaacaaataattggacttaattctgatcatttttaaaagcaattgatcaaaagaaaagaaattgtggaaaaaatttaacaaaattaaggaaagaattaagcaaatggaaatgacattttcaaaaaaagaatggactaaaattgaaataaaaattgcacaaaaattcgcggctaaaaatttttgaatggaacagtgaatttgtaatgaataataaatattcggaagaggaaaaacttcaaatattaaaacaattagatcaattatatgacaaaataaaaattaaattaaatgaaaaattggaatgaaaagtagaaaaatgtcaaaaaatattagcaaaacatttgggcattaatttaacaagtatttatttataaatggaagaaacaattaaaaaatgggaattctgtgaaacatcgaaaaattaatgataaaaaactaaaattgttgaaaaatatcttaaaaaaatgaatttatgcaaaatgggaaacattcacgaaaagaatggaaagaatttagagcatattctttatttcaaaataccaatataacaaaataaatactttttttctggattcgaaactttttaaatcgtagcaattataaataaagtcaaaaattcaaaagtttaaaaattttaactttatagactatcaaaaaacaatttaaactcaaaaaaataatccctttaaaatggaaatttaaaaaaatgttaccaatcatttcgtcactgtttttttttaattggctaatttcaataaaatcatctttatgaaagcattaattggtctaaaattttccaaaaattatttctgggtaagagtaccaccggtgtagccccttttccaaaaatttttttgagatttaaaaagtcgaaaaatgagtttataagctttttgagctcgctgatcacgaatttgactgttgtcctaaatgatcttgctctgagatatcgatggggatttgctgctgctgctgttttctgcataaattcagcaaaaaaatttgacgcaaattgttttctttcccgaaaattctttactccacaaatgatagaaaagggtgcacaatgtgagattttttttgtgaattttttccagttttttcccgaaaagaggtaaaaacggatcgttttttacacaacaataatagcgtgatgataccacagtttttttttctacatctactacaacagctttgtgtttgttcatggttggcatcatcgttccacgcagtttcttcaccat

SEQ ID NO: 76446 - DNA, 807 bp, Heterodera glycines
  Genomic contig location: Contig_ID=SeqID_1865; Location=3347..4153; Strand=+
  SCN-specific regions: Sequence locations=1-221,275-287,309-520,628 -753,775-807
atgggtaagtgtcgttgttgcgccgaaaaaagcgccaaaatgcgccgtcatcatagcccatggtacggcacgcggtgcccgtgtcaatgctggtccaatttgtcatttgggtacagacggaacgccaacggtcccgaaagcgaatctaatcaaaaaaaaaattttcaaaaaatgtattacgcatttttaaaattaagtttaaatgataaaaaggcgttacgaaattaaaaatttaattttttttttgttacttaattacaatttttaattttttggaacaaaaagatgaaaaaatcatttaagaatcattttagtggtaaacgaaaatttttttattagtttttttagactgtaacattcatagttaatttcaaaaaattccaacattgatcaaatcttgatgacaatgaaaaaattctgaaaaatacgctttttttatttttgatcaaaagtctttttttttgtaaaatttcagctcaattagacaattattttaaatggctttaaaatgtaaacctcgtattttttatttttaactcaatgtttttttttataaaaaaaacatttttaattgaaaacgaacttttattaaatttcataaattattttttgaaaaaaaatattaaagaaatttgcctgcagacggccttgcctgacccgtgggaccgtcaattagccgtaattctggcaatttgctatcgtacaccagctgctcttggagcgatatggtcgatttattgttgctgagataaaatcattatgtatttccgatttattacgcttatcaaaaacataattatgggcaaa

SEQ ID NO: 76447 - DNA, 118 bp, Heterodera glycines
  Genomic contig location: Contig_ID=SeqID_12739; Location=3148..3265; Strand=+
  SCN-specific regions: Sequence locations=1-118
atggaattaacgccagaatcagacaaaaacagtgaaaaagaaaaactcaaaaagtccaagttggcagaactccaatttgaggagttcggattcacttgcaatggactgaccaaaatgt

SEQ ID NO: 76448 - DNA, 546 bp, Heterodera glycines
  Genomic contig location: Contig_ID=SeqID_12741; Location=565..1110; Strand=+
  SCN-specific regions: Sequence locations=1-120,142-468,490-546
atggatgaattttatgtggtactacgatccaattcacctggaccagggaactcgacctcaaaattcactgtcaggcttccacacacgcttgagctggacgcaaactggatggtggcactttcatcaattatatacccatattcatttccatccgtcggaattgatgatgacgacttcattagcattaaacttgtaaatccaaattttacattcgcggatgacaaacgttttgtggatattgaactaaaaataccgagcatgcaattctctagtgttggccatttaaggcaaacattaaatgacataatcaaggatgcatataaacaacggtttgggctctcaccacagaaggccgccggaacaacggttaaagcgaaacgccaaattgacgttacggaccttttttttcacgatcaccctggtgattattgggaaaaaattgaagagttggaaaaaaagttggctgaattaaaagaggagattgcgacgaaggagagggaacatggtgccaaaggtacagagcagaaaagaaaaaggaacttgaag

SEQ ID NO: 76449 - DNA, 599 bp, Heterodera glycines
  Genomic contig location: Contig_ID=SeqID_12744; Location=40..638; Strand=+
  SCN-specific regions: Sequence locations=1-40,146-347,443-562,585-599
atggtcaagcataacgggaagaacagcggtaagtgcttgtgagagagagagagaagaaaagaaagggagagagagaatgagaagagaggaaaagagagagagagagagagaaagatcagagtgagagagagaaagagagagagagtcaatcccgggttttcaactcgagaatttctcgacctttttaaaatttgcctattctcgactgagataagcaagcgaaattgagttgcacgattggttaaatgagctttgggccatgggtccaaatcagcctgcctgcaagttttaaaaaaatgtttctcgggcttttttgggccgctgatcacgtatttgacaatcaatagatttttttcatttaatttttcaaatatttttgtatatgttttttgattttattttagttgaattgaatcatatttttattctataataaatatatgttttgattggtttaatttcatttttttaggcttttgttctgtgtttggcaaaatgtcaattccaaatggatcatttttctattacgaggttactattctgcacaaacattatgagtaagttaatatttaataattaatttacattagttattctta

SEQ ID NO: 76450 - DNA, 547 bp, Heterodera glycines
  Genomic contig location: Contig_ID=SeqID_12744; Location=1732..2278; Strand=+
  SCN-specific regions: Sequence locations=1-189,222-380,403-547
atgctgtacgaattgtttgggattgtgcacagtttccgttcacatttgaacaaactctttttggagtgtgttttagttggcgaagtgccaaaaaattggagtgacaattccctttttgcattgtttggcgctgcattgaacggacagattgaaacccttaaaattctggtaattgcattcagttttagcttaaaaaataacaaaataatttattttattaagtcggaaagcaacgacgtaaatctgagaatgggccaactgaaaaccgctggaggcacaatcggtgattaaatacaatagcaagatctggacttgctggccggatccattcctaaatttttctctgaatttttttccaaaaaatataggtccagatcagtctgaaaacagaatttagacatgaaaaatctgtgttatttttcattgtccagctttgtctaattctgaagtcactttattggatataaattgtgtgtttagacggcgtctcattgctttggattgcatctgccgccggtcattttgaaattgtcaaatttttggtaaa

SEQ ID NO: 76451 - DNA, 822 bp, Heterodera glycines
  Genomic contig location: Contig_ID=SeqID_12745; Location=304..1125; Strand=+
  SCN-specific regions: Sequence locations=1-745,783-822
ctcaacgcagcattagaagaggggtaccgagtaacagagcttttgcgtgtacttgagtacagtaaaagcgacaatgaattattccgcccgtacatgagcgaatttgttgtccaaaagctgcacgcttcgggatttgatcagaacatccgtgggaatcttgaagccgaggagcaatttattgcagaatgttgtgaacaattcggaatgaaaatttatcgcaacaaaatgatgccaaataagggaaagagagcccttgccaaattggcagtcaataatttgtgtatgttttttttaaatttttttcatctccccttaatttagggggtcgtttttccctacgcaactatagactctcccaaacgctcattaccgacgacccgtcggagttaggcaactacttggacaacaagaaaatcgatgtcacagggcttgacatgttgaccccggaccgaattttgatcagctaccaacagaaaaaagattgggttaggaacacccttgctcgaatgttgtcgtctcactttttaccacttctgcagctcggcttcatttgttaaaagcaatgcaaaaggtcgttcgaacacccggctgtgtccttttatatacaggtaagaataaaatttctatccaaaatatttgcaatttcagataccgattctttaatatatgctcacccaactggcaaaaaccctcttagtacagggccccatttgggtcagttcactgatgaattccccgaggttagtttaaaaatattaatttttctcttaaaaatatttttagcatgacatattggaatttgtgagcggcggctcaaagtaa

SEQ ID NO: 76452 - DNA, 528 bp, Heterodera glycines
  Genomic contig location: Contig_ID=SeqID_12745; Location=1663..2190; Strand=-
  SCN-specific regions: Sequence locations=1-528
atgcttcttactgagaaaatcgcccaaattttgaattgtcgtgtgtctgagctccgcgatcggcttaatcatccttcagattttgaacatgtcgttaaagcattgaaggggtgtcacgtacaaacaacatacaaggatcgaaacggtttcacaaagagctttgcgtttggtggcataacaccgcaaggagcatcaacaactatggcttacgggcgattgggaagacccttcaatgtgaatgtgacagcgcatttttacgttcgccaccgcattaaacttcgacacccattcctgcactgtgtaatcgagagatttcccgagggtcaggaggatcggttctacccgcttgagctatgcaaaattaatgctggacagattgaaccgggttggctaggacgtatttttactgaaaccggaagtgacaacaataacaacattaacacagacgaaaatgcaagcactgagacatcactaatatcaagcggacgccaagaatgtagccaaagcgacggttattctttatggtag

SEQ ID NO: 76453 - DNA, 494 bp, Heterodera glycines
  Genomic contig location: Contig_ID=SeqID_12745; Location=2452..2945; Strand=+
  SCN-specific regions: Sequence locations=1-21,43-68,98-125,147 -268,292-406,442-461,483-494
atgccgactcctcctcatgacaacaaaatttacaaaaaatctgaatatttaaaaggtatttttgtctcattatttattaataatattcaaaaaattagtcgatgatgctgatgaagtggatacggacccctctcctgaagaagttgagaaatggacgcccgagcaagtgattgaatgggaccagcgtagttatggaaaaatgcctgccgaggaagagatttggcaagaattcctcgacaaaggagaagcgaatgtcagtgatatttatccattttaatgtttaaattaaaactttaggttctgcgtgagttctttggcggagagggggctcttaaagttgagaaaagtcttcgcgaatatgccaagaagaaagaacagcgagatgaaattctgatgcgaaagcggaaagaatatgaagaaaaaatggaaaacaacaaaggcgaaaattaaacactcctttgtattattattgttattgattcaaatttggatta

SEQ ID NO: 76454 - DNA, 435 bp, Heterodera glycines
  Genomic contig location: Contig_ID=SeqID_12747; Location=263..697; Strand=-
  SCN-specific regions: Sequence locations=1-37,61-214,236-372,394-435
atggccggattaattagtgaacttcaaggaaatgatggaagaaatggacaaaaaggtttggtctcgaatggaatcgaacccacgcctccacccacagtcgagggcaacgattaaccactgagctaacaaataagcgagcattttctactttccgcattatacctactcatagcttttttccttacatttatttcaggaaaatgcgagaaaatctcgagtttgagaagagtcgcataacattaaatatgtaatttttaaaaaaatgagactcacttgtgaaaatcaattgctttgccctcattcgctgcaattgtgcgcagcattgagtccacggcagcatttagcaacggagtgaactgagaagaaaaagccatcttccaatttaatttttgcactaattgcccccccctttattatgtgccgctctccaataaa

SEQ ID NO: 76455 - DNA, 1217 bp, Heterodera glycines
  Genomic contig location: Contig_ID=SeqID_12749; Location=152..1368; Strand=-
  SCN-specific regions: Sequence locations=1-323,369-486,508-1217
atgtcggcgaacttgtcaaacgattcggaattttgcacgggtacccatgcactgccacgcaattcattccaaatacggtgagggggcggccattcatttatagactaaaagcattcgttcgatcttaggacgtttcccaaccagaattatttgctaccacttcgaattgtctgcggattttccgataccatccgtcctccgcctccatctcccaagaatgcgaactgagtgcggtatataatttagttataaaacttaaaaatgggtaaggacctgcccattattgaaccaaaatttcctccataattctttaatagtcgaccaaatataataatctttatattattttgataaatattatatattatcctacaaaatttaaaaattggttttaaaaaagataaatataagcctggtccgctagtggccttgtggggtacaagactttttggtccgttttcggtcggtccgttagtgtcccattccgtaaaaataaattattttttgggcagacttctggggttggcattccttttgaaaaaaaatataattcaagacaaaatcgagcgcctattcgtcaccgctcacaaatttggattggaatgaagtggacccttcccttgtggcaacgtgcagcatcgacacgacctgcacagtttggaacattgaggtggcaaattagcactgggagtaattatgcaaatgcttttcctcccaagacgaatcagccgattgggcaggcgccgtccatcaaagggctgcaaaagactcagctgattgctcatgagaaacccgtgcatgacattgcattcacccgactggacaacggacgggaccaattcgccaccgccggtcgaattccttactttgcttaattttttaacttttctttccctttcaggcgccgatggaagcatccgacttttcggtttagtcgtaatttcggcaactttaactttggtctttgaagatttgcgggcacttcaacactcaaccattttgtacgaagatgccgaaaggagaatgctgaaccatctctcctggaataagcgggacccgacaaaattggcaacggttgcccaagagtctaaagaggtcaacggagaataagtgtcttcagcttcagaagtatgaaaatgttcaggtcgtcattctcgacgttcgggtaccgtgcagacctatggccaaatttggtaatcaccgagctgcaataaatg

SEQ ID NO: 76456 - DNA, 478 bp, Heterodera glycines
  Genomic contig location: Contig_ID=SeqID_12749; Location=1993..2470; Strand=-
  SCN-specific regions: Sequence locations=1-324,349-447,476-478
  Gene Ontology: Mol. function=translation elongation factor activity; Cellular component=mitochondrion; Biological process=translational elongation
atgatgcgcgaggcctatgaccgggcggcatggattctgttggaaccgatcatgaaggtgtcctgcactgtgccaaagatgtttcatgtctgtgcacttttgcgagttttcttaacgttgttttccctttaaggaaaaggtggccggcactctcaccaaacggaatggcattatgacagggacaacgcaaagcgaagagttcgtcacatttgaatgtgaagtgagcacctcttcaaggctaaataacaaatatttggcattggctttgttatttacgttctttaaggccccgctgaatgatatgttcggatacagcaccgaactgagaacggaaacccaagggaaaggtgaattcacaatggaatacagtcgatatgcgccagtgccggaagcgacgcaggaaaggatagtgtacgagtggaaaatggagaatgggctgatagagccggagaaggagaagaaagagaggaaaagatag

SEQ ID NO: 76457 - DNA, 894 bp, Heterodera glycines
  Genomic contig location: Contig_ID=SeqID_12750; Location=97..990; Strand=+
  SCN-specific regions: Sequence locations=1-483,506-646,683-894
atgcgtcaaaaaacatatgtattggccaaagccattctagagagaaaggacattctctttgggtcaattgaaaatgtcgtcaagccgcaggcgatgaaggagaaggaggacgcctgggaaacagttcgtactgaaatgattgagcagggctttgtcaatttcgagcgaaagtcgtggcgcgatgtacgaaatcacgactggcaatacttaagacgttctgcggttgcaaaatacgaacacaatcagaaggcgggcgttgaaatgatccaatacaacgaggcatgtgccaagtttagaggacattcacaaagattagttggtgcaggtagacaaactcgtcttcgaaataatgggcaacgaagtgtcctccttcgacaacacaaacaacgattctgttttcttacacaattttccaaatgatgaaggacaacaaaatgaagtggccgacccgccgttctttccagccactaatgcattgcgaactccgaaattagaagaactgcagcaaatgaactccaacttaagccattccatttctgttggttcgtctcgcgacccaccggcacagacaaagggattttcggttgaaacaatcaaatttttggactttgcagaacaaaaaggtgggtacaacaaccatttaaaagttagtcttttttgacatgttttagcagtttttttcaaaaaaaaacgtcaaagattttctttaaatatatgaaaaaattttctaagatttttttctcttgaaaattttctaactttaaaagaatttcttttaaatttctgcggcgagattttgtcgcgtcccccacctgcgccgcctggtgtgcatctttttcgtaagagcgctaagaatccattggcgtgcggaatttttacagacattttttatta

SEQ ID NO: 76458 - DNA, 372 bp, Heterodera glycines
  Genomic contig location: Contig_ID=SeqID_12751; Location=1429..1800; Strand=+
  SCN-specific regions: Sequence locations=1-372
atgcgcaaattggacgacctgtccggcctgagtggtgaacaccaatccgacaatgcatgccgaagtgcaaaggatggcggccaacatgggcttactgagcgggatcattttggcatcgttcagcgaagtgatgacgccctcaagcatgccgaacatggagccaaggccgagcatcagcaacatcatgaagaacagaacggcccagaggggcgggaacggaaattggaggatcgcttctgtgaacaccacgaaggccaagcccgtcccttcagccgccttcaaaggaaaagcatcgaattgagggaaaatgaaaagcaaagcgaagaataccgacagacctgggcaatgatttggccgagttcgcacttttga

SEQ ID NO: 76459 - DNA, 1583 bp, Heterodera glycines
  Genomic contig location: Contig_ID=SeqID_12751; Location=508..2090; Strand=-
  SCN-specific regions: Sequence locations=1-1162,1184-1185,1214-1583
  Gene Ontology: Mol. function=neurotransmitter transporter activity; Cellular component=plasma membrane; Biological process =neurotransmitter transport
agcaatcacacaaaaagcacaaatgccccccattcatttgtgccaaactcatttcattctccgacaacactaattgccttaattaatgcccagggacatggctttgattctcaaagtgcacccgacgcttttccgcgacttggacgaccttcgcgcgaacgtttccatcgaagagtgagtccgaaattccctttgctcactttcgtactcatctccatcagattcgcctcttacatgcgttatgactttcgggagtccaaattccccgacatcattcatcatccgtcctatcaaaagtgcgaactcggccaaatcattgcccaggtctgtcggtattcttcgctttgcttttcattttccctcaattcgatgcttttcctttgaaggcggctgaagggacgggcttggccttcgtggtgttcacagaagcgatcctccaatttccgttcccgcccctctgggccgttctgttcttcatgatgttgctgatgctcggccttggctccatgttcggcatgcttgagggcgtcatcacttcgctgaacgatgccaaaatgatcccgctcagtaagcccatgttggccgccatcctttgcacttcggcatgcattgtcggattggtgttcaccactcaggccggacaggtcgtccaatttgcgcatttcgtcccccaacttccttttccctgttcagtattgggtgtctctgttcgaccaattcgccggttcttacgctttgatgtgtgtcgccttcttcgaaataatcgccgtcatttatgtgtacggctgtgatcgatttgtgcgcgacattcagtacatgaccgacgaaagtgtggggccgtattgggtgagaaatgaagcgaaatgaccagcaaaggcaccgcaacaaattcatgattggttaaccatttggggactctctcaatttggctttgcctcgggggacacttttcttgagaatgcccgcgggtgtttttgtggtccttgctcaattggcatggcttttgcttccaattagttagtgtaattctcgcacaaacgcttttccctgcagacaatcacttggcgcttcatctcccccgttattatggccgtcattttcgtcgcttcggtcttcaaatcgttctccgatgtgcccaaatactccgcctacgactcgaccaccgtttgtccccgcccccctccatttccccttttatttccctttttcctctcatttgtcagacccatcagcacaatgtcccctaccccacttgggctctgttcatcgcttttggcctcgtcgttacttcgatggcttctgtaccgttcatttggttcgtgcgcaaattcaaaatttggcgcgttgagcctgacattcccgtggtcagtccgtcgtccgtttcggcatctttttgctttgtttggcatttcttaaggcttccaaatgtctcggctccaccccatccaccacttatatgttgcgcagtgatttgtccttcaatcgaattatcgagtctcgtggctctgaactgcaaaatctcggcagaaatggccagcgcaacggctcagtgcctggaggcgcgggatcggcgccggtgtcgg

SEQ ID NO: 76460 - DNA, 1246 bp, Heterodera glycines
  misc_feature (1227)..(1227): n is a, c, g, or t
  misc_feature (1239)..(1239): n is a, c, g, or t
  Genomic contig location: Contig_ID=SeqID_12752; Location=42..1287; Strand=-
  SCN-specific regions: Sequence locations=1-215,237-358,380-596,659 -861,883-1246
  Gene Ontology: Mol. function=transporter activity; Cellular component= plasma membrane; Biological process=transport
atgtacgtgacggccaccttcccatacgtggtgatgactttgtttctgttccgttcgataatgctggacggagcaaccgccggacttcgttacatgatcactccgaatgtaagctgaaagtgccgagaatgacggggcaaaaatgggcaaaaacatcggaaagggaaaagggacaggaatttaatgagaccattttagcgaaaattggccatttggcaaagtgtttgaaacctttgcgtgctttggagagcatttgcccaattccgtcgggcaatgcatttgaaattactttcttaaatgaccaccacatctgactaaatttgttccacctctctttccttcactgatcactttggcgttctgcttttgtagcatttgtctttgccatttttgcattttccattgtttgactccctccgtctcaatttgtaatgccactttttgtcccgccaatgtccccaatattgccattaattactccccccccccctttcgtccgtttttccctttttttattttaattttcacttggaattttttgtttgtccatttgtccacttatcattttcccattgtttcgctttgtttcggctttatctcttctcctctctctctccctttgtctttgctttatttattccctcttcccttcccctttaaatttgcttatgccatattatttttattttttgttttcatgccaaagtggtggacaaaacaattgtttgggtcgggaatggcactcaaattttagcaatttaaattctttaaaccaattcgcaaacagttgtgccactcgacccgtcaaattcgccccttttttggacattttgcggatttttggccgggtccttccgagtccttcactgatccccaaaatctcttcagctttctcgtctttctgagcccgaagtttggctcgatgccgcaactcaaattttctactccatgggtctcggctttggaggtaaagttttatgtcgagaaaggcgcgaaggtcgggcaaaggaaaagtgtcaaagtgactgcggaagagaaggccaaatgtgaaatggcacggccaaaggcgggcgccatttccgcgcttaattttggggtccgaaggagtccggtcgattgagtccgtcgcccccgggcgcgggtgctttccccgccaaccaaactcttcctgcaggtctcatcgcttttgcctcgtacaatccgctgaagggcaacgtgaagaaggantgtgatcaagantgtcggc

SEQ ID NO: 76461 - DNA, 904 bp, Heterodera glycines
  Genomic contig location: Contig_ID=SeqID_12753; Location=1213..2116; Strand=+
  SCN-specific regions: Sequence locations=1-169,207-212,305-320,343 -374,417-448,477-904
atgttctcaaaattctatttatcccccatggggggtaaatggagactgggtgattattttttaaactcctcagaaaggggggggggataattggagactgcggtattaatagagactgggctataattagagcatatacggtattatcaagctatatgcattgagattgtaaattaaaataagtattttaaattgcgttaatttttgaagacattaaatatttaatgaacttttatttttaaaaaattgatccatattagagttattatttttagatttattaaaaaatatttttttaaatattgacacaagtttttgctattttttacattattttggcatcaattaatataaaaattgaaaaggtaaatctgtatttaaatattaatttcttattttaatatatataattttaagcgtcatatggttttaataaaatatggattactattttaattaattttatttataaatatgacgaaatactctgtcaacattcatacttttttggtatgttaatataaagtttgtttgacttgcaatattcaatatgataaaaattaatggatcataaaatatattttttacttttttaaacaaacaaattaattcgaaaattttttgtttctttgcttttttgttacaggattcgaaattgggtctaatagagatagaccgtaattagtgacccttaaaataacgtgcagaacttttatgatttattacaaaaaacgcaacccaaaactttgagtatttcattttgtacaattatttttttggtactgaagtgtatattttagtgaaattgatttgtccacacaatactcgaataacttcgattcaatttcatcgattaatttctaaaaactcatctgatctttcgaatgatacaaaaatttgttaa

SEQ ID NO: 76462 - DNA, 215 bp, Heterodera glycines
  Genomic contig location: Contig_ID=SeqID_12755; Location=545..759; Strand=+
  SCN-specific regions: Sequence locations=1-3,94-116,138-146,169-215
atggaaagaaaacggaagaggaaaaggaagaggaaaagaaaaacggaagaggaaaagggaagaggaaaagttaacggaagaggaaaaggaagaggaaccgccggggaggcgaaattcagccccaagggatgtgaccagcggaagagtcagctgagagcagcagcagcatgccaatgtgaaatgcattgcaaaatgaatcatatgcgaagtgggag

SEQ ID NO: 76463 - DNA, 155 bp, Heterodera glycines; identical to SEQ ID NO: 51421
  Genomic contig location: Contig_ID=SeqID_1867; Location=1249..1403; Strand=+
  SCN-specific regions: Sequence locations=1-155

SEQ ID NO: 76464 - DNA, 1226 bp, Heterodera glycines
  Genomic contig location: Contig_ID=SeqID_1869; Location=2705..3930; Strand=+
  SCN-specific regions: Sequence locations=1-175,197-445,470-604,634 -949,971-1019,1043-1226
atggaacaacaaaatatcacttattatccgactgaaattgtccacggacaaacgaacggcgattcgcaagaacagtttcacagagaacatgtgtttcattcggatgcaaatgttaattttcacgcgacaaacgatacaaattttggtggtggtggccgccgagcagcttttgtaagaaaacaatttggaaaaagaatacctatttgtctaatcaatcatttcattaaaatttgactcaatgtgacagaccatttaaacatgtattcccattaagaggccaagtcagttgcagcaacgtcaacaacacatcgtggttcaacaggggccgacttcaattccgcaacgggtcagcaccaccaacattccggcgagtactgcaggacaacagacggtgcatgtgcagttggtgccgcacaatcaacagggaaatagcccaatccccggccagcaacaacaacaacgccaacaaattgttgttcaacatgcacctacctcaatgccacaacggatcagcaccaccagcattccgacgagcactgcttctggtcaacaaacggtgcatttgcaattggtgcctcagcaagggaacagtccgattcctggccaacagcaacaacaacagcagcaacaacacattataatttcggcgcaacccgtccagaccaccaatacgaccacagaatccgcagatgggaatccgattgctgcgtttatggagtactttgtggaacaacagcaacagccgacgtgttccacgaatactttgcccaacgttcagaccattcagcagtacgggtcgccagtgttggactcgaagtgggctctatttgcatcattaatatacaagggggtctcaggccatgggccatatgatggacgattgattaagggggggggggggtgtctcgggatcaaatttcgatacggaggtgcgaattttacatcggtgtgaccattacgcacatcaaatcagaaataaaaaaagttacttcagtttttaacctataatttcttaaccgcaaattttggggaattttcggggaaaaaaaatcataaaaatttttttgttctatattttcaggtttaatttccgtggatctatttaatatattgtgtttaaggttcactttgaaaaataagctgttgagcggaatggacaaaagttcggagaaggctgaacgggaagcagtgaaacgggcacggcaagcagaggcagcacgacaacg

SEQ ID NO: 76465 - DNA, 1030 bp, Heterodera glycines
  Genomic contig location: Contig_ID=SeqID_12757; Location=224..1253; Strand=+
  SCN-specific regions: Sequence locations=1-49,73-87,145-182,204 -302,423-750,773-931,953-1030
atggccagcattttcgggaagagaaaatatggaagaaggcgaatgaagagaggggaagaagaggtggaagaaatcggaagacggatgggagagggggaaggaggagaagaggagaaggaaggggaaaatgggagggaagaggaggggaggcaaatgggagagatagcgcaaagggagcacccgaaaaggaggggaggaaacagtaaaataccgaaatgtccacacgggttcagaccaatgaattaccccggaactcagtggacatttttggagtgtgtgatggatgaagaattgaagttgatgaagaggaggaagaagacaaagagaaggaagcaaaaggacaaaaggaggaggagtaagaggaagaaaagaagggggaacaaggaatgggaagatgaggtggaagaggaagaagcagaggagcagcaaaaaggaagcgacggcataataatcagcaaagtgaaggggacgcggaggacgagtggcagacagaaagggaggaagagacagtccagcacaaaagaaaaatcggcggtctgtcagtgttagagcattcagatcaggagtgggacgcgaccgcgattcgcggaatttttttccgcgattcgcgaccttggcaatttgaatccgcgaccgcgggattttttttttttgcggcgcgccgcggatttttttggcaaaactttataaagaaaattttttgtagttttaacaagctctattaacttagaaaaaatcaaaaaatttgactttttgctattttcatgttataagttttttgataattgtctaatcgcgaagcgatatcgcttctaaatatgttgagcatgaatgatctccttttcatctatttttttgcggatagcatatgctgagataagcgcaaaaaacacattttcttcgatcacttttccatttaagcgatttttagcaactattttcaactatttttgcttatgaaaatttttaacaactattttggcttgtgaaatttttaaaaaactttttttttaactatttctgtttttca

SEQ ID NO: 76466 - DNA, 1584 bp, Heterodera glycines
  Genomic contig location: Contig_ID=SeqID_12759; Location=634..2217; Strand=+
  SCN-specific regions: Sequence locations=1-306,330-460,482-764,786 -977,999-1223,1246-1429,1461-1517,1539-1584
atgaaacgccccaatttcaacaatgctcttccaatgagtgagaaaaagcccaagcttcgtcgacggctcccggctgaattaaattgcgaattgatcagtttcgtgcctttggtctgcctatttgcaaatgtgaagcgggctccaattggccctgtttgctaccaattcgagtgtttccgtagtcggcgacaaaagaattttgaatatttggtaatttccctttttatttttcattttattaccaaaaatatttttagaagggtgttattgctttattcgatgtgatgtttgaggagaaaaggacaccgaagaagaagaaagtggggagactgcatctacaggaagaactgccgcatgacctcagccgaaatgagctcctgcactacctgtgctacggacgactgggaacgaatttgttcgagacttattttgtgatgagccaagcaacaaatgtaagcgaatttttaaatttttaatgacaacaaaatttttagtcaattgccattgggaatttgtttgggcttctgctcgattttgcaatgagctcaccaactccttggctcatgaaacgaccaatttgctgtggaattttctaccgtcaacatttgccgtggattctgcaacaaccgatgaacgtaatgctttctcatggcttttttccggaggtccgaagtgatggttttgaatttttttggctgttcaacccacacttgaaaaagtatgctgggtatgtcagaattctgcctgagcttagtcagcctgacaatttgcattttttccttagcattttctaagcattttacttgaccaatttattcatcattatcattacatacagatcggaatttgtcgatttttccattttctcaataaattgttgaaatgaatgaccttgtgacatatgatacacaaaaacaatacagtgtggggcacacgttgacactaattgggattgataggaacgaatattttttcttaggcccattggaaacttattcaggaatgatgacacaatgacagatggtattttttgggctaagctgtcataataaatcactggttcttccattcccttcgcataaattgcgcaccaatgagaccctcccttgtaatgtgggtcccggttcacaattagcgctgcgggatactgtagagtgaccggaggcggtaattgatcactggcgaagcagccccgaaagactcgtgcggtcccccggttttcgttcaagattaatgtgatttgcacgctgtccattcttcagccaaaaaatagagcaaagttgatggagaaccaggctgacaataagcatcaagtacaatgcaaacaccgcccagcaaatgacttgttgaaaaaaatttagtctttgcacaattggatgagtggcgtgagaccagctgacacttgctcttcaattaacttgtcactttttgggggagaggaggtggtggttgttgatgtgcttgttgtagacggaattgttttagttgttgtcgatgtaagcattgcctttcttcttatatattctgaatactcaggaatttcctctctacatgacactacgggaagagaaatccgaagaagga

SEQ ID NO: 76467 - DNA, 2169 bp, Heterodera glycines
  Genomic contig location: Contig_ID=SeqID_12760; Location=1..2169; Strand=+
  SCN-specific regions: Sequence locations=1-96,118-589,619-955,977-2169
  Gene Ontology: Mol. function=structural constituent of ribosome; Cellular component=cytosolic small ribosomal subunit (sensu Eukarya); Biological process=protein biosynthesis
ccaaaaatgctaaccatcgattctccaagccttgtgcagttttttctgcgtcctcctcataaacaaatttcacgtacacattgccaatctgtgaacaatggcaaattatttattgtgaacctgccaatttttaccatgtgttcgccaatgttttcacaaacctaaaagtaaaatttcgtaaattaagcgaaaattcgttcccaatttacgttcaattcttccacgggacctgaaaataaaaaattgtaatctcagaaaaaagcaattttgaattgccgaccataagtgcgttgaagttcggtgaatacttcctcgtaaaactcatcaaaatggcgctgctcaagctcatcctttttaccgacctctgaaaagttatgaaatttagtcacaaagaatcaatgaatgttttattaatagtccactagagtaaggaattttgaaatagtcggcatcaggaaaaaggtcgagatggggttaccaggaccaaatcccggattggccgggattgtcaggatcataggatcatcgaaaccgatcccgtctgggctcttcaagttaataatggaaaacggatggcgtaccgccggggacttcccggaaaagccatttttggggaaaacccagggactttgggccaataaaacgtgccaattttgcttggtttccccgttaccggaccgtcatcaaagcccggacctttcccactccaattttttcaaaattttggttccgaattgcttactgtcgaaagcgtccgcctgtgccgggttcacaatgggactctggtagaagtgcttgagcagcactgtatttgagaaggtaggtctgtggtgggcccgcaaacagttgtccccgtgtcgacaggcgccaatctaaaaaaaaccaaaaatttttttttggcattttaaaattgaaaaaatgttatcaaccttgaagaagaatgagcaattcactttgtccttttctgtgccgtaaatactggccaaatattcagctcctgacaggtcatcggtcgcatcataacgaggcatttttgcaaaaataggccaaggtaatcaacaaaaagcaaataagtgataaaattcaagaatacttaaacctcaccaaatctaacaaatgtaaatgatatatcattcgattcctcttggtatgtaatgcattaatccgaaagaatttttttgcggaaagcactttcatggacggtaaaaaaggaaaaaaagcggaaaaaaatcgttggcgtaaaaaacaaaacgccaatgcattcaaaacaatacaaagtcattgtcaacggaacgggccaactccgtctggccaactccgtgttttttacacaaactgacaaaagaaaaaaatgtaaaacaaaaacatttcatttttaacacaaaatcaattatgtatgcacggaattggaaagtgccgagaattcgctctaaaatggcggccgggtcggattccgagtccaacattgccaattttcacaaattctgcccagcaattgtcaaaatgtcatccaaatttgtttttttaggcggacgacaccgtggtgattgacattggcactggcaaagtgacggactacgtgaagtttgatgctggcaacatttgcatgatcactggtggacacaacattggtcgtgtgggcattgtcggacatcgcgagcgtcacccgggctcctttgacattgtgcacatcaaagactctgctggccatggccattcatttgccacacggtttgtttcttggggctggttttgcgtgtaaaacacatcctgaccaccaacacttttggtccctttttcggaaatttactcagactccgtaaattttggttttgattgttgcttatcttgaaaatgggcatcagttgtgcagccaaaccatgtgagacatggaaaattgggcggaaatgtctccgtttctgagtaatactcagtttttctagactataatccatctcttttaaagccggtatcagaatttgaatgagggaaaatgtttccgataatgagcaaaaaccgatcagtgataatcctctttttctgtccaggatgaccaacgttttcatcattggcaagggtgccactccgttgatcagtttgcccgcttccaagggcatccgtttgtccattgcggaggagcgtgaccgccgtcttgcgcagaagcagaaa

SEQ ID NO: 76468 - DNA, 831 bp, Heterodera glycines
  Genomic contig location: Contig_ID=SeqID_12760; Location=2883..3713; Strand=-
  SCN-specific regions: Sequence locations=1-175,197-607,629-750,777-831
  Gene Ontology: Mol. function=protein phosphatase type 2A activity; Cellular component=protein phosphatase type 2A complex; Biological process=embryogenesis and morphogenesis
gtgtggaattatttcaccgatctgttcgattattttccgttgactgcgttggtggacggccaaattttctgtcttcacggcggtctgtcgccgtccatcgactcgttggaccacattcgatcattggaacgtctccaggaagtgccacatgaaggtaattgttaattttctacatgaaacaccaccaaaacggggaacactccatttgtttacaaaacgatggtgacaattcattttgtttaggcccaatgtgcgacttgctgtggtccgacccggacgatcgtggcggttggggcatttcgccgcgtggtgccggttacacttttggccaagacatctccgagacgttcaaccatgccaacggcatttcgctaatctcgcgagcacatcagctcgtcatggaagtgcgtatttcgggggggggggggcatttaaaaaaacaaagttgctaaatggtgaaatattgggtaccaaaaaactacttttcatgaaaaaccacagtggtgggaattggtcgatccgaacgttaatttgagcaaatgtatcatgaaaaaacgcgtaattgctttcgactgtttcatattgacaaaatgcaaactgccgttacatttttaaatttattttatttgctccccgaagggctacaattggtgccatgaccgcaacgtggtcaccgtgttctcggcgcccaattattgctaccggtgcggcaaccaggcggccatggtggagctggacgacgagctcaactactccttcctgcagtttgacccggccccgcgtcggggcgagccgcacgtgacacgccgtacgcccgactatttcctctag

SEQ ID NO: 76469 - DNA, 1146 bp, Heterodera glycines
  Genomic contig location: Contig_ID=SeqID_12761; Location=163..1308; Strand=-
  SCN-specific regions: Sequence locations=1-365,387-409,431-1146
atggatttgtatttggatgatgtgcacgacgacaacggaattgtccagccaatgtggaatgattttgctcgtgaaatttggcccatttttgcgccaaacattcgccatttgaccgttcccgttggccatcatttggacgatttacgtcgtcttatttcgccgacaattctcaccgattgcattcaattggattcaatcgattccgattatttgttgctcgatgcaattgctgatgatgggccaaatgcgtattctgctggccaaattctgtccaaatggttacacattccgacaaaaaatgggcagccgaaacaatttcgtgatgattatacgtcagaaaccaatgaatgggtcaacaatttcaaaaaggtgtgccaatattttcataatatttggattaattggcatttgcttttcatttctcattttttaggcatttctccgtgccaccacttctgtcagttacataatccaattcaaaactcacacctcaattacgcagtttgaattggtgaacgaacggactaaagaaaagctgacattgaaggtgaaggcagaagacgatgatgaatatacatatattaattgcgtgttggagcggtgccaaattggagagacaattcaatgggaggacaaaaagacggacaatttgaacaaaatcgcttttgagctttatggaaattgcattgggtgagtggcaacagcttttgcttttatttgtctcgtcatatttaaatcgcacttcatttaggtcattgtcgccaccagaatcgggccaaattaacgtaaaaggtcctcttgaaatgaatcccgggcccagcggacagcgaaagaaaaagtgaaagaattattgggaaatgagaaatgatcaatcattatgaatggaaagtgatcggataattgctcctcacatttatttgtcgcttcgttcattcgaatgcatttaatttgactggatttttgtgtcttttacagcagaatgatgggttagaaaaaaggtgtcaggtgatttcgacactgaactatttcgcttactctttatgtctaattgagattttgacagtaaaggtaaagcgtattttttaaattggcagaaaattatgtacaatttctagagtcgctacttttagtgacgaaaaatcctga

SEQ ID NO: 76470 - DNA, 487 bp, Heterodera glycines
  Genomic contig location: Contig_ID=SeqID_12761; Location=1420..1906; Strand=-
  SCN-specific regions: Sequence locations=1-487
atggcacccgtcaaaaaaaagaaaaaactttcctccgcaaatcaccgcccaatttctgcaactgaaacaaatcatcagaagaaaccgttgggttcatttgtgacatttggaatacggcgaagtgttcgcgtggcaatgaaaacgaatcggattttgaagaaaatgtgaaaattttttgagttaaaaattatgaaatttcattttttaacaccgcgctaaacgctcaacttttgacaatttcagttgggtgtgcaacgacattttgatggatattttgcccctttttcgtcgtcgtcaactcggccaaaaaatggcactgatttcgccacgtttcaatgctttggtggacaaacattttgacggcaaaagcgagacaatttggagacaaatcagaattgccaagaatggaacaaaacttctatctgtagttacgaagagcaattcgttgcccatcaaaattcgctttaacaaccttcgaattgagtaa

SEQ ID NO: 76471 - DNA, 87 bp, Heterodera glycines
  Genomic contig location: Contig_ID=SeqID_12761; Location=2999..3085; Strand=+
  SCN-specific regions: Sequence locations=1-87
atgaaggaaggccaaaagccccgccagtcacgacacaagggacgactctcaaagaagacgcgcattgtgcgcgagcttgttcgcgag

SEQ ID NO: 76472 - DNA, 1101 bp, Heterodera glycines
  Genomic contig location: Contig_ID=SeqID_12762; Location=1..1101; Strand=-
  SCN-specific regions: Sequence locations=1-186,208-1101
  Gene Ontology: Mol. function=RAB small monomeric GTPase activity; Biological process=signal transduction
ctgtccttttggccgatgagttacaattatttgttcaaaattgtcgttgtcggcgaccacaactgtggcaagtcgtgcattttgttgcgcttttccgagaattccttccgttctgaccacgtgagtacgctcggagtcgatttcaaattgaaaaccatcaaaattggacgggacaaaattcggttggaattgtggtgggttttactttgccttgcgtttttaattgtcagctttaagggacactgcaggtatttcaatgtgttaactctccgtttcatttgcatcaaaatgcttatcgttaggcatggaaaggtatcggaccatttacaattcgtattaccactcggcccacggagtgatgtgtgtgtacgacttggtcggttcattggcacaaattgtaatttaatgctaattactaaatggaatttagacaaacgaaaagtcatttcaaaatttggaaaattattggctaagacaagtgaaggaacacgcgccacaaaatgccgtcctccttatggtgggcaacaaagccgacttggactccgagcggaaggtggactttgaccgtgccgaaaagtaaacggaggaatttttatacatttttaggtatttttcggttttgtgtacacactaaaattttcaaaaatatgccaacaaaagatccactaagtttttttgatggcacaaaaggaataatttgctctaaaaaatctaaggtttcttgccattttaagggtaaactattccctgtgtgcgatcaaaaaaactttgtacatatttttaaatttagaggtgtatacacaaaaccgaaaagtacccatttttattgttaagtattacactccttttttagtttggcaaagaaaatcggcgtgtcaatttacgaagtgagcgcaaaaacgggcataaactgtgacgacgcattcgttgaacttgccactgtcatgagggacagacttttgaactcgggtaaggaactgccgaattggcatttcgaaggcatggagtcgatttgtttggcattttctgtcctccgttaagcattgaattccgattccgataagtctgaccatctctcctccgcatttcacatcgacggag

SEQ ID NO: 76473 - DNA, 2301 bp, Heterodera glycines
  Genomic contig location: Contig_ID=SeqID_12763; Location=246..2546; Strand=-
  SCN-specific regions: Sequence locations=1-57,89-612,634-705,728 -813,835-842,864-1256,1299-1582,1606-1639,1662-1845,1867-2301
atgaggtgggttgattcgaactccttttgacctattgacttccctcctcccctatcagagcccaaaaattttgggaaattaacaaattcctgttgacttttttttaaattatgctcttcactaccttttacaacttaatccctttccaattgaaaaaacaaatattttttctgatttttttttgccacggtgaaaaaggtgtttttttcttctatatttcactccatttcaatattggaaaacttttttgcatctcaatttttttattgattcgccgaaaattatgcgaatttgcttccgattcccttgcgatatgcggaattgacttcccacctcccctggaatcacgtcacaaccgctaacccaaagacacgttttaactttagcttccgctgttcacttctctgttgaacacagtctgtgcttatgaccccgttgggtttggcatgccgtacaattatttgttgtttggtgactcccgtgaacctttggtggaagtcgcccttcagttgcttatcgtttgtctcgaccgcgactcgcagccgaactctgacgaagtgtccctttccccttaattcattttcacttcctttttagaacggttatgttgagaattactttgtcaattacttgtcgcgtattcaccgtgaagatgactttgagtttatgcttaaggtccaatctgaataattttgtcaaattattaatttcaatctttttctctttaggggttcacccgacttcttaacagtcagttgcaaacttcttatctgccgaactccacgaagaaggttgaactgcaccaggaactgcttgttttgctatggaaatgttgtgagtacaaccaggtcctttttacagttggctacaattttcactattttatcggattgttacagaaattcctttattatgtgctgaaaagcagcgatgtgcttgaacttctcgtcccaattttgttccatctcaatgattcgaggacggacccaagtcgggttttattttattcttctaagtacccttttaattgaatttttgttcttaagctcggattggtttgattcatatgggcgttttcctaattcttcttttgagtggtgaaagaaatttcggtgtccgattgaataaggcaagtcaaaattcgactgataaaacacgattgaaattatattaattactccatttttagcctttcacttcccgaggacttattgacgtgccaatttttaccggatctcatgccgatttgctgataattgttatttttaatcatgtttttatttattcaaaaatgttttaggttttccacaaattaatcaccagcggaaatcacaaattgcagtcacttttcgattgtcttcttacaattgtcgtgaatggtaaagttttcttttgcttttgcattattttcaattcgttttttcagtttctccttatctcaaatcgctatcgatggttactgctaataaattagtgcatttggttgaagcatttaggtccacccaatttgtcagttgtttttttacattcaaattttcctttagcactccttggttcattttctcaactccaacaaatcaccatttgattttctttttgcttgaattgttcaacaacatcatccaatatcagtttgacggtacttttttctacctttttcaaaatactttttttttacatttaggcaattcaaatttggtatatacaatcattcgaaaacgacaagtcttctaccaattggccaatttgagcagtgattccgtttcaattgcccagaatttgaagaaaggcaaaaaaggcgcgactttgaaggcgaatgaggacagtgaacaacagcaagccgtggaggaacagacaaagaaagaagaagaaacggagggacaaacagaacgggcgaaacagcaacaaattggtcggaaaggaataattaccaatgaaattgggctggaaataataacacattaattgtcagagctaaaatcgtcatcactggcacaaacgccggcaatcggcgcaatgacaacgatggaagaatcgttggaaagcaaacgaacgagcgaacaaaatcaaacacaacaggaagttgaacagctaaaacagctcgaaaatcgggaggagggagccaaaaatgggcaacagacgaacgaaactgttgccattgaggaggaatggacaccgacaagtgaatgggtggagtcgtggaagaagaagttgccactgcagacgatcatgcgagtcttgcagattttggtgccgcaagtggagaaaatttgcattgacaagtccgaaatgggattctaa

SEQ ID NO: 76474 - DNA, 793 bp, Heterodera glycines
  Genomic contig location: Contig_ID=SeqID_12764; Location=693..1485; Strand=+
  SCN-specific regions: Sequence locations=1-279,301-456,478-514,536-793
atgggcgtcagcggaagagcgcacccatcgctggccaaaatgcgcgagaatttgatcaatggaaccatcgactttcaggaagtgccgatcatcgacatgaaccccgaggacattcgggttagggggggggagagacttccatagtttgtccctttcgcttttacattctttccacaggctgagctgaagagagtctacacgcagttgaggatgtacaagctgaagaacgcgtaccaggacaacccgcacatcagcaaacggaaaggcggcggtgccgtaaagaaaagcgccgcgggcgatgcgactgtaagcggaagactgtcaagcggcgcgggccttagcggtgcgggactaccgaagggcgtccgcggaacggagggctattgtgccgtaaaacgcaattccatcccccgtgaggcgacaccgaatgctgttacatcgccaaaggtgcaaagaaacaaatgaaaaagtagtgaccgtgccgtgccattttattcttggcgcattctttgaattaatcgccttcaaataaatataaattcgaaagcgttaacgttcgcatttggtcttctgtgaaggtgagcaggacttctcccaatttaagcaattgcatggcgctgatcgcccgcctccgctcgtttttatggacgaagacaaaagcggcggcgatttgacggtggagtcggcgcctcataatgtccacctgctgaccagcagattggcaaggggaccgcctaccatcgcaactccgccagtaacctcaatgggcacggactgttcaattcgagtctaa

SEQ ID NO: 76475 - DNA, 122 bp, Heterodera glycines
  Genomic contig location: Contig_ID=SeqID_12764; Location=1730..1851; Strand=-
  SCN-specific regions: Sequence locations=1-122
ggccccggaggcgttgggatgatgcaagcgattcgaacttaaagtgggcgaccgaagatgcatccttcgctgttttgttgttaccgttttttgtctttgtcaaaggataaaagttgttgaaa

SEQ ID NO: 76476 - DNA, 488 bp, Heterodera glycines
  Genomic contig location: Contig_ID=SeqID_12766; Location=62..549; Strand=+
  SCN-specific regions: Sequence locations=1-36,58-488
  Gene Ontology: Mol. function=extracellular ligand-gated ion channel activity; Cellular component=integral to membrane; Biological process=cell surface receptor linked signal transduction
ggttttacattctccaggcttacgttccaacgtgggtcttctgctgaattattttttattccgcttttatttaagttatttgaccatcatcgtttcttgggtcggcttttgcatgggtctgtattttcttttttttgcaatttctctatttgtgcatttttattttttaaatcaattgtcattttagaaccgaaggcactcccggcacggacaacggtgtgtgccaattcccgcccccccccccccccttttgacatttcccttttctaaggtcggcgtttcctctctccttgcgcttactctgcaagtacgaaaatcaccagtcaaattgttaaactttgttgttctgttgctgttgtttcagttcggcaacattcacaaaaaccttccccgtgtttcttatgtgaaagcgatggatgtttggatgttgggatgcatttcctttgttttcggcacaatgatcgaattggccgtcgtctgttacatca

SEQ ID NO: 76477 - DNA, 1076 bp, Heterodera glycines
  misc_feature (782)..(782): n is a, c, g, or t
  Genomic contig location: Contig_ID=SeqID_12767; Location=1188..2263; Strand=-
  SCN-specific regions: Sequence locations=1-269,292-754,799-1025,1066 -1076
  Gene Ontology: Mol. function=potassium channel activity; Cellular component=membrane fraction; Biological process=synaptic transmission
aattaatggagccaagactttaagagacggcctttgtccaatcttgtaaatatttccttcaattcctccccccccccttttttagggtttggtaatgttccaatcaatcggtgaacgtctaaacactttctgctccattctgctcaaacggcttaagctgctgcttcgtcgtccccccctcgtctcccccatggatttaatcgtcgtttgctctttgctaagcaccgcttgcattgccaccggcgcttgggtcttttcgcactatgaaaattggttttgtttttgatttttgccattcactcatttgtcagtccctctcccccccccccccattacttttgctaatttgttaggtcctacttcgattccgtctattactgcttcatcactttggttaccattggttttggcgactttgtcgccctccaaaaggacggtgcactcgaaaagaggccagaatatgtgattttctcactgattttcatcgtttttggccttaccgtatgaatttttgggccaaaatgcgtaaataaaaaagttaatgacaggtgatttcggcagcaatgaatctgttggtgctccgatttctgactttaaacaccgaagacgaaaggagagacaaaagggaggcgcggctggcagcaaagggattggtaaatgacggcaaaagataaagctgaccaaacgcgtcgttgtcccaacacaggcgcccatcgacagtctccagggccggcgccattatctgaagggccgttcctcgtcctcctactcttcctccagcncctcctcttccccgtctccgacgccaagcggagcagcggacgacgaccctttggatgggtcgttgccacggcgtcgtcggcaccccgtggccggggccagcaccaatcggctggcaccattttatatggcggggcaaaactcacaacagcaacagccgaatgacactgtctccatcatctcctgttcatgctaccaattggcaaaagcgggcactgtgccgctcccgacgatggcatcgcttggggaggagcaaacagcccaaactgagcaacagcagctgcaaaatgttgcca

SEQ ID NO: 76478 - DNA, 232 bp, Heterodera glycines
  Genomic contig location: Contig_ID=SeqID_12769; Location=205..436; Strand=-
  SCN-specific regions: Sequence locations=1-6,61-94,116-155,179-232
atggccataaaaataattaagaaaatattaatgtaaatttcatttatttcataattataaccaactttataggcatgattctgtctgttcgtttgcaccaaaggaaatgggtttgtgtgccgtccatttgcgggggacaccgaaagaatgtggttatgatgatgataatgatgatgatattgctgctaaataaaaatagtttaaggtgaacgacccatttttgattattaaa

SEQ ID NO: 76479 - DNA, 1075 bp, Heterodera glycines
  Genomic contig location: Contig_ID=SeqID_12769; Location=704..1778; Strand=+
  SCN-specific regions: Sequence locations=1-331,510-520,572-637,659 -782,805-841,885-1075
gtgacggtccgactgagcaaagatggaactgagctcaccgcgcttggcccaacattgacgacggccaagcagaaggcggccactttggcactggcacatcttcgtcccgagttggagcagttgaaacgcttgttgaaggaggcggagggcacagcggaagaagaacaaattgtgccaaaattggtgaccaaaaatgatggcacagaacaacgcagcaacaaaggcaacatttgttggattgtgatgccgtaccaaaatgccatcgttcattttcatcatcaccgactgatcaaatggatcaacagcaacagtatgattcgcccctctccccctttctctctctctctccatctctctttctctttccttccgtctctctctctcaccatctctttctctctccccccctttctctttctctctctctctctctctctctctctttttctctctttatttcttcccctcttttctcctctttctctctctcccgccctctctttctctcttctctcgcgcactctctctctctctctttcttcccctctttcctcctctttctctctctctcatgccaattttcattcagccaatgccgcagccgggcaatcatcaatcatgaccactaccaatagcacggagaacaactacaataccaatgctgattttgcgctgccatcaacgcccgaaaatatgcaaatgccaatcatcgacatgtttgttgtgccacccgaggagcctgacatcgtcgaggctgacaacaatgacaatgctagccaatggaacaacaacaacagcaacaatccgatcatcaatcagtgccaaacaatattcatggaaaaacaatggcaccagcaggatgatgaggaggaggaggaacagaacggcagcatcgtcgctggccgtggtggggaatggcaccacaaagcaacggagcaattagcacaaatgccgcaaaaacagcgacaagcggttccaaaggcgttgggacgttcgccgacgtggagcagcagtgcttttcgtcaacaacaattgatgaacaacatcaacagtttatgcagcaacaacaacaacg

SEQ ID NO: 76480 - DNA, 897 bp, Heterodera glycines
  Genomic contig location: Contig_ID=SeqID_12770; Location=109..1005; Strand=-
  SCN-specific regions: Sequence locations=1-189,217-268,390-484,510 -699,732-773,796-870
atgccagctcagctgcaaccagtttcggttcagcaggctatgccagctcagctgcaaccagtttcggtccagcaaacgatgccaacgcagctgcaacccgtttcggttcagcaggagcaaccaacacagcagcaagcgacggtgtggcaaaacacaatgcctattctgttgaatcacacattgccggttcagcagcagcagcagcaccagcagcagatggtgttgtagtagaatgttgtgacaacttgtacaaaggcaactcttacacaaaaaaaatttaatttaatttttttcttaaagtataattttcagtttttttattttcttaaaaaagattattttccaatttcaaaaatttttttttaaaaaagacattttaaaaaaaatttgtatggtatttgatcactgagaattgccgatgtactagcctttgtacgaattgagtacccccccccccccctccccccagcaaactgtgccaaatcaacagcagcaacagcaaattcagctacagccaccggttcagcccgctgcccagcagcaaactttgccaatgaatgtacaaatgccaacggcacaatttgagtcatttttggttcaaatgccacaagcaccgccacctgtgcttcaaacacaacagggccaaccggctcagcaaacggatgatatgtttaggctaattggagaaaatgtattatcaataatattaataataataataataataataaaggaagaagctgctccgggcatactttcgacttctggtcgaagtggtggtggtggtggtggtgggtgggtggtgagagccgtcaatgggcttgatccatcaatggtacaggggaccagtcaacaaattgtacaaaacagattttaaacaaataattaaaaaataaa

SEQ ID NO: 76481 - DNA, 413 bp, Heterodera glycines
  Genomic contig location: Contig_ID=SeqID_12770; Location=2920..3332; Strand=+
  SCN-specific regions: Sequence locations=1-413
aaaatggtctaagtaaaaatcgtaattacgctcaaaaagcttctcaaacaattttagcgcttccaattccttctacaatcgcctttatacatcccattatgaacgctaaaattatcagagtgccgaaaatcgcatgtgatctaagcctagaaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagcaaaaaatggtgtaagtaaaaatcgtaattacgctcaaaaaagcttctcaaacaattttagcgcttccaattccttctacaatcgcctttatacatcccattatgagcgc

SEQ ID NO: 76482 - DNA, 2604 bp, Heterodera glycines
  Genomic contig location: Contig_ID=SeqID_1872; Location=36..2639; Strand=-
  SCN-specific regions: Sequence locations=1-357,390-845,868-1816,1865 -2604
atgcagcatacaaagcgctatttgcttgtccccgaagaaatttatcagagtttggcatcaccgccaccgtatgacggaacaccaattgggctggtacgtaacagaattaaacaaatcaaaaacgatgacggcataaatgaggcagaacgggcaatcaaatatgagcaggaacttaagcgtctcaacaagctgactcgggacgaggatgaacgtcccgtgggtgttaaattagaaaatttgagtgatgtggttgacgctatgccaaaaccagtcaacgtcaaaagaccaattgttgtcgctacgcgtcgccatttaaaggttgggcgtgcgcgaaaagcaaatgttgaacaactagaagatgttgatgatgatgatgatgatgatgatgaaactccaaagccatcgagttcaaataaacgacaacccacacaaagggaaatcttaaaattaatttataaaaacgcccaatctcttggagtgtctgaggaaggacaggtcttgagagcgggtgggcggccttttataaccagcagtgtttatgacattgttagtcacctgatgaacaaggacaagcgtggccaaaacaaagagccaactgcattcaaagaatttgttgaaagggcaagacagatcccgctcttgagtaggcacttatttcccgaaggccaatccggcaaaggcatttataaaaacaccacactgaaatttaatccatctttatggatttgaaaaagcttcgtttgcttgagtttttgtacaaggaactaagttcgcctgtcgcattcacgagcgttgaaccgctgctgagagaggcgcagaaaactcaaccaaaaattaatcgaaccgatgtccaaaattatttagccacccaacgtacatacacactgcatcgtcaggccaagcggcgctaccgtcgattgccaacattggcaccaggcttacacactgaatggcaggccgatttggctatttttgaccgacttgctaaacaaaaccgtggctacaagtacttgttagtctgtattgatacccttagtcgacaggtgtttgtcgagcccgtaaagaccaagacgagcgctaacatgataatagcatttggtcgtatattcaaaagatcaaaatatatcccgtggaaggtgttaacagatcagggaaaggaattcactgcccgcgcagtacagcagttcttccgcacaaaagacgttgaacacttttgtatgctcacttctccccaatttcatgccggaatggcagaacgtgcgaatcgtagcatcaaagagcgcctttaccgctactttacggagcgtaacacgtacaagtcgattgatgttgtgcaagacattgtttacgcaattaaccactcgccaaattcgagcattcgaatgtgcccagcagacgtgaactttaaaaacgcagaagcattgcgacaaaaattacatggtgcagcagctgaaaattttgtacgacatcagccaaagtaccgcgtgggagatcgcgtgcgcattgaaaagtacaagcacgtgttccaaaagggttacctcccacgcttcaccaatgaacttttcacggtggcagaggtacactctgagcgttcgccagttgtttatcggttacgtgatgacaataatgaaattattagtggttggttttacgcaaatgatttatgcaaaacgctagaagacaaacagcaaaaaagtatgaaattgaaaagattttgaagaaaaagaggcagaacggtgtggattatgcatttgtgaaatggaaagggtatggcactcgctttagtagttggattcccgtaaattcaattagcgagaaaaatatataaaaagaaataaattaataaaatttatttaaaaaaaatgccttcaaattctttttatgctgttcttccgtcaaacaccaatattgaaggaaataggacaaattctttccgagtgcgtttaccgcgcaaattgcaattcaattcggaatgggaggtgggtcttgccgttattgtatatccccactcttggccctcgataggcaccgtggagcaacaatttgtacagattgagtggcagacagggaatatggtacgtatcgaagttccgccatcaaatgtcacaaacccccatgagcttagcaaaaatttatataggctcctgggtgagggaagtgatccgttggcaaaaaaggtacgatcaacacagaattctttcatgcttacgataaacaaggctcgccgctgggccagagaagagtacattaagcgaaagactaaagaaaaacggggcgtccgtgacgaagagctgctcctacaggccatgttggcagatactggaacattggttgacctcaacagcgtggcccaaggctttctgacacgcgaaaagagtgctgcaacgagtaatgtaccgttgagaatgccagctgatgataccagttcgtaccaagaaaaattggatgagtacttttcgaaattaagtgacaaaaatttgaacattcttgatgaattgggcatgacaaaattgaacgccgaaatcaaaaatttgaccgaagaggaacgcgtgatccttgaagccacaaaggaaatgggaacggaagcatggattcaggcgtacc

SEQ ID NO: 76483 - DNA, 1162 bp, Heterodera glycines
  Genomic contig location: Contig_ID=SeqID_1872; Location=5700..6861; Strand=+
  SCN-specific regions: Sequence locations=1-1075,1111-1162
atgacactgacgccccaattgtgtgagccacgggtgaagagtgcgtccaaatattgctgactcatacccaccaccaaatcatccagcaccagcaaggttttttcttttttggcgcactcccgcacttgttccgctcgtgggacgccgctatggatagtgactggcacattgccaactttgccggcgcgctgcagattcatcacatttgtgttcacctccccatagctataaataacgcgttcaacaggggtagagatcattttgtccacatttcgcaacatacgcattatccactctgacttcccacttcctgtgctcccagacacaatcattgtaaatggatgacgaaattgtccatctttccttttaaattgttggaaggcgtccattttattttttatggaattttctttttatttatagtttttcatttttatagattttaatggatttaattcttgccaccgattggataaacaacgcttatcccgaaatggatttacaggacaccaacaaagagaacaaagagccaacgaaaaaccaataggaggaggcggacgatcccagttggatcagcctgattgacgaggagatgaagcgcgagccgctcgctccaattggtgaggaggcgccagcaacaagttgcttttgttttcatttgtcatttaaattttaaattaggcactccgaaaaagtgtggttgcgccgaacgccgtcgccctgttccgctcgtggactacctctgcaagcggttcaaatgcagtgcccatgagctgcttgtgcttttcaaaagcctagagaaacgccgggacattgtggagcatttgcgctccgtccaactgcgcactgcccacctgcgcccgtccgcgcgcaattttccagtgcgttgtaatgacctgtccatcctagacactcactccgccccagcttaccgaggctatcttggcataacggtatttttatttgctttatttgtctgtaccataaaattttcatggtccgcatgcactactacataaaacacggtatccgcttgcgccaccctaatttgccgtgtgtagttgaatttggaggcgtagatcacaaaacttttttccctcttgaaattttgtccattgttttgtagatgtattcaatttccaattgtactgttgtttttaaa

SEQ ID NO: 76484 - DNA, 1073 bp, Heterodera glycines
  Genomic contig location: Contig_ID=SeqID_1873; Location=354..1426; Strand=-
  SCN-specific regions: Sequence locations=1-742,775-840,862-1073
atggaattcaaccccggactgcgcctcattgccaaaacattggctaactccttgtggtaaatattttggggttataatttttaaaaaatgacacccacagggggaagctagcgcagcgcgtgggccagacggagattcgctacacacgaaccccggctgaattccacgcgcttctcgacgacccaacgctggacaagttggactttgtccacgtgtccgaacacatggaccgctgtgttgtgcggaagcgacccgagttcgccagagcgccaccgaccaactgccttccggtcgctgcgtttgtcacctcatacggccggcttcatctttacgactacatggagcaggtgtcggccatcgtcggtgcggagctgctctactgcggtatgtttatttgtcacgaattgttttttttttgtgaaaaaaagcaaatgtttaagacaccgactccatctactacgtcagcaagatgggtggtccgtgtgtagcagagggcgaggctctggggcagatgaagcgcgaacacaccgaccgacggatcgtcgagttcgttgcgggtggccccaagaactacggcatccgccacactgcgcgggacggcaccgacgagcgcgccaacctcaaaatccgcagcttccgcctgtcctatactgcgcagcagctgctcacctttgaggcaatgaagaacctgacgctggccacgtacaacattgacggaccaatgtgagttttgcaattaagcattaattttgtaaataaatttaaaaaaatttagcgatgatgccttggacaatgacgacctttacgtgtacgggggcggcgaacatcgtgccatccgcgtcaacttcccgcaaattgaccgcaatgtgtacgccgacctctacacgcaggaagcccacaaagactacaggcccttctacgccaaggggcgagttcggcctgggatgcagacgcgcccttttggctatgtggaggatgatggacagccgaacaaaggacaacggacgcatcgaagaaagagaaatttagtagagcaagatcccacacagcccggccactctgggtggttctga

SEQ ID NO: 76485 - DNA, 1922 bp, Heterodera glycines
  Genomic contig location: Contig_ID=SeqID_12774; Location=210..2131; Strand=-
  SCN-specific regions: Sequence locations=1-920,945-963,987-996,1046 -1046,1188-1188,1241-1242,1274-1922
aaaactttccttctcaacgcatcgtccatcaattcggaaatcccacaaagcaaattggccggctcagatttctctaaaaagtcctttttaaaatttgtttgttatattttgtggaagataaagaagtcggaattttgaccaaatgacctatattttacacaaaggtaccgatttgtttgggataaggcaacccaaggttttccattatcgccgcaaattcttcctccgattttgtaagacggggattgaatttcttttcttcccaaaccgatgaaaccattctgccggcataatctaaaaagatactttattcaacattaatttagtttaccatgcgccggatagataagataatcggggggaagagtgaaaatttgcgatttcacagatcggaaaagagtccgagcgtttcctgaaattatttgcacaaatatcaatgagcagattcacaaactcaacatgctgaaagtcagtccttccacagcctctgatcaaaagagcatcgccagtgaatgccatttggttggaatggcatacaaaagtaacacagcctaaaaacagggctattaattaataatgattacagttcggtttgtcctacaaattagaaaaatttaactcgccaaaaaaacaaatataacatatctagacaaacttgggacaaaacttcgaaatcagattgtttatcccattctttaaaaatctttgttaccatttgtgtgtccgggcgtttctctgacttccaattcgagtccatccccccaacgaattaaatcggagtgtttgacaagcaaatcagcccttccacccgcttttccagataaaatcgaaattgcttttggaaagtatttgttgcgcttgagttcgccagaacccgtcacatggtctgcatggatgtgtgtgttgaccacatatttaaggtcgagtcccaactcgtggactaactgaaaataattaagccataaaacagataaattttctaattaaaatacgtactgaggcatccctctcaaccgtttcgatcactggatcgatgaccagagcctgtctcgtctttgtgcatcccagcaaataggtgtaagtgaatgactttgcttcaaataactgaactgaacccattttggggcaaaacattcaccagaacatggaccaacttgccgaaacaacaacttcgacgccataagctttacaattactagattaataatggttaagaaagtatatatgatatgataaattcgggaattcataatcctatataataaagttgagtattgtttctgaaaattggaatgaaatggccaaaagtgccattttagcaccaaagaatgttgatgttagtaaaatgaataatagttttagaaatgttgcctggagaagaagttgtatatacgagtatagacttggctcaagatgagaatagacaaagagcagatgactatttggatgagtatttgaatgctttaaacccttcggggtttccacggcataaattgagacttaagaagaatgctattgttttgttaatgcggaatttgaatatcgaaatgggcctttgtaatggtgcgagaatgaacgttgagcaaatgcaaccgaatttgattgtgtgtaagattttgactggagacaaggcaggtcagactgtgtacattcctcggatcacgctttgttgttctgaagattacccttttgacctgcataggcaccaattcccgttggtgttagcttttgcaatgacaattaataaggcccaaggtcaaacccttgagcaagttggaattgatcttaggaaagatgtgtttagccatggacaattgtatgtggctctttcgagagcaagagcttggaataagttgagaattagattagatgatggcaatttagagagaaaggtgaagaatgttgtttacagagagctatta

SEQ ID NO: 76486 - DNA, 808 bp, Heterodera glycines
  Genomic contig location: Contig_ID=SeqID_12774; Location=1013..1820; Strand=+
  SCN-specific regions: Sequence locations=74-74,124-133,157-175,200-808
atgggttcagttcagttatttgaagcaaagtcattcacttacacctatttgctgggatgcacaaagacgagacaggctctggtcatcgatccagtgatcgaaacggttgagagggatgcctcagtacgtattttaattagaaaatttatctgttttatggcttaattattttcagttagtccacgagttgggactcgaccttaaatatgtggtcaacacacacatccatgcagaccatgtgacgggttctggcgaactcaagcgcaacaaatactttccaaaagcaatttcgattttatctggaaaagcgggtggaagggctgatttgcttgtcaaacactccgatttaattcgttggggggatggactcgaattggaagtcagagaaacgcccggacacacaaatggtaacaaagatttttaaagaatgggataaacaatctgatttcgaagttttgtcccaagtttgtctagatatgttatatttgtttttttggcgagttaaatttttctaatttgtaggacaaaccgaactgtaatcattattaattaatagccctgtttttaggctgtgttacttttgtatgccattccaaccaaatggcattcactggcgatgctcttttgatcagaggctgtggaaggactgactttcagcatgttgagtttgtgaatctgctcattgatatttgtgcaaataatttcaggaaacgctcggactcttttccgatctgtgaaatcgcaaattttcactcttccccccgattatcttatctatccggcgcatggtaaactaaattaatgttga

SEQ ID NO: 76487 - DNA, 968 bp, Heterodera glycines
  Genomic contig location: Contig_ID=SeqID_12775; Location=1077..2044; Strand=+
  SCN-specific regions: Sequence locations=1-247,269-728,750-968
atgcctatttccaattcactgcgcgaaggtttgtgagagatgcgagggacggagagcgtttcaagacggtttcattcgcctctggtggaccccgaccactgaaaaatattattagagcccgtaatagaaccggatcatgtcaggttttttaggactcctgatcccgacccggataattttgaaatttgacccagatcaaagattctttagaatttgagcaacaaaatgattggctggcgtacgattttttgaattcaattcaaacgccgaataaaaattgtcagaaggaggcaaaaagtgtctctttgagacgcctttacgaaatgtttccgaagctgtcgaagaaagtcatcggtcgagtggccaaagaaatggagtgagtgccgacaatttgggggatggagacgaaatgcgagtcatccaattgtgaattttagcttcgactttgaacagactgcgatttatctgcttgactatcctgatgatcatccgactgacccatcaaatactgcggtaaaaccctcggtgattgtgccttcgcttcgtccccgagtgatttcggcagaggaacagcagcggacgaaagggacgacgaacgtggggaacaacagcaggaccaatttgctaatggtgtgaccaaagaggggggggggggatttgtattgtgaaacctaacgaaatatattgaaattatatcatacgaaaaggttacagattttgggacaatgtttaacatgacaaaaaagttcacaaaatcagacttgttgcaaaactcatttctcaccaattttagcttccccccgaaagttgggacactgaggtccaagacgtggagaaggaattgcgtaatatggcggcggaacagaaacactgcagagagatgcggaccaaatacgtcggcttcaaaaactccaacattttcggcttttactccgcacgggtaacaaattgtaatttgtgtaaataca

SEQ ID NO: 76488 - DNA, 639 bp, Heterodera glycines
  Genomic contig location: Contig_ID=SeqID_12777; Location=2366..3004; Strand=+
  SCN-specific regions: Sequence locations=1-99,136-281,307-319,342 -351,404-639
atgcgtggaaaaagaaccagcaaaatgtatgactatttcttgtcattaccgtatgttttttttggcaatatttctggtcactaccgtatgttttttggcaataatttttaatttattaatttaatttaatattttcccctaaattttaggccatttctttggcattcatagcgcttgccgtaataattgctacagtaatactgtttacaatagaaacccgtaatttgaaattctgcaattaattattattaagtccatcaattaaagaattgtgccaaaagtttttatatattttttaaaaattttcgggaaaatttcgaaaataaattatacaatttttattaaccgccctaattattatatattttatatatatatattaataattaattaaagattattaggaataataattaccaaaatattataggtattcatgcttttgacttttattatttgtgggcttacagtttccccctaattatctcaatttggctttactcaattgtgtaccgggcgtacaaatttgttcaacaaaatgaggaacacaaaaacggtggacagtacggacagaatgtcaaacagtaccaacagaatgccaatgccaaagtgatttaatgattgaattttcaattttta

SEQ ID NO: 76489 - DNA, 323 bp, Heterodera glycines
  Genomic contig location: Contig_ID=SeqID_12778; Location=2185..2507; Strand=-
  SCN-specific regions: Sequence locations=1-323
atggccaagactttggaccaataccaaaaccttgaacgtgttccaatatcttctttggtctttaccgtgaattttttcgggtgccaaggccaagacaagataatggcattattgttggtcaaacaaagtgccgccttagattgccaatgtgctcggcttccccgcgctggccgcgccaatgtacaagaatcggaaaaccaacatgccggagggcgtccagcttatggccgcgccattcaacgaggcgcttctgatcgcggcggcccaggaattggaacgcacatttggcggatgggtgaagccgagcccggcgaacatcttca

SEQ ID NO: 76490 - DNA, 859 bp, Heterodera glycines
  Genomic contig location: Contig_ID=SeqID_12779; Location=266..1124; Strand=-
  SCN-specific regions: Sequence locations=1-502,524-534,563-608,665-859
atgtcacggttcctcgaactgttctatgccgacccgtggagcgaaggcattccggtgaaaaatgatgcatgggaggagagcatggcatttcaatgatgccgtgccagtgacgggtcgagagcattttggatttttgtcgagaattgacagcctcgagagtcgagaaattttcaagatggctgcgaattgattcgaaaacctgagaaatttcgcgacttgaaaccgatgaatttgttgtcattaacttggcaaaaatttctatgttttttttaaaattaacccgggactcaagaattctcggctcgggagttagttaatttaaaattttttgatgcattttttcttagcaattcaaaaattctcaggagaaatttaaggaggggggaatccgaagattttttttttttttgctctccgggccaaaaattttttctctagtgttattttttaaattttaagcgccagagaatgcaaaaaaacaaaaaaagccattttgtttgtgccaataaatgttaaattttttgcaattttgggttaaaattttaaaaaataagttaaaattgggtccggcgggggaaatttaatgaaatatgatacgaaaattgtgcaaaattttcaaaaaaataaaaataattttttaaattgtaaaatttcttaattttatctccagtcctacgaagagctgcgacagacttattatgacattcaagcgggtgtggccaatgccacccatctcggcctgcaaattgagctgctgaagcgatttgttgcgccgaaatcagaaaacgagcgggaatttgtgaggatttaaaaattaaaatgccatttatttaaacaacattttaaacattaaaataaa

SEQ ID NO: 76491 - DNA, 240 bp, Heterodera glycines
  Genomic contig location: Contig_ID=SeqID_12779; Location=926..1165; Strand=+
  SCN-specific regions: Sequence locations=1-240
gttttcgaatcaattcgcagccatcttgaaaatttctcgactctcgaggctgtcaattctcgacaaaaatccaaaatgctctcgacccgtcactggcacggcatcattgaaatgccatgctctcctcccatgcatcatttttcaccggaatgccttcgctccacgggtcggcatagaacagttcgaggaaccgtgacatcagtgggaactccactcgttggaccgtcacattgtgtttga

SEQ ID NO: 76492 - DNA, 749 bp, Heterodera glycines
  Genomic contig location: Contig_ID=SeqID_12780; Location=1547..2295; Strand=+
  SCN-specific regions: Sequence locations=1-9,31-749
  Gene Ontology: Mol. function=protein binding; Cellular component =nucleus; Biological process=regulation of mitosis
atggcaggtgaagaagaagaagaaacagtggtggaacatcctttgccgaaaggctgggagaaacgaatgagtcgttcatccggtaagccaaagtggcgtattaaaaaacaaaaacttaaaaatggtttgagttattgtgacatcgtatttttgacaggtcgtgagtattacttcaatgtgttcagtcaaaaaagtcaatgggaacgtccgacgcgtgacgccgaagacacggcaaaaaaacccgaaactgtccactgttaccatattttggtcaaacacgaaagatcaaggaacccaaagtcgtggagaagtgacaaagtcacacgaagcaaggaggacgcgaccaaaacactcgaatgtccgttcaaactttgggcaccccaagcggaaaattaccatttgtattggaaaattaaaggagctagcattttaaaaatgcacaagaatgcgaactccaacttaagacctcccctattccaaataaaacatgagttgtttatctttggtgttaagcttatcatgccgaattggttgcattggacgttggcgaacgcttttcccgattcaagaaaattgcgcgggaattcagcgattgctcttcggccaaacgcagcggcgatttgggcccattcggtaggaataaaatgcagaagccattcgaggaagcatcttttgcactgaatgtggggcaaatgtcggatattgtggacaccgattcgggccttcatttgatctatcgtttcgcttaa

SEQ ID NO: 76493 - DNA, 900 bp, Heterodera glycines
  Genomic contig location: Contig_ID=SeqID_12780; Location=64..963; Strand=-
  SCN-specific regions: Sequence locations=1-7,30-186,231-321,413 -596,636-680,702-900
gttgagcgggaccgggaccggggcgggaaatcccgggtttttcaggtcccggtcccgatcccggtttttggaaaaacagaaatcccggtcccggttttgccagtcccggtcccggcaggactaaataagcactggtaagaatgggggtctgggtgagaaaagagaagggaattggtgagggatcagaaatttttgataaaaataaattaaattatttattttcatttatagcaagtgtgcatatgtataagtggtcaagtggctaaacctttttactttcattatttgtctcttcggatcaattccctgatggaacagaacatttttttatattttctttaacattattttaattgaattaattaataaaaaatattttaatttaaaattattatttttttcatttttaatagcctaaaaagccataaattaaccaaatatttggtcattttttgacaaattctgttcacaaatctcgctcaaaatttcaaaattcttccgacggcgcctatcggcaccgccggatccagccccctcccactgttccaaaaaagttttttgaaaaaacattgccacaaaaacagcgatttaaaagcaaaaaatttaaaagattgtaaatttatttttaaaaaatacagaattttgggactcagaaaattccaagaacccccccccccctgaaaaaaatttttaaaaattttcctcgatcccccaaaacgtaaatacaaaattttattggtgcatttttgaatattggcaattttcgtaacgaagtgcacttaaattttcaatttttttcaaaaaaaaattttcacttgggaaaagtcccggttggtcccggtcccgggttttttcgctgtcccggtcccggtcgaaaaacttggtcccggtcccgacttt

SEQ ID NO: 76494 - DNA, 755 bp, Heterodera glycines
  Genomic contig location: Contig_ID=SeqID_12781; Location=1008..1762; Strand=-
  SCN-specific regions: Sequence locations=1-506,536-755
atgtcatctctttccgaggaggtcaagaaagttaagcaggccgctgtaagactcaatgtatttgtgttcagtagtcttcgtaattgtttaagaacattcctcctccggcagtttgtaacagatttgtcgaagggttttcaagcgtttatgtgtatgtgtgcagttaaattaatgcttttgagacactgaagttatttaggttcgaaactcgaccatcttcacatggcggtgcttttgcattccgttacgatgttgaaatggtgcagctcactagaaacaaaagtttgacttcgggcggtggcgacgatgggaaaaatggattgctccgcggcgtttgttttgaattgatcaagttcgtgcacgactcgacgcagggatttggacaagcggtaattccctctaaatcgcattcactatttacctttattttaggcacaatttgtttacgacaaccgtaaaatcttattcacgaacaagcgaatcgaacaatttgtttgctttttgtcttttaaaattatgtaattatataattttaggtattggaaattgacacggaaaaagtccaaggaatcgttcgcgatttcctgcgtgggtcttcggtcaaaattgagatcaaaccctgtcagactgataaacatgagctggatctcaacgacgtcttttcttccatctcgcgccgtcctgatgagcagtctgacagatctttgcgcactttccttgaaatgctgacttcccagccatttctcaatgcgtaa

SEQ ID NO: 76495 - DNA, 189 bp, Heterodera glycines
  Genomic contig location: Contig_ID=SeqID_12782; Location=1528..1716; Strand=+
  SCN-specific regions: Sequence locations=1-189
atgccaatgagttctccagcgtccactcgttcaggttgggcatccgaagcggcaattggagttcgtactgtgacagcagttggagcaggtcacgcttggacaattaattgggcaattaacaaattggcaatttttacggcactatcatttagtctgattgatcaaaaattaatcgtgaccggaaaatcg

SEQ ID NO: 76496 - DNA, 441 bp, Heterodera glycines
  Genomic contig location: Contig_ID=SeqID_12783; Location=70..510; Strand=+
  SCN-specific regions: Sequence locations=1-55,77-217,257-441
atgcgttcgccgcccgcggtcggtcgccccccgcggcaacgacccgacggatcagtgcctttgtccgccccgggggtcctttcgcattcgcttcgcctcccgtcgcatcattttgtccagttgtgccatcaatggctttgtccgtgtcgtcgtcctcctccatcgcgaaaggagtgaccacggcattttcatcgaaattttgcattcgaaggaaagcaaaaaaaaaaaaaaattttaaattaacaaataaatatttccagaaaatttcaaattgttacgaatttctcgagagagaatggctaatatttctgcaaaatgcaaatggtgccaaattgggagaagacggactgccaaatttattgaccgtttcctcacccgaatttgcccatcatttggcacttttattggaagtgccaaatttggaaatggaaatttaaaaaa

SEQ ID NO: 76497 - DNA, 1073 bp, Heterodera glycines
  Genomic contig location: Contig_ID=SeqID_12786; Location=951..2023; Strand=+
  SCN-specific regions: Sequence locations=1-186,208-224,254-433,457 -488,511-513,539-663,685-787,809-817,840-848,882-1073
atggaaaagcgcacatcacataatcacacaacagcagaagcattggcaagagctgtccaaatggagatggatttcatacaacgcattcttttgggcccacaacggggcaatttgacggcaattgaatatttgaaggcacaaaatttaggaaaaagtttatcctcaacaaagccaaatgacggcacggaatggaaaaatggggaaaaagtgccaaaatttaacatcgaaaagcatgcaaaaggaaatgatggagcagaaaaagccaaatcgacggaggataaaagcgaaacgaacggaaagcacaaaattgggatgggacgaatgaaaagggaagtgggcgaatgcaaagtgtgcgcgaggccgagcctttactgctattacggggtcaaatgttgcgaaagtgagtgccaacacaagcaatgtctattttggcattttaattgtttttggtttttaccttataaactagagactggaaattgcaaatttgtgggattttctgtgggatttgaattcaaaaatttaaaaaatgacttaaattataataaagaccaaaagctgttcaaataaacaattcgtcattgagttaaaaaaggttcaggtcatattaacgcaatttttggtggtgaaaaaacaatgaaattgaaccaaatggttaaaccgattaaaaaataattatattttcatattgttggataatttacaaattattcatataatcgactaattaaggctgcaagcaattctttcgtcgtattgtttccatgcgaactttgttcaactgttttgaaggaaaacattgccaaattggcgaaggtaaaaaatgtaaatttattaaacatttatgaatttaaatatggtttttgttcttttctcagatggcatccgatgccgcggctgtcgcctcgacaaatgccttttggccggcatggatccgacaatgatcaaagctaatgcgaaggacggagaagcgttggcccaatatttggccaggttggagctgcggaagagaaatgctttagcgaggaacaattgcgcggaacgaaacaattgaatttcgattgaattttgta

SEQ ID NO: 76498 - DNA, 1132 bp, Heterodera glycines
  Genomic contig location: Contig_ID=SeqID_12786; Location=2340..3471; Strand=-
  SCN-specific regions: Sequence locations=1-265,287-1132
atgcctgcgccgcatgacaaaacgaccctccgttcatttttgggagcgctcaattattacggacgttttgttaaaccaatgcgagaaattagggcgccattggaccaactcctccgaaaggatgaatcctggagttggggagatgaccaacagtccgcattcgagcaagctaaggcaattatggtttcagaacttctgctgacccactacgacctcacagttccgatcgtcgtagcggcagacgcgtcaaaagatggcatcggcgccacaatcagccacatttttccggacaaaaaggaaaaagtcatcgagcacgcctcaacagttctgaccaacgcgcagcagaactacagccaaattgagaaagaagctctggcgcttgtgttcgaagtccaaaaattccaccggatgcttttcggacggaaattcacactgctcacggaccacaagccattgctggccatcttcggctccaagaaaggcatccccatttatgccgccagccggctccaaagatgggccctaatcatggccaattacgattttgaaacggtacatcaacaccgcatcatttggccaggctgacgttctctcgcgcctcattgccaattatccccgaccagaggaggatattttgatcgccaacatctgcaccgaaaccgagtgctacatcagcaccattctgcaaaccaaaaccgaacaacttcccgtcactgcagacgaaatcgcagaggcgacaccgaaagatgagattttagcgaaaattttggcattcacccaatcgaattggccaaagaaatgcagcgacccggacatcgcaccgtattttccaaaaagggacattttggaaatcgagggctgtttgctctaccaaaatcgcgttgtcgtcccgcaatcgcttcgcaaccgaatgctgaagtccctgcacatggcacaccccggaattgtgcgcatgaaagcactcgcccgccaacacgtatgttggcccggcatggattcggaaattgaacggattgtccgtcagtgtgaagaatgccaaaaggcgcaaaaagcaccgatcaaggctcacggagtcaattcaagatcacgattcatggtcacgaaaaccgtgaatttcacaaattttagatag

SEQ ID NO: 76499 - DNA, 1258 bp, Heterodera glycines
  Genomic contig location: Contig_ID=SeqID_12787; Location=2269..3526; Strand=+
  SCN-specific regions: Sequence locations=1-81,103-550,575-623,645 -731,753-785,807-1032,1054-1258
atgaacttcgcaaggcggagcaaggccaggcttccgggaacgccatcgaaatactgttcgaacaagtgcatcggagtaatgttgagattgacaatgtacgaccacgaaaccagagaaaatactaaatttatttggctgcccatttaggtggacaatttgcggacgttgtgcaggggaggtgagacgttggatcagctcatccaactttcggtcactcaggtggaggggatgaaggatgagacggcgcactgtctcgaccctgggaagcttgttgcgcgattggtcaacatcatttctaccattccccatttaaaagcgttaattaacagaaatcttttgcaatttctcatcggaagacgggcgatagcgatcacttcgccaccattggaagacattttaattttttgttgcggaagacgcccaatttttattatttgttagcatttattacttaaagttgattggctgttcccatttctctttcaggcgtccttgctacgagttaaaatcggatggtccgtttctccgtgagaaaacgcagcgaaaacggaccaatcaaaaaatgaaggaagaagcgcaagtggtgaagggaaaaacggttggtttgcccgatataattttataatgtttccttaaattttgtccttggcctcgtaaccatgaggggaattcctcccctttcttttgattcatttctataattttgtttgctttgtcattttcccttgccatttttcctatttgtttttctgccccatttcagttgtctcaaatgagtgaggccacttctgccactgcttctgaggatggcactggtgctggttcgtctacagctgtcaataaagagttggacaatgttcgtcgtcatttgaaacgcgtctacaagcagaacggcacggactctgtggactattaccgcttcgtgctccaccctgacagtttcggagagaccgtggagaacatgtttttcgtctcttttctgatccgtgacggccaagtgcggctcagagtcgacccaaacagcggactcgcctcaattggttagcattgtaaaaaattagtagtaattgcccttaatgaagcataaaatactaagtctatcggtcttcattattccatttcagttaaactgagccgtgaagaacgggaggaacgctgctctgcccgagagcgtccaaagacacagacagtgccgagattggactacacaacatggcatcggatggtgcaagagttgaacatcactgtatactccaat

SEQ ID NO: 76500 - DNA, 1147 bp, Heterodera glycines
  Genomic contig location: Contig_ID=SeqID_12788; Location=1..1147; Strand=+
  SCN-specific regions: Sequence locations=1-341,437-504,526-1147
ttaattgcatgctcgttttgtttgttctgccagccccatccgatataccagctgatctcgcttttgtgcttctgcgcttgggtctctttgttgtcgccgctcccatttaccgtttgggttaagcattcaattttaaattaaatcctaaaaataatttattccaattagtattatgtgcttggcgatggccttcgtcaaatgaaccaatcggtggccatgtgccatttgtaccgcacctcaatggaagtgcttaattaaccttaattgatgttatgaaaaacacaccctgattgttcaggttatccctcatacaatggacactctcgtcacacttttctcggttttaatttattattttaattttaaaatatttatttagcaattcataattaatttatcgctacaaattaaaaataaaaatataatttttaaatttgaaaagtttatttcttaggttttgctcgctgttgcaaggttttccttaaattcaagaaaccaattttcactaaaaattctaagatttctcacgcaataccaccgaagcacattaaaacttcggacggtaacactctttcattttttcgttttcactttttttcaagattgagcgtttctcccgtgccattttgttcatcatcataattagcgttctcctcggcattttgcgcttctttgagcacgatgccgcactatacaggtgattttctttcaaaaataagcaagtataccaagtcaaatatgaattttcggattaattatcacctgactaattttgaaagggtttgtgatattttcatttttaactcaaaaatagtttttatttttgaaaaattaaagtttctgcatggacacggagccgggccctttctgggcccaacgctgtatgctaacggacgggtgggtgcgctgggtcagaaaatatgttaaaagcatcccctgctggcctcagcccactgatcagctttctccggctcggccgtcccttttggaaagtgttccttcccctggccgatctgttcgcgcagttccttttgcctggctcctgtctgatccttctccacatcggcttcaaccgagagcccgtgatcgaaatcggcaacgaaaatagtcacaaccgatttggacgatcattgcgtgaccaaacaaa

SEQ ID NO: 76501 - DNA, 1270 bp, Heterodera glycines
  Genomic contig location: Contig_ID=SeqID_12789; Location=747..2016; Strand=+
  SCN-specific regions: Sequence locations=1-90,114-329,371-1188,1210 -1270
atgagcaaaatcaaatgttacaagagaatggcatcagagaaaaatgaaaattatcagaatgctatatactcagaaacaaaagagtaccgggtaaattcagtgtttcaaaaacccacgcgcccatttaggaattatctgtcgacttctcggagcttcgacactgcttcgatgtccttttcccggcggggcagtgaatatccggagccgcttattcaccattgggtcactctttcgcctgtgccatcgccgatccgcggtgagccgtcatcttcctcataattgccattataaaacttcgctttttgtgtattttgttcgttaattgaacgtttaatatttatgtatattaattttaaataaacaaaataatcaaatgtttgtttttataagtaaatcctcacatggaaacaatggcacggaaaaaaggtgcaaaaataaacaagcaaatttaaataggtatttgtttttctcgtgcctttggggaataggcaattttcagtcattagcattaattaaacatcggatttttagtgatgaaagaggcggaaaatgagttttgtacaaggagggaaaggggagaatgataatggtggtcgggttttgcagatcaaacaatttcccgttgtgctgataaactttttcctagtcagaggatgaacagaataaggacattaacaaaagtcatttgcagggaaagaaccgacaaacgagcattaattatcaattgttaattggagatttaccaaattaaagggcagaaaaacaggggacctaatttgtaagtacaatgttgtctcagttgcgttcattttcggaggacaacttttgtgtatattaatcccacccaattaatgattcgccattatattttcatttgttaggaaaaaatgttaaattttacaatatatatatatagtcctattatggaatttaattcaattttcttcggtccaccagccgagcaccgcctgcacattggccatattttgagtccgcagccgatttggtgcggacaatgaaacggacaacggacctttaaatgggaggacaacagtttagggaatgattcgaatttttcagaacctttcgcgaaaaagccaggaaaagtgtggtcaaactgcggcgttctcctcatcagttcgtcttcgtcgttgcgctgctgttggaccacgaaaacggaggtgggcgacaggcgctgctgctgctggacgctgagcggactcgtcggagacaattcgaactttggggaattagcaaaagatgaggaaca

SEQ ID NO: 76502 - DNA, 2336 bp, Heterodera glycines
  Genomic contig location: Contig_ID=SeqID_12789; Location=1020..3355; Strand=-
  SCN-specific regions: Sequence locations=1-411,433-434,457-509,536 -690,768-1212,1234-1400,1422-2239,2281-2336
  Gene Ontology: Biological process=adult locomotory behavior
gtgagtgggcgggacttcaaatttaattcatttcgccttttagtgccatgaaatggaacggataaacaatggtgaagatgtgtcgttccacgacattctcaggtcaatttgcttagattatcgcttcaaaaaatgctccagcttaaaatctaaatatttcggaattgttaattaattgtttaatatttattggtgcatttaaactcggaatagataattaattgtgcttttacagtatgctttcctaccgtagtgtctacattcgcaagtcgcttcaacttgaagaattggtgcagcgtgaggaattggagtatttaattgaggaggaagtagccaaacatgtaatcaattttggttattaaccaattgaaagggctgattaattcgataattgccagacaattcgctcttggctggagagttgcttgaggcgcataaaacaacaacaaaacactgcccatgacaatgaaatgccccatattgccgatttgttctcccaaattcgcgcgaccaacgccgccgccaccgccgtggcatcgtctgccgtgtgcactccgattaagctgggggccgtgccgaaaagacggaaagaccgaagcggaagctaagcggcggagggaatggcaaacaatgcgaagcaacagacgaagaagcagcacatgccaatgccacaagtgaagagcaaaacggaaaaacagaaacaaaattaaaagcaaaatggaaaatgatatcataaaagtggaaaaatcggggaaatgaaaataaaacacaaagtcctaatggaattatttgctaacagctttcacttgcggaagtgacgagaaaagcaaacaaacgacgacggagcagcagcatcccggagcttgtcgaggtgaaaagcacttgcaaaataaccaattaataacagaggaagtgcctaattgctttataaatgatttgaaaaaaggaggcaaaacgttttgtatggggctctcgtctaaaatcgcttccacgcggttcccgcacgcgtaatggaggcggcggaagcgcaataatcaacgaggagaacggcgacaaggaaaaggtgagcagcgacggtgccgcgggcggatggacggcggagggccaaaaaacgcaacagaagccgaagcagcaaagcacaacggacagaccgaccattgccattgtgtcggaactgtcgggcacaatgctggccttggccaagcacgcgtcggtggaaaagtgccaaagtgtgaccatacggaaccatcccggcattgaggagaaggtaatgccaaggtgaccaacccatggcaaagcggggatatggggacaatctttctcggcttagtttctttattgttcctcatcttttgctaattccccaaagttcgaattgtctccgacgagtccgctcagcgtccagcagcagcagcgcctgtcgcccacctccgttttcgtggtccaacagcagcgcaacgacgaagacgaactgatgaggagaacgccgcagtttgaccacacttttcctggctttttcgcgaaaggttctgaaaaattcgaatcattccctaaactgttgtcctcccatttaaaggtccgttgtccgtttcattgtccgcaccaaatcggctgcggactcaaaatatggccaatgtgcaggcggtgctcggctggtggaccgaagaaaattgaattaaattccataataggactatatatatatattgtaaaatttaacattttttcctaacaaatgaaaatataatggcgaatcattaattgggtgggattaatatacacaaaagttgtcctccgaaaatgaacgcaactgagacaacattgtacttacaaattaggtcccctgtttttctgccctttaatttggtaaatctccaattaacaattgataattaatgctcgtttgtcggttctttccctgcaaatgacttttgttaatgtccttattctgttcatcctctgactaggaaaaagtttatcagcacaacgggaaattgtttgatctgcaaaacccgaccaccattatcattctcccctttccctccttgtacaaaactcattttccgcctctttcatcactaaaaatccgatgtttaattaatgctaatgactgaaaattgcctattccccaaaggcacgagaaaaacaaatacctatttaaatttgcttgtttatttttgcaccttttttccgtgccattgtttccatgtgaggatttacttataaaaacaaacatttgattattttgtttatttaaaattaatatacataaatattaaacgttcaattaacgaacaaaatacacaaaaagcgaagttttataatggcaattatga

SEQ ID NO: 76503 - DNA, 810 bp, Heterodera glycines
  Genomic contig location: Contig_ID=SeqID_12790; Location=154..963; Strand=-
  SCN-specific regions: Sequence locations=1-810
atggattcattccggccgttaaaatctccagaaaaattgtcatcctttgtcaatcgccaattcttttggtggtttaactccgtttgtgcattgggaagtcggaaacctttagaattgtccgacctttatgcactaaatccaaatgacacttgcaatgaactcgttcctcagtgggaaagactatggaaacgcgctattactggtccgaattatttaaaattaagattaatttgttttttcaaaaaatggtgtttactagagctaggcgggacctgggaatcgctgggattttgccatgactccaagcccaatttttttttggacaaaagcaccgggcgtttaggtctcgggatcccgccccggcccctgcccatttcaaaattgctggacctagtgcttacgtttcctttagactataactcgaagaactcactgcaatctcctgatgaactgtgccaaccaccaaaagaatccgtcataaatgtaacggacggggatgtgaatgtgcagcatcaacaggagcccgagtcggatttagcacctctgattcgtcatggcgatgatttaaccacccatgatgtctgaatttggataaaaagattcttaattgaatgcagtttaatttcagcaggtgatggccaattacgggtccactcaatccgaccactcgtcgtcctcctcaaaacgaaagacgtcgcctccctcactgatctggcgtctggtcctgctattccgttggaacatcatcaccgccatgatcatgaaatgcttctccgatttgctaacatttgcgaaccccgtcttactcaa

SEQ ID NO: 76504 - DNA, 246 bp, Heterodera glycines
  Genomic contig location: Contig_ID=SeqID_12790; Location=1512..1757; Strand=+
  SCN-specific regions: Sequence locations=1-91,114-246
cgctgacccacaaaatgtccaggccacgaaatgtccaagtctcgaaattgagttttttattattcggatgggcctaaggttaggcaaggggtaatataaaggctatattcgtattcagcgaccccgaaacccctaaaaaccccaaattagactcattttgtttttataaattttgaaaattttggacatttcgtgggtttttactcttttggacatttcgtggcttggacattttgtgggggcgcc

SEQ ID NO: 76505 - DNA, 1271 bp, Heterodera glycines
  Genomic contig location: Contig_ID=SeqID_12790; Location=4367..5637; Strand=+
  SCN-specific regions: Sequence locations=1-45,94-204,226-1085,1110 -1271
atggccccactttttcgcctcctcttcgtccgattctccgctcgactcctcctcttcctcctccttttcctcctcttccccttcttcctcttcatcgtcaagcttcgaccaattagggcagaacgacttggacttaatcaagcagaaaaggcacatcggagacattcagcaattgtgggatgaggacgaaatgaacgggtgggggaggagaaagccgaacccaaaaaggaaaagcatttagtaaaatgcgaaatgccctcaagccgacctcatccaatcggtggacccaaattcgaagccatgatggcaaatttgtgatccctttcataatcagcggacagttcagtcagtttcacagtttcataacgtttttgctattgtgttcctcgaatttagcgatggaagaacgacagaaaatccaaaaagcaatggctgcgattgccaacaattcatgcgttgaatttcggccaaggaaattcaacgagttcgattatgtggacattcaaaaccgaaaagacgaggggtacctttaaagataaaatcgaattcgagatccaatttctggattgggctgtctgattttaaatgcagttgctacacgcaagttggccgagtgcggggccgccaagtgctaatgttggagtcggggtggagcaagccgtgcgggtccggctgcattcagagtgagttcatctcacatttgcgaggctccttccgatcggtccgtttcgttcagcgttccccggctgtgtcaaacacgcgacaattgtccacgaattgctgcacaaagtcggcctttggcatgagcacatgcgcttcgaccgcgacgatcacatcaaagtgcattttgagaacattccgccaggtcaaagcggcaaaaataaataaaaaccagcacattttctttcagatttccacgctcagtttcgcaaaattggccaatatgagagtacaacatacaacgtaccgtacgactacctcagcgtaatgcattacggtaaggagtccggtgcgcggaggaacggtttgacaacaatggagactatggacaaaagataccaggcaactgtttactcatgaatgcctgataactattttcaaaattgaaacccacagaatttgattggcactgtcaaagacgcttctccaagtgattaccgtaagatctgcgcaatttataagtgcacaaaatgcatggggagagaatttaagtacggcaatgcataaatcaaatactactttttcttagacttgaaaattacttttcaata

SEQ ID NO: 76506 - DNA, 916 bp, Heterodera glycines
  Genomic contig location: Contig_ID=SeqID_12790; Location=2004..2919; Strand=-
  SCN-specific regions: Sequence locations=1-710,887-916
  Gene Ontology: Mol. function=protein binding; Cellular component =axoneme; Biological process=eye photoreceptor cell development
atgtccttggttgtggtcaagataaatgatcagccttgtcgagcggtgattgccacaaatttcactcattcattttgcgggtcgggcatcgtcaattcgctgaaactaaacgtcagtttttgccaatctttgcatattttgaccaaaacgactacagcaaattttgcttccctttctttacaattcgatcaaaccgcaggtgattgacttaaacgacgcaccaacggtcacaacgagtgaagggacaccgattgaattccttggccaggctctcgtccaattggagttcggcccgtggcacagcgatggctttacaccgcttttaatcgcttacgattgtcctgccgatatgctaattggtcaggatctgatcaacgtaagacgaaaggatgagcaaagattcacatgcacttattcaaggaaatcagtgcgacattgccaataaaattcgaataccacaaaaactcggtgaatgttgggggtacccgagtttcaatgcttgatccgatggccgccgaagagaaattcttttccgtgcgcgtggttgatccgcgaaataacgaggcaagtgatcaaaacaagaaaaaaaccaaactgacaaatgcaggaaattggactggagacatggaagaagggggcgagagagagcatcgaaatgggaggaatggtgaagagacgagtggaagtgacaagggaaccaaacgccgaaaaggaggagggcgaggaagagaaagaaaagggaggcatagaggaagagcaaaaggaagaggaagaaaagaaaggcatgcaggaagagcaaaaggaagaggaagaaagggaggaaaaggagaaaggctattatgagcaaaaggagggagaggatgagagaaaggaagaggaagatgagagaaaggaagatgatgagaggaagggatga

SEQ ID NO: 76507 - DNA, 852 bp, Heterodera glycines
  misc_feature (840)..(840): n is a, c, g, or t
  Genomic contig location: Contig_ID=SeqID_19; Location=38..889; Strand=-
  SCN-specific regions: Sequence locations=1-38,252-258,280-378,831-852
  Gene Ontology: Biological process=N-linked glycosylation
atgggttagagtcccatttcttctgattattttaaagcaaatattatattgaaattattctaatttttgttttttttaatttattttttttattaattaactttatggtattttaaattaatgataatgattttttgaattaataaaataataaatatttttaattaatagaataataaagtctaaattaaatattaaaattaatcgaataaaaattaaaaataaacaaatattaataaaaatttaaataatttataaatctcaaaatgagttaattttaggattagacgaatccgggtatttgggcaaaactgggtccggatatttccgggtccagcaaagccgggtccgggtccaagtttttaaaccgggtacgggaggaacagaaagtggaagaggaacagaaagtggaaaggaacagaaagtggaagagaaagtggaagaggaacaaaagtggaagaggaaaagaaagtggaagaggaacagaacgtggaagagaaacagaacgtggaagagaaagtgtaagaggaacagaaagtgtaagaggaacagaaagtggaagagaaagtggaagaggaacagaaagcggaagagaagaagaggaacagaaagtggaagaggaacagaaagtggaagagaaagtggaagaggaacagaaagcggaagagaagaagaggaacagaaagtggaagagaaacagaaagtggaagagaaacagaaagtggaagaggaacagaaagcggaagagaaagtggaagaggaacagaaagtggaagagaaagtggaagaggaacagaacgtggaagagaaagagaacgtggaagagaaagtgtaagaggncagaccattaaa

SEQ ID NO: 76508 - DNA, 1558 bp, Heterodera glycines
  Genomic contig location: Contig_ID=SeqID_19; Location=2980..4537; Strand=-
  SCN-specific regions: Sequence locations=1-157,180-914,939-1231,1253 -1283,1305-1558
atggatcaacgcccaactcaaactgatcaattaaatccaggaacagaagcatcaagtgggtacgagaagccagaagaacaaaaaaatggttagtatttggtgtttggtttttaggcttttatagttaacgcaatctttttagtccaattgattttcgaagaagcaaaggcttcttttttgactgcaaaatccaaaatcaaggatgaaattgcaaataaagaaagtgaagtgtcaaaacgtatttacggattggtttctgaagcgggtgcggctctacgtgatgagcaatttgcacatgagtcgtttgtgcaacagatcaatctaaaactccaaccggaaaaattgcgcttgatccaacttaaaaacaatcttagcactctgaaacatgcttacaccacgaaaggttggtatttttttcattttttaatatgaatttttcgtaggaaatatatctgcgggtgcgctggatgaggttgctgatcttggccaagcaatacagaagcaaattgactgtcttacgaaagtggaggtttcgtgcgataagcagatcaaggcagagaacgctcgctaccaccagaaacgcactgaactttggatggccattctccctgatattgagcaattagagggttcgaaaaaagaatttttcaattcacgtttctgtgaattacaaaatttggcccaaacaatgaataaagcccgaaaatctttgcaggtggtttaactcgtaaattgtacaatcttttttattttttttttaggtgggtacgattcgagaaaaagccgaccaatgcgacgttcatatgcttgaagaagacaaagaaaacaacgatgtccatttggtgggtacggaacaaaaggaaaccgatgatgatattattgaatttgatgaacactgattggttaattgttacaaatttaatttattttattttaaacgctgttatttcgaaaaatcataaatactttcaaaagcatcgtggaacttcttaactactgcttatggaatttgttgatactccatataatacgacctcaaatttacacagctgttccaaagttgactgaaatttaactaacatagaataacttggtcagacttaaagatatatcaaaaatttaagcttaaacttatgttttgctttcttttaataacttatatcatttcaatttaatttaacataattattagtgtactgcatacattacgttggtcagaaattgacattatatgcccaaataactttttaataacaaatatggtttgttaagactttctatcaagtcaattttattctaaatgtacaagaaaaattaagcggcgggttcgaatatgacccaaattttttgcttttgcctgtttaacatctaacaatccgtttcttactcgcccatttatctaatgtgataacaaattgccaagtaattagctgatcgttatttatcaaaaactttaaacttgactgcaacattttagcatgattccaccaaagtacaccttgcccatgttgggcatcatgctttttttcgggttatgctttggtggaaatgcaataaa

SEQ ID NO: 76509 - DNA, 2373 bp, Heterodera glycines
  Genomic contig location: Contig_ID=SeqID_19; Location=5209..7581; Strand=-
  SCN-specific regions: Sequence locations=1-334,357-1430,1453 -1642,1664-2373
atgcaagaagcctgtgccgaaatgaccaacctcaagcggctacagcactactttgcaatgctgcttgcgcacgcccatccgtccaaccctcaggcgctgttcgacgagttcctcgacgagatgaacccacctgttgccgccaaccacccaggagctgtgccgaagtcagctgaagtccgcgcggctgaggtgatgctcaaccttgagtattacctcaactgcatggggacgaacaccaagtgagtaaagctggcataatattgtccatataatcattatttttaagagatgttgggctgcaaggactgccagtgggctacgactttcaacatcaggcgcagctcctggaggaggacaacatcttggacagcttctatggggaggatgctcggcaacgctgcaaaccaccgcagcaagttgccatcgagcagattggacgcctcaacccagatcaacgggccgcctttgatgagatatcaacatcaattcttggcgggtgcaaccagaagctgttcttcctcgaaggcgcgggcggatgcggtaataacggcttacttatttttctaaaagtataattaattgctaaagttaatttaggcaagacgtacttttacaacacgctgataaagtggtgcatcgcaggcaagccctccttggatggaaacgccaacgcacagtgggtacgcaaccaagaactgaagcggaactcagctgttgccgccgccagcaccggcatcgccgctctgttgctgataggcggtggaactgcacacaggcacttctacgtgccaaacgacgtgtcgcaggagacgccgccgatgctgaacttcgagtcggcaaaagcggagcaactgcgccacgcacaactgatcatcattgatgtaaacaaaaacataagtttgcttttcgttcatgataacatttttaggagattagtatgttgtccaacaccgtgctcgactacattgaccggctgttgcgagacgtttgtgcaaatgtcacaccgtttggcaacaaagtggtggtgttgagtggcgactggcggcaactgactcccgtagtcgagcatggaactcgtgaggaccaagtgggtacgtcgatcaagatgggagcgctctttcgtctgttcaaaaaaatcaggtttttttgtctactttgttttttacaaacatatttatgttattagcctaacgatcaacatgcggaccgcaccaggagaacaatcgttgcgcgattggctgcaggaaatcggcaatggaatgcaccgcgtgggtacggacagccaaggcttcaccaaccaactgcgcattccgcccgaacttctcgtggacgacctcgaccacaccattcacttctgcttcccagaagcactgtttgacgacccgctggccaacgcggacgcaattgcccacaatgccatcctctgtccgaccaacaacgacgtgcagcacatcaatgaggtggcgcttggcagaatgagcgggtgcggaagggaattcctgtccatcgacgaacctctggagcctaacgaagagatgaacaatttccgcaccgacttcaacatggaggcggtgcacaatgaaatgccgtccggaatgccgccgcacaaactgaccatcaaagtgaactcttttttgttttgataattttttaataaataaatccaggtgggtacgcctgtgatgctgatccgcaatttggacgtcacccagggactgtgcaacggaacccgacttcaagtgatgcgcacttcggagaacaacctgttctgccggatcctcaccggaccacgagcgggtgcgcagaacatcatcgccattccccaaattcaattcgaatacggccgcgcacggcaccaccgtgggctacgattccgccgtctgcagttcccggtccgcctttgctttgccatgaccatcaacaaggtgaaagagaataaaattcatacaattatctaaagaaatacgtgtacaatttgttaaggcgcaagggcagacactgcagcggatggcactcgtgctcaacgggcgccagtgcttttcgcatggccaggtgtacgtcgccatgtccagagtcacgcagatggatggcatcagggtgtacgcgccgttcagccaaagtgggtacgggacgcacatcgagaacgtcgtttaccacgagctgttggacttggagacgcagcagccgaggacaccgaatcgtggactgatggacgtggacaatgacccggacgcagcaataccggacgtgggcccaagagtaccggacgtggacaatgacccggacgtggaacgagataatggaaacgcagcgggtgcgaacgatcaagaaccaaatgatcttgatagttcttttgatgatttttttgattga

SEQ ID NO: 76510 - DNA, 2149 bp, Heterodera glycines
  Genomic contig location: Contig_ID=SeqID_20; Location=1058..3206; Strand=-
  SCN-specific regions: Sequence locations=1-629,652-1675,1697 -1779,1813-1892,1914-2149
atgccttcaaaagaacagagacgaaaggaagctgatcgcttgcgacgccgtgctatacgaaacactccagacgtggctaatgttttggtgggtccgagcacaagcgaccaacaatcttttcaactaaatcagggttttggttctattagaaacgaaattttaataaatagatatagaaccatctacctcaaccaatgtccaagcacaaacacaaccacgaagtgctgttgaacctgctgtgggtacgtccccaatggatctggacaccagtgttgtttcgactccgaccaccaccggattacgggctttatctattattggaggtctttctttaagctaaatttcaactaaagcaatatatataaaacaattgacaggctctacaaataaaagaacccgtcacagttcaaacgtgggtacgtcaaacaatgcaactgaacacacggtacagcaacgagaggatataagtcacgctgaaagcgttgcaggttttttgagtttattttcccataattttctacaaatagttacagataatcgacgtcgcaaatcagcaccaacgcttcttgctgcgggtgcgaacacaccacgttacacaagcgctaggcgtgcaaaggttttggattcattgtttttgtgttatttctttttcagttaaatagtaattttaacggttttagctggccgaacttaatgtgacgttgctcgaagaacgcatgcaaaaggtggtccgagattatttgtcaagggagtggccaaagcagcctgtgatagcgcaaaaacgtcgccgctcaacgggttaaactgtttaaattataatatacgaaacacataatttacagatgcacgatgcactcgctgtgggtccggctgcaattgtttgtcgtattcacaatgcctaaaaaatgccactgccttcattgctgcttgggtgtatctgaaggagttcacgcatggcgtttttcctgcaccaatcttttttaccgcaacacgtaacataaagggggtccgtccgactgaacgatgtcaccggaacaccttcttgaagtgtgccgcacgttcttccgggcaccgagttgataatcagttttatattgtttaaaaatagaattatagattgactactatgacagtggtcagttcggtgacgcgttttgtggacattgctgtgcacgtcttcttcgtggcgaaaacgaaatcattaagcgggggcggcaaacaccttgctgtgccaatggcgcagtgcacactggacaaatggtggccgaatttcacgaactccaacagccgcctcctgcctatttacatggattggtggatgttgacgacgagagggttcgagatgcttttctgaacaacaacatggcgttcaacaacctgttcgcctttgcctccacacatggcgaaaaagcaccaccggaccaaatgggtggtcggttggatacatgcaaatataacggttaattagtcgtttagtaatcaatttaattatacttttacagggcagttttcattcctgttcagcgaccttattgctccgggagtccgtcgcccgtcatttgctcaagtttacacattgtcacccgaagacgctttggctgtccgcgaagaggcttttgaaaccgctgtttcaccacatgtcaggcgcacaatcatggagagactggaggcgctgatgcgggaaaacccatttggacagacctttcaaacagtgggtacgaaggtacaagcgactcgtgctgcaactggagaagtcccacacttcagagtaataagaggatatatatatgaaaataattttttaataataaagattgcactgctcacggatcgagacttgaaagggggtccgcttcagggacgcaatgatatcacagtgattgaacgggtggatgctcccactgcaaagcaggtcgctgtgatttgggttcaagaggatggtcttcctccccaaattagcggtaataaaaaacattacaatgaactctaatttaaaatattagcattctgggtgtccgacaaggccgggaagatgcgcgagctgaagagtggcatgccgcaaatcgacccgtgctgcttcccactgctccatccactcggcacccttggatggaggtggtacatgaagaaacgtgggtccgaggtataa

SEQ ID NO: 76511 - DNA, 3094 bp, Heterodera glycines
  Genomic contig location: Contig_ID=SeqID_20; Location=4856..7949; Strand=-
  SCN-specific regions: Sequence locations=1-714,737-993,1016-1056,1079- 1278,1303-1645,1667-2151,2174-3094
ggtttgaaaaggcctatgtccgtgttgcacagccaagaagatcggcgcaacagtgtagaaacgatggtactgcgggtgcggacgaagtgtacgactacgacgagattgcagccaccttcaaagtgcgctacatgacggccatggaagcataccttcgcctgaattcgtacaaaatcgtgggtacgtcacaccagatctacactctgagcgtccacgacgagctcggccaaacaattgtcgtcgaagaagggcatgaagaagaaggacggtggagggttcgagaaaacacacggcttacggccttctttgcactttgtgcaagagatccgcatgccgctcagttgacgtacgaccgagtgccatatcgctacacgtgagttaaattagaacctattaaatttaatgtttttggtgtttagttgggacttcaagtcgcgagcatggaggaagcgggtgcgtcaactggaagaagacccgcacaaggcgaaaatgttcgtgcgtgtgtataccgtgtcaccgcgcaagcatgagctatttgccttgaggtaataaattaaaatgaaaagttaataaagctgtaaaatagaacattgctcctccaccgtccgggacccaagagctttgccgaccttcgcaccattgatggcatccaatttgacactttcgtgggtacgtgccaacatttgggtcttcaagtgagcgacgaagtcttccgccgagccatgcaagaagcctgtgccgaaatgaccaacctcaagcggctacagcactactttgccatgctgcttgcgcacgcccatccgtccaaccctcaggcgctgttcgacgagttcctcgacgagatgaacccgcctgttgccgccaaccacccaggagctgtgccgaagccagctgaagtccgcgcggctgaggtgatgctcaaccttgagtattacctcaactgcatggggacgaacaccaagtgagtaaagctggcataatattgtccatataataattatttttaagagatgttgggctgcaaggactgccagtgggctacgactttcaacatcaggcgcagctcctggaggaggacaacatcttggacagcttctatggggaggatgctcggcaacgctgcaaaccaccgcagcaagttgccgtcgagcagattggacgcctcaacccagaccaacgggctgcctttgacgcaatctccacatcaattcatggcgggtgcgaccagaagctcttcttcctcgaaggcgcgggcggatgcggtaataacggcttacttattttaataaaagtataattaattgctaaagttaatttaggcaagacgtacttttacaacacgctgatcaaatggtgcatcgcaggcaagccctccttggatggaaacgccaacgcacagtgggtacgcaaccaagaactgcagcggaactcagttgttgccgccgccagcaccggcatcgccgctctgttgctgataggcggtggaactgcacacaggcacttctacgtgccaaacgacgtgtcgcaggagacgccgccgatgctgaacttcgagtcggcaaaagcggagcaactgcgccacgcacaactgatcattattgatgtaaacaaaaacataagtttgcttttcgttcatgataacaattttaggagatcagtatgttgtccaacaccgtgctcgactacatcgaccggctgttgcgagacgtttgtgcaaatgccacaccgttcggtaacaaagtggtggtgttgagcggcgactggcggcaactgactcccgtagttgagcatggaactcgtgaggaccaagtgggtacgtcgatcaagatgggagcgctctttcgtctgttcaaaaaaatcaggttatttgtcaactttgttttttacaaacatatttatgttattagcctaacgatcaacatgcggaccgcaccaggagaacaatcgttgcgcgattggctgcaggaaatcggcaatggaatgcaccgcgtgggtacggacagccaaggcttcaccaaccaactgcgcattccgcccgaacttctcgtggacgacctcgaccacaccattcacttctgcttcccagaagcactgtttgacgacccgctggccaacgcggacgcaattgcccacaatgccatcctctgtccgaccaacaacgacgtgcagcacatcaatgaggtggcacttggcagaatgagcgggtgcggaagggaattcctgtccatcgacgaacctctggagcctaacgaagagatgcacaatttccgcaccgacttcaacatggaggcggtgcacaatgaaatgccatccggaatgccgccgcacaaactgaccatcaaagtgaactattttttgttttgatcattttttaataaataaatccaggtgggtacgcctgtgatgctgatccgcaatttggacgtcacccagggactgtgcaatggaacacgacttcaagtgatgcgcacttcggagaacaacctgttctgccggatcctcaccggaccacgagcgggtgcgcagaacatcatcgccattccccaaattcaattcgaatacggccgcgcacggcaccaccgtgggctacgattccgccgtctgcagttcccggtccgcctttgctttgccatgaccatcaacaaggtgaaagagaataaaattcatacaattatctaaataaatacgtgtacaatttgttaaggcgcaagggcagacactgcagaggatggcactcgtgctcaacggccgccagtgcttttcgcatggccaggtgtacgtcgccatgtccagagtcacgcagatggatggcatcagggtgtacgcgccgttcagccaaagtgggtacgggacgcacatcgagaacgtcgtttaccacgagctgttggacttggagacgcagcagccgaggacaccgaatcgtggactgatggacgtggacaatgacccggacgcagcaataccggacgtgggcccaagagtaccggacgtggacaatgacccggacgtggaacgagataatggaaacgcagcgggtgcaaacgatcaagaaccaaatgattttgatagttcttttgatgatttttttgattga

SEQ ID NO: 76512 - DNA, 669 bp, Heterodera glycines
  Genomic contig location: Contig_ID=SeqID_176; Location=386..1054; Strand=+
  SCN-specific regions: Sequence locations=1-669
atgattttggaccggctcccggatattaggggaaatgaaggcggtgattcaatctgcaatttcttcaagaagtactcacagtacacagccgattggtcaaacaaaaaacgaatcgaatcgttagaggcaaaactaagcggtcgtgccgaaagagcttataatgccgctttggccaatgaaccatttgtctatgaaaatgttaagagaaacattttgcaacaattagaggacaatgattgcagagaaatgagcgcatttaatgacttaatgaatggggtcacacgaaagcatggcgaaaacttagacgatttggccgacagaatttcgagcctagtgcgtcgtgcttatccagggctaacaagaaacctggccgatgagtattccataaaacaccttatccgaagtttgaacaatccagatctagcattgaatttggagctccatcgccgtaacggaatgtcttttgatgaattcgttgccttggcttctcgtgcagaagcaacccaaagggctacaaaaaggcaaagtgcggaacaccgaccaaaccaggaacgaaaatatatgcacccaagcgaccgcgaagttgaaacaaatttcaaaaatcagttaagacccaatccagttgtttgttacaattgtaacgaacctggtcatatttcacggaattga

SEQ ID NO: 76513 - DNA, 612 bp, Heterodera glycines
  Genomic contig location: Contig_ID=SeqID_177; Location=1115..1726; Strand=-
  SCN-specific regions: Sequence locations=1-280,302-362,385-565,588-612
atgccttcagaatcagataaaagaattgcgcatgaaatgagcatgcccacctctgattttttgcctaaatccaacaaaacattaatggacgacatcgaacaaaaggcacacaaattgtcagatcgcgtcaaacgcgaactactaacactcttcgatgaaaagcaaaaccacgataaaattgagcgagtaagttttaataattgtctaggccataattttggttttttacaaaaaatttagtgttcaaaaaggctactcagaaaaaaagaacaagttattcttacaagaaatgaacttattgcgtgagttttttttgctttcctaccaaatccaacattgttggttatcattaggaaaaaaagctgttttagactgtttggccgtcctgtttcgtccagcaaacgttgggacattccacctgaaacaacggcagaaccaaatttcggacatttttcaatgctagaaaagcactggtacgacgagaagctaaataggcggacatatatttccaacatcacacgacgagtgagcagagggatatagccccccccccccgaacctataaatgaaaatagaaaattttcaaaaaacagtagtttagtgcctaataaa

SEQ ID NO: 76514 - DNA, 2191 bp, Heterodera glycines
  misc_feature (2188)..(2188): n is a, c, g, or t
  Genomic contig location: Contig_ID=SeqID_178; Location=79..2269; Strand=-
  SCN-specific regions: Sequence locations=1-196,218-278,301-895,917 -977,1000-1520,1547-1593,1615-2191
atggacgacatcgaacaaaaggcacacaaattgtcagatcgcgtcaaacgcgaactactaacactcttcgatgaaaagcaaaaccacgataaaattgagcgagtaagttttaataattgtctaggccataattttggttttttacaaaaaatttagtgttcaaaaaggctactcagaaaaaaagaacaagttgttcttacaagaaatgaacttattgcgtgagttttttttgctttcctaccaaatccaacattgttggttatcattaggaaaaaaagctgttttagactgtttggccgtcctgtttcgtccagcaaacgttgggacattccacctgaaacaacggcagaaccaaatttcggacatttttcaatgctagaaaagcactggtacgacgagaagctaaataggcggacatatatttccaacatcacacgacgattgagcagagggatatagcccccccccccccgaacatgtcgcggattattcgatttttaagacccgaatgccttcagaatcagataaaagaattgcgcatgaaatgagcatgattttggtaaaaaggtcaacacctaatgcaatgattagaaattttaaatttagatttatgtgttcgatgtattaaaaaagcaaaaatgggcatatgacgcaaatcagcccacctctgattttttgcctaaatccaacaaaacattaatggacgacatcgaacaaaaggcacacaaattgtcagatcgcgtcaaacgcgaactactaacactcttcgatgaaaagcaaaaccacgataaaattgagcgagtaagttttaataattgtctaggccataattttggttttttacaaaaaatttagtgttcaaaaaggctactcagaaaaaaagaacaagttgttcttacaagaaatgaacttattgcgtgagttttttttgctttcctaccaaatccaacattgttggttatcattaggaaaaaaagctgttttagactgtttggccgtcctgtttcgtccagcaaacgttgggacattccacctgaaacaacggcagaaccaaatttcggacatttttcaatgctagaaaagcactggtacgacgagaagctaaataggcggacatatatttccaacatcacacgacgagtgagcagagggatatagccccccccccccgaacatgtcgcggattattcgatttttaagacccgaatgccttcagaatcagataaaagaattgcgcatgaaatgagcatgattttggtaaaaaggtcaacacctaatgcaatgattagaaattttaaatttagatttatgtgttcgatgtattaaaaaagcaaaaatgggcatatgacgcaaatcaacccacctctgattttttgcctaaatccaacaaaacattaatggacgacatcgaacaaaaggcacacaaattgtcagatcgcgtcaaacgcgaactactaacactcttcgatgaaaagcaaaaccacgataaaattgagcgagtaagttttaataattgtctaggccatcattttggttttttacaaaaaatttagtgttcaaaaaggctactcagaaaaaaagaacaagttgttcttacaagaaatgaacttattgcgtgagtttttttgctttcctaccaaatccaacattgttggttatcattaggaaaaaagctggtttagactgtttggccgtcctgtttcgtccagcaaacgttggaacattcgacctgaaacaacggcagaaccaaatttcggacatttttcaatgctagaaaagcactggtacgacgagaagctaaataggcggacatatatttccaacatcacacgacgagtgagcagagggatatagcccccccccccgaacatgtcgcggattattcgatttttaagacccgaatgccttcagaatcagataaaagaattgcgcatgaaatgagcatgattttggtaaaaaggtcaacacctaatgcaatgattagaaattttaaatttagatttatgtgttcgatgtattaaaaaagcaaaaatgggcatatgacgcaaatcagcccacctctgattttttgcctaaatccaacaaaacattaatggacgacatcgaacaaaaggcacacaaattgtcagatcgcgtcaaacgcgaactactaacactcttcgatgaaaagcaaaaccacgataaaatntga

SEQ ID NO: 76515 - DNA, 1481 bp, Heterodera glycines
  misc_feature (1472)..(1472): n is a, c, g, or t
  Genomic contig location: Contig_ID=SeqID_179; Location=131..1611; Strand=-
  SCN-specific regions: Sequence locations=1-196,218-276,299-891,913 -973,996-1481
atggacgacatcgaacaaaaggcacacaaattgtcagatcgcgtcaaacgcgaactactaacactcttcgatgaaaagcaaaaacacgataaaattgagcgagtaagttttaataattgtctaggccataattttggttttttacaaaaaaatttagtgttcaaaaggctactcagaaaaaaagaacaagttgttcttacaagaaatgaacttattgcgtgagtttttttgctttcctaccaaatccaacattgttggttatcattaggaaaaaagctgttttagactgtttggccgtcctgtttcgtccagcaaacgttggaacattccacctgaaacaacggcagaaccaaatttcggacatttttcaatgctagaaaagcactggtacgacgagaagctaaataggcggacatatatttccaacatcacacgacgagtgagcagagggatatagccccccccccccgaacatgtcgcggattattcgatttttaagacccgaatgccttcagaatcagataaaagaattgcgcatgaaatgagcatgttttggtaaaaaggtcaacacctaatgcaatgattagaaattttaaatttagatttatgtgttcgatgtattaaaaaagcaaaaatgggcatatgacgcaaatcagcccacctctgattttttgcctaaatccaacaaaacattaatggacgacatcgaacaaaaggcacacaaattgtcagatcgcgtcaaacgcgaactactaacactcttcgatgaaaagcaaaaccacgataaaattgagcgagtaagttttaataattgtctaggccataattttgggtttttacaaaaaatttagtgttcaaaaaggctactcagaaaaaaagaacaagttgttcttacaagaaatgaacttattgcgtgagttttttttgctttcctaccaaatccaacattgttggttatcattaggaaaaaaagctgttttagactgtttggccgtcctgtttcgtccagcaaacgttgggacattccacctgaaacaacggcagaaccaaatttcggacatttttcaatgctagaaaagcactggtacgacgagaagctaaataggcggacatatatttccaagtgagcagagggatatagccccccccccccgaacatgtcgcggattattcgatttttaagacccgaatgccttcagaatcagataaaagaattgcgcatgaaatgagcatgttttggtaaaaaggtcaacacctaatgcaatgattagaaattttaaatttagatttatgtgttcgatgtattaaaaaagcaaaaatgggcatatgacgcaaatcagcccacctctgattttttgcctaaatccaacaaaacattaatggacgacatcgaacaaaaggcacacaaattgtcagatcgcgtcaaacgcgaactactaacactcttcgatgaaaagcaaaaccacgataanattgagcga

SEQ ID NO: 76516 - DNA, 1015 bp, Heterodera glycines
  Genomic contig location: Contig_ID=SeqID_180; Location=740..1754; Strand=-
  SCN-specific regions: Sequence locations=1-51,74-385,407-708,731 -751,807-860,883-1015
atggagcaggacaaaagggcccttgttcaaaagccggtggtcttggtaatgccgggggaggaggggacgagaatgataagagatgccgagggcggaagggtaaatatgctaagagatgaaggggagaagggaggcgagaatgatcagggaatctggaggagtgacgagttgattaagagggaggggggagagtatgatcaaaagctactacaacagagaatcttagccgattttttttatcaaataagatttaagaaaattctaaaaaatttctacaaatttcattaaaaattcaaaaattttcttcggctgtgttataaaaagctaattttctcaaatgcgctaattgaacgacatacatttaaacaaacaactcaaattccaaaatttattttaatttctttccatttttaggccccaacagatgaggactgtggagacgatgcggaaaaagaattgtccgaggcgttgtcagtggtcaacaaaatccgaatgggcgacgaggaggaaattgagtcggaaaatgtcaatacttcgacggcaccgttcactctgtccatcgccgaccttccgggcattttggatgatgcgtcgcgcaaccggtggggccaaaattgccacaaaagggagaagagggtggccaattgagcaaaatgtgtggcattttgtgtgaatcgatgtgggattttgagtccattttctactttttgtagccaatgcaaaaagtggtcagtcgctggcggcaaaaatcataaaaaatataataatttttccagtaaaactttttttaaaataatttatttaaacccctaaaattttggcggtctgttaaaaaaaaggatcgtcgacaaaaagttttgaaaaatgaattaattaagaaaattacatagaagtggacacaacaccaaaaaaaattgttgcaaaattatgaccgaactcttagggaatcgaacccgcgagacaatcaaaatcatgaaaagttttggttaaaaaaatacgattttttgcaaataaa

SEQ ID NO: 76517 - DNA, 1389 bp, Heterodera glycines
  Genomic contig location: Contig_ID=SeqID_181; Location=207..1595; Strand=-
  SCN-specific regions: Sequence locations=1-410,432-432,455-568,591 -683,874-877,900-1161,1204-1220,1242-1389
atggccacagcgaggagggaggatttagcagtaggacggacaggcaaaagagcagcgacaaaaaaagactattctcatcagttagccaaagaagaagagaaaggggaattgggtgggacagaagcggacggaggatgcgccggggggggggaggcgggcggcatgggaaggacatttactcaattgcagcgcccgctcaccgatggatatgagacgtaaatggaaaatcagatccaactgatacggtagaaatgtaatggattgcatatgagcaagaaaaagtaagcatccaatggaaatgtctggacgcgggaaaagtgtggccgctccgccctccgcccaccccccccccctatacatggatggggcaaggccgtcttcatatgcattcaattcacttccattttacctcaatcaaaatagttatttcaaaaatgttgtttcattattttttcactttttaacgaaaaagtttaagaaaatcccaatctaagttttttttctgttcatccacgaaatggagcaggacaaaagggcccttgttcaaaagccggtggtcttggtaatgccgggggaggaggggacgagaatgataagagatgccgagggcggaagggtaaatatgctaagagatgaaggggagaagggaggcgtagcaccttgttacccgttaactactttggtatattatttttatatgtttttaaaaaattcaattcatttatttgacttaattagtaattagtgtttttaagaaattataatagttttttaaacgaaattgatatatttcaatattttaaaattattttatttggatttactattttcattgtttattttttaaagtgaaattatatcaattataattttgcataaataacaattttcttattttattgaccatattgcaataatttatagaatgctattacttaattatttatctcgcttttctgtgtcttttagcattttcaattaacataaaataataatgaatataataatctattcgttatttttaatattagcttttcttgcatccgtgacgttttttttcataatcagttctatatttactttttgtaaattttaacacttgtatcatttcaatttttagtttatatcacagttatattttaacacttttgattttatatcattgaaattagcaaattttgttttacatattaaaaagcaaaatgtaatagaaattgctcattttatatttttattatttcttttcgttcatcttctataatgatcaaattacaacattattatcattaatcttttatgatgaatatggatgtaatatggtaagaaaaattttactgaaaaagtcacaaattcagtaaattattaaaacccattaaacattttaataaa

SEQ ID NO: 76518 - DNA, 646 bp, Heterodera glycines
  Genomic contig location: Contig_ID=SeqID_183; Location=78..723; Strand=-
  SCN-specific regions: Sequence locations=1-3,30-40,130-147,181 -201,223-244,266-646
atgattaatttattcatttataattttttgtttatggtggtaatttttaattatatcttaaaatgataaaatatttcaatataaactatttttaattatttatttaaattctcattaattttattaaaactgcggaataaacccatgtttttaaatgaaaattataaaaaaaaattaattcaagtgatctcggcaggaattttttgtttgtctttctgtgccaatcttttttttttaattctccgaatttcttttaaaattcttcctaaatggaaatctgtgggaaagcttttcgtaaaatccgccaccttgggcgtttcgtaaaatccgccattttagcgactttttcgacaaaacatgtcataactttgcttaagagcaaccaacttttacattcttggtaccattctatagccaaactttgtctctattaacaaaccaaatttaagaaaatttgggactgtctcgataacgatgcatgcgaatattacaagtgtccgttcggggtactcaaacaattatggggagcaaaaatccaacgcagaattaaagtacaggctatagggaagctattccggaaagattcggtctccccataaatctgggcgcatcggttcggggggactgccccgaaaacaaaaataaa

SEQ ID NO: 76519 - DNA, 724 bp, Heterodera glycines
  Genomic contig location: Contig_ID=SeqID_1874; Location=108..831; Strand=-
  SCN-specific regions: Sequence locations=1-73,110-263,300-332,379-724
atgacgcaccaatttatggtggcaaaatgcgcttatcagtttaaagtgccgcaagttgcggtaaaaaaagacatttttaattaaatggttaattaattaattataagtttcagtcggatttttatcgggacaatgtgctcattttctatgagaaaaatccaatcattcctccagtgaccgcatggattgtgttgccaaacattttcacaccactttcgatcattttcaatctttccatcattttgctaacaattacaacaatgtaataaaatttttaattaggtttttttaatatttttcatttcaggaaggaccgcaaagtgtgtaattggaatttaataatatgaattttatataaattaatttgattataatttagcaaggattatcggactgcgtacaaaaaggcgtttacgcaacgaaaaaacacttctgctgcagttgaaccgctttttcataggtgccaaattgtggcggtttcaaattagcgaaattgaaatttggcgcacattttggacaaaattaatctactgtagagaaaaatcagaattaatttcatgaattattcatttacaaaaagttaaagatcactcaaaaacgaacaagtgttaacattaattgacaagctaaactgctgcatcattaattgcttcatttaatattccatcaaaaaatataattttatcagaatcgcacttttttattacgccattaacataataaa

SEQ ID NO: 76520 - DNA, 154 bp, Heterodera glycines
  Genomic contig location: Contig_ID=SeqID_1875; Location=897..1050; Strand=+
  SCN-specific regions: Sequence locations=1-92,116-154
atgatgcaccaatttgtgatggaaaaatgtgcatatcagttcaaagtggcgcatgttgcggcggtaaaaaaatacatttttaattaaacgggtaatttaaataattataaaatttgagtcggatttttatttggtcacaattacaacaatgtaa

SEQ ID NO: 76521 - DNA, 102 bp, Heterodera glycines
  Genomic contig location: Contig_ID=SeqID_1876; Location=1888..1989; Strand=+
  SCN-specific regions: Sequence locations=1-102
ttcttaactttttaatttttttatttctttcggctaatatcttctacaataatttgtcagtttggtcggatgtgcgtcaaacggaaaaaataattaaaattt

SEQ ID NO: 76522 - DNA, 67 bp, Heterodera glycines
  Genomic contig location: Contig_ID=SeqID_1876; Location=2125..2191; Strand=-
  SCN-specific regions: Sequence locations=1-67
cgggcctggacgttttcgcgtggccattttcgcgtggccgttttcgcgtggttgcatataaaagaga

SEQ ID NO: 76523 - DNA, 2586 bp, Heterodera glycines
  Genomic contig location: Contig_ID=SeqID_1877; Location=226..2811; Strand=-
  SCN-specific regions: Sequence locations=1-181,203-820,843-923,947 -1078,1112-1250,1286-1361,1397-1844,1867-2166,2189-2249,2278 -2428,2476-2586
atgcacaacgcaaaacgcatcatcagtgaatttgtcaattatgcggacatccttgattttatggcatggaatggagacaaactttgggatttcaattcaattaatttcaattctcttgcggttggttttttaattggccccaaaataaatttatttgggtgcttttttgagtaacgcccattttgatgattttggagttaaaaatataaaatacgaaaaaccgacatgtgtttaatataatttacttctattttattgtacatatatagagagaatttataatgttttactatttaagcttgcgcttcctgatccgccaaatgatttgccaaaagaaacaattggtaaaccgaaggatgtgccaaaatccaaaattgaaaaaccattcaatatgccaaaaacaataattgccaaaccgaatgatgtgccaaaacagaaaaatgccaaaaagaaagcatcgaaaaatgatggggggcaaaagaaagaaaaacttgttgttagccgaccatcatcacccaatggagtgccaattgagtttgaattggaaatcaatgaatacactaatggacaattgatcaacaaaaacactatttctggacaatgggacaaaaggaatgagaaaatcattgatgaaatgttaaaaaataaaaaagttggtgtcacacaattggggcccattcagtcaaaagcaggtatattagcacaaagatgaaaatcagaaaagccgcgtatctcaggcaaaaaagccatttttcagaaaaaattatcatataaccagatctaagatggattttgccgcttaaatggcaatctttgaaagttttttataaatttttatttaagccacaaatgagggtaaaacctcttatattggggcaaagtaattaccgaaaaataatatttatatttacatgtttcacgggaaaaattatttttaaaattataactgattgataaactttttagacattttgccattaaaaccaggacagttcgaaactgaatcccattttttctctgataaccatgcgaacagtcagcaatcaactgttgcatcaacatcgaaaaatcaagtcagaaatttttaattaattaaaaaataattattttagaaatctaaaaaagtgcctgagcgtctattaaaacattccaagtcaatggccgaatttagaacaacgcaaaactcaaatgagtcaataaatgtatctgtaggaccaaataatataaataaaccattggaattaattgagtaaaaatttttttagcaaaaatttattttaaataacaatatcgaggctaagaagataaacgtgtatggagatgggaattgtctgttcaggtttagaaattttcatgaattgatattataatttttaaatcaataataaatattatagatcgacatctttctatattagtcggtatataatcaaagtttttgatatattttttatgtcccaaaattttttggtttctgatgaattaggtccttcatatcttcagtcttagatagaatgctcaaaatgaaaagaaattgatgttttaatagattcagcggataattttctaattaatattataatctacgcttccggtcattaaaatgcgattttattgtattcaaggtcatttgccgtttcactgtatgacgatgatgatggcaaagcgcataaaaagttgcgcaaagctgctgctgagtcattaatccaatttgagcaggactcgtcacgcagttccgaggacaaaaacaaaatgaaagcaataatccgagctaatttatctgaaggcgattcaatgtctaattaccataatagcattgcggaatatgccacttattacgtgttaaagaacagaaattatgctggcgttgcggaatgctatgcattggcaatccatttaaatgtatgcaatgaaaaaaaagaaaattaacagaatttagtcaaagttccatataggctcgaagtaattagggttaattatttggccgtaaataaatattctcctactttgcataagttttgaattcttaaatttttcttgacataatttttctaattctcaagcaatagatcagttacatttttaatcacgaatttttcgaaaaattctaaaaattttatcgatatatcagatttggctccgaatctgccttcggaatgaaatttaatccacaaaatttttaaaatcatgaaagtaaacaattaattagcaccaggtttttagtttaattgcataaaatacttcttaattggtgctaaaaataaattaattggttatattagttttattttgtaatattttggttaacaaaggaaatgaaaaatagttacaaaaaaagttgcttctactttttttagcgtaatgttgcgctcgttaacagcatacaacacactgccattgttcttcattctaattttactcaaacggcaatttttttaaatttaatttttattttaaacatttaaaaaaatttttcaggattataacaatatcaccagtgataaatataaacaaatttgggaattggttgatgatccaattgtgatttggcatgatggggatgagcatttcaacagcatttgtttg

SEQ ID NO: 76524 - DNA, 1165 bp, Heterodera glycines
  Genomic contig location: Contig_ID=SeqID_12791; Location=543..1707; Strand=-
  SCN-specific regions: Sequence locations=1-231,253-275,320-325,351 -611,640-695,717-1165
  Gene Ontology: Mol. function=cytochrome b; Cellular component =mitochondrion; Biological process=morphogenesis of an epithelium
tcaccctcagcgggccgttcggggacggcacccaagaatggcacaccaggagggtgataatgatagagagggtaatccttgatttaatttgaaatctttcaattgcaggtcgttgtgtttgttggtggtggcattggcataacgccgtacgcctccacgctgatggatttggtgttggagagggcgtcgggcaaccatagtggcataaagtgccgaaaggtgtgatagaaaatttatttttattcaaaatcaattccattttttacataattcactttttaatcattattttgaaattaattgaattatttttatttttcggcacttttaaataattattttattttaaaggtttatttcctgtggatttgtccgacgcataagaattttgaatggtttgtcgacgtgctgaagcaagtggaacggcatgaccaggacggcatccttgagatacacatttttgtcacacaattcttccataaatttgatcttcgaacaactgtattggtaagcagattgtctttgtttgacagatttgattaaaaagaatcagcttaattccgattttgaacttatttatcaacaccctaattagtcatcggagaattcgtcactgatacatatacatttttgaaaaaataatacgataatccacacttttgcctgaattatagggacagaaacctgattttatcagttttcacaattttatcaaggctaatatgttttccaaaagtttgaattcattaacaactttagtgccaatttactaaacaacttcaccttttacaatacaataaatcactgatcgaatataatatattatttagatgtaatattcactaagctaattatgctcattagtctctaatttgttgaacgtatatatttatcacattttcaacagtatatctgcgaaaagcacttccgcggtgacaacagcggcatcagcatgttcaccggtctgcgtgccaccaaccatttcgggcggcccaacttcgactcgttcttcaaatttttgcagcaaagtcggcacccggaagttgccgagatcggcgtgttcagctgcgggccggcccaggtcaacaaacaaattagacgcgcctgcactgaggcaaatcggttccggaacgcgccgtcatttgtgcaccgattcgaaacattt

SEQ ID NO: 76525 - DNA, 1639 bp, Heterodera glycines
  Genomic contig location: Contig_ID=SeqID_12793; Location=467..2105; Strand=+
  SCN-specific regions: Sequence locations=1-182,205-718,742-1283,1392 -1607,1629-1639
atgttcaaagatctgttcccctcgctaggcttctgtcccttccatgcccttttgtgggtgctcaaaggctatttaatattccgttccatcaaattcttcgaaatctttgtgaggagtgtttggggtcattttttcacaagccctctaaatttggccccctacaaaaaaagttggacaggtataattaattaattaatcatcatttggacgttccttcgacaaattcacactttcagtggtgacgggctgcacggatggcattggcagggcgtatttggaggaattggtggccacaaaaggaattcgaaaattgtatctgatcgcgcgcaactcaactaaattggaagctttgtgctcatatcttcgtaaacaaatataaaaattccgattaattttggactttaagaggaaaattacgagggatgcgaaatcaaaagagcgatttttgattttgagaaggatgattttgaaaaattgccaaccgagctgcagtcattggaagtcggcattctgagtattcgcttttgctattgtttggcatttccatttgattgccttttgtcctcagttaattgtgccgggacgggccccgaccaagtggccaacttcgctaatttgccccccgggctttcgtctgtcattctgcgcgtgaaccttctctcttgtgttaaggtgggtatgcttttgccatttgataatcactaatcacttgtgtcctccccccacccaaatttccctctcatttctaatcaaaagatgatcgaactgatccttccgggaatgctgcaacgcgaccgaggcatcgtcgtcaacttctcctccattacggtgttttcccatcgctgagattcgaataatcagctgaccattaatccgttcagggatggcgtcccctcccttatatgtccacttatccggccaggtgaccgcgtaaatccgatcaaaaaaggcaatggcaaatcctttcaagcaaagcagcgatcagcttcttcaccgactctctgggagatgaatttgcccacaccaacgtcaaaattcaagtgcgtcgtttcttctcctaatttggccctttctctatttttgctcttttttcagtgtcttttcccacttttggtcgcaacgaaattaactcaatacgctgcagaagatgcaaatctgttagtgcttgatgccaaaagctacgcacgacaagcagtgaatataattggcaattatcgaatttccacgggatgttttatgcacgacatgcaggtgaaaatagagactgggtgagaagggaggtcgagaaaaagagagtagaaaaagagtgggagaaagagggaggatgagaatgtcatagagagagatagagataagtgaggaagagaaagagggagataagggagagagaggatgagatattaattaagatgacgagaggtcattagctaattataaattcagtaattcccaaacaaatttgtttttcttttttcagatagcatttggcagttttattgggttcaatttgttcaaacttttttacgttcccttcggcattctcggaattcacaaaagaagaatcgatgcatacaacagaaagaaattggcaaacgaaagaaaaagcggaggaaaaggagaaggaataaagtcggaatga

SEQ ID NO: 76526 - DNA, 991 bp, Heterodera glycines
  Genomic contig location: Contig_ID=SeqID_12793; Location=3601..4591; Strand=+
  SCN-specific regions: Sequence locations=1-651,675-744,766-851,881-991
atgccttcagcttataacccggctttcaaagtggcgaatccgacaaattctgtcgaattgactggaaatgagcagcaacaactttcacagaaccaaggacagatgcaatcagcagatgaacagcaaagcaaccgctcaaagcaagacgcaagtcaaagggacgaaaaggggacggacgacgcccgaggggaggcagcggaaaagcccaagcagttcggagttacccagcaacaggtgaggatggtggactaaggccatgaatggtcatattgtgtggattaaggcccagaagttggaccaaccatcggtgatcggaatgaatccactgcagatgagggaccacctgcggacacagctgaagaagaacagaaagccgtggaaccaaccttaggaagaaaaccattggaaacggagggaatggacaattttaaactctcagggaacgatgcgatgatacctcattaattacgaatgaaagcctttttttgcagaatttgagaagtgaataaacttagagacagataaatgaatacaacaagagctcagttccacaaaaatattcaatttggcaacctccccacaacagggaaagggatggcgctacttgcaaagagccctcttttgaattttatcaaaaactaggggggacccttttgttttgcaaaaaattttttgatagaaaaccatgaaaatttgttctacggagttttagtcgtcgctgatcacgaatctgacatttagattttttgttcaaatttaggtcaagaaataggaattggtcaaaaaactatatcaatttatctcttcgaacaatcgcctgaacaatgtgaaacataaaatttgtcacgaccaattttaaaattaaaaaatgtaatattaactcaattaggaggctaaaaattcccaacagtcataattgttaaattactcattgattgcccattgttttattgccgtttcttcgtgtaccagtcacaaagtattgaatgaa

SEQ ID NO: 76527 - DNA, 534 bp, Heterodera glycines
  Genomic contig location: Contig_ID=SeqID_12794; Location=186..719; Strand=-
  SCN-specific regions: Sequence locations=1-534
atgaaggaaagatggccccataacaacagtcatccctccagtggtggatgtggtctagtggctaagacaacggatccacgtaaggggccccgagcgtctaccccaatttttcgcctaaataatagcaatttactcgctaaatttatgtttttggttttcattgcaatttgcagctgaaacaacaaatcatttcatcttttatcttcactaataaaatgtttttaattaaggtaaaacggactgtttcattagtgtgaaagatttatggccaaaacaaaaaattgactttatctgactttttgagtcaaaatgccaactcgtaccaaaatgagttttgagaaaacgaatcctagacatagaacacaaacttaaatttcaatgattaaaatttgtatacgagttggctacaacgaatttttacgagtgtcatgacacctgcactcaataactttttggccaccgccgaaatgactccgaccctttgattgtgagagcaatcgtaatccgaatttttcatattacataggtaataaa

SEQ ID NO: 76528 - DNA, 1976 bp, Heterodera glycines
  misc_feature (1892)..(1892): n is a, c, g, or t
  Genomic contig location: Contig_ID=SeqID_12796; Location=2143..4118; Strand=+
  SCN-specific regions: Sequence locations=1-167,193-546,569-667,689 -718,740-800,829-1252,1290-1597,1648-1904,1926-1976
ccgccgacaattttttccaaattgctcgctgttccgacaagatcgtaaatcagaattaattcatgatttaacagtacttgaaaacttttcaacatccgatcacaaaatggtcggatttaaaataaaagaaaaattcagtaataaaaatcccagagtttatagaagagattttaaaaatattaattttgcaaaattaagtcgagcgatacttgaaaatagatttgatgtttctataaattcggtgtataccgttgaacaaaaatataacgaattcttaaataaagtactgaaattatatgatacttttatacccaacagacctctaaaatcgataataaaacaatcgtaccctcaaaaaataagagacttattttcagagaaattacggttacataagcttgtaaaaaaattcccggaaaaaagtgatctcatcttaaattacaaaattatttcaagggaaatgaagaaacaattaaaacaattcagaaatgaaaaagagtcaaaaattatttcccaggggcaaaattcagttaacaaatttatccgaaataagttatcaaaattttttgagattcctactctaattgataatgctggaaatatgttttccagcaatgtacaaaaatgtaaaatattagcagaaatatttcaaaagtcttttttaagaaaatcaattgttaatggtccacaaactcagtcaacacagaataagaccaagctttttgacattgaattgaacgctggcataatttggaacatattaagaagacttccccggcgtaattccacttcacctgataatatcccttatattttattaaaaaattgcgcagatccaatcacaaaaatattagcagatatatttaggctaattttggattccggtcaaattccggaaatatggcgaacatctttggtagtatcaattttcaaaagaggcgaaaaaactgatccattaaattacaggccggtttcattaaccagcactgtctgtagagcttttgaacgaattttgagtagtaaaattttagaatttctgaacagtacaagattctttgataaagaacaatttgggttcttaaaaaatagatcgactacaactcaaatattaaaaacgatggacgatatatataattctatacaaaagaatcaacaaattgacataaataatctatattgattttgtcaaggcgtttgattctgttccaattgatttattacttcaaaaaatcaaaaagattggaattgaaggaaaaatttataattttttaactaactttttaaaaaatcggagttttaaggttaaaatcggcgatcaattgtcagaaagtttcaaaatatttacgggagtgccccagggaagtgtcttagggccattactctttttaatttttataaatgatctgccgtcctttatttcaaataaagcatcatcagttggcataaaaatgtatgctgacgatgttaaattatattatgcccatgaaaacgatgaccattcaaatcagttggataaagcggttgaggctttggaaaaatggtcaaaaataaatgggttagaaatttcaactgaaaaatgttttgttctttatttagggaaaaataacaagaaaaaagaatattttattaactcaaaaaagatttcagaatcggaaagtgtacgtgacttgggaattataattgactcgaaacttaatttttcagaacatattagcaaaattatacgaaacgcatatcttagaattttccaaattttgagagtgttgaaaagcagggaaataaaaactctaacagcagcctataaaacttttgtacgacctcaattagaatacgctaccaaagtttggaaccctaatttaaaaaaagatatagataaaattgagcgtgttcanaaaatttttcacaagaaaagcacttagaaaatgtggttttgtgtacaaaaaatatggggaaagactaaaaatcacgggtttaca

SEQ ID NO: 76529 - DNA, 602 bp, Heterodera glycines
  Genomic contig location: Contig_ID=SeqID_12797; Location=201..802; Strand=+
  SCN-specific regions: Sequence locations=1-265,288-429,451-510,532 -566,593-602
caaagctgaagtccagcggatttgggatgtttttgtcgatggaatttggcccatttttgcgccaaacattcgccatttgagccttgccagctatgaaattcattacgatatttatgagcataagccaacgccaattgagccatttgaattggtgaacgaacggaccaacgagaagctgacattgaaaaaagaagtcgcttccttttttgcaattagtcattgggtgttgaagcgatgtccaattcttggggagacggcggcggttcagcagcagcagcagaagaaagacgaaaatttgtgccgtttgaacaatgtctccgtttttatgctttgtaacactaattgcattgggtgaggagcaacaattttcctttttttttttgttgaaaacattcaaattgccttcaatttttaggcctttgtctccaccggcagaagcagcagcagaaagaacgggccaaagcagcgaaaagggcgccgtctgattatgtggaaatgaatttttggcacttgatagaaaacttacaaattaggtcgatcattttttgtatgaaattattgatttgccatattttaaagtttaaactcatatttatttttaa

SEQ ID NO: 76530 - DNA, 1059 bp, Heterodera glycines
  Genomic contig location: Contig_ID=SeqID_12798; Location=124..1182; Strand=-
  SCN-specific regions: Sequence locations=1-210,248-745,767-892,914 -989,1016-1020,1050-1059
  Gene Ontology: Mol. function=enzyme activator activity; Cellular component=cytoplasmic vesicle; Biological process=intracellular protein transport
atgggcaaaatcctatcgaaactatttggcaaaaaggaaattcgaatattaatgctcggattggacgcggctggaaagacaagtttgtggcacttcacattttttaattttcctcttattaattgttgaaatttcatttttggactggtattttatcaaatcaaaaataacatttcctgtctggtcaactaaaaagaaattggtgcctttttgttctaatttgctattaaaaattccaaaaaatttacaggtattctctacaggctcaaattgggccagtccatcaaatccattccaaccgttgggttcaatgtcgagacggttgtgtacaggaatatcaaattcagtgtttgggtaagaaaaaaagtaaagcaaaaaaaaagaaaagaaatttatggatttgagagaggaatttcagcaaaaaaatgtcagagacacgccaaatccagtgattttcgtgcttaatttctgagccccgagtcgaaaaaaaacccgggatttagcagaaataaatgccatgcggtgatttgggaccctaaaaccacccgcgggttcatgttttatattgtttacttccacgggttcatattttaagttgtttacttacgtttaactcctcaattgtataaagttttcccatctcttccataaattcgaatttcttttggttcatttcgcttcccctttttaggatgtcggcggtcaggagaaaattcgtccgctgtggcggcattattacgtcggcacacaagcactgatttttgttgtcgattcggccgacagagacaggttttcccgacacaaaaacacctcgatttttctcatttttataaaaattttgtgctaagttctcacatttggggccatttgctgtacaaagaaattaaatgggtcaaaatttccaaaaaaaaacattttttttttgaattttgctaatgcattttattaattgggccaggattgacgaggcacgccaggagttgcacaaaatcatcaacgaccgggagatgcgcgacgcgctcatcctcatcttcgccaacaagcaggacttgccgcagg

SEQ ID NO: 76531 - DNA, 815 bp, Heterodera glycines
  Genomic contig location: Contig_ID=SeqID_12798; Location=2056..2870; Strand=+
  SCN-specific regions: Sequence locations=1-517,542-567,592-815
atgggcgagagcgcctctttcaaaggcattcccggtgggcggagttcggtgaaagctgacgaagcatacagcgatgttagtactccaacatcaatagagaaagaatgtgttactattgtcttactattagtactaagaaatataacgatttttaggaagacaaagatgtcaacaccaaaagcgaaaataattccacgttgggaaaaaagcgggtactgttgcagaattgcaaagaaatgttctggaactctcaatcgaaaatcagaaaaaaatgtcagatctcttgacaatttcaattcatttgtcatttattttgatcaattttagcatggatcaacatgtgatcaatggttaacgaagccagcagcttccgttgccgacaagatttttgacgaagatgatccgacttttattgttggtgataaaacatttcgaacattgtaataacagtgccgttttaacaaattaatgttatacattttggacatttatcacaatttatttttgaaattattcaaataaatgttaaacatttcttatgaagcatatgattaagttgttaaacccaatattttaacaagcatttcataatatttttgaaattatagccaatggcagaatttatggaaaacttagaacagaagaatagaaggggtgccaaaggattttacgttgaccctgtccttgaattacggtttttatctgcgggcgatcgaaacttcgaactgatcagacgataccgctttcctgatgaaggaattgatttcatttcaagtcttgtaaaggatgaccttcagccaaaacgatggcaataa

SEQ ID NO: 76532 - DNA, 493 bp, Heterodera glycines
  Genomic contig location: Contig_ID=SeqID_12803; Location=73..565; Strand=+
  SCN-specific regions: Sequence locations=1-158,203-493
  Gene Ontology: Mol. function=isocitrate dehydrogenase (NAD+) activity; Cellular component=mitochondrial matrix; Biological process=isocitrate metabolism
atgcccaatttgtacggcagcattgtggacaatttggcggccgggttggtcggcggtgcgggcgtggtcaacggcgagtcggtgggctccgactacgtgatctttcagcctggcgcacggcacacattcaaagaggcgtttggaaagtcggagcaaacaaaaaattattattttttttacaaatttgaatttttatttatttccagacaaattgccaacccaaccgcgatgattttgtgctgtgccaacatgctcaaccatctccatttgaacagttacggcacggcactgcgacacgctgtggagaaagtgctcaaagagggaaaagtgcgcacccgcgacttgggaggtgtgtgtgccgtgccattcattcattactcaatcaaaatttcataaaatggcaccaaatttgtactacaatataatgttttttccaggctttgccaacaccagcgattttgccagtgaggtcattgccaatttccaaatgtga

SEQ ID NO: 76533 - DNA, 558 bp, Heterodera glycines
  Genomic contig location: Contig_ID=SeqID_12806; Location=595..1152; Strand=-
  SCN-specific regions: Sequence locations=1-27,104-280,310-531,554-558
gcaaagaaaatgggacgaataccggagaaagtagcaaaaacaaaacgaagaaaaagaagaaggcgaaaaagacaaaaaaggaaaaaaacggggagaaagaaaatggcaaagacatgaaaaacacttttgaggacaaaatgtcacaagacaaagtgtcaacatttgatgatacgaatgaaaatgttaaaggtgacaaaatgtttacaaaaaattgggaggatcaattgtcagaggaaaaagagtcgacaaaaaaattttacgatacagtgtcgttcgctgtatcagagaaaatgccaaaaaatgatgccaagggaaattgccaaactgacaaagtatcaccatatgaaaagactgatgataatgatgacaaagcgctgacaaaaaatttggaaggaaaagaaaaggttgacaaaacacaaaataaggaaaaggaaaacaaaattaatgaagaagaaaaaacaaagcataaagattctggtactaatggtgaaggaactgttgcaaaaaaagaagccgctgttacaaatgccaaaaccaaaaaagcctatagaattgcag

SEQ ID NO: 76534 - DNA, 5610 bp, Heterodera glycines
  misc_feature (1533)..(1533): n is a, c, g, or t
  Genomic contig location: Contig_ID=SeqID_1878; Location=493..6102; Strand=-
  SCN-specific regions: Sequence locations=1-51,75-384,406-522,544 -544,566-760,782-799,837-1317,1340-1443,1473-1971,1993-2416,2448 -3534,3556-3779,3801-3936,3966-4006,4063-4265,4295-4657,4679 -4820,4849-4912,4947-4988,...
  SCN-specific regions: Sequence locations=...5028-5134,5156-5404,5443 -5472,5495-5610
atggacgccaacaaaatgattcaggtgaagttggaaatcgtttaagcgtcattaatgaatatagttgtttaaacattttgtagaaaggctatgtgaagctgtggactgccaacaaaccgttgcctcctcaaaatgtgccggatttacagaaagatacccggcccaaagtaacggcggcgacagaggaaatgattttggcactgaaagtgttccaaaagtttcgaaagaacaaaaattgttgggcatctgtggaaaagaaactcttaaagtcgcaaacctttttgagtttggccgaacccaacggaaaggacgcaatgcgaaaagcggcggtgcgattgtgcgcagaaatggaagcgaaaattttggcacaaattgacgaaacggcaaagaaattgttggactgaggaggacgaattgacgagcattttaggaaaaagatcctttccgattttgattctttgatcagtgaaagtgcggtattgttcttgtaaagcgccatttatccacattcgctttaaaacattttctcttttttcattgtcagctttctcttccctttcttttcccacgggtccctctgtttaaacggaaacatttcctcgagagtcagtcagagttgatcaactgatgattagggaggcgattagagttccgggttcggaaaccggtcatttttgaaaatgccaatccggtccgatccggcgaatttttgaccggttttttcggattatgatctagctaagaattcttgatttattcatttttactcttttccaaaatatcttggatttcaatttcttaaatttggtaatacaatttaaagttttatgtttcttgattatggctgaaattaacaaaaatttttcgtgtttcgttttcgccaacaaaaaactttcgttttcggattctaaaattttaaattttcatttcgttttcgtgaaaaataaatattttttcgtttctttttcggaagttatttttttggttttcgcacgtctctgaatggtgcccttttgattcaaaagcgaacccaatcagacagtatgatgtcatgaaccttagacagtaaacttcgtcaagaatgactatcggattcggagaaggaactctcgacctctgtcgcttatggaaatacaatagaaattggggttggttgacctgcactggcaaaaaaattttgtttaaaattttcgaatgaattttgaaaactttttagtgtttagaagaattatttcttgcagtgcatttacgaatgtgcagaagaaaatcaaaaaattggtccatgtcaatgcccaattcgttcaaagtgaccgatcgctgctgcttctccctcatttccacgctgagcatccgatcgatcaccagggagaagtagcgaagccgagaagcggaaaaactcacctgaaaagtgccgtcgcagcaataaaatttgaacaaaatgaattattaaaaataaaatggcaaatttcaaatacaaatcaacattattcgaaatgatcggcaattgtctaatgcaattaattaattgatccncaaataattaggcgacctttcctccgctttgtcccgcttcttcgtttgttggtggacacaatggcctaaattaagcataatttaatttgatgaacattttaacaatggcaaatgccgttgttcacccaatgcaattcttgccaccataaaatcggaagaataatccattcaaattgtttgctcatctcgagccaggcagtccggcgaagccctggcacttgaattgttcagccttgcgcatggcctcgtccgaaaattcgatgtccgaggcgccgtaaattatgtggcgatgatttgcgattcagtactttcttccaaaagatgacgtcacaaccgaacccggctttgctgttgattttgaccaattgcagcagatgaaatgaggcggtggtcggcggaggaaagataaattcgcagcttttgaaccaatagaaaatattggtcattgatgagatgagtgttagattttgtattcggggaatgtaaattttcggagactatcgtcaacttaaatttggataatcctttttcagttcagttcatttctttttcaattttgtttgatttggtttttacttggcaattaattcttttttctgcttcatctctacacactgttggctcaatgtgttcgatttgctgccgtcctttcagcttggctttggcattgctctgatcagcgcccaatttgaccacagagtggacgaattgttcaaaacatgacgatggacattggacaaaatgggaattcgaagcaaaattggaatgaattgcactttttgaaattaaatttaattggacatctaaaatttttcttttcgtctacccctcccttctttatgcactatttcgttccaaaatggtatcaaattttttttgtctgtttttatgaaattaaaatataaaaaaatatacaaaagttactttcgatttaaattttgcttaacactgcatttaatgcccaccgtgagcggctccccttttgtgcactattttcgtttttaaaattggttccggattttttggctttttgaaattaaattgtaaaaatgcaaaacaaactctctgaagaaatttcgggattttcagaaccatcctattgacggattgggacggtactcttcccacatacatatggtattcggcctggtgccggtcaattggatactgttgtactcgggttgtgaatgggtaaggaccatcttgcgccggttctgaacatttgggtccttccttaatcactgccacacccacaaagtcaaattccgcgtccgcccgaagtcggcggagtgggggacatcgacactgacggtgccgctgtccgatgacgctccgtgaaaccctccggggcgtgccaattgtttcgttttttgccatccagagagattatttgtcgccctgattttcacgaatcttggaaagatttcgcttcttgttaatgtcatcagtctcgaatttagtagaggctcttcagcaatgataaatccaagttttagccaagaatattttgaattatttaaaaaaaatcccttttcgcagaggtgtctatttgagccaaatctgactcccaacattttgttgaattcaaaaattttttacaattatcgaaaattttaagacttttgaatccgcatttataattattaactaagcaatcattttaccaaataattagtcacactcgaaatcccttaaatatttcagcctagcaggattgaatcagtcgtcgaaactcttaaattgtctttgaatgccattgcgctgatttttggcgtctatcggtcgcgtcgcatccactgcattttcagaggccaacattctcaaccccccctccccccccccagtcgtttatctcaattgctcattggtcatctattccatgccgttcctttgaaaatggcgtcgtttgttgtgctctttgatcattggtcactaattggtcattaattgcccattaggacgccaatcaccgcacattattcactctcaattcattaatttcctccaatattttcattttttgcactttgtcctccaattcgaaaaaggttatttagcgcagtgtgcgtggcttaagcttttattaatggaagcataatttttcagatgtcctacctacgattcagcgccgaccaactcgacactttgccattgtcagcgttgctccgcgagttcagatacctcattggcttgaaggagcattttgagcgcagagcagttgttcttgccgagcgcgtttttggggctgatgtcatcactttggaagatgagcagaatttgcggcagctggcaaggaatattggccagttgagagcatctttagatacaattaaaagacggctcggctttgctgtggatgcgggcgctactgattcggagtgaggaggagaggcaacaacatcttaacccaaacggccctctttagggccacaaatggacaaatgaacgtaaatggccaatgtttttcgtgaagaataataataaaattgttataataaaagaatataaataataatctttaaataatatggaattttttgcaaacttggggcgggtttaggcttctaagtcgacttttttcatgccaattttttgctatttctcgatttttactttttgtgctgatttggcattttggtgctggttttgaggaattttctaataaatttcagcatttaaaaaattattaacaaaaatgcaattaaaatgaaaactacaaccctaagaatcgatctgaaaaatctcagaaaaatacaccactatggaaaattttaccaaaaattcatccgaaatttatttagtgcccggcactccgttgtacactcaatacggccaggcacaggaaattgcgatttttgtggtgccgcaggccgactcggacaatgccacgcagcccaaaattcaatacgctttccgtggccaattcgcgccctttcgactgccccacgttttgcgctgttgggccaatcaggtgacggaaattggcaatcagaaaaaaggggggaattcggcaaaaacccaaaaaatgccaaaacaaacaaacaaaatttttactaattgacacaggtttatgtcggagagattgccaacggggaaggagtgttgtggtcattggaaatccaaccggaagcggccaaagagtcttttgctgctcggggacgcgaaatgttggcgaatcccatgcatttgagctcaccaaatcatggtaaaaaaggagagagagacgggcatggcaaaggcacggaaaatttgggagggcaatacttttttttgacccactttaatgcataaaactttttaaaaaatataaaccccatgacaatatcaaaattttatcgcataatttcaggcggatcatttgtattttcaaatgacatacatttaataattttttcttattaaattttaaaaatcgtaaataaaccgagacataagtcaattaaaataaattccgaatttttcatttgtatttatttaaatttacacattacattataatcgcttcccccattttccgctttcgaattcgcagacgatgcccgtcgctttgaagggtacagcaattttgtgtacggctcgtccgccctggtgctccttttggtgttgtgttgcggttgctgtgccctttttctgttgctgtggcgcttctgcttcgaccgcgctgagcaggacgcaatggacagaaaggtgctgcttctgcacgccccaatttttctggatccaaattttgtgtcgtaaaaatgggatttatcgaaaaaaaccgtcgtcatttgttttctttttccacctcccaccttatagcattgttattggtccatgtgtctttttgtgattaccaaactgtgtgtaaaatggttgagggacttgggggctttaaaaaattaaaaaacccaagggaaactcctccccttttttttgatgtgccaaaaattgaaaaccaaactcatttgcagggtttcaagccgttgcgcagcttcgagctggtggaggacgacgacgagctggtcagcgaggagagcgacattgagggggacgaagagaaaggggcagcaaaagcccaagcgaaagggacagacg

SEQ ID NO: 76535 - DNA, 303 bp, Heterodera glycines
  Genomic contig location: Contig_ID=SeqID_1878; Location=6500..6802; Strand=+
  SCN-specific regions: Sequence locations=1-268,297-303
ttcgaagcattgacttctcgagattgagaactttctgaggcttaaggccgagaatgtcctcaagactgacaatgggccctgatgagtcccgggctacgcacggttcacagtccggaccaacaaaaatattttagagttcgattcacacggagttcagttaaatcgaacatttttttcgggattcatcatgcacatcagccaaaagttaaatcacttttgaaattgcatatcaattagagattaccactccatccatatcaatcggcaattcatttttctaattaatttttgtatatatgaatt

SEQ ID NO: 76536 - DNA, 1252 bp, Heterodera glycines
  Genomic contig location: Contig_ID=SeqID_12811; Location=563..1814; Strand=+
  SCN-specific regions: Sequence locations=1-487,511-792,815-834,857 -1016,1043-1252
  Gene Ontology: Mol. function=pre-mRNA splicing factor activity; Cellular component=actin filament; Biological process=intracellular protein transport
atgccatttaaaattgacattttgtttgcgtgcgcacttttcattgcggcatctgccagcccaattttgccaacttcggcagatgcaaaagatgccattaaaccgtcggatgatcatggagatgaaatttcaacaccaattagacacaaattagtgaaggacacggatggtgaggaaacagccaataaacgggcattccgtaagtaaaacgattaaaaaatttgaagaatttatcacgaatttttgtagtttttgatggacaaacgccattcactcctggagtaatgccctttgttcccggtggaatgccgccgaatgttcctggaacgagcccaatgattcccggaatgatgccgagtgttcctggaatgatgccgagcatgcctggcatgacgccgaatgttccaggaacaagcccaatgattcccggaatgatgcccaacgtgcccgggatggcgccgagcgttcccggcatgccacctaatgttccaggaacaagccccatggttcctggaatgccgccaaatatgcctgtaatgccgcctaatatgcctgggatgatgccgaatatgcctgtaatgccgcctaatatgcctgggatgatgccgaatatgcctggaatgcagccaaatatgcctggaatgcagccaaatatgcctggaatgatgccgaatatgcctggaatgatgccgaatatgcctggaatgatgccgggaatgatgccgaatatgccgggaatgatgccgaatatgcctggaatgatgccgaatatgcctggaatgatgccgggaatgatgccaaatatgccgggaatgatgccgaatatgccgggaatgatgccaaatatgccgggaatgatgccgaatatgccgggaatgatgccgaatatgcctggaatgatgccgaatatgcccgggatgatgccaggattcactccgcagtttccaggtatcaatttcaataataatcttattaatccatcgctcaacccaggaggattcaatcagatgccgaatcaaattggatgaaaaacattttgacaaacttcgatcagtgataacccagcgatataaatttcacttacaattaaagcatttcatttttttttaattttcaaacaaaatgcttataaaaacttataatttttgatttgttatctttcagaatcatatagtaatattttttttgcataccggtaaattgtttaaaaaatacattaaaatggataaaaaacattagaaattattgatga

SEQ ID NO: 76537 - DNA, 144 bp, Heterodera glycines
  Genomic contig location: Contig_ID=SeqID_12812; Location=375..518; Strand=-
  SCN-specific regions: Sequence locations=1-144
agacaagcattcgagtccacaaagaagggttttggacaaacagtggtgctcggtgtcattgaccaggagctgaaaattccaccggacatgcttttaatgggccgcacaattaaaggggcaatttatggaggtgtaatcaattag

SEQ ID NO: 76538 - DNA, 1266 bp, Heterodera glycines
  Genomic contig location: Contig_ID=SeqID_12813; Location=1512..2777; Strand=+
  SCN-specific regions: Sequence locations=1-130,152-443,467-534,557 -569,592-843,866-1266
atgaaaggtttgatggatgccggcaagaaagcgttcggctgtacgcgcaaatgcatgaacaccaaggcgggcaactgcgagaagacactcaagtgggacagagatttttttgaaattttagaaccagggaaatttttgaaaaattcattcctcatgggtttgatggcacatttttagccgtacaaattgccggaaaaatgccgtccattttcatcccctcttccattcttcgttaaaatttcgcgccaaatattttgaatttgcccaggtgcggcttggacttcccgccggacaacgtggcggtgcaggaagtgaagaagtgcgccctcaacagcggactgaacaccgccaacgcgcaagcgctgtgcaaatgcgcgtccgccgcgggcgttaagtgagtgatctaaatttgttttgtccattactcgagactctcgagttttcaaacacaaaatttattttgggataagaaacatctctgctggttactattagtcgagttatgcgggaccgggaatctttggaaaagcggggaactggcttttcaaaaattctgggacctgaggaaaccgggaattcccggaccggtcccgcttaattctaattgctagggcttttcgggagtggaattctcgaaattttgggacagagactctcggaaactgtcctaatgatcgatcacctccgtctagagatgatcacataaatagcatcaaattgcatacaaattgattggccaaactaatcgatcatttttccattttcccaggaatttgacgccagccatctgcgcaaaggtcaaagtcacctaaacaagttcatgtcgtccgggcgctgctgatgactgactgatcagtgtagtaacagagagatgagcaattttagtgatcgattgaccgaaatcccccaaaatgttttgacaccggtgattgatcgatagttatcatttatcattttggtggtcccttccaccccatttgtttcccatgacatcacctttttcaatttaacacaaagcatttctctcttttcactggcaaaattgctttttcttatctgtagtaaaaaaagaacatccaatcatatggcacgtgtcataatgccaattataaatgccaaagacaaatggctgcattaaataggggaatggcttggtatgaagcttccaagatggatttctatatccatattttatggccatattttgcgatttttatatccatacatcaaagaagcgaaatttaaaaatagtcataattcaagtta

SEQ ID NO: 76539 - DNA, 299 bp, Heterodera glycines
  Genomic contig location: Contig_ID=SeqID_12814; Location=344..642; Strand=+
  SCN-specific regions: Sequence locations=1-124,175-249,293-299
atgtacaaaaaagccaaggaatggattaaattggaaaaagggcgtgaaaaaggaaaaagtgccgcgagtttttatgacccattttggtcactctggcattttaccttgatgacgtggtgagtgcaataaaaatatttttatttctatttattattaaaaatataaatttttttagcccaaatttatttaaagttaaaaatcataatcttccgattttttgctttagcttttctgatatgctaacaactctattttaaattatcatattttacattcaaaaatatttttatttccctaaa

SEQ ID NO: 76540 - DNA, 361 bp, Heterodera glycines
  misc_feature (282)..(282): n is a, c, g, or t
  misc_feature (294)..(294): n is a, c, g, or t
  Genomic contig location: Contig_ID=SeqID_12814; Location=912..1272; Strand=+
  SCN-specific regions: Sequence locations=1-63,87-194,216-311
atgcgctttgggttgccagctgtgaagccaatgtttcaaactgtaggaaagatacggtatataatacagtatcaaaatttggcacataaattatatgcacttttaggccgattattctgaatttgagagctcttactaatgaatttgacagattatctgaatcgtattttggcataggcaatgatgagtcatcaccaaataatctccacttaacaaatgaacatgaactgaactacataataacaggtaatgaatgattttgccgaataatttttattgttnaagcgattgctntttcattgctaatacagaaaatttataattcttaaattaaaaaaaacaaaaaaaatttttaaaaata

SEQ ID NO: 76541 - DNA, 2305 bp, Heterodera glycines
  Genomic contig location: Contig_ID=SeqID_12815; Location=208..2512; Strand=+
  SCN-specific regions: Sequence locations=1-102,124-169,193-247,304 -341,367-428,450-515,558-757,779-1106,1129-1151,1173-1910,1956 -2033,2058-2259,2298-2305
atggacggtgtttttatgctacgaatgttgacaattcatgcgggaattttggtgtgtactgaagttgtcgatgcgatgtgggaagactttatcgcgagtaataataaaataaatgaattaaatcataattagctttaaaggcaaattaatacattccaaattttaggcctataaataaaaaaaattttatttgacaaagaaaaacattgaatatctgagactttttgaaaaaaaatcattttagttgttttttatttttatttttaagaaaatgtattaagaaattttatgaaaataaattttgcaaaataacaacctatacaaaattcttttcctattaatttagtttgagattttgaaaattcttttaacaatttaaacatgcattagaaatttcctcactaattttgcgaatttttgtttatggcaaataaatttttttttattttgcccatattttgggtattttattttccagccgtagttggcatttagtcaacataaacactcatcccaatttttatttatgaagataaatttttatttttaattattttgagattatttttttcgtattttgttgatcagatcgtctccaattgcgcaccgcggccaccgaatcgccgccggccgtttcgacgccgcccaaaccgccaccggccgtaatttgttttagcgctcctaaggcgtcttatgctgctactggtggtggtgtcgaatgcgtcaccgcagcaacaaccgcgtccgatccgacaatataccggcgaaagacaagcgtcctggtgccgttgcttagcgctgtgcaagagcagtgccacaaaacggaattcgcacaagatttgccaagacattccgccacatacacagcggcaagcggagcaactttggcagtcgcgtcccggcaaattttggtgccaccgcggaggtagacaacgtaaaatgaacggaatagccagcagggggccgtcctcggcgagttgctctgacgttactcaaaaacctcaaaaaaatgttgattttcttttggccataattttttcaaatttatacgaattttctgaaatttttaaggttcttagaaaaatcattgggctttaagttttatcaaaaattaaaaatataatttttgagcaaggttatgaataattttctgttcaaaaatttcattttgataccagacaatcaattagttcattcctatttttcaaaatttaaattattcagcatatttgaaacctcaaaaagtgataatttagcctaaaatttaaccttttgataatttgaatttttaaacagagaccaatttttgctgaaaactcccaatccgagcgaatatcattcggaacagcgacaagctcttcgccatttaacagtgagcagtgacaacaagccgtcaaatgttgccgccccattagtgccaaaatatcaccaattctcaatgatgtcaaagtgccgacaacgacatttggcgccggcatcgtatggcaaaatcggctgcagaagtcgaagacggacaagcagtagcaatggccaggggggcattgtgccgtcgtggagtgccatgttcggaagcgcattggcaccgttccaaaacagaagtttttcgttgaacagcgccgttgcccaacaactgccatcagaaatccccgaagtctcttcgtgtggagaagaagcatctctagttgaggtgccggctcaatttggcaacatttaattaagcaaaaggggcgtggcgaggccatggcgaaacggacaattagtaccgaaagagcttaagcaagaaaacatctctttttagtctttgtctcttaataggatctattatctatccaaaattcatcaaatttctgatattcaacattgcaaggtttagttttttgtaagttgtttatccccttttaaaacattacattttaaaaactaaaaaacattttatataattttcttattaattaccaatattttttagcattcaaatgttagcagtaaatcaattaaataactcttaatttttctaaatcgttttctaaagttagaagagggagaaagcagcagctgcgtaacaaatcaacgcccaacaaacgatgagaaaaaggaaagtaacgaaactgatggggacgaagaggcaaatgtgccgcgctgttcaacctcaaaatggcacggagaatgtgccaaaaaatgacaaaaccaataacataaaatgccaattcaaattttcaagaaaaatttttagagtgatttattcatgttttttgatgaaaatttattatgcatatgtatagaaatgtaagaaaatgcttattta

SEQ ID NO: 76542 - DNA, 1028 bp, Heterodera glycines
  Genomic contig location: Contig_ID=SeqID_12817; Location=436..1463; Strand=-
  SCN-specific regions: Sequence locations=1-548,571-829,851-940,962 -971,1003-1028
atgcatgaatatataaaccaagccttagctatgcaaaaattagaaattggtatcaaagaacgaaatatatttaaatgtcaagatgcagagattatatccgataccaatttttcggagataaaaagttatcaaaaaaagatagggaattataaatttaatatcaaaatgttgtataatgaaattagagtaactgcagtaagtcatttgtttaggcctgagaaaacaaatattttagtccatttcttacagaaagaaatagagaaatttttctattcgttatttcggcatatctaataaaatcgcaactttttttgcaaaaaaacgaaacattttcgttactaatagaatcgcatgatttttagtgtaatatttgagccttactgcacaaaagaccaaaaagttttgcaagtttgaaggtcatttactaatttcgtttgctgaatttgaactaaattagggttgcgtcagcattacaatgcaaaaagcgactatttaagaaactctaaattttcattactgatatataattttgccttcaaacattagtttatgctattttattttgatttaacatttcttttccacttttagaaatgtccgagcaaaatcaagggtccgatgatgttttgccaatgtgggcggtaccggattttgatgaaatggaccaaatgccgcagcggcaaaaacaaaaaaaatcccaacgttgaaggagtttcggcaccaatggaaggaacgaagacttctgtgggagagggaggaagcagaaaaaaaagaccccaaaacatggaagaagaggaccgatgagatgaagaaaatctgtgaggagagattggagcaatcaaaaggtgcaggcggcagcaacaaacgacaggagccggacacatacactcggaactgggacgaactactgcgccaagaaagagaatatttggacggggggctatggggaaaatgatgagataccccttctccgccctccagctcccctccccctcccgcttctaaatatgttgttgtttttaaataaa

SEQ ID NO: 76543 - DNA, 564 bp, Heterodera glycines
  Genomic contig location: Contig_ID=SeqID_12818; Location=105..668; Strand=+
  SCN-specific regions: Sequence locations=1-301,323-355,386-389,419-564
atgacttactgcagttactctaatttcattgtacaacgttttgatattaaatttataattccctatctttttttgataactttttatctccgaaaaattggtatcggatataatctctgcatcttgacatttaaatatatttcgttctttgataccaatttctaatttttgcatagctaaggcttggtttatatattcatgcataataagccctggtaatttttgaattttatcgatcatttctaagaatgaaaaatataaattttcgatttcaggggcactaaatgccgctatgtagaaatttttcacccgtttaaaaagcatatttgcaaaaatttcgagattatttgatcgtttaattatttttccagaaattttccaatttctcgtaattttgttttttataaaattaatttttggtctattgtcgacatctgggattatagttacttctagtgttatgacatcattcaaaggatagaaaagcgaatataattcttcttttaataggacatgttggaacaaaacctcggctgtgttttcgctagggcatctaagagggca

SEQ ID NO: 76544 - DNA, 453 bp, Heterodera glycines
  Genomic contig location: Contig_ID=SeqID_12818; Location=913..1365; Strand=-
  SCN-specific regions: Sequence locations=1-394,416-453
atgaattctgaaaaatcagaaaaagctaataccattttggtggaagctgcaaaaaaagagacagaaagagcctggagggatgtagctgcgttagcagaagttggcgattttgccaaatcttctcgggaaacgcttaatcgtgcaataaaatctagggaaaaagctccgtatgctaatggtgttcgggaattatatcttaaaatgtcagattcaatttgggaaattttcaaaatcatggaccaaatcaatttggagtcaataaaggctgaatctgcgtggcgtgagttcgaaagatgtaaaacatttgaccaggcaacaaagtttgaggaacaatcgcaaaattcattaattgaagcccgaagattacattttgagtcccgaagggtgcagagccaaatgttaaattatgaaaatagactccaaacaattgtttgggagcatatgggtatataa

SEQ ID NO: 76545 - DNA, 1570 bp, Heterodera glycines
  Genomic contig location: Contig_ID=SeqID_12819; Location=1370..2939; Strand=+
  SCN-specific regions: Sequence locations=1-16,38-96,121-192,214 -323,345-384,406-434,456-697,737-1017,1039-1139,1162-1570
atgttatttaatataatttctttattattgttcttctcatattttgccgaaggtaatttttttcattgatattgataaatgctttttttctatttctattaattaaattatttatattttgtttttgatgaatatagagatacgttatttcaatgttaaatggtcaatttatacatttacaaaaaattggtccaaagtttaaatttcagtcattttaacgagtgatgacgaaaagaattcttttgcatttgacctaaagaagcgacttgaacaatttaaacgaagcaacaaaaatgaaaaagcaaatgagatggaagaaattgaaaataaagtggagagccaaattgaggaagcaattggacttatcaaaaatttgacgaacaatgaaattcaaaggcttcaaaattttaatgaatttggtaatggcaaataggaaaacatattgaaatcaattataaataatctataattgcttttaattttttttttcagcgaaaaactcaatcaaaatttaaaatgtaaaaatgtgagccgtgacaaaaaaaattaaaattttcgctctttagtgatacactttttccaatttaataaggttgatcgttaataattatagaaaaagtaaatcgaaatgccaaaatcaatgaaaaaggtacctagtttagcacaaaagtttgaacacaaatgaatttttatgttgtatatatatatatatattttatttaataacattaattaaggctcaagctactccttcgattctgataatttaccgacaaaagatcatagagcgagcagcaatacttttcatataccaaattgtgggattagaattggcacttctgctgaacataaagcaaagtctagaacgagcaataggaacaacaaaatgttcaacgagttggaacagcaagcggctggcatcaaacaaacattgtcggcacaaaaaactgccaccaatgagcaaccacaaaacactcttagtaacacacgaaaaaagttgctggaactccgagcccgaatggacaaagttggcattaaaccgatgcacaaggcaaactctggcgaagaacgaaaacaatcattgacaattagtccgaccaaatcgccaaaaggcattgttgtggataagcgaaaaattcaaagggacaaaatattaaacaaatggcgatggttgatgggaagtgttgtgttatccatgcaagaattgtacttcaatgccgagaagtcacaaaaatataaaccgattgagcgtcagttgttgagtgaaactttaacgaatctgaaactagcaaaacatgaagcatcgaaagattccgcacaaattcttggactgttatccaatgccaaaaaattctttgatcagtaccaaacacatagaaagaaactccagcaagctcagaaaattggtcatgaacatctttcggaagatgatgacctttaccaaagtgatttgggctcagagaatgaacaagaaaactcgggtaaaaatcaggggttgcctgtggtatttattttccgtaaagaaaaatggatgcttggtgcgataaaagatttcaaaaaagctccgtaa

SEQ ID NO: 76546 - DNA, 1789 bp, Heterodera glycines
  Genomic contig location: Contig_ID=SeqID_12821; Location=235..2023; Strand=-
  SCN-specific regions: Sequence locations=1-57,120-346,369-868,906 -1019,1100-1268,1474-1509,1531-1725,1747-1789
atgtcaatgatcacagatttggaacgacttttggacagttggtattaaaaaggaatcttatttttaataatttattaaaatattttaaaatttctatataaattcaaaatttattttatcagaccaccgtccaactattgtccaaacattgtaccttataagacacgggcatcgccttgatatcattgaggggattgacgggggttggaagaagcaattggaatcgaaaaaggacttagtattgtccaatatatctgatcaagacttgccattatccgaaatgtctgatcaggacgtgccattaacgaaacacggttttgaacaagccaaagagcttggagaatggtaaataattattaaattattatggcaatgtataaattcatgccaaagtgtctcaataagtcatctgaattttgtctaagtggtcaaagagtgttagtctctataaaggcaccggttcgaatcctctccatgcagttcgaaatttcgatagttaaggactaaacctataacagggctgggatcgtccaagcccttttttcaagtacagggatgccaattgccaagtacataacgggtaaaatttgtgaaacacaagtacacatagaattttttcaacacataattaaaaaaatgcgtttttattcaaaggtttgttttggttcgccggaatgaatttttccaatatctttttgtttccactaattagttttctcatttcgcgacattttaggttcaaatcaattccaattgatcaaatttattcgtcgccttttcaacgcacagtcgccacagcaaatggcattttggagggcagaaatggtggcatttatttgaacattgagccgggcctaactgaggtacctttttaaattattttattaaaaccaatttaaatatttcagttctataaaccctgtcaacaaaaaattgaatatttgcatcaaaatgattcgtatcaactttttaaattttccaactcgaaatattcgtctgtatataacaaaaggttaaagaaatttttttcttaattaatacatatttaatacaattataaattagaatatctatttaaatacaaaatattaatataataggttgcttgagcttggaatcatgggacgacctttattaaaacagccaaaagaactggaaaatgaaaaagcaatcaaattggaaaaagaaaaagcaaaagaactggaaaatgaatgcaattctgttgttgagcaaacacttcgtcatattctaaggacaaacaaaaatggttttaaaattatttaatggaaaatttaaaataactatttttaactaatatataaccgtattcttactttttttcttatttaaaaaaataagtaataaattatagttttttaatggaaaattttttttaattcattgaatatttaaatattaaatttattgttttattatataattcctttttttaaatataattaaataaatttagccaaacacgttgtgttagtctcacatcttggcgtcattgctctcattcatgagctgctgagcggtgaatgggttagcgttggacagactactgtaagcaaatttgtacagtatgctgaaaaggacagtcaaaatgtggacgatgaattgaaacgattccgtttggaatactccagcggaatgtctcatctctcagaaacccattatttgcgcccacattgaatccgctgatggattgatgctgctgagtcatttcctaaattcctccatcatgagtttttgaccaaaatttcattagattttttctgacaataaa

SEQ ID NO: 76547 - DNA, 1071 bp, Heterodera glycines
  Genomic contig location: Contig_ID=SeqID_12824; Location=1767..2837; Strand=+
  SCN-specific regions: Sequence locations=1-242,264-440,462-964,1002 -1034,1056-1071
atgaaacgagagcgtaatgtccgccgccttccgcaggatgaaaaaactgtgagagatcataaggcaagaaatttgcaacgcgatgacgttcatccagtggcagaaaagagcgaatgggtgtgcctgcgccaaatgtataagtcgtcccggcctctctctctctgctacattcttaaaaagcataatatttaaattaaattggatataaaattagatttaacaataactgattttttgttaactttcgattttggcatactttgcgtttcaattgtttgcctcgttttccgttatgaaaaaaataataaaccaaaaaattggagctgattaaaacccttcggtagtaaaactcgggaacaaaatggagcagttcgttgttcagttcagggggaagtttggtgttaattttgatgaatttcattagttttgggccaaaagtgttaataaaaggataaaaaggaccaattgggcttctgaaataaatttatgtcaaaacgcaatgaggtgatatttaaattggctaatttagtagtaaaaattcgacttgaacatacttcgttggcacacaaattgacgacgtaagggaaagccattagaatgaaaatgagtaagaaattggcttgagtctagaagaatggaaaatcactttgtgattcatgaaatgattgagttaatcatgtttagctttgatgggacttgcaccggaaagcagatcctggcttttgtgataaagccgaatgttccagaacaattttaggacattcgagtttaatagacccgatgaaaaaaccataggaacccttatcagtttgcaatgttttgtttcttttgcaaaaattatagacaatgtgagctaaaaaaatccaaaccgtagcaatttattgaatatttcacagaatgtatgtagattaaattcatatgttattatgtttgtctaagaaagcagacgtaattatcagttttatttgcaaaaaatattcatttgagaacatggtctgtttgtgtttgtgtgccatttgaatgacggactgccgacctctcattttcttttttgtttgtgagaatgaatga

SEQ ID NO: 76548 - DNA, 706 bp, Heterodera glycines
  Genomic contig location: Contig_ID=SeqID_12826; Location=169..874; Strand=+
  SCN-specific regions: Sequence locations=1-622,664-706
atgacttcactctacgcttgcggaggacttcactctacgcggcggatatacgcggcggaggatttcactctacgcttgcggaggacttcactctacgcttgcggaggacttcactctacgcggcggatatacgcggcggaggatttcactctacgcttgcggaggacttcactctacgcttgcggaggacttcactctacgcggcggagtacttcactctacgcggcggaggacttcattctacgcgacggaggacttcactctacgcggcggaggacttcactctacgcggcggaggacttcattctacgcgacggaggacttcactctacgcggcggaggacttcactctacgcggcggaggacttcactctacgcggcggaggatttcactctacgcttgcggaggacttcactctacgcttgcggaggacttcactctacgcggcggaggactttgtcttcactctacgccagcggaggtacttctctctctttctcgacgcggcggaggacttttcactctacgcctgcggaggtgtatcagcgtgcccggggattgaacttccactgacaaagtcattatccaatacactacacgggccgctgacaaattgcaatgtaaataatatttcaacataatttattataaaaaataattttccccgtttttttaaatgaaatggacaccaatttcacaatatga

SEQ ID NO: 76549 - DNA, 629 bp, Heterodera glycines
  misc_feature (582)..(582): n is a, c, g, or t
  Genomic contig location: Contig_ID=SeqID_12827; Location=31..659; Strand=-
  SCN-specific regions: Sequence locations=1-16,38-66,91-275,322 -443,466-481,528-629
atgtcaaaatttccttcacataaattcaaatttaatattaaaattgagcacacagaatttggtaatgggacaaaatatttcttccatttatattgtgctaaacgcgaatacaacaatttttatgctgaaacaaatttgggtaaaaaagagggacaaatcgaattttgggacggaatttgtgaaaataacatgtacagacttggtgtgattgtcgcgcaaagtacagcaaatcagttgacattcttaattgaggtaattatgaaatatagaaggactaattaattttaaatattaagtgcattaatttatttttatattttaggaagatttttatgtgaacatacaatgccaaagactaatgctgaatgctaatcagcgtgacatcaattatgacctggacattaataaaaatggagcatcaggagcagaaataaaatgttatcaaacaaaggaaagaacagagtcagaaagtaacagaaagatttttagaaaaaatgaatttatttttatttattaaaaattaattaggacgccgaattggagacgatgtagcaggaccaagtgaacaaaaagaattgccanacaaaaaccgagtgccaaaaataacgcaggatttgttggcaaatttt

SEQ ID NO: 76550 - DNA, 982 bp, Heterodera glycines
  Genomic contig location: Contig_ID=SeqID_12828; Location=903..1884; Strand=+
  SCN-specific regions: Sequence locations=1-76,114-200,222-320,343 -396,418-477,505-515,574-589,633-768,790-982
atgaattcttctgcgatggaagtgcaaatcataaaggaatcagaggtaaaaatgaaattttcagatgcgaattttgaattaaaataataattaaaattaaaaatattatttttgattccagttgtatctgcatttcaaggacgagcgtccttgctggccatttattggcttgtccttgacatttggcatgctcgcaactgtggatttttattttgccctcattcaaatcgtcaatcacaatttggtttggcttggttatctcggccattccactggtgatcggtgcgatttcaaatgctccgattttatactagactaggtaaataaatagatttaaaaaattgcctaaatggcattcatattcatccattttatcagcagccaacatatttaaattagaagctataaatttttaatttaatcgaaatttcgaattttcagcgtcaaaaatcctaaaaataggtttataaaaatcagtaattttataaatttaataaataaaaaggaggaatagcatttaaaaattagttcatataaatttatgaaataataaattacctaataaattaattactgcgtttaaataagcaaaaaatctaaaaaaaaaaatccatttataattttaattaaatctaaatacttcaataattaatggaaacactttccagtaatgccgaatttgtgacatcaatttagatccataaaataaaattttttctttttttagttcgcactatcgcgagacatttgctgttgaattgaagaaattttcttctcttattggacttggcaacttatctcttggcaacaataccatcagcgctagtggtcaattatttcaaacgccagcaattcaactaattagtagtgctaattagcacgctaattaattgcacaacagagccacataaaacagaattaattacattgacatttaacaaccaattaaggaagacattcaaattttgtcatttatgtataa

SEQ ID NO: 76551 - DNA, 2060 bp, Heterodera glycines
  Genomic contig location: Contig_ID=SeqID_12829; Location=31..2090; Strand=-
  SCN-specific regions: Sequence locations=1-55,78-198,221-405,427 -489,511-793,831-877,899-1305,1496-1906,1935-2060
  Gene Ontology: Mol. function=myosin light chain kinase activity
aaaatttcataacattgaaacgcttacatgagcaaaatttgtcaatatatgaagcaatagaaatgattaaattatttcaagacaaagctggagaagacccgaaaggagttttcaacacgtcaaaaattattacggattcggcacataatattaggcaagaattcccttcaggcaatacaacgacgagtgaaaaaggtcgaaaaattgcattttggcaattctttcaacacattacaccaaatttgatgagaatgttagacaataatgcagcactctatatgagcatcgatgagaacaaacttctaaagaatgttataaaaaatgtgaaaaatgaaatagataaaaattttgtggaaatgtgagtgattttttttggattggaatgaattttaattggcatacctatactgtttttaaagcaattttcgattttcagattgaaagaaaagatacagaacgttgaattccatcacagtgcaatcgagggagaaattgcaaaatacataaaagaggaggttgatgctaaaaagaattgtgatgaacaattaaaggctcattattggtcaatgtgagttaattggttttcatgggactctatttttaattgtttattaaggcttgacgcaaaagaattagatgcggattcgtatctgaaagatattgaaaacgattttatacagattgccaatgataaagaaagtgaaaagaaaaaaatagagggatattttgaaggactgtgagtggtttgaacaaattttaatttatgattttgagttctctgtcctcttttcccatatttaatttaatatgttaataaaatttatttatttgcattttaaggcgaagaaaatgggatgatgtcatttcaaaagaggcaaaaattgaacttatgaaaaatattcgatatgatttggcaataaatttcgaattcaacccgagcaaaggtgagaaaatacacagcaaatgagcagggctgctcgaaatctgtctggaagaattaaaaaaaatttcagcttaataaccgaattttttcaattttccagagaatatacggttgatgtccaatttttaggcccacaattctttaccattaaaacagaaaaaatttattaagatatccatgaccgagtcaaatcaatggattttgatgaaaaactcaatgatgtgcgtcaaatttcttcattcgtatcgaatgaacattatttacccatcatagtaaatttgtccaaaattgaaattgtcaactataaatatgacactaaaacagcactggaaaagctacgagaattggtggacggaaccattaaagaacaagaaaatgaattggagaaggcaaacaaagaaaaaaaagggatagaatggaaaaaatgggaaactgatcgggaaaaacaaaaaacatcaaaagaatttgaagaaaacactaaggcatctgaagaaaacgacaagaaaaagcaaacattggaaacgaataaaaaagaaatggaaaatgaaaagagcaaaatggtagcaacaaataaagaatttatagcagtgatagaaaaaataaaaaacaaagaaacaattacagcggaagataaaaaagctctgcaaaatttgtgtgcattcaccaaatggtacataaatcataatggaacaattaacggaattgcaacgaaattggagcaaacgatcagcgaacaaaagaagaagcagcctaatctagaaaaaaagttacatcttaaaacaaaggaagaaaaacagttggaacaagtgaaaaacatccagcaaaaattgaagggcattgtggacaaaattggtggaattgaaaaaagttcaggaacgaatttgtgggaattttgtgctgaggaagaaagtggaaaagaaaaaaaggtggatgaacaaaataaagaaataattgagacaaatgcatcatcatcatcatcatcatcattatcggagccgaagcaaaaaaagagcaaaacgaaaaaagaggggacggcggacggaggaaaaaagagaacacatttattggataaatttggcggaatactacatcatgaagaaacggctgaagaaaagct

SEQ ID NO: 76552 - DNA, 926 bp, Heterodera glycines
  Genomic contig location: Contig_ID=SeqID_12830; Location=941..1866; Strand=+
  SCN-specific regions: Sequence locations=1-118,140-176,198-368,394 -681,704-896,919-926
atgtcgtttagaagtcatccttggattctcaaccaagaatttgaaagaaaagcaactaacaatgagtctgaagctttggatgcgacgaggcgttgcgccagtcatttggggccgcacctaaacaacaaaagcataaaaaaggaagtgggaaatgtaattccatcaaaacttaaggcaaaacaaaaaatgcattgctaatttttgttgttttgcgacaaaagccaaaataaaaggaatgaataaaacacaatgccagggcgtggatagagcttttttcgttttataagttctgcaagaaaaacttttttccctccaacatcaaaaaaaaaaaatttgtccaaattttcaatattttagacgggtaccactttaaaaaaccccaaaaatggcacatacaatggccccgcgaatggtctgcatggactgctccgccgcgtccgcatcggccgtgtcggtggtgcgcccgtgctcctgcatgccgcggtgccggtacgtcactgtgccctccatgtcgcccttcaaatagcgcacacccaacgtcatgttcttctcgcgcagcgcggacaacagttgccaagtgtcgaaaatgccctcattttcgaggcctgaaatacccattgaagcaactatttgcgccaaaattctttaaaaaaatttcaaacggcgcctttcgactcccccttatttttcctcaaaaatgtccttttctttttttttggattaactttgctagtaaccatttgctcgagaattttttcttcggctgcacttaccccgagccttactatttaatttttttaatattcctgcaaaaagcaatttaaaaatgctttttttgggtccaaaatcctatttttgacttattctatttttatctggaaaaaattgcgagcactgacttttcataataatttgcaaaattgcaa

SEQ ID NO: 76553 - DNA, 2514 bp, Heterodera glycines
  Genomic contig location: Contig_ID=SeqID_1880; Location=98..2611; Strand=-
  SCN-specific regions: Sequence locations=1-108,132-354,384-730,786 -848,872-930,952-1346,1399-1442,1464-1821,1843-1905,1927-1948,1970 -2021,2043-2428,2500-2514
atggtcaaaatttccgatttttccccggcggcgcctatcggcaccgtcatgccccgagaacttctatttattcaaagaaaaatggcccaaaatcgcaaaatttggtaattttttggagaaaatctgttaacaaaatacactcaaattttcaaaatctgttcccagcggcgcctataggcaccgcgggaccccaaaaactcgtatttttcacagaaaaattgtccaaaaattgaaaatttgaacatttttagtgaaaatctattaacaaattgtattaaaaaattttcccggcggcgtctaccggcgccgcctgcccccacttcccaaaattttttttgaaaaaacgcgccgcaaaaaagctttttattttgaaatagaattttacaaaatgctttatgattttgactattaaaaaagttgtagaaaaatttcgcgtttcgcaatttcgcgttttttggaatttcgcgtttcgcatttattttcatttcgcattttttactttcgcaaatttcgcgtttcgcattttattttccgatttggcccatccctgttccctaggcaaaaattgatcatgaatttccgtttagcatttccttcaccacgactttggcccccggtctgactcttgtttttttggaccattagcatcagagcatcactaattgggcgggggggggggggacgtacgacgccgactgacccaatttgtcatcataacttttttcttctcatcaattaaatccaataaatttgaagtcattcgaatgtttttcttgttttaatttatccttaagctatgtaaaaaaactgaacgaccgaccaactgcggaggctttttgatttggttgataaagaaaaaattattatttaaacaatagattttctcacagttattcccgcctctccagttattaggcgagcataccatcactataaatatgtaattaagaagcacacaaaaaattggtgtaaaaaaagagaattggtcaatttgctgttaattaattataaggcgcatcctttgatctgttttgaaactgaataaaaaagtcaattaaatgtaccaaagtgatcagatagaaagagaataaatttgctaaagtttgtccctttttccattgatgagtcatcggatgaacaatttcgatgtaccatttgattttttcagtaccaaaatacgaaaaaaaaaattttttttgcccaattttaaggtgaaatacttaatatttttcacttttattttttgcctaaaaataccgccccgggccgccggtcaaaggcgacatgaagtttgggcaccagaaatttgggcaccgggaagtttgggcaccagaaggagggatttcaaaaaaataaaacaaaaaaatatgtaaaatgttaataaatcattaaaatttagtaacctttaacaaaccttgtgcttaaaaacttgtattttcttgaaaattaaaaaatttaagtatggaaacctggcaatcttatttcgttaattcgtatatgtttaaacgtagagttaaacgtgtactagtttctgtttggacttagacctgaatacccggcttattgttagttgggcccaaaatatcaagagacccgtctaatttgggaaaaatagggttcggaccccgtgggcgggggcagcttttcgcgggggcgggggattgcgggggtcagagtcgcgggggcgggggtgagaaatttctcgcccccggggacgggggcgggggtttgtttttaattagctccaaaaaatctcacaaaaaattttttttgaaagatgtgtttggctccacattcctttattcgatatatcgcctcgattcaattcttttttggtataattgcacagatattgtctaaaaatgaccaaatttaaggattaaaattatgccagaatagtcaatttttatgggtgtttttgtctaaatccagggtttctatttcaaaattttcaaaataagaataaaggccaaaaaataagattttagggtcaaaaataagaacattttgcaaaattgcttcaaatatttttacattttattcgatcaaaaatgtattctattattatatttttcataaatttcagtgcattcgggatcactaaatcagatttttaacattttttgcggcacatttcaaaaaacttggtgaatgtgcgaggggagaggccggtagcgccgattggcgccgcaagcggaaaatttttaagactttatatgaattttgttagaaattagtcaatttttttttagaaatttcctttttttagatgagaataaggtacaaccccaaaaccagaacatttcttagaaataacaacatagaaaaaccctgcattatttggaaaaaaaatcaaaagaaaacgtaaacgcggtgtcgaactcataacaaaaagtatggttaatgttgaagaactaaccactaaaccataaatattttaaaaaacataagcaaatttactttatttcataaaaatttgtaaaaaattgttaaaaaattcgaaccctaaataaa

SEQ ID NO: 76554 - DNA, 695 bp, Heterodera glycines
  Genomic contig location: Contig_ID=SeqID_1882; Location=295..989; Strand=-
  SCN-specific regions: Sequence locations=1-108,142-146,171-431,469 -575,616-695
atggcaaatcatttcaatcgtcaaccgttgctgctgtgcgttctgtcgctgtttgtactgctccaactgctcgctgtgctccgtccgccggccatcgatgccacggggctgcccagcggtggcggctgctgctgctgccagcaacaggcggcgccgccgccgcccccgcctcagcagagttgctgctgctgcggaggtggaggaggaggccgcaggaagcgccagctgttcagcgggctggccgagctggagaagtacgtggcggagcaggaacagcgcatgtactgttgcggggcaacgggacgaaaacgacggcacacgggacagccggtgggcaatttgacaaattaaaaaacaaataatttaaaaaagggtaattaatagctttgacatttaaaggtgccaaaatggagcataacttttatttaggcaaaatattttttaatcaaaaaaaaattttttaattttgtttgcctttttaggtttcgagaagagtcgaattttggggaggaagcgcactgagttcgctgatgtaccattgacaggagagcacagcataaataacgccttttagctttttttaatttattttttcttttttatttgattatttttgtagttttagtttcggcttttacttttttaatagcaaatttgttgttgctaatgcccatatacaaaacgaatgaaataaa

SEQ ID NO: 76555 - DNA, 527 bp, Heterodera glycines
  Genomic contig location: Contig_ID=SeqID_1882; Location=1877..2403; Strand=-
  SCN-specific regions: Sequence locations=1-144,166-197,241-491,526-527
atgaaggtaaaaactagggtaagactggaccggtttaaaattgtgccacgcttattggatgcaacccgttttgccacacttggttaccaccggtatttctttttgtcgttaaccgaccgattactgctttacgatgacatgcaatagattattttttaattcatgacaaataaaattcagattttgactccaaattcaattttttaaatgtttttttattttaaaaaatattttatttttccttttcgtagcatttttatattacggtacgctattttccaaaaaaaaaataaaagttctgactgaataaggggcaagcaagggccaagtgcaggcgccgatagggaaactcggtatttttgaaatttattttaaattcatacttttcgaaaattattccaacatgtactaaattcaaatacataatcctgtagatatgtttaattttcagattgtgtatcttaaattcaaggccaataggaaaaatcaggattttttaaacaatttaaattaatttggaaaataaa

SEQ ID NO: 76556 - DNA, 1346 bp, Heterodera glycines
  Genomic contig location: Contig_ID=SeqID_1884; Location=700..2045; Strand=+
  SCN-specific regions: Sequence locations=1-1346
atgatgaatcgtcaaattgatacaaaaaagcaaaagcctaaaattacctatgaaggccagctttacaccttcgataaatcaagtgcggacggaacgagaaaattttggagatgcgaatacaagaactcctgcaaagggagaatttggacggatttggacgatcaattcattcgtttggcaactcctcatacctgtccagtgaacgcagcaaatgttgaggcgcagaaagtgaagacggcaataaaacgacgagcactcaccacgttagaaccgccagcagtgatccgatccgaagcacttcagaatgtgccatctccagctggacttttggttacgcaggatgcttcaaaactggtactgtttagtcgatgatatgaaaagcaatcacgaaagaaatcttaaggtaattaaaagggcacggcacgaagtcaatgcaccacctgcggttccacaaagcgttgaccagctgattgttcctcccgcttaccagacgtacgagtcaactgacggcgaagtggagcagtttctgttggctgactctggtgtgtattacgaggccggaaacgaaaatgccacgtttcctgcatgcgaaatccaattttgcttcttccatttcgtgcggaatttgcaaaaaaaaaatcaaggaacaaaatctctggcaggtcagtaagcatattcagtttgtttttgtaattttcgtgtctattcagagatactgtactgacacagtgttggctgagaatctgaggatgctcacttctgtcgcgtttctaccgctgagtgacatcaggacagctgtcatcgcattagacacggagtttgggaacgtcgcggcactccgaccgctcattgactggttggtctcatcattatcagaagtgtacttcaatttttgtgcaatttttaggttgctcaacaattacattggacaaccgcggccaaatgggacttggtctcaaccactcttcccaccagaacaatggaacgtctacactcgaactctgaatggagaagcaaggacgaacaactacgcagaggcagaacaccaccgtcttcaaggcgccttcaattgccgtcatccatcgatctggcacttcattgacgttctccgccgtgagcagaagggcaccaatgggaagtatgcgtcatttattgctggacttgagccaccgaagaaagctaagaaataccaagcggctgacgagcgcatctttaatttggtgcagaattataatccggtgaatccaaactatgacaatgatcacaattaccacataaatcacaatcatcatatcattttggaatttcttcgtggcatttcgcgcaattatcatatgaacccgtga

SEQ ID NO: 76557 - DNA, 2051 bp, Heterodera glycines
  Genomic contig location: Contig_ID=SeqID_12831; Location=737..2787; Strand=+
  SCN-specific regions: Sequence locations=1-81,103-265,287-853,875 -1601,1624-1727,1749-2051
atgccaagtgagtcgaaaaagcgtgcaatttgttgctggagatcaaccaacgcgggcggcccctcgggcatggccgaacgaacattgacaaacgggttgaagcgggaaaccaacctgaaaatcatgatcagtcaatcgttagtacgacttgcaatttccgattttatatttatggttacgatatgttaacggtattgcatgtacgtctgtttattcatggactgtttggttactgtatttctctgtgcccgcgctgattactatgtcatatttagaaaataataattgccgtgggtttagtttctaattaggtcctctaccatacccggtggcattttcgatcatttttttcttaagtacatcaatcaccgactcggtgttttgcgcgttgatccgtgcaatagagcgtcgagccctctcaaaaatctgcatatatcgctccaattcgcgtagattatttaggctttcattcagcagccctgttgttgtggcaaaggaatcccgtcgactaactgtctgaatcggggcgttaaatggctggctcaacagcattaattaagtttagccattcattacattgaaaaatcaggcatttggttttgtggtcttaccacatcctattgcggctcccggtaaattggacaccagaaaattggacaccgaaaattggacaccgaaaattggacaccgaaaattggacaccaatggaaaaatggacaccagaaaattggacactgttgtaaataaaaatgaaaataaacaaaataaattactaaacaaaaattttggcttggcctaaaagatctttatcttaatctgccatatgttgtttataagcgtaaataatatggaaatgaatttgttattatttttgtaacttcaggagaagaaaaacatcatatcattcataaagaaataagttttattactcatttctggtgcattttttggcccattgatcaatcgtcacccatttctggtgcattttttggcccattgatcaatcgtcacccatttctggtgcattttttggcacattgatcaatcgtcccccatttttggttcaatcttagtgtccaattttccggtgtccaattttcctttattgtccaaaattccggcggtgtccatttttccgcttggtgtccaattttctggtgtccaattttccggtgtccaatttaccggtccccaggggacaaattcggacaaaattttcattcattctaacctttttttcattttcagggaaagaaagcggataaaaaaggtgaacgacagcagcagaggatttcttttttataatgtgagaggggaaagccactacaaattgctgtcatcaaaaagtggcatgatttgactgaaccaatcctctaacattttcattactaagtgccgaaggttttctgaattttagagattacctggcaaaatcccgggaaattgtctctcgtatctctaaaacaaaaaactgaatttttaaatgttacagcaaagaatggcgctggtcaggcgaactcgggcgaacgcagcaaattggataagtcaaccgcccgcggcgtcgggaacggatcaccgaaagaagcaggtaaaaggagagagaggggtggaggagaaatgagatttgtttgcgagtttaattttcccttttcagccgtcccggccaccacgccacagccagcagcaggagaagcgagtggtgagagagaatggggagacgaaaacggcaaattcattatttcttttgttcgttcagcaaatgccgcggcgaaagcggaggtttcacagcgcaaaaaggaaaagccggacattttcatcacgaagaaattgcctgagaacaagaagcgcgaattcgtttcaggtagagcgaagcaaggaatacgaataggcgaatttttgcaaaattccgttcgttttcaggcaaaaacccggactacgagacgctcaagcagttggacatgcaaatcttcctcaaaaagaaactgtcgggaacgcaggcgaggccgcacgacttccaatcgcaagtgtcgtcgcaacaatcggccatgtag

SEQ ID NO: 76558 - DNA, 1041 bp, Heterodera glycines
  Genomic contig location: Contig_ID=SeqID_12832; Location=1..1041; Strand=+
  SCN-specific regions: Sequence locations=1-468,490-757,781-1041
  Gene Ontology: Mol. function=guanylate kinase activity; Cellular component=apical cortex; Biological process=regulation of synapse
aagttaattggcatttgttcgcttttagttaattacgttcgcccggtcattgtgctcggggctttgaaggatcgcataaatgacgaattggtcagtcgacaccccgacagattcagcagctgtgtgccacgtaatgggccatcttttccctaattagcatcgtacaattccgtcactaattgtctctcttcagatacttctcgcccaccgcgggaaggcgaagtgcacgggtaatttgcgacaattaattggatttgctttcttcgattcatttcaatttattctccagacgcaattattatttcgttacgaaggccgaaatggagagggacgtgaagagcaaccttttcattgaagcgggccaattccaaaacaatttgtacgggacgagcgtagcggcggtgatggaagtggccgaatctgtacgtttttggaggaattgtcaaatttcggcatttctcgactttgttttactttttcttttggcttaagggaaggcattgcattttggacgtttccggcaatgcgatacggcgactgcaaaacacagcccatatttatccagtttcggttttcgttaagccgcttaattaccaacaattacggtaagaaaaggacgggcgatcattgggtactgtatccggtaacactgattgtgaggctaattgtaaggctggttgagcccattaaacttggtctcacggggtttgggttcgctggtcacaaattcctcccattacggtcaatccctaacagcgaattcgaattctaacaaaagtcagtgccaccaacattttcccctgctgggcttccctttttatatccgcctaatttattgtaatttccttcagagaatgggactctttgctcagtgaagaagatgccctgaagcaatttgaacggtgtcaacgccaagaacaaaacttcggggatttgttcaccggtaaatgccggccactagtaggatgggatttatttttatttaaaatcacgaaatatttaaataaacataatcccgtccctaagtaattagtgttgcca

SEQ ID NO: 76559 - DNA, 1461 bp, Heterodera glycines
  Genomic contig location: Contig_ID=SeqID_12833; Location=123..1583; Strand=-
  SCN-specific regions: Sequence locations=1-100,123-1373,1396 -1423,1445-1461
atgcaactgcaaattgcattagcactttcaaaggaagaatgtgaaaaggaacgtgaactccgtcgaggtgatgacatccgcttgcaagtaaatgagtttaatttttaccatttactaatattatgctattttaatactcaactttgatatacagattttgatttttaataaagtttgaaattatagttaaatatattaatcgaggcataattcagtcagactggtcgagcaaattcattaattttagatcgcaattgaagagagcaagcgtgaattggctcgttcttcaagtctttcgtctccgtctggtggaattgaccctgtcgaaaaacagggcacctccaagtcgcacggagctttggatgatttgctttcattgggactggatgacgtgttcaggagtaatattccaaatgcgactgcgccgggtagttctgcacaaacacaacaacagccacctcaactgggcgttttcaacgacccctggtcgccacggccttccacaactattccaatggttgaaactgcgccgcctgtctccgctcaccagacaagtattttgtccattctcttttgagcatttctcttcccacacagttattcaaaacgacccatgggcacctgcggcttcttcctcggatccaagctttgtgtcctttggttcttcgtcgacgactcgaacaataaatcccgatgggggccacgttctcggtcctctcatgcagtcatcttcaaccaaaaatgacccatgggcatcatttgaaacacaaagttttgctgcatccgaaccaacgaaacaatcatcggatgatttctttggaaacattggtgaacctgcacaaacgacgaaccaaccgacaagtcagggacagcaaagagccggtgtaaagacacccgagtcctttcttggaggttttcaaaagttgcttttgcctaatacaattgcaatttaagagaattctgctcttgttaatcttgataatctgcttgggccttccaaccattcgactattgcccctaaaaaaggtgattatttcttgtttcgtgccataaaattgttcacattcaaccctttcagcgactaatccgtttttggtcggttcatcaacgactgccatgaccaataacaaaaataatccattttcaaccaatgaaaggccgagcccatcactaaatgaaatgatgcaagcaaaaaacggtggaggagcgtactgatcattttcctctatttatgttcaaattctaagagccaccccttcctaaatattcttgtcatgcggactcacattttggagtctgctctaattttcccccgttcataagcacatctattcgtgatttcttacttaaataattgtactgacccaaattttaaatccttattaatggaaaagtgatattcatgataaaaccccgcattctgttgtttttatgtatttatatagggacaaatgaaataaa

SEQ ID NO: 76560 - DNA, 1211 bp, Heterodera glycines
  Genomic contig location: Contig_ID=SeqID_12834; Location=481..1691; Strand=+
  SCN-specific regions: Sequence locations=1-102,125-633,655-829,853 -932,955-1043,1065-1211
gtgtattttcttcaaatgtttcatattttcttcgtcaatcgtggttatatgcttgttttggagccacctgctcttggttccgtttacgatttgcagaagtgagtttatttatttggctgcttctgtattccttcctttaggtgtatcgctgattccataaacattgatataaatgagcaggtctgatcgtttttttaatcaaatatccctcatttttgattcagtaccttttcctctctggtggtgcttctatcaatcgcaatgcgatgctttctgcaatttctgacgtgggaaccgatacgaacccgatatttctcgttcgtcgaatcactaatacccaatcagaacctaccaaaacaaattctgacggaattaatgagatataccaaggtagagaatctcagtgtgttcatacattcttcctattttcagattgggagatttccatggatcgtatgttgggaattgtgcccacaaattcgccctctgcaattagtgaatgtgtcgaccttggcaaaaagtgcgctcaactcgctgaaaatattgttcgcttttgtaacaacgtgctaattgagcatcaatttctatatcaggtcagaaatgctttttagttttgaatgagaattttaattattttcttcttcaaaatgcaattgtactattttttaaattttcggctccattaatgcaatattccggaatccaattgtgttgattgaatacacaataaatttttaaaaacttacatttaatacttaagggttggatgtctgtgatctcaaatttggatgaaaatattctgcgtattcaacgtcgtttggacaaatcaattggacaagcagaaaaattggagacatttcggcaaaacggacgctctctgttgaatgggtttgacaaaatcttggaaactttaaagaaagtgcgtcttcttttttgttatggtgttcttccatccttaaggctttgttaagattgtgcttcccccttcgcttctttctcttggccattcttccacaaatttatccgattctgatggatctgctgaagaaataacacttttcgattggatttcgtcaaaagacccggcctactcgctcagctctttttcgcaacatgtgctcgatcacttgggaaaaacgacggacgaagagctaagagaggcgcaacatttgttggctatggtccaagatgtgtcgcaaaaacctcagtaa

SEQ ID NO: 76561 - DNA, 736 bp, Heterodera glycines
  Genomic contig location: Contig_ID=SeqID_12835; Location=363..1098; Strand=-
  SCN-specific regions: Sequence locations=1-563,585-686,715-736
atggagaataaatttattcttgttccttccgacttgtacaaaaatttactaaaaccagacgccggagaaattaatgttgataatgctaaaaataaattgtcatcacttttgaagcagagaaaattagacgctacttcaaaaaatttactttataaccaggaattgaggcgtttcttgaaactaaggaaggaaattgaagacaaacccgtaaaggttgagctttcagatggctcattaatggtgtttaaaccaaaacagcgtgaaagagatagcaaaattcctactcaaattgttaatgacgaaggattggatgaaacaggctctattccaacacttgaagacccttacactactgctgaagagagtgatgctgagtcaacaacatcaacaccaaagacgagaccactgataaaaccaatgcgtgttgggacaagtaaatttcgtcaaaaacaaaagtcttttgtagtcaagaaaaaaggaaaaattatgtcaattataaataatgaccctgagaaatttggggttggctatagaggacatatactgagagctgatggaacggcatatttaaaaagtaatgttaatcaagcattagagcgaatattgagacggtcacccgagaatgctccatcacccataggtacaaaagctttagagcaacgactgagaaacgacccgaggactagtggaatattaaaacaaaaatttaatgaacaatcgggatcgggcgttaaaa

SEQ ID NO: 76562 - DNA, 1315 bp, Heterodera glycines
  Genomic contig location: Contig_ID=SeqID_12835; Location=1178..2492; Strand=-
  SCN-specific regions: Sequence locations=1-375,414-712,734-1032,1054 -1087,1109-1115,1137-1142,1167-1172,1194-1315
atgtcttctacttcttcaaagaagactctccaatctgtagtggagcaagtaattcaacaagacgcagaaataaaaagcagtgagaaaccactaaaacagaatgagttggaaaagagtgaacggaaatcaacccacaccgtatataacttgcttgaccacaaacaatccttttggaaattggcccggccaaagtttgcagtgatcaactttctctgcccagggtgtcgtcgaatcaactataagcacaaggaccagttcaagttgatgggagaagatgagttccactttacacaagtgatgtgtcccggttgcgtaaagtacaatatgatgcagactgatatctataacaaacacacaaagaacccccactaattgtatttaagattaaaatttaacattatataattaataaagatgattgatgaaaaattttttcacttgaacgatttgaaattaaaattgccttttggtatggtaattagtggaccatccagtagcggtaaaacaacatttttactaaaatttttgagagaaagagatgaattgattagcccacacccaaaatcagtgctttattgttatggtcaatttaatgatagtattcctgtactacaaaaaatgggagtgcatgtgcacaaaggacctcctagggacgaattgctgagctctctaaagaagcctctcttattaattctagatgaccttttaacaataattgatgagaaaactctatccgaattattcattaaaaaagctcatcatcttaatatgggtgtgattttcataacacaaaatttgttcgagagaaaggtgaaggtagcccgaattaattcacaatatattgttttaatgtctgctccgaatgccgcgctacaaatacgtaatttgggtgttcaactgtttccaaaaaatcttgcatttttcctaagtgcgtataaagatgccactttatcaccttatgggtatttatttttggatttacacccggcatcgacccctttactgagaatacggacgaggatatttaaagaagatgaagaaaaagcattgtatattcaaaatgattaatttacctaaaaatgttattcaaaacttggattttttaaagaaattggtaaaaacaaagtcttttaaaaagagacaacaaatatttaaagaagcgactagtgaacaaattgcattattaattgaaattagttataatatattaaaggggtactttccgctcacgaagagacaaaaatatagacttttaccatacgcaaattttgtgagaaaattaggaagagttagaactgagaaaggtgtaaataaa

SEQ ID NO: 76563 - DNA, 819 bp, Heterodera glycines
  Genomic contig location: Contig_ID=SeqID_12835; Location=2600..3418; Strand=-
  SCN-specific regions: Sequence locations=1-484,509-576,600-819
cttttgttccaaatcttgtggttcaccccgaggacaacgacccactcccgacaggaaagggacatctcggtgagctgactgacgaaaagccggacaacattttggagttcatcagcgctggctgcaaaaactacggctgaagttggaacgtaaggacaatgggtaaattgagtacgacttgaagataagggggataacactggatgaacaaactgtgcaaactatccattatgacagtgtgaaagatcaaattatgcgttatgggtccgatgaccccgcggaccccattattgtaacatacccccattttattcgtcctaaccttatccaaggcaaagtgtacactcaatctctaactaagcattatcaacctgtcttcacaaaaggcattattaataacgccttccaagtcctcgaatttggttatcgcaaatgataagtatgcattctcaattaaattttctgtatattagttttcttattgttcccttcttttctttctctctgtttatatcactcatgtgggacggaatgacccctggttgatcctctccaacactccaggccatccatctgagatgaaggtggacgagctgttcattattgtaatgcacagcctggtgcgtgagtgtttggattggggaccgaagggtgaagccgttccctgggtgtgtttgctcacttttttcaaagggaactctaagaattctgatatgccttcaaatctatcaaaagagttgcatactttctttttatcatttctctttattttctattttacacttgtatttttcatttgaatgtttattcagaaataaa

SEQ ID NO: 76564 - DNA, 556 bp, Heterodera glycines
  Genomic contig location: Contig_ID=SeqID_12835; Location=2818..3373; Strand=+
  SCN-specific regions: Sequence locations=1-2,26-93,118-556
atgaacagctcgtccaccttcatctcagatggatggcctggagtgttggagaggatcaaccaggggtcattccgtcccacatgagtgatataaacagagagaaagaaaagaagggaacaataagaaaactaatatacagaaaatttaattgagaatgcatacttatcatttgcgataaccaaattcgaggacttggaaggcgttattaataatgccttttgtgaagacaggttgataatgcttagttagagattgagtgtacactttgccttggataaggttaggacgaataaaatgggggtatgttacaataatggggtccgcggggtcatcggacccataacgcataatttgatctttcacactgtcataatggatagtttgcacagtttgttcatccagtgttatcccccttatcttcaagtcgtactcaatttacccattgtccttacgttccaacttcagccgtagtttttgcagccagcgctgatgaactccaaaatgttgtccggcttttcgtcagtcagctcaccgagatgtccctttcctgtcggga

SEQ ID NO: 76565 - DNA, 2520 bp, Heterodera glycines
  Genomic contig location: Contig_ID=SeqID_12836; Location=223..2742; Strand=+
  SCN-specific regions: Sequence locations=1-494,516-1278,1300 -1480,1502-1553,1596-2260,2282-2308,2331-2496,2519-2520
atggaccccttccccctgttccgaatgctcatcggaggcccatggatcctagtggcgatcggggccggagccgtcggactgctcgccttatatttgtatatcaaattcaacccagcttttcgcatttatcggtcgctgatcacggttatcatcctcctcgggttggtcggcagcggagaaagtgggcaaattccaccaaacaccgactccgtcagcttagcaggggctcaagccccttttgccttcattccaatcggcgggattttagtgcttggcttggcactcattcgtctcacaactccacgccgacgcccgacaattatcatttttccgccctcccccctggtcttttccatttttcttctctccccactacagctcggagttctctgcccaaaaggggaccaatcagcaaaggggtacccccctgagcgagggggcggagcgacggcgcccggcgcaacacccctccaacgtctatttaatacagcggtccagagaagaatttcacttccttccacatttaccccccattcactctcttattgtcattccctttgtgaaccgagtatgactgacgacttcgcaaatggcgggttcggcgactgcaacgacgactttggtgggggcggaggtggggaagtttcccctcgggcacaggcggggagagatgcgcagcggcgaaggagcctcagcaaccattccgagctgggcgcacacggtcggccgatggcacgttgcaaaagcctggggcgcccaaagccccttccgcccaaatcagagcgccgttgcgtcgcggacgatgtcaacttgttcgccggcgagaactggggagacgacccttggcaacgggtggaggtcgaacgcttctttcgggagcaggaggcccggggaaagcgaatgatccacgagcggacgggcgaacaggtcccctttccatcaactttgggccttttgcccgctaatcggcaggaaattgccccggggtggacggtcgctgactatttcgctgaaacgaggtgccggtccctcaaatggcctcaatggccatgcatttattcgcccggaggtgtgattgggagttcgaagcgcagtaggactcttcagcaaaaggggcatgtcccctggcgtctaggccagacgcattgtgattggcacccgctggaggaattgtggtggacaacgcagtccgaattggactcggaatgcgatggcgcgccgatgacgagagaaagagcgcgggcggacagcacagaaagagtggcgcagccggcgggtcgttggggaatctctcccccaaattggccgacgaaaggagcacttcatcgaatcgatgccatcaacaacggccgccctccacgcccctgccattcaatttggggccgaagtccatcaccccgccctgtctcccctcccaagcacctcccaccaactgaagacaccattcattcacatcactttcattgccatcaaactctttctcatcaggggactttcccctccgatcgttcggaattggccttctccaaaaccccatcccttcttagatcgtactcttcctcctcctccttttgttctttctccaccttctcatcaaaaatgtaccgcagccgtgacacggaacgttcgtcggggcgcacggctcgacgtctgcgcctcttggaattgacggccgccgaactcgcccgaggagagttcgaccataatcgcatggtccagcagcatggtggaaacgctgaccgcgtcctggccgccgccgaccacttgacagaactgcgcgggaaattttcccgcaactggtcgaagtgccacgacattcctgggaaggaccgtcttcgacaccgcttcgatgtggaccgttggttggtagtggcgccgagcaatgccggagaaaacggtgggcaaaacgacgggcaatcccgaggaaaaatgcgttcggtggtggtggttgtgccgcccacctcgccaccagtgggggggagtacgcctgggaccgtggcgaaaaagcacccgccgacatcaccaaaaaggggcctgtcccctagtgcgctcccaggcccatcaaataggggcctgccccctctgtccccgactgtcgccattgccaagccggtcgaggagatcactcaagtcgccgaacttttgggcaaggtcggcgacgaaatgaaccgaagaatggcggaggacgaggagcgatcggcgacggggggcgaactcttgtccctcccatcggaagacgaagtggtgccggagacgccgacgccctcgtcgccccgcgccgggagtgtcgcaaaaaaaattagcgacgagaatggcagaggaaagaaaggagtgagcgccctccaccgagggccgggaatcacgggtcagggctgtttggtgttcaacgccaacgacgggactcctcgagagctatcgtcggatgatgaagaccgttttgggggaggcgctcgggaccattttgatccgatcggaatgtgttggacacttcttcccattttatttttctctcacttttaa

SEQ ID NO: 76566 - DNA, 1206 bp, Heterodera glycines
  Genomic contig location: Contig_ID=SeqID_12836; Location=3640..4845; Strand=+
  SCN-specific regions: Sequence locations=1-1206
atggacccaactgacaatgagcaagaacacggcaacgacgggaatgagcgaaccggaggctcacccacaacgcaagtcggggcagttccgccgagcgcgaagaaaggaaagggcaaaccgaaagttgtggagacttcggcaattcaaagcaattcgggcgttcagcccggagggactcggaaccttcgaagtaatggcattaccatacgtgccattcgggaccagctggaaagggcatcgggccctctcgccgatcggatcgcggaggcacgagaactgctcgagccggacctcaacgcaggagacaagcctcagtcagcagtctgtctctcagccatggaaaggggactgcgggagttggtcgacattttcaagggccacttcgatcggggcctagcggcgatcggggacgaggcaccggagctgcatgactatctgtatgatgctttcaccgtgccactcccggcagcgacgagatgtttggggcttcgatcgcacccgcccccggccgaactgcttcaaatcgcgatggaacatcttgctgatctgcgcacggtccgtcgaacactcgaggacgtggaaaagctatctcagctttcatccgagactcggtcaggaacaggggacagcctgcccgcgggagatgatcccgctagccgtcgcacgccgcctccacagcaaatccatgacccgactgatcaccagtccgacgagtggctgtttggacgattcccaagacggttcgagcagctgaacatccaagagggacgtcgggcggtgacgcccgtgatgcgaagcgtcgcccaggtcgcccaatacccggtcgtaaacgcaggaggagccggagccaacattcgagaatgggtcaatcaggccagtgatcggagggaacggactcactccccacggatccaacaggcgggcaatcggccgcgcccaccgggtccaaaccgttcagtcacgggagatccaaatccctgtagtcgttttcggatacccgaacagatcaggggcagagacccctcggttctgcgcgccgcccgacgtaacgaagcgacaacggcattcgaaaccgtgcgcctccagccgccgacattttcgggaaaaccggaggattggacgacattttggtcgtatttcaagcgggcagtggacgacaagcccatcccgggcttcgaaaagcagccttacggcttcgctgcttaa

SEQ ID NO: 76567 - DNA, 517 bp, Heterodera glycines
  Genomic contig location: Contig_ID=SeqID_12840; Location=1..517; Strand=-
  SCN-specific regions: Sequence locations=1-272,294-337,366-421,443-517
atgatttatttgcttcaattattggcaattgcttttgggctcttttcgaattcattgctcgagagtaatgttgtgatagtgagcaaaaatgacaaacgaatcggaaaggtgagctaaaatacaaataaaccaaacacaaatttacaaatttatggcttgcagcgcgaaagtttgagaaaattttaattttgagtagtccctttctattatttagtaccaaaaattttcgattttccttatttgtgcccccttcaaggtttccttcacccaaattttccaaaaattcaaattttgtgaaattctattaaaaggttttttcgcggcgacggtcgtaaccataaaaaatgaaaattaattaaaaaattccattttttttctccaggtaattcccccggggcgttacaaaatcgctgtttgggacaaaatgaagaaaaagaaaccagattattgtgatgatgtttttatcaaaatgaaaaaccaatcatttctcactgaagaagcattacatgacgagtaa

SEQ ID NO: 76568 - DNA, 899 bp, Heterodera glycines
  Genomic contig location: Contig_ID=SeqID_12841; Location=476..1374; Strand=-
  SCN-specific regions: Sequence locations=1-596,619-899
atgatcgcgaaaaacatttgtgggatgtttttgtttgagaatgttttcagccctttgcataaattcgtcccatcatttctcaacgaatgtccatcacttcgcattgtctctttcatttttgacgacattttcgccgaatttccatttgatgacagtgccatcacatcggatggacaagcggtggttaagtggcttttcactccacttcaaaacgctgtgccaaaggtgttgatctgcacgttggacatggatgacgagaatttggcgtcgaagattgaagccttcaaagcggtgattttcaatgatttttttttttggcttttcgttgttttttttggctctaacagaattggccacttcaaccataaaagttgtaaaccttttggtttttcatgtccccctcccaaccgaaaagtgtcattcattttcatatttattaaccaatttttccacatttttaggcttttgcctcggcttcatctcccgtcaatttcattgtcgtcatgtgttttattccttcgtcttttgctgaccctgttgtgccatttgtgttgaccaacgaattgacccgtgaacaattggcatttaaagaaactgacaaaagtgacgactgttttgtgttggtccgttgtccaattgtgcgtgatgcgagcaaatgggcaaaatgggaagaggaagcgattggctgggaatgttttgatcagtggaatcaaattctatttaatgtggacgaaatcggagacgggtctgtgaatgcttaaacgaaaaaccaaatttattgcttttctttttcgatttttagacttcttgatgcaactcccggctcaagtgatcagcagaagtgaatgaatgaattgttgggaagtgatcgatcaatttgaattatggatttaaataaa

SEQ ID NO: 76569 - DNA, 907 bp, Heterodera glycines
  Genomic contig location: Contig_ID=SeqID_12842; Location=155..1061; Strand=+
  SCN-specific regions: Sequence locations=1-119,142-252,274-544,638 -692,721-805,827-856,878-907
atgaggactaagggagagaatataaatgcaaatacggtaaaccctatcgtaattacggatattcaaattgaagaatcgtcgttaaatacggcaggaaacggggtacaaattgttcagatcagtgagaatccattagaaaacaatggaagtcaaaaattgaattatattatggtgaataactcaaagggtactatgggtcaaataaacctctcggcaaatttggagacgataaattggaccgaaattcatcgtctgtttcctccccctaaaattgcattgaaggcaccacagcctgaggaaatgactctgagccaacaaccgtcaacgtcaaatggtgttgctgaagagagtctcccgagttgctcaacgattggaatttgcaaaaatgggaaggcatttcgcatctgggataatcgcggtcgtccagtcggcattgttagtccgtctttcaccgactcgcaccgaagaccaacaccttacttccgcccacggcaactccagccggtcccgcaacaaccgcaacaacagcagcacaaccagcaacaaaaaaatattttttataagataaatttattcttatgatcattttttgttaaatgtcattatttatataattaaatttaaaatagaaataatagtcaaataattatcagttttaactatagatcaaaaagatgtaaatctcaagagagtataaattaattatatttatattattttcacggcacaatgaaaaatagcatacggaacttaaaagtcaaattttaaacataattgtataggaaattagccagcgatcagccaaattatcttaatttaaaatgaatttgctccttactgaaaaatgaagttatttgctaatttattatttaaaaaacttaagaaggatttgcacgaatttaggaaa

SEQ ID NO: 76570 - DNA, 443 bp, Heterodera glycines
  Genomic contig location: Contig_ID=SeqID_12844; Location=251..693; Strand=+
  SCN-specific regions: Sequence locations=1-171,255-443
atggtccattggacgacgaaggtgtcaaacggtgccaaagatggctctggtggagcagcaaagaacatcggcgatgtcgcttgggacaccaaccagtacttctctcagccccagtcggccgacgttgagatgagcgcgtacgtttgagtccccgcgggaacgaccttttttgagagagagcgagagggagagagatagatagagagagggagagagatagagagagaaagagagggagagagagagtgagagagtctctcgtactcaatttgtcggctttcaaatttttcatttaaaaaattgccaaaaaagaaaatgccacttttgtttacagttatgccttgctcacatacatgctgctggacaacaaagagcatgcgctgcccattgtccgttggctgaccgcgcagcgcaattccctgggcggcttttcatccacgcag

SEQ ID NO: 76571 - DNA, 55 bp, Heterodera glycines
  Genomic contig location: Contig_ID=SeqID_12845; Location=86..140; Strand=+
  SCN-specific regions: Sequence locations=1-55
gatcatcttggtacccgtggttgggcgttggcggcaaagatgcaagcaccgtatt

SEQ ID NO: 76572 - DNA, 610 bp, Heterodera glycines
  Genomic contig location: Contig_ID=SeqID_12846; Location=16..625; Strand=-
  SCN-specific regions: Sequence locations=1-54,99-175,201-287,310-610
atgactcaacagctaccaacgggtttcgggcaaatgccgccccttggccaagtcataattaaaaaataaataaataaaatattaataatttattatttcaggttgctcatttggttcaaccaatgctcatcaatgcggctgaacagcaaattccggtgtttctttttcgtcatgctttttatttttttaaattaaaatttcagcaccctttcaatgctgatggtacgcacaaccaacattttttgaatggttgtgttgcagaagtggggcagctgctcccgttagctcatttttattaattttaaaaacataatacaaagttttcaggccattgtgcctgatcgtcgtgtcagttgagcaccgtgcggcacaacagacaacagctggcccgcttcctgtcaccaactgcgttctgcgcacgggtgatggacaccgagtggaggcttctggctggcaagcgtatgcgcatgtgttggcctccctatccgtcgggagcgcctattggttcattaactgcgttgcgcgcgcccgcttccagcgcctgggctgctggttccgcgttggggtcggaggccccaacgcgcttgtggtgccgcacgtggccccacag

SEQ ID NO: 76573 - DNA, 1914 bp, Heterodera glycines; identical to SEQ ID NO: 1885
  Genomic contig location: Contig_ID=SeqID_1885; Location=1..1914; Strand=+
  SCN-specific regions: Sequence locations=1-657,697-704,734-1266,1299 -1914

SEQ ID NO: 76574 - DNA, 287 bp, Heterodera glycines
  Genomic contig location: Contig_ID=SeqID_1886; Location=431..717; Strand=+
  SCN-specific regions: Sequence locations=1-203,225-287
atggccagctgcggcggcggcggcggcgaccgatgtgctaaaggatgcgatgataatgaccctaattatggtgataatatagggatggttcgaataatggaagcgcattcattcttcctattgtgccgtcgtccttcctttctttatgatgtgctctgtagaaacagatttacagattactgtagcttaccatttcatttcccttttgccttccctttccctttgctcaaatttctctcatccgttcacaatgcttaaaattcaaatttggcgtttcgtccacacaa

SEQ ID NO: 76575 - DNA, 462 bp, Heterodera glycines
  Genomic contig location: Contig_ID=SeqID_1887; Location=594..1055; Strand=+
  SCN-specific regions: Sequence locations=1-284,326-391,417-462
atgggtgccggagggggggtaagaccgtatcgatcgtgaactaccagacgggtcaattagactctcaattttaaacaagaataaacgaatattaaattattcgagaatttttttttgtatattttacaaagataatcaaaatacgataattaattattgatcaatataaatgaaaaagcaaattaaacagaaatagtacatatattaaaaagatctaagaaattcctgtacataaaagtaaatcgacaaattcattgtagtggtagcaaatttcattatacgagatataaaaaacaaaaattaataaaatataaaaataaaaattcacctacaaaaaatgacttcctaccctaaaacatacaaaatttcagcataattctattaatgttggcaaaattttaaacaaatcaaaaattgttagaaattttatgaaaactttgtaaatttctcaaaaaaaaacaa

SEQ ID NO: 76576 - DNA, 586 bp, Heterodera glycines
  Genomic contig location: Contig_ID=SeqID_1888; Location=1466..2051; Strand=+
  SCN-specific regions: Sequence locations=1-448,471-586
atgtctgggccaatacaaaaagggatcatcaatgcactcaaagctctcgacaatgccaaaagcgccacttcactccttctacaccccgatccggacctgtcaaactgggaaaatgccgtcaacttggaggctcaatttgatcgcgtcgtcaaggaaatccgtacaatggaaatgcagatggacagtctacgagactcatccaacgcttggattgaacttctcgcccgcctgaccggagacgacaaagacaacggcgaaaaagaatacatcaaattcgacaaaaatgagaaaattgccgagcgatacgacgcagcaacaaccaaacttcgggatttgcgagatctcgaagcaacactcagtgccaccgctaaactgcacagaggcagagccgacagagaagcaaaggcggatcaattggccaatccgcaacaacaaccgcccatgccaccagcaatggcagcaccaatgacagtgccaacattcacagcaccgctctaccaattccagccaattcaactggataaatttttcggccaaaagcgaaaatggcccgaattctacgaatcccttcaatcggcaatcggca

SEQ ID NO: 76577 - DNA, 2601 bp, Heterodera glycines
  Genomic contig location: Contig_ID=SeqID_1889; Location=78..2678; Strand=+
  SCN-specific regions: Sequence locations=1-1687,1709-2601
atgcagatggacagtctacgagattcatccaatgcttggatcgaacttctcggtcgtctgatcggagacgacaaagacaacggcgaaaaagaatacgttaaattcgacaagaatgaaaaaatcgccgaccgatacgacgcagcaacaaccaaacttcgggatttgcgagatctcgaagcaacgctcagtgccgcagccaaactgcacagaggcagagccgacagagaagcaaaggcggatcaattggccaatccgcagcaacaagcgcccatgctaccagcgatggcagcaccaatgacagtgccaacattcacagcaccgctctaccaattccagccaattcaactggataaatttttcggccaaaagcgaaaatggcccgaattctacgaatccttcaaatcggcaatcggcagtcaatcaatcagtaaagcgcagaagctgaacttactccgcaatctactgggcggagaagcgcgagaactcatagcgggcttccggctggaagacgcaaactacgagacggtccttcagctgttaaaggacacgtacggagctccggaggaacacatcagaagtcttcacttcgaactggccaatctcaagccgtgccgaagcctacgtgagaccaaagactttctgcttcaacttgagcggcttacaagggagctgaacaatgccggagaggacatcgagggaccgcaggtgttcctcatgctggagaagaagctgactccaccattcctacgaagcatcctcacaaagaaaggagaggatccggcaaactggacgacaaccaaattccgggatgtgctaaccgaagcagtccggaaagaagtccaaatccaagaagtgatgggagaatatggccatcactacgtccaaccaaaagcagaagtcgtctcagcagcacctgtacaagcaccgagaacaccaaaccaaaggtcacgaaggcctaaccaaccaatggcactgcgtgatatgacatttatcgcctcatcactggacgagggtcacagacatcaagggtatgtaagccaacagcacacgcaacaagcaaagaaacactgccaacaaatgcgaaaccaagtacagagcgtcaaaaagggtccgccatacccctgtattttctgcaacagcaatcattggcatgacgaatgccaaaacgtcgacaccctcaaccaacggatcagcatcgtcagagaaaagaagctgtgcttcaaatgtatgaagccaaaccaccgcgcatcaaattgcgctcgaccatctaagtgctatcactgcaaatgtcggcatcccacggcactctgccgagatcagtacaaagccgagaatggcatcaacacgcctagcacctcttgcagtgaagagaagccaaatgccaacgatggcaagcgatcaacagtgatcgaacaacaacaaatgtgtaatgccatccaaagcaaggaaaccagagcgttgctaatgacgacaaaggcaacgatcttcaatccgtcacggccatccctcagcatgatgggaaccatcttcattgacccgggaagccaccgatcattcatctcgagcagtgcagctgaacaattggatctgaacatcctcagcacggaagaatgctacttgtccagcttcggtgaacgagaaccgaagcgatacataagcgaccgcgttgcaatcggcattttatgccccgaccaggacaggttcattttcaacctgaacgctttgaagttcctgctgaatgatttaccggtactacaactaaacgcattggataatgacgaacttcaacaaaagaagctttccctgccgaatgagtcacggcaaccggacattctcctcggaatggacgtttggcaccagctgaatgttcaaccaattgaacaactgccaagcggatttacgatttgccaatcgaaaatcggcaatatcatcagtggaacagggcgaatcgagcttaagcaaccgtccaacatctctttcgtgctaatggtcaacaacgatgaatcgccacaaagcagtaaagcggctcagaggcagaaaaacattcaacaaaaagaaaaggccgaactgagacggcatcaacgcaacaaactcttgtccagcattgcaacattgcgatcaagacggaagagagaatcggctcccatcagctcaaaatcaatcgtgattgatctttcatcagacagcgacgcatccggcattgagatcatacaaaatccagtcagggatagacaagccaaatcaccaaatgagcattcaacggcaccaattcctatggcagtgcaacggctaacgccaacaaggaagagttcatcagttgccaagcgaccagcattttcttccagcaaacaaccaaaaggaaaagcagcgaatcccacacaaacaagccaaacaaatgaactcaacagaaaaatgaaagccttgtcgccaaccgcaagtggatcaggcgccaaccatcattgcgtcgctacattggccagaagctcggactcaacaacagtaattgataagggcagtcaacagaattgcctaaacatgagctcggcaacaatcagtaagacaccatgccaacagcactcgtccgagaagacgttaaactaa

SEQ ID NO: 76578 - DNA, 906 bp, Heterodera glycines
  Genomic contig location: Contig_ID=SeqID_1889; Location=2900..3805; Strand=+
  SCN-specific regions: Sequence locations=1-906
atgacgtcaaacaagcaacgacaattggtccataaggacgttaaactacgtcaccaattcaagcaaaagcactcgagcatgcagctgacagcacgtttccggaagcaaattcacatgtcctcaacgattgaggaggttcagcagcgaatgaaccacaacagaccgcaaccgcggaggtcacaacagaggggactaaggccaactcaagcgcctaaaatatgccaatccgggatggcacagtatacaagcagggtcgagggatccgcctttcaccctgcgtcttctgcaatggcactcactggaccacgacgacgactcagcgaacactcaacctggcaattgagctcttcgcaaaaaatcatcaagcccgagcagagaatgcccattcgccaagtctgaaatgacgaatgacgaagcacaattgtggtcaacgaatgacgaattggaagtcaacttccctggaccaatcgccggacttttcaaaggcgaacaaatcagcacggcgacaaactgctttgctcaaccagcaacacttttctccaccaagttcagaactgtcaatacgcaaccgaattctgccaactgcccgacaactcaaccctgatttggaaatcaacctgcaatggcaacgaatgccaaacatgcgactacgagaaggcggaagtcatcaacggaaaattcactgcggcctacggagaatcaatggccacttggatctccgaagatcaccaaaagacattaactttcgccaaaaatgcgccagaactcatcgcctgcgatggcacacgcatcgtcatgtccgaacagaacttcggaattgccaaggagcaatacgacgacattgtcaccaccacgacaagatggaaaagaggcatccgaccagaacagctcgcaagtggcaaatag

SEQ ID NO: 76579 - DNA, 1130 bp, Heterodera glycines
  Genomic contig location: Contig_ID=SeqID_12849; Location=792..1921; Strand=+
  SCN-specific regions: Sequence locations=1-270,300-446,481-630,713 -1027,1049-1130
  Gene Ontology: Mol. function=calcium ion binding; Cellular component =endoplasmic reticulum lumen
atgtttttgcgtctgaactgcttggccgccattctgtttgcactgtgctgcacctctagcactttttggctcggttccgctactactgatgaacagaacaaagcgccacatgttgaccaccataagctgaccgaaacacaacaatatgaagtgggtaaaactaacaaatgtcgccaattaattgagacaattagcgatgctcgagagtgcgttcgagtcgagagattcaatttaatagcttttgttttaatgaagttcttagcaaaatgcaaaaaaatattatttacataatattttatgattgattcgcaaaaattttaattttaaagagcggcaaggaaaccgacccgaagcatgaccacgagcagttccttggcaaggacgaggccaggcagtatgaggagttgacgccggagaagagcaaagaacgactcgcgtaattttcgaaaattttatttaaaaaatattttaaatattttacagaagattagtgccaaaaatggacctaaactcggacggtcaagtggatgagttggaactacgggagcacatcaatttcatgcagaaacgttatgtggtgcgtaattagttgaggggatttaaatatatttttttaacttagccgaaagctttttaatttttattttgaaaatttgggtttataattttttattttaagtaatttcgctgaaatttttaattttaaatttttgaattttcacattttatatttctcattatccctcatttggtttttttgagatttttttaagctttttttgacaattttgacggccttcgatgttttacttatcttttgatcgattttctatgcttcggttcactataaatttcgttttttttaattttttcaatttattttcttatactggctaatccttaaaaatataatggtttatttttgcagaacaacgatgttgagcggacatggaaaaattacaaggaggagcagctgaaggacggcttgctcgattggcaaagactacaggtgaagaaaatctaaacagagggggaaaagggtggaaattctaaaaaaatttaaggaatttgatttacggaaaaccacaggagggccaggagatttcaccggaatacgtcaaaatgattga

SEQ ID NO: 76580 - DNA, 947 bp, Heterodera glycines
  Genomic contig location: Contig_ID=SeqID_12850; Location=1..947; Strand=+
  SCN-specific regions: Sequence locations=1-81,103-169,191-296,327 -849,880-947
  Gene Ontology: Biological process=mRNA polyadenylation
ccgatttagagcagaatcagcgcatttccttcttcaaacaagtcaccttccaaatcggctttcttatccttttcttttaaatgcttttgtttagaacaaaaaacaatttccgatgtttccctaccaagaggagaagtcgcgggtttgtctcaaaattgatcaaccgtcaaaatgattgatcatttccattcagtgggacgattacggtgaaatcattcgtccggaggaatatataattgtcgattccgccgctgcgactcagcaattagcgacggtgacgaaagagaaggacaccgcaggcgatgaggaggagggcgaggagcagcgaagggtggcggtggaggaatggccaaccaaatgcatttcgtacatcgccaaaatagaggcaacatttgagtgattaattaactcactgatttcatgtgattgctctgtcgcttttagattttgtgcaaagtcgaattcatcgacttcgaagggcgttcagacggcgaatccatcaaaaagcttctgagtcaaattaagcccaagcaattggtaattggttgcccattttcttgtcaattcttcctctgacaatgagacagcgcttaattttgttaggtcatcgtccatggcacggccgccgccacgcgtcatttggcacaatattgccaaggacagcaaattgtgcaggtgtgttgggtccatcgcgttaatttgttttgcaatttgattttacaaatttattttaggggaaaactttcaccccgtcacttggcgaagtgattgatgccacaattgagtcgcatattttccaagtgacactttccgaccaactgatgtcctctctgctttttcaaacggtgcattaatttttaacttttttttttttaaatacggtaccacaggtgaaagaggctgagctcagttggttggatgctcgcatcattcgcaaatcggcgatt

SEQ ID NO: 76581 - DNA, 823 bp, Heterodera glycines
  Genomic contig location: Contig_ID=SeqID_12853; Location=37..859; Strand=-
  SCN-specific regions: Sequence locations=1-218,241-823
atgttgtgcccatttcaaatcattagtaaaataaatgccaaggtcctctctctgatggttcgtttccgggatttttaggaattggaaagtcatcaataaaataatttattttttggtttttgtgtcctaaatgtaaagttaaacatttatttgaagcgattttaaggccgtttaatttacagtattgattaaatttgttaataaaattttggagtggagaaaaggaaatatttgaaagaacatgataggccttaagatcatcggcaaatagtttaattttaacattttcagtttcgcagaattttggtaaatcgtaaaactgtcctggccacggatcccacggcacgtgtgttggcgctggccccgccgaatgtcgccgtcgtcaagctggtgctggagatgcaggacgcactggccgccggaaaccacgtggagccgatgcttgccttgttctccggcacaggtaagttgagatatgccaaggaagttgagcggatttccccccacctgctcgccaccgcggtggaggcacaggactttcaggaactcctacagaaggaccaagaccgcgtcaaggtggagcggtacctggacgcctgcgagcggaacccacgcctggcccaggaaatggcagttgccaaaattgtgcaggagcacaaaaatcgccgcctgtgcttcgccactttgtccttctgtgagcaattgccggcactgtttggggaaacgacgcatttgatcatcgatgaagctggacaggcgccatacgtccagatcctcaacttggtaaagccactcccctgcctaaccaaagtgctgatcaccg

SEQ ID NO: 76582 - DNA, 953 bp, Heterodera glycines
  Genomic contig location: Contig_ID=SeqID_12853; Location=2105..3057; Strand=-
  SCN-specific regions: Sequence locations=1-75,102-104,126-373,423 -588,625-728,752-953
atgcttctcaaattggctgattacttccaggtgagtcctctgatcacttatcacatcttctttctttgtctgatcattttaatttaaatattatattatttgtgtaaaaatctctaatattttatatgaatgaaacaaatgaaccgttctgtgatttctcgtaatccatcataatatttggcactttttgacttagccattaatgctcccaaatttgctaatgaatttgttatttctattaaaaccgccgcttcactttcaggtggcctcgttgaagtcgcgctgcgaaacgcatctgatcaattgcgtggaaattccgctgatcgaccgtttccttctgattgaacgcttcggactcgacaatttgaaagtgattattatttaaaaaatttaaatttaaaaaataaattttaattaaatttccacttttagaattattttttgcatttgaatgttgacaacttccgtgcctttttcaaggcaaacaatgaacagttttttcctgttatcagcaaagaatttttgttggctttatccgtccgacttttggatgaatgaatttgttaaactctgccgattgggtccgagtttgatcaaatttattttttggcattttcataaaatgttgtttttttttacaaattttcctcattttcgatgagagaattatttactttttggttcaaattatttgttttcaaatgggctaatttgctgaatatttgggcattttttataattaattatttttcaaattcaggataaagaacactaaaatttagatttagaccccaaaattcagatttttttttgcaaaaaatggggtcagcggccaattttccaattttgcgaaggcgtccggccatgtaaatcatcgttggcttttttcgaagcgcgttttttccaaaaccttttttgcgcttttaaaaaaacaatgtctcggttccaataaa

SEQ ID NO: 76583 - DNA, 972 bp, Heterodera glycines
  Genomic contig location: Contig_ID=SeqID_12854; Location=443..1414; Strand=-
  SCN-specific regions: Sequence locations=1-76,101-264,314-480,517 -620,644-972
atgcttctcaaattggctgattacttccaggtgggtcctctaatcacttatcacatcctcttttccctgtctgatcattttaattaaatattaaatttaaccaccataatgctaatgagttttgtcctaataaaagtgccgtttcgctttgaggtggccgcgttgaagtcgcgctgcgaaacgcatctgatcaattgcgtggaaattccgctgatcgaccgtttccttctgattgaacgcttcggacttgacaatttgaaagtgattattatttaaaaaatttaaatttaaaaaataaattttaattaaatttccactttttagaattactttttgcatttggatatcgacaacttccgtgcctttttcaaggcaaacaatgaacagttttttcctgttatcagcaaagaatttttgttggctttatccgtccgacttttggatgaatgaatttgtttaactctgccgattgggtccggctttgatcaaatttattttttggcattttcataaaatgttgtttttttttacaaattttcctcattttcgatgagagaattatttactttttggttaaaattatttgttttcaaatgggctaatttgctgaatatttgggcattttttataattaattatttttcaaattcagcataaagaacactaaaatttagatttagaccccaaaattcagatttttttttgcaaaaaagggggtcagcggccaattttccaattttgcgaaggcgtccggccatgtaaatcatcgttggcttttttcgaagcgcgttttttccaaaaccttttttgcgcttttgtgctaatattgtgattttaaaatatatttggcgttttgttatttaatttgtttcatttttgtttgtgatttttgtgaagtgttaggttagttttatgcggtcgtcagttatccctattgattgtcctcgccctattttatttggaattaataaa

SEQ ID NO: 76584 - DNA, 644 bp, Heterodera glycines
  Genomic contig location: Contig_ID=SeqID_12855; Location=320..963; Strand=-
  SCN-specific regions: Sequence locations=1-91,113-203,225-644
atgacacaaaagtggttaaccttgtgttgtaataatcacaagatgaaggtaattagaacagaagcgaatgtattagcggtggggggataaattatggaggatgccaacaaaaagaaagtgcaattagcattgtcactgatgagagtgaaaatagaaagatgaaagaaatgccatatttatagaaatataattccagtaaacagaatttaaataaaaatttaaatctaagacaccgggcgataaccatggtttaattggaccttgtcccgatataattacaagtgaaaagctatattatgtacagacattacgctcgaataccttccatgtcccgtgaattacgcatcgttagccgacttcgtgtcccataaaacttgtaccgtatacgttccgttttttaaattgatttcctcatttcccggtacagcagcagaaattagttgtacacctatgatgtacctatttcgtgtgtgtattggattacacattttgccgatgccgttgaatgaatggtacgactgatccattcgagaaaaaagaatggtggcgagtgaaatgcatcgcatcgccggccattccattcattccattcgctttcacttcacccatttttggccatcggcggacggaagaggtcaaataaa

SEQ ID NO: 76585 - DNA, 1603 bp, Heterodera glycines
  Genomic contig location: Contig_ID=SeqID_12857; Location=251..1853; Strand=-
  SCN-specific regions: Sequence locations=1-84,106-165,187-246,268 -327,349-427,449-941,997-1346,1400-1438,1463-1538
atggttgtaaagccagatcacgtgcatgttctcccaaattcggttgaaaagactgatcagatgttgatgctccgaaattcgatggttgaaaagccagatcacgtgcatgttctcccaaattcggttgaaaagactgatcagatgttgatgctcccaaattcgatggttgaaaagccagatcacgtgcatgttctcccaaattcggttgaaaagaccgatcagatgttgatgctccgaaattcgatggttgaaaagccagatcacgtgcatgttctcccaaattcggttgaaaagactgatcagatgttgatgctcccaaattcgatggttgaaaagccagatcacgtgcatgttctcccaaattcggttgaaaagactgatcagatgttgatgctccgaaattcgatggttgaaaagccagatcaagtgcatgttctcccacatatgatggttgcaaagcctgataagatgttgatgctcccaaattcaatggttgaaaagcctgatcaagtgccttttttcccaaactcgatggttgcaaagcccggtcaagtagtgacggtagcgaagaaagagcggatcgttttgctgccgcattcgctggtgtaagtgtcttatcagttattttcggtgttggaggtgatagttcagcagccaaagaagagagtccttgaactgaaagtgcttctcggccatgaaatttttgctttcctttctttgcggccaattgcagcgcatttggcttcctaattggcgacgcatttggcgatttgccaattgtcggccgcttcgactttttcttcagcgtttcttcttcgcgcactccgtcacaaaatggcggcgaaagtgccaaaatggccaccagcagaagagcagaaattacggaaacggcatttaattgcatggcaaaaaaaataaataaagtgggggctaaaattgtgattatattattaatttttctaaataagtaataattattattaatataatattaaacaatatggcatttgtacaaacaaacgcacgcattcagagaatgaatgaattgattgtaaccagcgcaaatgcttagtatgtgaaaaattcacattatttgctcttccaccaattttgttaggcttttcgccgtgctgctaaaatttcgcatttcattcgccttgccattctttgctggccagcagtgcaactgctgttgatgaaaaacgttaataagcaaaagtcgggcgaaggtgtaacccccgggggcggcacgcagcgcggccaatgggaaaatgatggcaaaaagcataaacagaagcagcagagatgttgttatatcagagtatgttttttccaaattttgaacgaaataaatctttaaaataatttttgaatatttatttcatttgttttaattttagttgttttagtttgatgaaatatttgaaaaagcaaaaactaattttttaatttaaaattttttgcggatttatatatcaaaattttcaggtatatattcattctttcaaaaatgtttatgcattgtgagatacccggacaaataaaaacacaataaaaaatgagacaaataataataataataatataaaaaagaaacaataaa

SEQ ID NO: 76586 - DNA, 1762 bp, Heterodera glycines
  Genomic contig location: Contig_ID=SeqID_12858; Location=117..1878; Strand=+
  SCN-specific regions: Sequence locations=1-21,83-83,131-386,408 -618,649-955,982-1152,1181-1404,1427-1636,1658-1762
atggacaacaaaatcggacagagagaagaggaacagaagagacaggaagagaagaaaagggacgaggaatgccgaagagagacggaggaggaggaggaggaagagagggaggaggagagggagggggagggatcggaaggagacggcacaaatgccgaagaaatgacggaaagggacgcggagcaaacgcaaaacgcaaccaaagtgagtgtggtcggcatcaaaccttcttctttcacttttggaatattctggtgtttgattccttaatgactctgatttgcttaaaaatgtaaaaacggagcgaacaattcatcatttgataaatttaatggcttttcgaacgattccacggtaaaaggaatccctttttgccccattgttttgaaatattttgaattaaaatatagaaaaagcttatatcttaaaaagtgaatgcttttaaaaatagggagcagaaaaaaacaaacagagtgttaatattaacctcatgaagcaaaagattctatctttttttgacaaaaaaatatatctgggggattttagagagtgctgctgttttgaatatgatgttaagcatttgagtcaattactaatcctaatttataattcgaattcaaataaaaacaaaaaataaataaatttttagatttgtttctgatacatatgaaggatttgaaaatttataaatgtgtttcagttttgtgatcagtgatcatgaaaattccatggatttatgtcacggacaacacaaaaacattaaaaaaactaaaagagtccttcgattttcatattttatgtgaataaggacaattgattttccaatcacttcataaaaaaacaaatttatcgtaggattctccggcggaaaaaatgccatcggcgaacggcggaaaaaacagcgcaattaatgccaacgacagaaaagggacaacggcaccatcgaacggcacaagtgcactgactgtggagaaatatctgatgcacttgcggcaaaaggaggagcgggtgcgttttgtgacataatttttagaaaatttgaccatctcgatgcgtttgcattgattatttatcgattgatcgttctcaaagattcggcaattggaggaggaaaatcggacgctcagatcgacactgttggacaaatcgcgcgtttaccaagcccaagtggacgaactgaccaacgaattggtgcgaaacgcggaaatggtggcacgtctgcagtccgagttggcactgaacaaaggtgccagcatcatcactcattcggcgcctcccttaaggcgagtttggcgtggcggcactttttgtctgatcgctctcaatttggtcagtttttttcagagatttgcctcagccaaaaaagccgcggaaagtgccgtcctcctccgtccacacgcacagcaccagacaccagcagcaacaacagcttttgtccacccaccaattgcagctcaacggcggccattcgacgcgtccgcaagcgaaagtgccgacaaacgcgtcactgcagcagcacgccgcgtccaaatgtggtggcatcgcccatcagctgcagcaggcgtcgacgtcagcgaccgacgcagatgaaatttgtgtcgcgttgcaacactttgtggagcgaaatcggaccaatcagccgcagcaacagcagcagaatggggcgggggtggtggaggcgataatgggcgtactgaaggggggccaaggcgaaggtggcacttccacggcacagccgacgcagccgagtaaaagcatgtga

SEQ ID NO: 76587 - DNA, 2495 bp, Heterodera glycines; identical to SEQ ID NO: 12859
  Genomic contig location: Contig_ID=SeqID_12859; Location=1..2495; Strand=+
  SCN-specific regions: Sequence locations=1-219,241-271,390-471,494 -624,651-681,704-1161,1183-1727,1899-1908,1934-2495
  Gene Ontology: Mol. function=transcription factor activity; Cellular component=nucleus; Biological process=wing margin morphogenesis

SEQ ID NO: 76588 - DNA, 923 bp, Heterodera glycines
  Genomic contig location: Contig_ID=SeqID_12860; Location=284..1206; Strand=-
  SCN-specific regions: Sequence locations=1-17,51-228,250-369,391 -392,414-554,576-799,821-923
atgtacaaaaagtggtccaaatatgtacataaatatgtaagaaaaatcccaaaatatgtaagaaaaaccccaaatatgtaaataaaatttttttaatggtattttttgggaaagaaaatccccgtaaagtatgaaatagccacaaaatgacataaaaattactttttttggtattttaggcaacattttcaaacttattttttctttataaattttcaaaatatgtacaaaaatatttgccaaaattttggattttttttttgaggatttccaaaaatttccgtaaaaaatactcaaaatatgtaaaaaaatgaaaatatatatgaaaaaaatccaaaatatgtacaaatatgtaagaaaatcccgaaatatgtaaaatggtgggaaaatccgtcgaaaaataatcccccaatctccatttatcccccaatctccaattatcccccccccctttctgggaaggttgaaaaataatcccccatgggggataattagagaaaaggtctcttcatacgatagtggtgaagcttctaagaaaaagtacatttaatacgaaaaataagttttaataaagtgcgcgaactttttccgcaccctgtagtataattagtaggtaaaacatctttttgttatttgcgtataaaaatcaggactttaattttgcatattttgactttttctgcatatttcatgcatatttttcccttttttatacatattttcaggtttttttgcatattttgccatttcttgtcaaatattttccgattgaatatcccttcggaaaaaattgattatgtataaaattaaatccaaatttgaatggatgcgcgagtgggtcaacagtgagcttcttgccgaaaatcttgagaaatttttgatttgcaattgcaaaaacaacgataaaatttatgaggaataaa

SEQ ID NO: 76589 - DNA, 2620 bp, Heterodera glycines
  Genomic contig location: Contig_ID=SeqID_12861; Location=310..2929; Strand=+
  SCN-specific regions: Sequence locations=1-48,93-394,416-462,486 -577,599-726,755-758,796-803,825-902,925-935,957-998,1141-1273,1304 -1399,1421-1424,1446-1446,1480-2072,2095-2164,2197-2295,2317 -2367,2390-2620
atgacggaaattgcgaaggatggacattttgtcagcttaatagaccagtaatttattaaatattaaagtcatatttaaaaattaataatttagtggcgtcataaaagaaaatgagaaatatgtgacaatttcggagttaggcgaaggaaatttaaaagaaaaatttaaagatttaaagacattaatctccgaaataaaagcagcatttgcacatttaagtgaattagtcattatcctcaaggaagttatgaatgcgctggttaaattccacgaaggtaatttaatttttataaacataatgggcccattatgagctttaattagcgaagggatttaagcgacaaaaactccaaaatatatacgtaaatatgtgctaataatccgcaaaatgacaagtaagttttaagttttgtttaatatgctttttattattttttttatgagctccagtggccagaaatgcatgaaaaatgttttttgggggattcaagcttagatagagcctattttctaggtttatttttagagcctaaaaagcctaaaaaattttgtgaaaaactattttggcattttgccctaaatttattaagaaaaattcaataaaaacgaaaatgcatccccaagaatccaccccaaaaatttcagaaaaatacatccctaagaatcgacccaaaaattttcaaaaataaacccctaagaaataaaaaaatttctcaaaaattaatctcttaaatttatttgtttattttcttgacaagaattttattttaaaaattatgcaattttaaaaaatttctgatttttaagagaacctaaacagtagcattaagaaattgtaaaattaatggtaaatcaatgcttttttagttggaattcatttgcatttcaatccaaataatttatttgtgtttaaaagaagaaattatggtcttggaaaaatgctgatcaaattatttgtgtctgatggtaaattgtttaattaggataattaagataacatatttattattagacattatttaatttttattcaaattaataaattatttttaatgaaaattattttagaacattttaattcttataaattaaaaaatattatctttaataatttagctaaattaaattaatattaaatttgctttatgttaaggtttcgttttatttgacaatcaaaaaaaggaaaaaaatcagaaaaattttatggttaaagttaaggaagaagatatagaatattcaacagattttgctgcgcctgagctgcttcaagtcagaagttattgttttttatttattgaatttcatttcagcaactttcaaatggcactgatgaaaagggcgaagttgaggtgagctaactgatttttacgtttaatttttccattcatattttattttcatatatatatatatatatataatcactgaaaaataataataatgaggttaattattttaaaacaaaattaatttttttatctttgacagaaattagggagggggtgggatttaactaaggaattctcgaaaaatgtcaaaatgcacaggaaatggcgaactatgcataaaaatccaaaaatgcataatcaactttaaattcaagttgttcatatacagtaaaaatatgcatatggatttaattgacttgcttaattataacaattaatgaattattccaatatcaggtcaccccgaaaatggacatttggtcagcgggaattaccatttttgaaattgctttctcagaaatggttggcttttattcgacatgccaccgaactgttgttggggaattgtttcgaagtaccaaattgaatttggatgtggaaaggccagcagcaaatcatcttttaaaattaaaactgccagaagaaagtgctcatgccggctctgaaaaatggtggaaaagatattgggtagtgatcgatgacattctcatcgtatggcataaattgccagagattgcgtttcttgcggtggtaagccggggaataatttgaaaaagcaccaatccatcataccttagagaaattggtggtttgttaagctacttttcgagttattagcacctatcttctaggtttttatgtttagagcctaaaaacctaaaaaatttaaaaaacctattttgatcctacatattttggcgttttgcacaaattacaatattaacaaaaatacaataaaaacgaaaaatatatctctatgggcagctcggtgatgtgacacttactccgttacatttgcggcgccgatatactgtggcaccccaaattaatgcttaaaaattaaatctcaaacactattttgtttcctttatggtcataagaaattcttttcaaaagtaataacgaaccactgaatgaaatctttttaaaaatatttttcagcgggggctttaagaaatcttttcaatttttcgaatttataaatttttaaagctggacagcgacgggatattgtaaggaagaagttagctggaccttaaagcaagtaaagcggcggttgatacgaggcggatttgcctcagaacgcaatggcctagttgccaaaggactggatttccacccctggcttaacattttgcctatttctttattaaacagaggaaatccataaa

SEQ ID NO: 76590 - DNA, 680 bp, Heterodera glycines
  Genomic contig location: Contig_ID=SeqID_12862; Location=209..888; Strand=-
  SCN-specific regions: Sequence locations=1-18,75-280,302-680
atgggcacaccatcagacacaccaccagcagcagcagacatcaaagacgacaacaacaacaacaacaaaaagaaggaagtgggcggaattctgaacatcggcaacacatgctacatgggcgctgcactccaatcattggccaacgtgacagcactcagcaattttctgatggaaaagtgggtgccaataatgtcaatgtccaatgccatcaatttatgtttttacccctcttttttcagcgaaaaccgactgcccaacaaactcgtcgatggaatatgtgcaaatgatcaaaagcattttggtgttgcgacaaccggcggcgccattcgaactgaaggtgtggtgaacagtgtgccgttggtgatggtggtgttgcgtttcatgactcgccgttttttcaggaagtcatctccagccgtaccaatttgttcgctgattcgttccaacatgacagccaggagttcatccaattctttgtggacgagctgcacgagtcgatgaagggcattctgcgcggtgttacgcaaggcgtcagctgtgacatgtacagaaatgacggcgtgggtggtggtgctgatcaacgtgacgaccaaatttggcgcaatgcaatcgacgtaatgccaaattttgtgattttttttgtaccgtttaatttggcattttcagcattggagaaatga

SEQ ID NO: 76591 - DNA, 1253 bp, Heterodera glycines
  Genomic contig location: Contig_ID=SeqID_12862; Location=2020..3272; Strand=+
  SCN-specific regions: Sequence locations=1-142,165-395,417-1077,1099 -1179,1201-1253
  Gene Ontology: Mol. function=ubiquitin conjugating enzyme activity; Cellular component=chromatin; Biological process=establishment and/or maintenance of chromatin architecture
atggcaatgtgagagaatcagcgacctaactgatctgatctgatccgcttttccgttacgcatatttcagtcccatccctttaaacagatcttcaaatggcgcgttttcatcgatggtcctccggaaacaccatagtgagtgggcggcggcggcagaggaaaagtgcaaatcaatcaaattaattgtttccccattaatccctcctctcccctttttttagcgcgggatgcacgtttacggcactgctcaaattcccagcttcgttcccgttttatccgccaacaatgactttcctcaccgacattcttcatccgaacagtaagaaaagcgcgcaatgattcatcaaatcccagcaaaagcccccacccgtcccttttcagttgacacgagtggcaaagtctgcatcagcattcttcatccgcctggcattgatccactgggctatgagcaggcgtcggagcgttggaattgtgaccgtaccgttgagtcaattttggtgtccattcaactgctgctggcggagccgaacttcaacagtcctgccaatgtggatgctgccgtaagtggattgattcttcggcatatgaatatagtatatcaattttcatcaaaatttcaggttttgttccgcagcgacccggcacgatacagggaggaagtgcgtcgccgcgttgagatagtgatggcggcaccaacacaaccggaagggcaggggacgacgcaaccgtcggaagggcagaggacgcaagcggcggacgaacaggggacgcaaccgccggaagaacagagggcgcaaccgccggaacagcaagggacgacgcaaccgccggaacagcaagtgacgacgcaaccgccggaagaacagagggcgcaaccgccggaacagcaagtgacgacgcaagcggcggaagaacaggggacgcaacagccggaagaacagggaacgcaacagccggaagaacaggggacgcaacagccggaagaacagggaacgcaacagccggaagaacagggaacgcaacagccagcgacaccgccgcctgaagggccgcagcaacaaacggacgaatggtacatgtgatgtgatgtgatgccctctgagtgatgatattattacacttatgtatgtattgtatgtgattaacagtctctctctgttcatttgccctgcttttgttcactgtacatatgtgtatatattgtcattcaccaattactgtatgtatattgtatatatgtgatgtatcgagca

SEQ ID NO: 76592 - DNA, 784 bp, Heterodera glycines
  Genomic contig location: Contig_ID=SeqID_12863; Location=127..910; Strand=-
  SCN-specific regions: Sequence locations=1-194,216-252,287-333,366 -454,772-784
atgcacagaggcggcggaaagcatggtgaatttggccctttttataaagaaattttttgctttatttttggcaatttttgagagaattttcgttatttttgaaaaattttggaaattctcaaaggacgagagaaactttccacaggcttttctggaaggtgtgtacgtgcaaaatttgcagacccaaattgaggtgctggagctggaaaatgcatatttgcgaggctcaactgaaagggttttccaattttcaattttaatttaaatttatttttattcatttttagggcgctttgttcgtccggcagccaaaccgacgcttttcctcagtaaatggccacagcagaaggaggaggacaagcggaacaaaagaagaagcggagacagcggcagaagcagcacggcactattattatgcgacgagaagttcaaccaacgcaattcgagtggaatcggaggaggaagaaaaggaagaggaggaagaagaggaggaggaaatggagagggaggaggaggaaaagcagaggaggagagaaaaaagagtaagggaagagggggggggggggtaaagaggtaaggcaaaagggaaaaagagtaagggaaaagaggagaaaaggaagacaattgaaggggaggaagaggagagtaaggaggagagaaaaaagagtaagggaagaggagaaagagtaaaggaaatgaagaaaaaagtaaaacaaaacaattttaaggggaggaaaaggaggaggagatggagaggaggaaaagcggaagagggggaaaacga

SEQ ID NO: 76593 - DNA, 1111 bp, Heterodera glycines
  Genomic contig location: Contig_ID=SeqID_12864; Location=131..1241; Strand=-
  SCN-specific regions: Sequence locations=1-147,170-171,274-439,462 -542,564-688,718-962,986-1111
atgtttcttgtgccgatgttattggaagcccagcaaaagatggcctccgggtggccaatttatctgtaccaaattgagcacattaattcgggatatccatctgatattcctgtcaaaggtgggcaggagggcaattgcaaacactcaaattttgaaattttaatttttcaaaatttaatttaaattttaattaacttttaaatttaatttaaattttaattaacttttaaatttaatttaaattttaattaacttttaaatttaaatttttccaggctcttcccacggcgtcgaattggaccctttgtttggcattcctatcccttacgaaactgaaaatgcgacggaagcggacaaacacttccaacgggcactgatcgaaaccatcacaagcttcacaaaggccgggtaaatttagcaatgacactttaaattagtggttggtggtttctcggcttgttcttcttcatgatactcgagagtctcgacttgaaaaaattctcggggttttggcctcgagactttggattaaatttgactcgacaaaagtctcggatttttggggccgtctcggtctcaagtccttggcccaattctctgtctccagtctcgaggaactcggtctcgagcatcacaagtccgtacctatttttgggtctcaattatcaaaatggcagtaatttgggtggcgggttttattttgtgtttttaagagttccgcgcatcaattcgttggccaattggcgtccgacagatccccacgcaccgtttcagtacgccaattttagctcagacaccactcaaatggagaaatcgctagcgccggaaaagttggaattctggcgccagctcagtgccgactttccctacgacatcattgagggcaccaaacgcgagacgcaccaaacaaaggacgaactctgatcagtggcgaaggaaggatgatcagagataaaggcaaacattatgccaaaaaaggcaaacatgccaaatcaattaatttaatcaattattttgtagcaatccaacagtatttgtatttaaatttcatctcaaatgtcaattatgtaacaaacaaaatgaatgtaaacacatgacatttgccaataaa

SEQ ID NO: 76594 - DNA, 720 bp, Heterodera glycines
  Genomic contig location: Contig_ID=SeqID_12865; Location=646..1365; Strand=+
  SCN-specific regions: Sequence locations=1-40,77-237,266-692,718-720
atgcccgccaaacctaatcttctctcgcaggagcttgccgaattggaaagaaggaaaatggagctggaacagatgatcgcctcagctaagaaagaagtgccggaaaggaagagccgtcgtccaaagaagtgccaaagttcggacgagcccgcccctcaagacgagcccgaggaaaagggacctaaggcggcagctctctctgatgctccgactactcagccatcccatccgccgctcggcatcgtgcctccaccacccccatcacctgttggctccgacatggccgaccttttgcatggtcacgtcaataagtgggcaatggaacgtgaggaggccgtgcattttttgcagaagaaaaaaagagatgtcgccgtgcctgttcacgatgcactcaaaaagttcaacggcggcatcaaacgcctgagaacggcgctggacgacgtccaggaaagtgtcggctcgatagctgctggtgtgaacgaattggccagctccaccagtgacggcttggtcattaccgtcactcttctgcaagttgaagtcgatcgccaggcggtggagctgcgatcccttcgccgatctctgcaccctccgccagacgtcgagaccgttgagacgttgtcagtcatctcgtcggaagaaggagcagcagttgccgaaccatcttcggcggcgagtgtcgccaaagcgactgagaaaggggagaaaaagaagaaatga

SEQ ID NO: 76595 - DNA, 796 bp, Heterodera glycines
  Genomic contig location: Contig_ID=SeqID_12866; Location=6..801; Strand=-
  SCN-specific regions: Sequence locations=1-304,329-796
atgggcgaaaacgatgatggcgatggcaccgcgggcggtgccgtaggcggaatgacatcggccgccgcttcggccgactcggcactttcggtgcacgacgagttcgcgggtctccaggtttttttagtgcggtgggactccgattctggcattctggacttgcgaggctcggttttttggagttattagatggcaaaattccgattttttggccccctggaaccacacgaatgccaaccaatgaccattaaagaaacggcacttttgctgtgggggccgcagaaaaagtgccaaaggcgggatccattttgttttgcaatttttattgggaaaactttttgtcggggatttctgggtcgctaatcatgaatcttacatctatttcaaccaattgtcaagaatatggctttggtcaagtaaggaaaaaaagttgtggccaaaaaactgacaataaggatggccattgattggacacctaaaattgattaaagtgcaaatttaaacttttgactttttgttcgaattcgttgggtccggggttcaaaattgatcgaaatgggttgtcagtttcgtgttcagcgtgcctgaaaaccctcacaaaaacatgtttttaaaactacattttttgaacaagttgctatgtcatccgaactattaccaaacagtttcttaccgtttattcttttttttccagaaagagttggccaaggagttgaaggtgaaggacggcctggaacgctttctgtccatggcgtcggtgctgaacccgaaggcgtacacgcccgaattgttgtag

SEQ ID NO: 76596 - DNA, 1181 bp, Heterodera glycines
  Genomic contig location: Contig_ID=SeqID_1890; Location=1312..2492; Strand=+
  SCN-specific regions: Sequence locations=1-116,138-240,264-768,804 -1181
  Gene Ontology: Mol. function=ATP binding; Cellular component =intracellular; Biological process=germ-cell development
atgcagcaggacgaaaaaaaccgaattctaatctgcactccgtcgaacactgctgctgatttggtcgctcgtcgtattttagaaaccaacatactcagtcccatccaaatgcgtcgttactacagtttgggcaaaagcgtagacgaaagagacagaggattggacacaattatcaagatggaaaagtgggtttcaaatgttgttgtttttttgcagtctctccgtctttttcggaatgtttaatttttggcttgtttttagttgctccatttatggcctttacgacgagcgtttcaaaattgacaactacgcaatgttgacgaagcagaatgtccgacttgtctttgctacgctcgcctgttccgcatacctcgaagaggaaattcgcgtttccgattttttctcgtcagtaattacactcttttgtctctgcaaaatctccgttattacaggcacattttcatcgatgaagcgggtcagtcaattgagcccgaaactctgattccgatcacacgcttcgcaacaagaaacactcgcgtggttttgtgcggagaccaccagcaattgggtgcgttttactcattatacataccgaaatgttagaaaatgggtctcctctcccccaattttaggccccgttgtaaaggcgcattttctcaaggcttacaaatcgtgccatttgtcattgatggaacgattaatgaccacaatgagagcagaagaaaattcttttagaattaatggacaaaaaagcgtttacacggacgggtattaaattgtttaattttggagtaggtatttaaactctttcagacggactttttgccagctgacggacagttaccggtgccatccgaaaatcattcatttttcttccgtcaatttttacgacggcactcttcgcgcagttaacgaagagaacagaaagtctttttgcgattggaagcatttgccctccaaagttttttttgcccatttgctgtttttttagtctcaatattttgcagaattttccgcttttatttcacgcactgacaaaaggggccgaagtgaaacaattggagggccgatcttatcacaacgaagaggaagttgaagtggtggagaaatacatccaattggtgagggaaacggacattgaggacacggaaattggggcgatcagcccgttcaaacaacag

SEQ ID NO: 76597 - DNA, 2040 bp, Heterodera glycines
  misc_feature (84)..(85): n is a, c, g, or t
  misc_feature (90)..(90): n is a, c, g, or t
  Genomic contig location: Contig_ID=SeqID_1891; Location=58..2097; Strand=+
  SCN-specific regions: Sequence locations=1-116,138-322,345-473,495 -1392,1414-2040
cgtctcaatacatctttgacccgagccaaggaattggtaattgtcgttgcgtcgttggattttgtacggaatttgaattccaanncatcnccaattaatattggatcaggtaattcaatacaaatgattcctttttatccaatgccttttcagttttattgagttttgcatagacaacaaagcctgttttggtggatgggtttgtcgatgagttgggtttcaaccagcaaactctgactaaaaatgggaattttctgcggaagtgccttaaagagagttttcattctgagtttacacgcatcgagagaaagaaaaagcccgaatttgctgtattttctgcaccaattcgaaaatgtatgtttctcttttataatgcaatttaaaatctgtttaagattctgattcggattcctcaacctccgaatcctgcgatgaggacgaaggcacagtcagtgatttgtcaccactttcttcaagcgacgaagaagggaaacaattttgggccaaacaaattccatggagaaagagaccgagtgaaaggaacactttgagagggcccaaaatagaggaaatggcaaatgcgatgagcaaactgaagaccaacgaatatacagaagacatacagtacgaggatttgacgacggatccgttggaaaattggcctgaggacgggggccaagacgacggttatgccaattggaactgtccatcaaaagcgacgacccttttgagcgatgaaagcaaacaaaacgacagtggaaatggctacggaagcggtaattttttaacaattctgaatgtgacaaaataatacttacttttgtccatcagcgcctttgtacaatacgaaaacggaaaatgttactgcaaaacaaaacgacagtaattacgctaattgccagcaaaaggttagcagaattcccgaggaaagtgtccgcgatcagccgacacatcggccgacgaatgcacagaagaaagactttttttcggagatcgcaacttccattgaggaagggagcatcggtgccgccagggggaagaatcccctggggagtgtccagcagaactgcaaactcatgtgattaacacccaacccatgccatggcatttctatccgggtttactcatatgttgatcgaagatacaatattcttgtttaattctttattatatgaattttatttctacattaccgaaaagatgctaaaacccgatttgttttttttatttttctgtttttttagccagatcccagtttctatcattgtttcaaataataaaataactaattgtaaacaaccgatggaccttgattaccaatttgaagaattagaggcaagggttgacaaattgctaaatgccaatgcaggaattggtggtccgatcacagacttcgcttttaatatggccaaagaggagggttactcagtccaattcgtcaaatacgttttggattcggttgacattcattacagagacgagaaactgctcagacacatggtaaattaaagcaacaaatccaagagtggaacgtcggcaccttaattaaggtacgatttacagcttcccaagtgaagaacacaaagatacccttttcggagtgtctctccgccaaagaaatccattcgatttctaatttttgctctgaattgaaaaacgacattgccttttcgattcgccctgtttctcaggggcacagccaatcggccggcgcggagtttcctttgctcacgcgcattgccattgtggccacttattgcgcgagttacaacccccaaacgagcgacaaagtgtttttcttcaaagtcggcacttttggaaagcactaacaaagtttttgatcttttcaaggggaaagacgttttgaggcgcaaattgcgaggggcggcgcgggaggaaaattggcacgaaagtgggccacgccctttcgaccaccagcgggcgctgttcattttccttttcttctgccgccaatttgacgaggcacttcacgacagtccctcggcttcttctgctggctttcacttcgattctgtttga

SEQ ID NO: 76598 - DNA, 947 bp, Heterodera glycines
  Genomic contig location: Contig_ID=SeqID_1891; Location=3647..4593; Strand=+
  SCN-specific regions: Sequence locations=1-406,430-783,805-947
atgccttcttcttccgctgattgttctgctgatcgctctcttccgtcttcctcttccgttatcttccaacaattcacgatcgatcagcgacactttgtggacgaggattacttcagtctcgagagtattttcgccaccaatacgaatatttgctgcactttcgagtctaaaacgccccccggtgagtttggttttttttcggtcattcaaatgtttcagcgctttttcctctgctcggccggaaagcgcctgaggtcatttctgagaagggataccgtgccaatgtccccgcttggctcgtccccgccgtcgaccacatttgctcggtagtgccatactgggactcaaatcccgattttatagggcccctaatcccgagtgttattttaggaccggaattcgggatttttccaaaaaactaagaactaaatttcctaaaggatttaagggggggggggcttagcggccaaaaaagcgaaggttgtctatccatgtaaatcgacgagcttttttctttgttttaaagccatttttgcggcgcgttttttacacaaacccataaattctccccaaaacccaaattcataaggtaaagtttcgccatttttaattaaaattgttcaatcgaaacatcgggacctggatcatttataggctcttgggattggaaatcgggccgagataggattaccgaaattgaaaccccgattttgtctggatcccgattacgtccgagctctagtgccaactcagagacacgcatttaacagtcggattttgccatagtttcccatttctttcagtttgccgtgcccaccgtttacaattccgtcaatcgcgacgtaatccacgcgggtgcccaatcggtcaacttggaacagttgcaacgccactactacacattgggcacgttcatttgcaggcaatccctctcaataacattcacg

SEQ ID NO: 76599 - DNA, 101 bp, Heterodera glycines
  Genomic contig location: Contig_ID=SeqID_1892; Location=1..101; Strand=+
  SCN-specific regions: Sequence locations=1-101
atgggcaccgaagggaggacgaaggacggcaccgaagggccgccaaaaggaaacattgcggcggcatttcgacacttctctctgtgaaaaactgctgatca

SEQ ID NO: 76600 - DNA, 2888 bp, Heterodera glycines
  Genomic contig location: Contig_ID=SeqID_1892; Location=436..3323; Strand=+
  SCN-specific regions: Sequence locations=1-521,554-1448,1470 -1950,2083-2267,2299-2555,2602-2888
tcgtctgttgcccaaagcgcaaattccggcgacgggcaacaaccaatggccacaattcgcccgaaaatagcgcaaatgagtgccgaagttgtggactcaaacccatacagccgtttaatgtgcgggcattccgaataaatttaactttaaacaaaaaacagggccttaaaacgcatgggaattgtgcagaattatgagcaaatccgagagaaaactgtcgttgtggtgggcgttggaggggtcggttctgtggttgccgaaatgttgacgcgatgtggcattggcaagctcattctggtgagcagagaacggaaggcattttaacactgaaaacatttgggaaatcggggaccacgcgaggggttgggcagacggctcaccaacaaagggaaggacaattagggaaattttatgtttatttccactagtttaattttcacagttcgattacgacaaagtcgagttggccaatatgaaccgactgttttatcagccgcaccaaagcggacagagcaaagtggccccccccccctccctcctcttccccccccccttctttttgccgaatcaactcataaattcgccatcttccagcattttccatgcgtccgcttctcttccgtcccttcaatttatttcttctcttccttttcatatttttcctcactaaaatccgtcgtattattcatattcaatcctttcttgccgaacaaagtgtgcctttgcgggaacaaaaaatggccgattttgtgaagccattcagaaaagcaatgggaaatttgtaaacagacaaaattagtcattttaggccattgagagggttggcactgatcctccggccattgtcctccttaacaaagtttgtcatcctcttccaatccctccccttccttttcgattcgttcgttcagttcgccctcaacatcactctcaacttcgtctgcaatttgcgtcttttccccggcgcttctgatcgcctcatcgtcgttgtgttcgaccacatctccgaaaagactctgctcaattcgtttccccatttgaatgtcatccattggccccttttggctttggtcggtcaatcgaccgcctcaaaattaattcaaaaaatttccgaaaaaaaattttaggcggacaaattcggccccggggatggtcgctaccaaatgtttcagtatttccgtgccaaattggctgtttttctcacggagttggtgccttctttttggatggtgaggcgagtaaaaagaaggaaaatggcaaattaatgggcaattaggaagagaatttgaggtgcaagcggacacaatttggcgggaaaatcttttcgaattgatcggttggaagcgaaaattgtgagagaggaaacggagaaattcagatgtggacaatggcacgaatgaatacggacgagcggatttgatctttgacagtgaggggagcgacgggtaaatggccaaagaatttcaaaggaaattagataattactttaatttagattgctcagctcaatggttcgtccccgtggaattttgaaatttctcaatttttccgatcgccggcggttatttctttgtccgctcatccgtcagaagtcgcagttttttcgactctgtctcccgctttttgctgaatcacttcgctactgataataatgtgatggctcgccaatgccttcttggaatgcacggcgcaaaatgtgcgcaaatcccttacaggtcgctaattggcgcagaatttcgtgtcgaatcggacaattgacaaaaaatgcctttttgttagagttctttcaaattggcgccaagcgattgaaattaatgaaaatggagaggacgacggcgcggctttgttccaattcgatggcggggaaaatacgggggacaaattcgagaaaatgagagcggaaggccatctttttgtggatttgaattcaattggggaatggaatgatgaagaaaaaggaaaatgggagaacggagagagaaaagcgaaatgtaacggcagagggggagagcagaaagacgcgagaggaacagagagtgaggggcaaagttggagggcaacagagaagagaggagaagagagtgccaatcggacggaaaagaatcgcaatcgaacaatggtcgccgccattcacgcgttgttcgaatggatccacgggcttttccccggcatcaagcagtttttgattgtccgattgtttccccattacgcagcacatattctcttataaattaaattagccattgtgccaagaaattcttattgttaataaataaataaataataaaacaaataaattttaattaattattagccataatgtcccttttgttgtaaatgaccattcgaatgatcaggcgaaagaacaacaacagatgaatgcgtgcatgaatgagtgatcaaggtcagcgagagaatgtgcgccgatggcccttctccgtcgtccgatcgtttttcgttcggtgattgatcgttgcgcatgccatccgtccatccgttctctgtctgtcgttcgtcattcttttttttcaatactaatcacgagattctcgtcaccatttattcaatcatttatttctaattaaaccattaaataataatggcaaatgccccgacaaaattaatccgtttgttaatgtgtcgtccgactcattttaatgtgaaatacgaaataaacccatggatgaggccaggcgacccggtgaatgtgcaaaaggcaacagatcaatgggaaagactgaaacgcactatcgaggttataaaactgcacaaaaagacaaaatatttatgatttataatcatatccaaagtctctgttggggagtagaaaaaggccgggattcggctgaattctgattcgggactttaaggaatccggcgcccaagtc

SEQ ID NO: 76601 - DNA, 1630 bp, Heterodera glycines
  Genomic contig location: Contig_ID=SeqID_1892; Location=1287..2916; Strand=-
  SCN-specific regions: Sequence locations=1-183,215-399,532-1012,1034 -1630
atgcgcaacgatcaatcaccgaacgaaaaacgatcggacgacggagaagggccatcggcgcacattctctcgctgaccttgatcactcattcatgcacgcattcatctgttgttgttctttcgcctgatcattcgaatggtcatttacaacaaaagggacattatggctaataattaattaaaatttatttgttttattatttatttatttattaacaataagaatttcttggcacaatggctaatttaatttataagagaatatgtgctgcgtaatggggaaacaatcggacaatcaaaaactgcttgatgccggggaaaagcccgtggatccattcgaacaacgcgtgaatggcggcgaccattgttcgattgcgattcttttccgtccgattggcactctcttctcctctcttctctgttgccctccaactttgcccctcactctctgttcctctcgcgtctttctgctctccccctctgccgttacatttcgcttttctctctccgttctcccattttcctttttcttcatcattccattccccaattgaattcaaatccacaaaaagatggccttccgctctcattttctcgaatttgtcccccgtattttccccgccatcgaattggaacaaagccgcgccgtcgtcctctccattttcattaatttcaatcgcttggcgccaatttgaaagaactctaacaaaaaggcattttttgtcaattgtccgattcgacacgaaattctgcgccaattagcgacctgtaagggatttgcgcacattttgcgccgtgcattccaagaaggcattggcgagccatcacattattatcagtagcgaagtgattcagcaaaaagcgggagacagagtcgaaaaaactgcgacttctgacggatgagcggacaaagaaataaccgccggcgatcggaaaaattgagaaatttcaaaattccacggggacgaaccattgagctgagcaatctaaattaaagtaattatctaatttcctttgaaattctttggccatttacccgtcgctcccctcactgtcaaagatcaaatccgctcgtccgtattcattcgtgccattgtccacatctgaatttctccgtttcctctctcacaattttcgcttccaaccgatcaattcgaaaagattttcccgccaaattgtgtccgcttgcacctcaaattctcttcctaattgcccattaatttgccattttccttctttttactcgcctcaccatccaaaaagaaggcaccaactccgtgagaaaaacagccaatttggcacggaaatactgaaacatttggtagcgaccatccccggggccgaatttgtccgcctaaaattttttttcggaaattttttgaattaattttgaggcggtcgattgaccgaccaaagccaaaaggggccaatggatgacattcaaatggggaaacgaattgagcagagtcttttcggagatgtggtcgaacacaacgacgatgaggcgatcagaagcgccggggaaaagacgcaaattgcagacgaagttgagagtgatgttgagggcgaactgaacgaacgaatcgaaaaggaaggggagggattggaagaggatgacaaactttgttaa

SEQ ID NO: 76602 - DNA, 824 bp, Heterodera glycines
  Genomic contig location: Contig_ID=SeqID_1892; Location=4155..4978; Strand=-
  SCN-specific regions: Sequence locations=1-53,76-286,308-555,579 -694,717-791
atgaagaaaagcaaaggcaacgattggaagaaattgacagcaaaaagtgatcaaatgatggccattttgattggttggtcatttgattgattattaattggccaattgttgctaattcgtcctcctccttcacttcacaattgcaatgtgcaacatttggctgctccgccacttttcataaattcggacatatccacaaatttgacggtaaagcccaacttctgcaccatactcgccgtgtgttcagttccgcttggatggcatgccatttttgattaacatttctattgtcaccgtctaccgtacctattgatgattactgtttttccaattacgatggaattgcaggcgaatctcatggcgtcctcctcgtggacgggcacaagttcgacctcattggacatgttatgcctggccactgaaaaaatggaaaatcgaattgactgactgacggaccgaccgacccggatcaaaagcgtagggatagtaaatggcgatctgatcattcaggggacagaagcaggtgtcgatgtggtaaaaactgaagaactcgtctttttcccattcaaaaaatcccatcaatttgtaatgggaattaaggattattccaaagtttatggcactagtcggagaagcactggtttaggtttaaaaaaatctaaaaaacaaaacaaaacaaaaaacaccgggtaccatagtaaaagttaaggttgggtagataaccacaactacgctggtttacccgtagtaaatgataactaaatttccactaaattgcaaaaagatttttcaattaattttaaatttaaatatttaaaaataaa

SEQ ID NO: 76603 - DNA, 3075 bp, Heterodera glycines
  Genomic contig location: Contig_ID=SeqID_12869; Location=963..4037; Strand=+
  SCN-specific regions: Sequence locations=1-412,434-637,660-1141,1163 -1236,1259-1287,1315-1804,1826-2656,2729-2751,2783-2800,2823-3075
atgattgatttggcgaaacttgcatatgccttgattttgttaagaggttcgtacatccataagactttgtagtagttcttgggaatgttgccctttatttgtacgcaaattttcacctattatgccgttgcatttcaagttatatattttgagcaatttgtcgtgtcgtttttcaaacaaaattttcttttcagataaaaattgaaatcaaatcgttctttgacatttgaaagctgttcgttaatgacggatcaacagcaaaagccgatgagtcggagtatgactccaaaaacaccttcaggtttatctttaaaatcttgttaataaggatgaaagaagaattaagtagatgtaatatgtgaccatcaattcacattaaatgagtccatttgttaacttttcagtgcaaccgttcaaaaagggcgacatcatttgggtggtctaccgaaaaagcatcaattggccagccaaagttcgtttttgggtgttctttccaaatgaagttcgaaaattgaactttcacaggtcaccgcgtactatcccaaggacaagaaagtgtcctacgtgttcttcccactgaagcagaaaaacgccgtcttcaaaacggacccggcaaaagtgcagcttttcacggtacgatttgctatttttgacatttcgcattaattgtgttttgtttctctcagttggatgaccaaatgccggaaaatgccccgctcgacttggagtacagttttgaacaggcccgtcgcattcttcaaggcgttccggaggaggaaattattgcagaaaatgtgcaaaaagaggaagaagcactctcccaaatgaagccgaagaaaaaaccgctgacgacggcggacgcattgaaaaaagcaaccaccggaacaccaaaagggacgccgcgaagccaacagaaacagccgaagattgtggccacggaaaccaaattcaagcagggcgacccggtcattgtggacactccgatgggcatgtggccgggaatggtttgtaatttgaatggaattccaaattgttttgaattgcgttcggaataagacaaataaagtgccgaagagaggccgtcgccttcgctttggcgttgcgcggcggtgcggagtttcggagccctccccttccccgggagcatcgctctgtccgcctcttcgtaaagaaagtgcccgctttttttggcacggtccgcatattcctgatcgcttggtactgccccgacggggtcatgaccactgggaaaaaccatgcggaacacaccgttttttattcctaaatttctttttcatgattcttttccccatttcagttcatttcctacgtgaaaggcaatccatcgttggtcaactattcactgtttcctcgcgaggaacactcccacgaagtcgtgcaaacgtcgggagaggcaatcatggcatttccacccgagcaaattgagcaagcgattgaggacgggcgcagcagcaactctgaagtgctgttagccgcgctgcaggacgtgcaaaagtacatgaaggagatgggacatgctgcttcaccacatgaagcagttggtaccacttcgtcgatgcaatcaccgaccatggacacgccgccgccactttctgccgaagatgcacaaccgatggacaccagtgaggaattgggcaaggagaagccgaagaagcggctcaaagtggagctgaccccgcccagagaggtgagtgagtcggaagagaaaagtacaacaaatctgccaaaattttgagtgtttgaaaggccggaaattacggcaaaaaaatcattttgcaaatgatttttaattgttttagacaaagcctcatcctcgaatgtcgttgaattcgcgtctcagcaaccacactggcgacgaagttgttgacaatgagagtcattcgccggcggtggcgacgccgccggtgccgaaaagcaaaaagcgaaccgccgcctcgctcaagcagaacgacagcggcaacaacaagtcacttagcacattgattgaggcggccaaaatgatggagggcggctcttcatcggaagagcatcaccaggacggagtcagcatgcccaactcgccggcggggagcagtggtgccgcgccgctggtcaattcctcgcgttgaaaactcaagcagacaccgactcggcaggagaccgtgagtaaatggtgtccagacatttgcgtttcgggcgacccaagccaaatcttacatttttcggcccattcttgcttaaaacccaacgagcaccattttttacatttcaccccattcatggggcggttacatgtcgtttcgctactcattgttagtgaaaatgcgttacttatatggtggataatgtctttatggtgtaaccttttggtttgcaaagtttttgtgataataactcgtgtaaacttgttcccagtgcttttttgttccctgatcacgaatcaggcatcaattttgaccaattcctattccttaatccaaactcagcccaacggtctaaactcggaaaatttgaattttctcgaaattttgttcgagctagggataaattgtcaaaaaaaatttgtcgctttgtaactatcgcatacctgtgcacagggagggtcagggggggtctcttagtcgatcgtaagggttcgagacagtcgatcgtacgaggtgggggggggaagttgggggaggggggagagtgaagggaggaagaggaagaaaagaaaaaggagtgagagaaaaaaagtaagtcacttatttcttaacaaatttcattaaaaaatccaaatttttgcgatagactaataccgatacatcaaattttaaaaattttcccgggatgcaaaattctatataaaaatttgtgaaacaggtcatcaaaaaactataaatttgttgaaaactcggggtgcaattaccaagcggaatgacttaccatttagcgaaaggacgcatttttactgattgcgagaagcgaaacgacttaaaattagtggctaaaaaatcccttgtcgcgtctaactcatatggtctaatgcggttctttcgggacttctcccccacttttaatgcacaaaaaatctaa

SEQ ID NO: 76604 - DNA, 338 bp, Heterodera glycines
  Genomic contig location: Contig_ID=SeqID_12869; Location=140..477; Strand=-
  SCN-specific regions: Sequence locations=1-73,95-109,131-313,336-338
gagtacaaacagtactaaattgcttcgcttttgtgcgattctgaaaaacaccgaacaaaagctgactgaacacaaaatgacaggaaagaggaaaaagttaaaggcacaatccaaaagggacacattttggttacacaattatttacttggatacaataaaatcgaatgccaaaaattacgaaaagaatgtgagaagaaatgaacgaatgaacaaaaaacaaatttttgttgttttgactgacacgcataacatcgaaaatgggaggaagagagggtataatttaatgtagcaaatggatggactcgaattacttctgctcctcttctcactgttaatg

SEQ ID NO: 76605 - DNA, 454 bp, Heterodera glycines
  Genomic contig location: Contig_ID=SeqID_12870; Location=1862..2315; Strand=+
  SCN-specific regions: Sequence locations=1-454
atgactgaaaatgtggacagtgagggggacggagataaaatggaagtggtgagggaaggggagggggcggggaatgaagagaaaagggcaccaccaaagcgccaacgctaacacttttaaaaaactaaaaaatttgtttttgaatttttcgtatacaggcattaaattccattttcacaaaaaaagataatctgatttctgaaagaaatacgaggctttaaaaaaattcagcaatcacaattccggccccagagaaatgccagaattcaaaaaaaattcagcaatcgaattccgaaccaaaaatctcggaattcgggtttttaattacctctctggcatgtgtgagcatgaaccctaatcaatagataactgcgctgcaaaaaattggacaccgagacgtgtggggcggaaacgcataaaaatgaaaatgaagcagcaccacccacggcatgta

SEQ ID NO: 76606 - DNA, 553 bp, Heterodera glycines
  Genomic contig location: Contig_ID=SeqID_12872; Location=77..629; Strand=-
  SCN-specific regions: Sequence locations=1-553
cttctgtcaaagcacaagcttgaactggagcgggccaagcgcaagtttggggacaatcagcgttcattggtcgacgcgaagcacagtttggacgtgatcagacagaaacaccaggccaccgtcgacgaactgggcaaaattgacctgagattgggcaaactccatgacgaattggccgagaagcacaaaaatgtaaaatgcattcgcagtgatagactattaaatgtttcgaattttaataacagtatttggactacaaaaatcgtttggacacacaatacaacgaattgttgtcggcggtgctggagaaagtcacgaaactctgcgaccactttcagcagatcgaggtaaaaaaagagcagaaaacagtgggtattgttcggtttctcattgaatgagagatttttttttgctttagtcttcacaaattattaattgtttaattcaggaccagaagaaatgcttcgcagaattggccaatgaaatgctcacgaagaacaaggaggatttgaagcaattggaggcgaagaaaaaggccgaagcggaagattaa

SEQ ID NO: 76607 - DNA, 1274 bp, Heterodera glycines
  Genomic contig location: Contig_ID=SeqID_12873; Location=333..1606; Strand=-
  SCN-specific regions: Sequence locations=1-809,831-834,856-894,918 -1274
atggagaacgaaatgtaccaaaatttggacaaaattcgtgatgatcctcaatggagtctgctgatttcgtgcttcaaaaagtttgcgtccaaaggccatggccaaccgtacgaccgggaagacacattcaaggaggcattcgaggaatatcgtgtgcagaaaatggcggagaagagcatcgactgcaactcgtatgacgaattggtggcacggcgtgtggcccaggagcagaaaattcacaaactcgaggccgccattgccgaggtaggcgcgttggggacatgataaaattcggcacttgaaatctcatttacaggcgcagtgcgtttctgaacagcttgaaaaggaagccgcggactgcgagaatgacattgccagcatggaccgatacattgaggagatccaaatggttgcgtcggccaaggaacgcacattggtcagtttcgaggggaatacttgataaaatttgaccaaatccctctaattacataatgaatcacattggcgaacaaggaactggtgatggcacgggagaatttggccaacgaaaaccgggagagggagcgtctgatcagcacgtagcgaattagcggggaacaagcgcgtgcattggtcgcgaagcgtaaatcggtcaaatgttttttcaaaatgtacaaaattcacttttcgagttttaggttcgcgaagagttggtgttgctgcacgaaaacctcaacaaaacagaggcacgcatttacgaacgtcagcccatcattttcaagcagtccgccaaggtacttttggtggttgcacttcattcccccgcgtcgtttctccctccccgaaaaattataaaaattcataaacatagaaaattttcaaagaaaattcttacaattagtaagttttttcacaagaaaattttttgaaaaaattacaattagaacttcatcataaattttgaaaaagtcgctgaaaattttttttcttgaaacatgatgaaaaaattcaataagaatttttaaacacacatcattcagattcgttccgactacaacgcgttcatgagccgtcttcgcgtcatctgcgagccgttgttcagtgaggacgaactgcagcagcacctggccgaattggaacagtgcagcgtcgaacaggcaattgtcgagtttcagcgatgccgtgacgacaacaaattgacacgtttgctcaaccaactgaaagcgatgatggaatgccaaatccgtgctgtgcaacaagcagaggaatcaatgcgagtgaccaacagcaaattg

SEQ ID NO: 76608 - DNA, 1535 bp, Heterodera glycines; identical to SEQ ID NO: 12874
  Genomic contig location: Contig_ID=SeqID_12874; Location=1..1535; Strand=+
  SCN-specific regions: Sequence locations=1-45,67-223,246-290,312 -403,428-1024,1048-1052,1075-1255,1277-1308,1351-1404,1443-1471,1493 -1535

SEQ ID NO: 76609 - DNA, 1008 bp, Heterodera glycines
  Genomic contig location: Contig_ID=SeqID_12875; Location=73..1080; Strand=+
  SCN-specific regions: Sequence locations=1-51,78-382,405-476,505 -604,627-710,733-1008
atggctgcgttggtgcaatcggtcgatgagttcatggcgggcattccagtggaggaaaaggaagagaaggagcagcatttgaagagcccaactccggagccgaagagtccaccgcccgagcaaaacccatccgagaatggagagtcggaagagactttgcgctcagaagagagtgccaaccagccagggccatgtcatggtgcgcctccgatgcggggcaggggtcaaggaggccctgggcgaagaggccctacgatgggaccaggccaaaagcaaaagcgcgtcaattatttggtgcggcaattgggaaaagaattccacaatgggccaaggagctgccaatgttggtcctgtcggcgtggaaagaactgggatggtcgcgggggacgaggaggtggcggcggttcgggccgcggttacgctggaggacgcggaggatacggatgcgctggtggacacgaggcacatggacatgaacgcggtgcacatggacatggacgcggagcacatggacattggcgcggagcgcgggggacataccatcacggaggacaaggccatcacggaacgtgaggccgaaaggggactggggacagttcatggaggaggggagggatgttggatctgcatttttggcttaattcattttttccattatttatttgtttctctttttttcttcgtttctttgacatttcctatgttgtaatttccctggcccttctgctcctcactcactcataaaagtgaccccttcgtccaatccatcggaaaatattcttccaaacaattttgtgtaattccatctgtttggcccctcccatttgtcattggtatttaagtctttgcttattctcttatcctcaggattttactcacccattcgttgactcaggttccctgcctaaagcgatacaactcacttaacaattggctttgttttcttactatttaaaaagcgatcattctttatttaactttgcatttccacttttgatttccatttta

SEQ ID NO: 76610 - DNA, 4834 bp, Heterodera glycines
  Genomic contig location: Contig_ID=SeqID_12877; Location=106..4939; Strand=-
  SCN-specific regions: Sequence locations=1-370,393-472,494-848,870 -897,937-2000,2022-2694,2717-3092,3120-3286,3309-3473,3495-3552,3575 -4028,4050-4119,4145-4177,4200-4228,4250-4317,4339-4460,4492-4834
gggaaaagcaatacaccaatgcccattcagagccgcaacctccgccctctgttcagccggagttgaacctgcaaagcttgtcccaaagccagcagacttctcgagagcagcagaaaagcgaccgcgactttccaacgcttgccggtgcccccagcaacaaatttcaggtattttttgttgcaacctttttaaaagtcatctttgttccaggacttgtcctccgaacatcccaagaatgccgaggaaagtgccgaattcgtttttccgtttgctccgcaaccccaaccggtaggatgcccatgtaatacttttcagtgcttgacaaccgtcatttcagcttcttcagcgctattacggcgcacctgttgcgcagaattccaaccaaagtttgtctttggctattatggaatttcaatactaggtcgttgcattaaaaaaaatttgccaggtggcgcctatcggcaccaccgtcatgcttctgaaaaggcaaaaatgagtaattcagcgtcgctgaaatttttgaaaaacaattcaggagaaaaagatttattgcttgaacagcaaaataaaaaatagtcattttattttgcagcggtgggggagagcatattcaaatttgttgaaaaaatccgcgcgtcttttcgaatggccatctttctccaactatccattattttgttgatttacctatttcccacccaaaatgaatgtttatttgtacgaaaaacccagaaatcctgagtaacggcaaattagttcccaatttctaatcgaagatcagccagggcaacccaaattgagcttgcccttattatttattgttttcattctcaatttgtgtttgatcatttcctccccggcccccaacgctgaaaccatgtagccaatttattgtgcaataaataattaaatttattttataaaaattattttttacacataaattttcattgatcatttttgaagaaattatggccctagcgtgagttaacgaattttaagaaattttcgaaaagttggcactggctaaccatattttgtcgatcattttgtacaccaatgcccattcagagccgcaacctccgccctctgttcagccggagttgaacctgcaaagcttgtcccaaagccagcagacttctcgagagcagcagaaaagcgaccgcgactttccaacgcttgccggtgcccccagcaacaaatttcaggtattttttgttgcaacctttttaaaagtcatctttgttccaggacttgtcctccgaacatcccaagaatgccgaggaaagtgccgaattcgtttttccgtttgctccgcaaccccaaccggtaggatgccatcatgtaatacttttcagtgcttgacaaccgtcatttcagcttcttcagcgctattacggcgcacctgttgcgcagaattccaaccaaagttcggctcagaaatacaatgttttgcaacggggcgcaagagtttccacggacagggaacagccggagaaaaagcactcggcccgtccgcccagcaccaacgccgcctcaaacggttctaccttttattttttgcctatctaatgtcatccatttgcactttcaattagttacaagcttcggaaatgccgatcattggaatcccccatcgatctgcggcgaattggaatcgcattgggacgacccattgccatttcgaaagccttcggaacgctcgttgttcaatagaagaaacaaagaccaatttggtacaaggccaacaagcacatcagatgccaaggaaaagggtgattttccattaccttttacattctttgcaatggcatttacttcgcaggttcaattcctcgcgaatttgtcaattcccgtaataaacgtggtcgatccactcatgccaaaggggagcgtgagcgcacttttgtccgcagtgggggcaaacccaattcgtcttccgcggtccaagaaaaacacgacgaggtgctcatttcattttgaaaaacctttgtagccaagatgtttctttgtctagaaaccattcgcatgcaactcaaacgaaacgggcgacagtttctcaaacattggcgaattccacgccgaagactacaactgtttgttggaccagcaaaaaaagtcgaaaagtttcactgactcaacggagaagaagaaaaacacacagcgaatgagaggtgtcaaatcaatggttggcagtagtagcagaagtgtcgacactgagcatggaaacaacacggaaagaaacggggcgaagacgaaacgtcgcacgacgacaaaacgtaggcatacacattcaattcaccctttttataaagactttgggttactaataaaaaaaatattgcaataattatgttacagcccaaaaacgcaaacaccgaaaaaaagattgttttttttttgtatttttagagccgcaatctccgccctctgctcagccggagttgaaccttcaaagcttgtcccaaagccagcagaattctcgagagcagcagaaaagcgaccgcgactcaatgcgtggctctaacagcagaagttgtggtactgaacatgagaacaattcgcaacgaaacggggcgaaggcgaaacgtcgcacgacgacaaaacgtaggcacttaaaaaattattggaactaccaacaagaatgatactcaaatgcagcgtgggtttgacatcataaagtaatagataacaataaaattttcattttgaaaataataatatcacaattatgcatcagggaaaacttaacaagaatttctgattgatttttaattacatttgattggagaattttgaaagggtgtaagtgacaaacccaaagattgctgtacaatatatggatacaatacgatgtataatcaaaaaaaaaaaaactagttaaaaatactttttaacttatgtcttttaagagccgcaatctccgccctctgctcacaatcagccggagttgaacctgtctcgtgaacaacggaaaggcgaccgcgactcaatgcgtggctctaacagcagaagtggtggtactgaacatgggaacaattcgcaacgaaacggggcgaaggcgaaacgtcgcacgacgacaaaacgtatattatttttgccaaattatttttaaaccaatgcccattcagagccgcaacctccgccctctgttcagccggagttgaacctgcaaagcttgtcccaaagccagcagacttctcgagagcagcagaaaagcgaccgcgactttccaacgcttgccggtgcccccagcaacaaatttcaggtattttttgttgcaaccttttaaaaagtcatctttgttccaggacttgtcctccgaacatcccaagaatgccgaggaaagtgccgaattcgtttttccgtttgctccgcaaccccaaccggtaggatgccatcatgtaatacttttcagtgcttgacaaccgtcatttcagcttcttcagcgctattacggcgcacctgttgcgcagaattccaaccaaagtttgatttttgacaaattttacatagcgaaaaaaatgaattttttccggcggcgcttgtcggcaccgccggaccgcccgccaccccccttccccaaaattttttttggaaaaaacgcgccgcaaaaaaaggttgttagagcagaaaaaaaggtcgacgccggagaaaaaatttggaccttcgtatgaaaatcggtcccgagacacccccccccccctccctccttgtcccaattgtttgccgtatggcccttgggctgagacaccccttgcacatgtaagattataggaacgtgtcgatatcacaatcagaacggtggagaacataataatatctttgatttaaactgaataatttcgcgttaaaactatttttgttctatttttgattaacaaagctggtaaaaatgaaaaccagtcccataagcacctttttatagtctgaaaatcacctctactcctaaaaacttcttgttaagttaagttggatctttcctccgcttaattggaaaatcttaccaaatgtttatactatattccaattaaagtttttaaaatttgcggtgacactttgtggcatcgccaaacgtgaggtggtatattattgtaataaattgtatgtttttgtaatacccttttatttatttatttaatgtcaaataaaaactaccacagaagggcataggccacttacactgcagctcgaggtacaaaaatgaatagatgaagatcaaataatactatattcgtagatgtcctcaaatgaataaatagagtatatgacaaacaagttttcatcggtttcataatgataacgttttaaaaatttatgttatttttccgttttgggcctacacctcaaattttataaaatgtcaacaaagggcgcacttaggcgacaattgtataccataacatagcataaattaaattagcgataaaggacactttcgatcttgcgcataaattttgaatgtgaaacttttttaaaattttgatgtgtaggcccaaaacggaaaagtaccaatttgggtggcatttaggaacagatattttgtcgatcattttgtacaccaacattccttcagagccgcaacctccgccctctgttcagccggagttgaacctgcaaagcttgtcccaaagccagcagacttctcgagagcagcagaaaagcgaccgcgactttccaacgcttgccggtgcccccagcaacaaatttcaggtattttttgttgcaacctttttaaaagtcatctttgttccaggacttgtcctccgaacatcccaagaatgccgaggaaagtgccgaattcgtttttccgtttgctccgcaaccccaaccg

SEQ ID NO: 76611 - DNA, 1261 bp, Heterodera glycines
  Genomic contig location: Contig_ID=SeqID_12878; Location=231..1491; Strand=-
  SCN-specific regions: Sequence locations=1-72,106-149,171-386,642-1261
atggttgaaaccggaccttacttatttgatcaaagctttgagattcagggcagaccttcgatgccttcggtcagtttgaataaatttttatttcatattaaatatgaaaccgttggaaaatatgtaaccagtattttgtaaggtgctgctgtttttcatgtgacattttattcaaaataaattaaatagcaattcaggtgaaggcctttgagaagagtcacttttccgcggaccaagatctaacgcttaccgacgagcttgtaagtgtatgagtaattagtgggtccgtaacagttggccctggactttgataaagctatacactcttttggagaacgctaactagataccattgtgcataaagaattaataatctcgaaaagaacaataattttaataaattataaaaaaaattaattcttttatttattaaaaataatttgaagcatataattatttatatttattgaaatcgaaatgaaattaatggtttgtaaattctaattaatataatacattaaaattaaataaaaaaaattaatttattttaaataaaaccttattcatcagaaaaatctgatttgaatttaaaaatttatttattattaagaaaataaaaaatatttttaattaattaaaaacatgtgaaagaattcaaaagtaatagaaaaataagctactccgtccggatccgaaccttcccccccccccctcaaattatgtgcctgggactcaaatgtcccgcatatgccaaaaagaagcccccatgctagggggtagagacagaggctggaatttttttaacttttagtcaacaccaactttgggtcctcaaagcagacattttttgattcgaaactcagttggcactctgatcaaaaacctatagttttcccagatgtcccgtcccgagttgccttatctttcacttttcactgtattttttacatttatagccttaaataattgcattcattcaaaaatattaagttggaaagaatttgtaaccacgaaatcggacacattctgtccaacgcccaaaatgaaaatggattttttttcaagaatgtaagagtaatttaaatgatatcaaaaataatgatctttagatcgtaatcaaatctgatggttttacaagccatacctcccattcactgccagccacatacaacgatgagcaatttctggcctacattgatttaaaattaggtaattttttgcggaatcaaagagaaaatattaaatttctatgaataataaa

SEQ ID NO: 76612 - DNA, 395 bp, Heterodera glycines
  Genomic contig location: Contig_ID=SeqID_12879; Location=378..772; Strand=+
  SCN-specific regions: Sequence locations=1-28,69-132,264-304,356-395
atggaggcggctgccaatccgcataacgtaaaaattaaacaatcttttaataatttaattaaaaaatacattttcaaaaatcatcttaacagcaaaatgaatcggtggcggcagccaaccagcagccaaacgtaaaaataacaaaaaaatattctattaatttaaatgatttttattatagaatttaattaattttaaaatttttcaatcattttaaattgtattataatggatttattaaaataatattaatttattttttaggtccttgaagaatcggtggcggcagacaatcagcataacgtaaaaatatttataacaatgttttaaataattaagaattgttaataatttacattttctggttttgtaaatgaatttttattaggaaatga

SEQ ID NO: 76613 - DNA, 318 bp, Heterodera glycines
  misc_feature (312)..(312): n is a, c, g, or t
  Genomic contig location: Contig_ID=SeqID_12879; Location=1259..1576; Strand=+
  SCN-specific regions: Sequence locations=1-110,133-318
atgcaagtgccatttgaattgcttaacgaatggacaaaggaaaagctgacattgaccaaagcaaatgaattggacaaccgatggataatgaagcgttgtaaaattattggggagaaagaggagaagcagcagaacactgtgttcatttggcttgttgctggcactaattgcattgggtgagcaattaaaaaaagcatttgatttttatccgaatttgaattttgcgcttaatttaggccattgtctccgccaccggaaaaagtggaagaacaaacgggacaaagcatcacaaaagggacgtcttctgctgancaatga

SEQ ID NO: 76614 - DNA, 939 bp, Heterodera glycines
  Genomic contig location: Contig_ID=SeqID_12880; Location=225..1163; Strand=+
  SCN-specific regions: Sequence locations=1-221,243-939
ttggatttgcaacgacgtttggatggacattttcccatcgtttgaccatgcccaactcggcctcaaattggcacttctttcgccacgtttcaatgcgttggtggacaaacatttcaacggcaaaagcgaatcgttttctgctgacaaaatgagtgatggacaaaacaacaaaaacagtgatcaaccgcagaagaaatgtattaattaagaatgaccgaccgatcataatcatcagtgatcaagtgcattttatgaagaacaacctctcaatttcggtaaataaatcggacgcataaaaatggcaaaaaatgtacgaaaacaacaacttagatttgcacaaaataatgaacaacaaaaaaaaacaacttgtttttcgtgcgtttcattccactgggagctcaggaaaaaaatagggcaaaaacctaaaaatataagccctattttcaatacgattgtttgaaatttgccgaaattccctgagaaattcaatgattttgaaaaaatcattgaatgggatttgcggaactcaggctatatgctccggctataaattttacaaagagtttaacaacccacgcataacacaaaaatttttgctatctatcgaatgtatgaatttctccttgaaaagttatgacttgggctgggaattatatggaaatccatattttttttcctgtacagtgggatgcctgaaacggacgacacccaactcgtactgctccaactcgtactgctccaactcgtactgctccaactcgtactgctccaactcgtactgctccaactcgtactgctccaactcgtactgctccaactcgtactgctccaactcgtactgctccaactcgtactgctcaactcgtactgctccaactcgtactgctccaactcatactgctccaactcgtactgctccaactcgtactgctccaactc

SEQ ID NO: 76615 - DNA, 2045 bp, Heterodera glycines
  Genomic contig location: Contig_ID=SeqID_12882; Location=406..2450; Strand=-
  SCN-specific regions: Sequence locations=1-286,327-492,514-580,602 -746,768-908,930-1559,1581-1926,1948-2045
  Gene Ontology: Biological process=regulation of protein activity, epigenetic
atggcctcatcggcctcctcttcaacaaaacttcgtcagccctcgggcaatcattttgagacacaaaatcaccacgtaaacaacaccatggaagtggtggaactgagcaatgtgattaaaaaggatgataaaaagattaaaatatgaatttcaaaggttgataatggttttggcgaaggattggccattgttggcgatcaaacggtctctcttccccagcaacatttgaacaaaagcggcgatcgaaaggacaatgaaaatggggatgatgtcatggttgtcgggcaaaatgaagatgccaagaaaaatggcacaggtagaggaggaaaatgccaacaattcagcccttcggggaaattgactcatttaattagaatttacagaaaaaaacctttttttacattttttattttcgcatgttggacaaacttttgaagattttatcagtttcttaattttgattttgaagtatcggcgccagacaaatttatttggcacttttgctgtttatttcggtgctcaaacatctaagaaaagtgccaaaagtttttttattagaaatattgtaattttggtgtcaaaattttaaatttgaggccttggtctttaaaaaaatgcgaacccagggaattaactgtttgaaagctaattagtttttctaatagaaatattttttcaattttgaatcattttcattttgtgccttttttcttgcagacaaagccaacgtggactgtattctgttggacgaggaggaggagaacggcaccaacaataatgatgacgatgagattcgcctgattgaagagccagtgccgaaaaaggcacggcccactgatcatccggggccacagccaccggtcaaccgaagtccggttcccgaggaccccaaaacttcaagagaagttgatttttgggggatttttatgcctaatattagaaagaaatattggtaatactaccgatggtgtcccccttttttcaaaaaaaaaaaatttctaaatttccgaaccggccagagaatacgactcgaacatctattctaaatcccggattcgaaccaattccaacaaaattcaaaatatgcaacaaaaccggttcaaatgcacgaaaaaactatgtctttcaaattagaattgttcgaccgtggcaccattttctttcattttttatgttccattttccacccaccccctaaaatttttaaaaattttcctattttatgtccgactcatatgctttaatgtccccaattttacaacaattaatttagccagcagtgcccatctcgtcctcctccgtcaccgctgctgggcccagcaaaccctcgccactgaccgtgccaagccaagagatcaactcgtactccgatctgttggaccgattggagctgtatgtacggacagcgatcaacgaaaatgacgctgtggacagaaaggcacggcatttttttttaaatgcagcatttgtttttcagaatttaaccctttggcatttgtttgtgccatattttttttttaccatttttggtaataaataatacctgtggtacaccacctaccctttttgaaataaaaattcttagatttttctcgagacaattcgttttagggattgtaagtgtcgggcaactgattctgacattcgtttagatccattttgaaccccaaacccggactcgaaaaaagtcaaaaattcagaaaattcacatttctgtaaaaaaaccggacccaacctcacgaaacaaaaagtttacatacgccgattttgttttggcattttaaatatgtttttttaaactcctcattttcctggattctaatttttttattcaattttccagaaatataaaatgccattttctcaacaacaaaaaattgcgctgttttaggtgttggacgcactgctttccgccatcaatacgcaggtgcaaaaggcgccgtacgctgtgcgcaagctgattttggacaaacaattggtgctgccgaacacaatttcgatgccaccgtcgcatgttgttgaactgctcattgagcatgatccgg

SEQ ID NO: 76616 - DNA, 2194 bp, Heterodera glycines
  Genomic contig location: Contig_ID=SeqID_12883; Location=1824..4017; Strand=+
  SCN-specific regions: Sequence locations=1-153,175-551,573-917,942 -1287,1309-1355,1378-1409,1431-1528,1557-2194
atgggggagtcaattcgggtgatcgctttgatcgatatgggtaaggaagggaaagcatttttttggcttttttccaatttatgcattcaatcactgtttacgcgtcctcaatttccttttggccataatattcctacttggtcaatcaatgtctaaaaaacaaacacaaaatttggtgtttttccggtatattcattgaataattttttttgtcaattgcatttaacaaagaatttaattatatagaaaaaaaaatctatagactttaagccttcgattgacaccaagattttttttttttaaaaaaagggcggggtttccacgtttgagaaattttgcaaattttaatgaaattaaaaaatcgaccattttttttttgatttttcatttcataggcatacatacccctgccgaattgaggaaatttttttgccaaactttgtagatactttttacacccaagtggaggagcgtgaacagccccatctccgcggccgaccgttggccgtcgttccgttcagtcgcggtacaaccatcacgggacagtaagcaaatatttctagtttttgaattattatttttttttctaaatccgtccttttgcacctagcgctcacaacatcgtctctcgaattttttgattttttttaaaatttaaccctccattgtttttcagggccattgccgtcaactatccagcccgagccttcggaatcaaacggggaatggacagcaacgaggtttgagtttcaacaatcaccaaattcaatttaatggtaccgaaaaagtgccggtggtgtaaaaaaacggatgaaattttgcgcattaattttactattttactcggagcggattatatataaccccgttcatagttttacaaaccggacccattaggtaccattcgatagcactaagtgtaaattttgtaattaaatagagaaaccattgggctatggaatgacatcaaattcatctaattcggacaaatacggggggtcttttgaataaaaaatggaccccattttttaacaaatttttgtttattaaatttcatttttttcgatgcgccatctttgtccgatcatccatttgtgccgtgtgcctgcaattgaaggcgtggagaagggagacatcagcaaataccggtgagaattttttttttttttttgatgggggtagaaaatttcatttccttgtaaatttccgccatttacgaatcaatttggtattttttaagtgcaaaatactagataaagcaaccgctctcaaatccgagctaaattactcaaaaatagttgtgaaaaaatttttgcaatcaaatttgattcccaaaatggacgttttctaagaattttttcaaaaattaatgaaaatttatcaaaaattcgcgaaaaataatcaaattctgtaatttatgtaattttacagggacgcaagtggtgaaatcttcaaagtgctggtcgatttttcggatcaaattgtggtggaaaaggcgtcagttgacgaggtcggaccatttttgggcaaaaaaaattttcttttatttttttaaaggcatttttggatttgactgcgcactgtgagatggaattaaacagccaaccaatggaggaattggttcaaaaggtactcattgctaatatctttttttagctgaaatttctatgttttttgcaaaaaagtggatttgacaaaaatttataaccgaaaaactcaaaaaatgaaccaaaaaattcaaaagtagtctttttgagatttacgggtattgtgtcgagggacggtcccaatgggttccccaaaaaatgtcgtaaatcgcaattcttacaccaaaaatattggaaattttttttgtacaatttttaccaacaaaaaaaaaaaatcattttagctgaacgatgaaattgcgcagctgttcccgagcacatttttggtcaacgaaagcgacaaacaacagacagtgatcgcggaggaacggttgaacagcttgaaggagtggttgagcaacgactgtcgcgtctccaggcaacaggtagggcgggtgcataacatgaaaaaatgggtgggtgcgtttttttgcaaaaaaaaaaaaagattgggtaacaggacgggacccgtattgtcatttgtccggaaaattttaattttagggccaggctccaattgacgaaacaaatttttaaatttgttaaca

SEQ ID NO: 76617 - DNA, 1172 bp, Heterodera glycines
  Genomic contig location: Contig_ID=SeqID_12884; Location=378..1549; Strand=-
  SCN-specific regions: Sequence locations=1-305,328-398,420-423,450 -497,519-1102,1124-1133
atggcgagtcattccgatgaatacgaaattgatgaattttggttggataacattgcctatgatgacggcgagccacgtccaaagtcgaaaaaatgcgaaattattgcagggattgaccttcaaagtcccagacaacggcgagagtgggctgaaagtcgaatcttccgtcaatactacgatattattttggatggaaatggaaatttgactaattatgtaatatgcaaatcctgcgtgccacctgcgaaacctgttacatttaattatgccgggtttcataatttgcggtatattaaagactttaatttaaatatttttggatttgaggagacatttggaaaattggcatgggataaaatttggcacaaatgacaaacatgacaaaatggaattagcattggttgaattttgtgttgctgatggacgtcccttttcaattatcaagggcgaaggattcaagcatttcatggatgcttatgccgaattaatgtaaccggttttgaatgagtataagggaaaagttttagtattgaacggcatctgcaaaagcgatcagtactctcagctgatcttttgccaaatgagagaacaattggcagaaaagtgattgaaactctgcagacaaaggaatcggaactggacaaaaaattaattgacgtcagacaaagtgcttgcacattgtcactcgatttttcacaaaaattgggtgttgattatgcagttgtagtcatacattttatttgcaaaaactggtctgttactattatgtgaaaaataattttttaaggttaaggaaccttaatcattttgtacttcactgtgttccatggcctggggacatccaaaaaaatcgtgaaaatatttcgggatttattgatgacgtgttagaactttatgccatcaaaaattgccgaatttattacgtaactgatgaaggcagcaatttatctcatttgggtgatcgagaaagtcatcatttttgccttgcgcatatcatttctacaatttgtcggcggatcactgaaccttatgtcaatgcgaatttaacaaacgaaaaaaagcagattgttaacacaatgaatgaattcataaaggagttgcatgtatttattggagaattgaggtcataatacttaattaattaaaaaataatagttaaaatagaaaataaa

SEQ ID NO: 76618 - DNA, 83 bp, Heterodera glycines
  Genomic contig location: Contig_ID=SeqID_12884; Location=2860..2942; Strand=-
  SCN-specific regions: Sequence locations=1-83
gcgtattaaaaaaaactgctccttccaaaagtgttttcttaatcgtttttaaagcatgtttctgatgaattttaagaaaaata

SEQ ID NO: 76619 - DNA, 1044 bp, Heterodera glycines
  misc_feature (15)..(15): n is a, c, g, or t
  Genomic contig location: Contig_ID=SeqID_1893; Location=12..1055; Strand=+
  SCN-specific regions: Sequence locations=1-61,84-207,232-450,484 -627,650-771,803-1044
atgcgtggccaacgnctgtgccaaaattcccagctgtacctttggccaacaatctgtgcggtcggtcgaaatgcttggcccatcacttcgtcactggccaagtcgggctattcaagtgcggtgtggctgaagccccgcgttggaaaggtggcgaagccgacttggcggttctgtcgcaagtttttggtgcgcaatttttttaatgaatttaaaagaaaaataactaaattaccccaggcgagaccaggctataaccgactgattttgccactgctaaagaagggagcgaaaaaaatggcagatttgcctgaatgggccgagtcgaacagtgaaccgagcgaagcggaagacaatgacaccgcacgagccgaggaggcgggcacaagcgcggcagagcacggcgagacatcgtcgagagtttggtcatggacaacgcgaatgccgaaggcgggagaaaatgaagacaaaggcaaaagccaaaatacggaaaatcgagcaaagtctgagaagccacggaaaaaggagaagcagaaaaataaggacatttttgatcagttgcttcaggacgaaacggacgacgaagaagacaaatgggcgtgatcagaagagaatgaggggggggggggcaaaaagcaaaagcaacaacaaaggcattcttttgaagagtaccgcccccctcattaattcattaaacgaccttttgtggcgagaatttttatcagaaagtgaacgatgtttcaactgagaaattgcagcatttttctgtgtttgtttttattataaaaatggttttttaattaatgcgcaaagatttaacctcaaatacaaatcatatttcttaacaaattgtgatttttaatgtttattttccaattctgctgcttctttaaagtaacattttttatgaataagcgccgaaatttccattcacaaaattcgcactgcgaaatgcaattttggttggcactctgttaacaaatatgagaggtgctatgtcattatttaaaaaccatcattatgtgcgttatttaaaaaaccatcaaa

SEQ ID NO: 76620 - DNA, 136 bp, Heterodera glycines
  Genomic contig location: Contig_ID=SeqID_1893; Location=3587..3722; Strand=-
  SCN-specific regions: Sequence locations=1-91,131-136
aaaaaaaacttggggacctctgttttatataaatgttttagtacccaattaaaagtgaactgcagaaatttcattcatttttttcgactgctattttataattaaaatttggtttttattttttttatttgtacaa

SEQ ID NO: 76621 - DNA, 200 bp, Heterodera glycines
  Genomic contig location: Contig_ID=SeqID_1894; Location=1414..1613; Strand=-
  SCN-specific regions: Sequence locations=1-29,53-100,122-200
tgccgacccatttacataatcattttgttagcaaaataaaatgagaaaaatagagatttgttcaatataaccctgtactaatttattataaatttggttttttatagctaaaatttgtaaatgaattaaaaagggctgttttattaaagtgtgaatcgtaccagaattgaactctactattccgatctttttatatcaga

SEQ ID NO: 76622 - DNA, 783 bp, Heterodera glycines
  Genomic contig location: Contig_ID=SeqID_1895; Location=1..783; Strand=-
  SCN-specific regions: Sequence locations=1-328,350-447,469-653,675-783
  Gene Ontology: Mol. function=cation-transporting ATPase activity; Cellular component=integral to membrane; Biological process=lipid metabolism
ttccatttcttcagcgtcttcttttagtgcacggtaagacaacaaacaccgaaattaaattaattgacaaaactcctcttaaggcacgtggaattttgaacggagcgtaaaagtcattctgtataggtgagcggtttcattttggaacaatttttcaaaaaaaaactacaaaggaatattcctaactgtaagctttcaaatcatttttaaatgcccttttatagaccatagtcgatttgctattgtaaatttcggcttttttgagtatgtcgccaaaagtgatcataaattcgatcaaagacccgaaaacgatgaaataagtcaatagaaaaatttaaaaaattttctcatgtcagtgttctcccgatttattctctccattcccccccccccccctcgacagtttctacaagaatatctgcctgtacatcatcgcgctatggttcgccttcttctccgccttctctggcgtgaccattttcgagcggtggatcatcgccatgttcaacgttttcttcaccgcttggccccccatcattctcggcctcttcgaccgtccgctttcccagcggatgattctgcgccacccgcaactgtaccaaagcttccagcaaagggcattctccaatggagtcagtgtcaaagcatccgaattttatttaagaaaaaacgggtttaaattatcccggcatttgtccattaatttgtgccttttgcccatttcagcgcttcttcttttgggtgggcgtttcgctgtggcattcgctgctgcttttctttctc

SEQ ID NO: 76623 - DNA, 599 bp, Heterodera glycines
  Genomic contig location: Contig_ID=SeqID_12887; Location=179..777; Strand=-
  SCN-specific regions: Sequence locations=1-137,159-208,296-449,472-599
atgattcatttggtgccgccttttgctgatcggatgcttgcgttcttccaaattccaacgcctcagttaaacaaacagatcaatgtccaaacggatttgaaaccatatgaaaatgatccgaaaaaagtagtaagaaatgagcaaaagccggcaaaggggatgcgtcagagcatcacttctaatttaagccgagacttgaaatggagacaaatttttttttaaatttttcaaaaaatatttatccgtatttaaagaaaattttttaaaaaaagtttacaaataaattaaattaattccgatcacatttatatcggtgggcattgtttcgcttcgagtctgaccaaaatttaaaatagcaaaaattttagggacaatcaaccatctgggacgaatatggggaagattgtcaagtgatcaagaaattgttgcacaaaattgaacaattaataaactgtaaaaatgaaacaaattgtattataaaattaagagccgccccttgcgatactgtaccgaactccaaccgtatgctgtgctaccgtgacttgtattgcgataaagaaatgctgaaggaagactatgaccgagcacgcacactgtaa

SEQ ID NO: 76624 - DNA, 1575 bp, Heterodera glycines
  Genomic contig location: Contig_ID=SeqID_12889; Location=335..1909; Strand=-
  SCN-specific regions: Sequence locations=1-88,110-499,521-1259,1288 -1575
atgagcggcggtccaccaattaccacacttgcagaggctgtaagtatcttagctagagttggcaaaattgaggcttggattttgtaaatgtttttccagttttaagtggtctgattttgggcctaattgtaaacatgagagtatcatgcattcttccactaattaaattagcgattatgaccacaattcacctttcccatgacctaattgcacacaaagtgcccattaatggggttggggttgagaaatatcagtttttcttccataaattagtcttctccacaaaatggtacaaaaaaagaaaatcctacccctcgaattgctttttgaattgaccaacgcactccgtttcgatgtccggtgggcgtctgtccgagtttcggaaatttttgaccactttatgctcaaaaaacaattcgcctggattcgggttgaattgacttcctgggaaacccttcgccagatggtttatataatccaagctttaaaccatcaaaattttgatttgatatgattgaatttagagggctgactttggcagagctaagggccagtttaaacgcgctgtcatgacacttccaaaccactcactggacggtaccttcagctgtaagccatcggggccgcagttctttttttgtcgggcagaggaggggaagggggcagagtcgactgattccctatttcaattctatgctttacatgcctaatttctgcagttaaaattttagctgtgagtgcccatttcggcttggactcgagcgtcggtgttcagattgttcatgacttggggctgaccgatccagcagccatttttgaaaaacgggtggaccatctatgtgagatggtgtcagaacactgggacgtccaaatgtttgggcaagcgactcgttgtaagttttgtcgttgcggccccaattattgttatccccaagggcgtagtgggagggggctaatgccccgaaaccgaaaacaaaatttttagtgaaaatgggaaaatatctgaaaaatgatgcccctccccgaatagtgaaaatatgcgggttatttaattttggttttatggtgtttttcgaggtcgctgatcacgattctaatacccattgcgaacccatgacccgaattcgaacaaaaatcaaaattaattttgcagcaaaattcacttttatgttagaatctgaacagaattcaggtacgggttccggaataggtcgaaatgagtatcgacctcgaaaaccccataaaaacttgtttaacacgattttttgaaaatttttatttaaaaaagggggggggagtggacaaaccaaactatacccaatatttgcttcggtcactcaaatccacgaactctgctgaatacacctttttcttactctttcctttagacttacgtctacactctttgcactacaatgatctcgcaggttgtttccgtcgtcccagcacttcgtcggcacaagttggtggagcaaaggaaggtggcaaaaccaaagacagtggagggcagaaggtggtcgcaccgaagaaaaagaagaacggaggagcaaagaaatcgcgcatcacgaaaaagaa

SEQ ID NO: 76625 - DNA, 324 bp, Heterodera glycines
  misc_feature (293)..(293): n is a, c, g, or t
  misc_feature (301)..(301): n is a, c, g, or t
  misc_feature (308)..(308): n is a, c, g, or t
  Genomic contig location: Contig_ID=SeqID_12890; Location=33..356; Strand=-
  SCN-specific regions: Sequence locations=1-324
atggcacttccaaaccactcactggacggtaccttcagctgtaagccatcggggccgcagttctttttttgtcgggcggaggaggggaagggggcagagtcgactgattccctatttcaattctatgctttacatgcctaatttctgcagttgaaattttagctttgagtgcctatttcggcttggactcgagcgtcggtgttcagattgttcatgacttggggctgaccgatccagcagccatttttgaaaaacgggtggaccatctatgtgagatggtgtcagaacactgngacgtccnaatgttngggcaaagcgactcgt

SEQ ID NO: 76626 - DNA, 398 bp, Heterodera glycines
  Genomic contig location: Contig_ID=SeqID_12891; Location=171..568; Strand=+
  SCN-specific regions: Sequence locations=1-19,42-264,288-398
atgtgtagtgtaaaatttggcattttgtttcttcttcttctgacaattatgccgttcatatttggaaatgacaaaacaaatttgccggttgagaaactgacagcacgacaaattcgatcagaaaaaccaattaacgggtaaaaaagaggcaattaacggacaaattttggaactttttttgttttgttttaaataccacaattaatttattataggataaataaggacaaatctttgaaaaatttttctgggtttttaagattcaattcctttaaataaaaaattttcaggaacaaggcctaatgccacctccatttttcagctaaaaatttaaagatttaatcgaatgatttttctccggtagaaaatttaaaagttcatttaattttgatttgaaa

SEQ ID NO: 76627 - DNA, 1476 bp, Heterodera glycines
  Genomic contig location: Contig_ID=SeqID_12891; Location=2736..4211; Strand=+
  SCN-specific regions: Sequence locations=1-59,102-691,722-1132,1155 -1243,1270-1381,1417-1476
atgcatttcaatttgtttccgcttatttgtattgttattattcttcaatttaaattgggtaataaaaaatataaaataataataataaatattcattattacagaagaggtcgtttttgcgccgtccttttcgcgccagctcgagtttttggcttctaacttttttcattgacgaccaaatctaacaatcttggcatcattcgaaagcccttcacatgcactattagcctaataaaaagcaaaaagattttctgatctataaaaaagttattaagaaaaattttccaaaatttcgatttttttgaaaatttgcagttataactttcttagtaattccaagcaattgtttataaaaaaaaatcttctaaacatgtaaagctttcgaataataccaagattgttagatttggtcaacaatgaagaaagtttgaagcaaaaaactcaggctgacacgaaaatgacccctaccgcatttattaccttttacagtatgccttgcccctgacagtaacggtggtcaatttgaacttcgcatcgaaaatttttcaaaatttgccaatggaccaattagaacaataaagttgggtcaacccaagtacattagagggttgcactggcgattgaatgcatttgttaatgagcaaaacggaaagaaatctttgaactgtttaattgcaataattaatagtggtaaattttatttatttattttaaattttatgtgccattttagggattatttttgaaaaaaaaaaaattaatgaaaaaccacgattatttatcccatactcattcagcatagcttagattaaatgtgtcaaaaaacatctcgaaatatatttgccaaaactaaaaatgcaaaaatatgtacataaaattatacaaaaagtgccaaaaaatagtcaaaactctgcgtttttctaccaaaaaaagcttaaattgagcttcaaaattatattcttaatgttaattaaattcttacaacaaaaaaaaatcccccgactcagtaccgaaataccggttccgggctctagttttcatgttctaatactcaatcggatactctctgttatttttagacacaaattggcattgtgccgtccatgcgacggcagaaattattgtcggagaaaagaaaataaaaacagaaaattttcaaggctttgtgaaccgggatgaaatcattagggaatggaatttcactgaagaaattgatgtaagcggagaattttaaattacggggaaaaaaatttttttttttttaattatgggaaatttagaaattgttggaacattgtcaatcatccaaaagtgatgttgtccttttgagtgtcaatctgaagatggacccaccaactggcagaaggtgtgacagatcgccaaaatttaaatgaaaaaatttatgaaaaatttttagttttcctatttaatgacattttactggtgaagaatgatgaatatgattcggcagttgca

SEQ ID NO: 76628 - DNA, 1116 bp, Heterodera glycines
  Genomic contig location: Contig_ID=SeqID_12893; Location=849..1964; Strand=-
  SCN-specific regions: Sequence locations=1-140,173-1116
  Gene Ontology: Mol. function=choline kinase activity; Cellular component=cytoplasm; Biological process=phosphatidylethanolamine biosynthesis
atgggcccgaaactgttgggaacattcaccggaggccgtcttgaagaatacattccggtgagaaaataattttatgtgtaaaatcgtagttatacaattaaattatgcagtcacgacctgttgggaaagatgtatttgaatttctttacatattttttaaaatttttgtctttaggctggtatttgtgacgcgcttgaaaggtgcttttcagtctttttttgttttacaaattatttaaggtggcttattcaactgaaacggtcccccagcggctccacttccttcgatttgccgcctgaaaatcacgaatgggctcctgcgaccataaattgcgaagctttacagaaagaaattgacaattttaggtgtgttttcgtgagctataatcataaatcccatttttaaggaaacttgacatgaacggttgtgtggtcactttctgtcataatgaccttttggccggcaacatcctcttgcccgaagcacattctggcaatatccgaagctgctccgcatcaaccgcttccaaccaaaaggacattgtgttcattgaatttgagtacgccagttacaattacaggtgagtgctttcgctgattcttttgcaattgttgggatcgatggcaaataatataatgaatttctcacattttttataggggttttgattttgccaaccattttattgagcgcgccatcaattatggcaaaaaaacgacacctttttacgaaattctcccaaagaattttcccacggaaggacaaatgcttgagttcatgtacaattacgagaaggaaggttgccctaatgccagtgaggaacatttgcaggaaagtgcacggacgatggtcgaagtgagttttggcccttggttaccaatgtcagcggtttttttcaggaaactgccccttttgtgcccgtttcacatttgctttggggaatttggggcctgttcaagggcgcaagcccatcaattgaagaattcgattacacggtaatattattaaaagaaagaaataacaccaaaattcagagttttgcaaaataccgattggtcgaatattacaagaccaaagatgcgctgaagaagatcgaaggaacggacgataattag

SEQ ID NO: 76629 - DNA, 255 bp, Heterodera glycines
  Genomic contig location: Contig_ID=SeqID_12894; Location=2206..2460; Strand=-
  SCN-specific regions: Sequence locations=1-50,81-227,253-255
atggcagaaaagcggaggaaagagcgaaacaatgcgaaatgtgagaaatcaaataataaatttttaaaatatatttatttgattgttttttcaagtgatactctatggtcgtccccgcaaaacgaaacaatgctcttcagttttttcaaaggaagactttgcgcaaattggaaagaaagatggcagttcagcaaacgaacgcattaaacgaattcgataaaatacttctttttgtttcgtttttattttaataaa

SEQ ID NO: 76630 - DNA, 304 bp, Heterodera glycines
  Genomic contig location: Contig_ID=SeqID_12895; Location=235..538; Strand=+
  SCN-specific regions: Sequence locations=1-100,125-174,198-304
gccgattcttctaaggtccctggcggtggcaaagtcgtcccacgctctgctgctggcggtggcttaagacaacggttcagtttttcaaatttagatagatttcttttttcatatattttctaacaatttaaggcgagctggtggggcggcaaacactggtcgtactcgaactgctggcggaggagggggcggaggaatgaacagcggcggactgtggcgcttttatactgaggactcgaccgggttgaaaatgtttgtgcaaatgatacttttaattggtccaaatgtgaaatcgaaattctga

SEQ ID NO: 76631 - DNA, 853 bp, Heterodera glycines
  Genomic contig location: Contig_ID=SeqID_12897; Location=2252..3104; Strand=-
  SCN-specific regions: Sequence locations=1-12,34-230,252-349,387 -716,745-754,790-816,839-853
atgtacagatgggtgggtgtccaacagggaggcgaactgttgacagtttatgaacgggacggtgaagagggcgtattacgctttgcacaggtaattttgtcattaaataggacacaatttcagacacgaattgactgatttgtgagttcaaatttaaaattagaaaagccgaaatttcgattgcctaaaattgggactgggtcgttttggcgcccacgttttggcgccgacgatttggcgcccacgttttggcgccagggtcgttttggcgcccacgttttggcgcgaagccaaaaattaaaaaaggtaaaaatttgatcaaaaattttacaaaaaaaagtgaaaaacttttaccttccaatgggtttttcaaattttcaaaaaattcacaaccccctagaattttttttcaaacttcccgattttgacgtgttttatgggtgtagattagagatcaacatgtacctggatccagccctgtatttttcctggatccaggtacaggcacaggccatttttcggcaacctggatttttcctgtacatttattttcctgtacttatgtacagaaaaaataggtacaggccattttttgaaacaggtacaactacggttttttcaaaatgttgatctctagtgtagatcaacatgaaggagtgatatgatcaacttgctgtgaacattttgttggtcaacatgaaaaattgacttagcaagaattttttcaaatttttctcttcgctatgcttcaagtcaaaacattttgaatatttttaaactcttaaattttttcggttgaaatttcaaaagagttagtgattataaacataaccttaacggtatatttaataaa

SEQ ID NO: 76632 - DNA, 841 bp, Heterodera glycines
  misc_feature (444)..(444): n is a, c, g, or t
  Genomic contig location: Contig_ID=SeqID_12898; Location=103..943; Strand=-
  SCN-specific regions: Sequence locations=1-16,38-172,196-335,357 -500,524-645,667-841
atgaatccctttagaattggtctcccaacaatagaaatggacgataattttgatgtgaacaactttggtcaggttgaatcaggaattgaccgtacatttgctgatcaagaattgagtccaagcagcaacgagagcatagagaaatgtattgacaattgcatcacataaatactttattttctttttagatgatatctgggcccaaccaaaatcaccatgtggtatttctattccctcaacaatttccggagatcctgactctgattttttatcaaaaattgaggctgaacttacttgttttaaggcaggccaaaggatggaagtgaacggagacttattttcctggtggaatgaaaatactggccgtcttcccgaattgtcaaaacttgcaagaatggtccacagcattcccgctacatcagtcagttctgaaagactgttctncaaagctggacttatttttgccaattcacttcgaaataggtcagaaatcaataatgtattaatttattttataatttaaggctttccggcaatactgtgcgccaaattttgattgtgaaggccaatttggacgcacttttactggcaccaacaaatgaatttgaatcagatgaggaaagtaaagaaaaagacgatttttgagttttgatgactttatttactagcattgaaaaagaaaaattattattttttggttacaatataaatttggtcatacccgaccggggtccccgacccccgactttttgccccccgagggctcggggcttaaccctaatttaacgtatagaaaaaaagttaaacgtagtgaagtgaatgttgttttttacataataaa

SEQ ID NO: 76633 - DNA, 827 bp, Heterodera glycines
  Genomic contig location: Contig_ID=SeqID_12898; Location=1314..2140; Strand=-
  SCN-specific regions: Sequence locations=1-365,397-401,423-827
atggccgatgaaattcaacaaaaaattgttcagggaattggtccggattttttttctgtgacctctgatggatggtcgcaaattacaaaatcacccgcactcttaaggttctctattccttttcatagtttataaaaacagactttagcgttactgtacaccatataaatcaacaatttgtacgcgccgattttgtacttgatgtgattccaatgacaaatcacacaggagcagacatagcggaagaaattggaaacgctcttcggacaaatggattaaacccagaaaaaattatttgtttggttcgcgacaacgcaaaaaacatgataagggccacaatattttgaacttgaataggttttacctaatttttgttttttataattatttttttaagctttcaatgtgtgtgccattttcttcatcttgttatgggagacgtattgggactgcctgagttggcaggactcatttccaaaattcggtcttgggttactttttttcgtacaagtaaaggcctgtccttgctccgcgactatcaagaaaagacaaattttaagcaaaaaaactcacaatggtttcataaattattgttttcacaattattcttttaaattaaggcctgcccgacccggtggaactcgacctttgaaatgatgatgacatttcgtgaacaaaaaaacgttcttttaactattgaaggagaaagacgaggatttggtgttggctcatcaaaaaagtcgcgcctagatattgtccctgaaaatttaccaaatttggaaattaccgactttgatttttgcgcgaactgtgccctttattggtaa

SEQ ID NO: 76634 - DNA, 631 bp, Heterodera glycines
  Genomic contig location: Contig_ID=SeqID_12900; Location=1337..1967; Strand=+
  SCN-specific regions: Sequence locations=1-631
ttggatttgcaacgacgtttggatggacattttcccatcctttgaccgtcctcaactcggcctcaaaatggcacttctttcgccacgtttcaatgcgttggtggacaaacatttcaatggcaaaagcgaattgacaatttggagatcaatcgaaattcgtcgcaaggacaaaggaccagaaccgaagctgtctgtacgaatcgatgacaaatttgtgccatttccaatgcctgacgaccgtccgttgcccagcaaaatccgttttaagcaccttcggatgtggtaattaaaatcagagctatgacaataaaagcattcattcctttttcaggtacatcgatcactccgtcatcgcttttcttcgttcaaatcaccaaattttcgacaaaagaggcacctatttacacttgcggattcaatcatcacacaccacggaagagcagccaatttgggacatttttgttcgtgaaatttggccaattttttcggtaaatattcgccatttggactttgtcaatgctgctgatttggaccatttgcgtcttcgcacttcgacgacaattctcactgatctcaaccaattggtttcaatcgattcctgtgatttgttgcctgattcgattggtgcaga

SEQ ID NO: 76635 - DNA, 1949 bp, Heterodera glycines
  Genomic contig location: Contig_ID=SeqID_1896; Location=348..2296; Strand=+
  SCN-specific regions: Sequence locations=1-1627,1655-1808,1831-1949
atgggcttcgaaagtgacaaccaagttcacatgtacaccttttacgaggatagtccgtccatgggattaattgcgtcgacggaaattcagccgaacaatgcgaaatcgcaagaattggccgattgggtgaaggggcaaattgaggggaaatttgctgctaaaatagtgcacgaattggaattggaaggtgagtaaattgtgggggaatttactgctacttttttattataatttgatgttttttatattctgatttttttttttgtatcccccagaaactctctcaatttttcatttttttcccctcgtattttccctatgatttgccctccctttttctgttttgtcccatttcccctcctccttttggcaacagatttggaaaatgccggcaaatccgacgctctcttccgccgtttgtcctcttcctccgccactttggtccttttctcccattcgcttggccttcgttcgcttagtcaaagtcaaattgcgctgcgaaatgtatgaaatgctgggaaatccctccgtaaatccgcttccattttaagtttgtcaagatttttcatcattgtccaccgtttttggaaaatttagagcggcggtcgatggcggagggtttttttggcgcgccgtcacttggccaaatgttaggcaaaacccgaaaaacatgcgcattgagcgctgaacaggtcaaaagaccaatcgaataagagttccatttgaattggtcttccttcccctttaagttggctttgtgttgcgaccgattttcaaaaaatggtggaaaatgtagcaaattgacccaaaaatactcaaaagttgagcagcaaaatgaggaggacaataccgaaggggacattaacaaatctggcgcagagtgctcatcactttcggagggtaacactccgaaattggcatttccccttttcctttttttcattcaattcccccccccccccttagacaattcattccgtcgtttttgctattcccgcgcaaaaggcaatgcgtccgcccattccgtcgctgaacgaccctttgccttcctctcctggcaccagcgtttgatgtgcaaattcgaccgaatgctccgtcttcgtcagtccgaaacccatcgccaactgcacacagaggaaacacttgtccaattggactttggccaactgagtccctcccggcaatggctcatcggtgccggctgtcgagtgaacaaatcgatgggctttttgacattggacaaacgttttggacgccatttcatgcgcaagtggggcatttcgaccgaaggagacgaaacggcggacaaagttgccattgtggcgcgagacgacgagcgaatatttgcgatggaaagcgcggaaggcgtgacaatgtccggtgctcgtcgctttgcttggattctaattaagcaattaaattaattaattttgttcagttcgaagttggccgattttgtggacgggttttacaacaaaacgctgaaatggacgcccaaaaatgagcaaattgtcgaaccaaccgaagaagaggacgaggaacacttcttcgatttgagcattttgcagcgaatcaatcggcaaatgtttttggaccgaattctcaacacggtgaaaatgccaaacaattggcaaaatgtgccattttcacatttcccttcccttttcagaatcgtcccttcgatgccgttctctttttctccggcggcccttcccacggcccttcccaaactttgctccattttttccaccaaacgcaaaagtttttcgaaggctttgagcaattcatccaattttttatgttcgatcttccttttttattagaatattttcattggcatttctaccttttcagaatcgattcttccaaaaattccttcgattggcattttgactttgaccatttgccaaccgtcgcctttttcccagccaacaggtaaaaaaaaatta

SEQ ID NO: 76636 - DNA, 980 bp, Heterodera glycines
  Genomic contig location: Contig_ID=SeqID_1896; Location=3742..4721; Strand=+
  SCN-specific regions: Sequence locations=1-301,323-468,490-756,779-955
atgaagcgaaccaacgcatcaaacatcactccgcctcgcgcaaaacgttcaatgacacctgcactggacctggacccaaacactgttgcactcgcagagcaagaacgacaacgcactttggtgttcattggcctcccggaaagcaatgccattcgcccatcggaacgtgttcaggaagacagggaagccgccacaaaaatcctggaccatcttgaagttgaggcccaaccaaccgccgtctttcgactcggacgttacgacccgcagcgaacaacaccacgcccgctcaaggtggtcatgccaacaaccacacaccaacacatggcactcggaggatggaagcgcgagcgtgctcgactccgttctctacaaaacctgaaccgcctgttcgtccgcccagcgctgaccaaagaacaactcaaggaagaatatgaagcgcgcttccgaaaacgtcaacaaaaccctgctcccgtggcaccagcaatgcaacctcgccagacaaatgttccgactcccgtcaaagaaaatggaccaaaccagaaggaggccagcgacgacatttccaaaccgccggaaatttttgaccaaacaatcctcgtatgttatgaagcattaaaatcattaccaccaaacgacaaaattgttcaccaaattcaatcactcgaaaaacaataccctcgtcttttcaataaatagttctgtcagacctccaaacatttcctcaaattaaaaaaaatacatttattccattacttaaaatttctcaccaaaatttttcctcacaaaaaaaattttttttttctcttctacaaccctaaaaaaacaaacaaccacttttctctttgttggaggtctgacttttctaatttctgcttctccattcaaaatttcaattcttttatcattactttccatttcacctcatttccgccaaaagtgtaagtggcacatgcccttcttttggttatttttatttttga

SEQ ID NO: 76637 - DNA, 1388 bp, Heterodera glycines
  Genomic contig location: Contig_ID=SeqID_1898; Location=676..2063; Strand=-
  SCN-specific regions: Sequence locations=1-81,103-175,197-277,299 -593,631-685,707-950,972-1146,1168-1233,1301-1309,1347-1388
atgtggcgaattaatcaatcacttattatatatattactggtggtttttatttccattggacaacaaaacttaaatccaagaagaaaatcagtaataaaatttgaaggcttctcccattttaaaagtttattttttgtgccagtggatcaccaaatttctactctaattgaattaaaaaagaaggacccacaaaatcaggtcaccaatgaacgacaaaaaattagcgagttaatgggtatatgattaaggttaattattgcttaaacgagcacgttctttttaaaaaattgtataaagttgattaatgtgccccatttctcctgaaggcaaagataatcccaaataattgtggaggaatcaacaaaaattgtgactttgctgaccgccgacggtcggtcagtcattggagaagggcgtacccctgggcgaaatccggctttccccgtcccgcctacgcccatcgccatttccaatgattgtcctgtgaaaatcggctaacgtccgtcctccggcgcgaaagccgccaccacaattaggagcgccaccgcctcgtcggcggcattcattggagttgttccagttctggtacctggttgttgtgttgttgttcttgttgattttgttgctgtcctcctccgcggcgctatgccggttgtagtggacagagcttgtcaaaatgacggacgcccccgcgggggcgcccgcaaggcgacaacgaccatcgcgcggaggaactcgcgcgagacagatcaaggtcgcgccacgcctcccccccccccctccgcaccggcgcgaccttattcaccttgtggtacacccaattcatcccactttcgttatgggggggggggattgggcgcggatatgtcatccatttcgggaggcagtcagtggtggattttgggatgaaagaatgaaatcatccgggagatttagaaggggccgatcaattttaaaactatttttagaaatacaagtgagcaaacgttgggatcaaaatgctcttcaatgtccatttttagaggagatatttgtcactgatttgggggtcaagcctctattctggataactgtattaccttgacattttgaattgatttgattttttgggatttttttcaatgaaaattggcagacttaatatcagttagtgacaaattattttttagaacctagctctaggcatactccccggtacagggctaacctgaaaaaatgaaaatgcttattggttttaaaatttttttagaaattctgatttttcattatttatttatttatgaaaaattaatattttttcagaaagtgctctgaaatgcaccaaaatttatttacatgttgataaggctctctgatgcttataatacgaaaaagggtgaataataaa

SEQ ID NO: 76638 - DNA, 2073 bp, Heterodera glycines
  Genomic contig location: Contig_ID=SeqID_1899; Location=861..2933; Strand=+
  SCN-specific regions: Sequence locations=1-31,94-227,284-495,517 -789,812-829,878-1012,1034-1297,1319-1380,1427-1476,1525-1627,1672 -1672,1735-1768,1837-2073
atgcatctgccaatgtatatccaggtaactgtattttaataatttaggtaaaaataactacaatttttaaattattttttatgaaaattaattgagtaggtccattataatccggaacatcgctacccattggaacatttggtggatttgttggccgaaactgtgcttggccgttacaattttgaattgcgcaaaaacttgacaatcgatttgttcgattcggtatgttaaaatcaaaatttttactttataaaataaaatcattgaaatttaaaaaaaaaaagtgttatttgtagggatgtaaaatttttgtacgaaaaatcgcgaaatatacaaaattccggaatatctatgaaatatatacaaagtcctccctaaatattaaaatatgtaaatagcaatgccacaaaaagaactaaacttatatagatgattttttttgactttttaaaaagggataacaatttttaaattaaagattttagtggtgcaatgttatttatttttttaaattttcataagaattttctttaattctaaaaacctcaaatacgtattaaaaatatgtacaaaaattttcacacgcataagtaatatgaaaaatatcagttaatgtgtttatatgaaaatttatatccctattggcattttaattatccattttttgaaaggctgcgaatgcggcaatccgtgacggtgccggattcattgtgtcggatcggcatcgctttcagcagatcagcgttggcgcaaaacaggcacgagcagtgctggcaccgacaaacggtgaaaatgaattgaaattaaatgatagtattaaaacaattgcaaatataaattaatttaaattttagaaatataattgaaaaataatttacctatttttgaagataaaccattaggagaagttatcatcttatgaaatgattttttaattttgattattttttccattttcaagtcaaaatcaaaatcgatgacttaaagttcaaatttttcactaagtcattaattaattgttcaaaattgcattttatttatcgcaaaagtcgtaagtcaaaaacaacgaaaacacattatttattctttttgtaaatactcgatttgaagagacaaaggttgaattggtgatttgatcatgcgtcttttgctaaagtgaatgctgatatttttaattttatttcgttggggttttaaaaaaaaatttgtttcagaggttttgatttcgcttgtttctgatgatcattcggaactgctcaaatacgatgcatcactgagcaaccatcaacgagcggactttttgaattttttaattaaaggtaattagttatatctaataattaaaagtaatgaataataacattaatattagctcatttcattaaaatgaataaatcttttaatttacttaaattaattaaaaattggatttacaattgaaaaaaattgtcagtgaaaaaaagaagataactaatgaaaatatttaaaaaatattttaataatgaaattcttttattaaattaaccaaaattaagaatgtaaaaatgtgctggtggcccattggagtcctgcgaaattggcggctgacgctaaagaaaaaggcacgaacaaaaaaaaattattggtcttttaaaaataaaataataaatttaaaatgtattcatttattttcagacaaagaaaatgaaaaagaatcagagggaaaagctgaacaaaaaggcgaaaaggaagaagccgttaacactgtggcaggatatttggtattttgaaaaatatataaaatattatttaatagaaattcataaatttttagattggaatatttattaattttatgccttatctaaaacttttttacagattgcttcctctgagcgcgttctgtgcctttatgcggaaaacagtaaaattgccgattctttgttggctgctcacattgacaggagcaatcagaagggaacggtaaaaatttaaatataatttccaatcatttaattaatttcgcttaaaatcagaatgtattttttctgaatttgatcacaaattgcataattttgttcataaatttttcaa

SEQ ID NO: 76639 - DNA, 871 bp, Heterodera glycines
  Genomic contig location: Contig_ID=SeqID_1899; Location=3310..4180; Strand=-
  SCN-specific regions: Sequence locations=1-29,51-329,352-373,395 -436,458-636,658-669,712-788,832-871
atgcgttcttttttcttcgccagcctcgctttggtgctcatctgtgcctccaccactgtttctaagccccacgcgacggtattgtggttatttccgataaaaggcatttaaatgtaaaacattcatattttttaagcctgcccatctgtcaagaccaatgggtgcaagtaagtgtgcattttgagtttctgcttcgatatatgccctttgggtgttcctttcacatggattaacatttctgtgccaatccccgactaccttaccctgccgccccttattttgacaaacattgccaaaagcaaaagcgaggtggaagaatgaatgaatgataatttaaaattatttgtatttcaaatggtaataattgattgtgtttttgaataaaatataagcaaataaatcagctaatttcataattctaataaaattatacgtgttttgaataaaaatatttgatttaattttttccctttttttacatgttctatattaaaggttaaatattaataattttatgagaattatcaggttgaaatatccaaggaaaatttctttcctaatattttcagttgattaatcctgaaaatccaggaattccaggcaatttcgataccgaatcagcgtctggtccgagccagttgaaaaaattacaaattacataacttccactattttaaattttaaaagattaagaaatgtaataattaatttcgaattacgattttaattttatgttttcaatttttttaatagcacttaaaatttcataaaaacagtttatcttggcatttatctctctttctctctttattttatgttgcatttcaaaaaattatttgaagcgttccacccatttataatttaaaataaa

SEQ ID NO: 76640 - DNA, 959 bp, Heterodera glycines
  Genomic contig location: Contig_ID=SeqID_1899; Location=5488..6446; Strand=+
  SCN-specific regions: Sequence locations=1-351,373-441,463-473,496 -547,569-682,704-723,747-937
atgaccacaataccgtcgggtggggctttgaaacagtggtggaggcacaaatgagcaccaaagcgaggctggcgaagaaaaaagaacgcatttttgggagttttcaacgcttaaaaatttgaaaatttgaatgcttttagagttttcaatgattaaaattgaaaaaatttgaaaatttgaagtttcaatgcttaaaatttgaaaattttagtgtttttagagttttcaatgattaaaattgaaaaaatttgaaaatttgaagtttcaatgcttaaaatttgaaaatttgaagtttcaatgcttaaaatttgaaaattttagtgtttttagagttttcaatgattaaaattgaaaaaatttgaaaatttgaatgcttttagagttttcaatgattaaattgaaaaaaataaaaatgtaaattctttcagagatttcaatgctaaaaattgaaaaagttgaaaatttgaatgctcaatagaggtttttatttaaatatatggtacaatcgggggaacaatggcatagcttcaaggaaaaaataatgcttttggagatttcaatgattaaaaatttgaaaaatttgaatgctttccgagttatgaatgattaaaattgaaaaaatttgaaaatttgaagtttcaatgcctaaaatttgaaaatattagtgttcttaaaatttcaatgattaaaaattgaaaattttaatgcttttggctgtcttattttacatttttatagtctctcatctgcttccaaatacattctttgaatatacattcggcatttatttttcggcaaaaatcatttgaaaatgtcagaaattaattcctctaataaccattgggaaatgatgaaataacccttttaactattctcagcaattcgaaaaagaaatcggggtgaaataatattttcacttaatattgaacctgggacaaaaaggcaaaatatgagaaaaa

SEQ ID NO: 76641 - DNA, 204 bp, Heterodera glycines
  Genomic contig location: Contig_ID=SeqID_12902; Location=10..213; Strand=-
  SCN-specific regions: Sequence locations=1-204
atggcaaaagtgatcatggggatagatgatcagaagaagatggcaaaagtgatcattgggatagatgatcagaagaagatggcagaagtgatcatggggatagatgatcagaagaagatggcaaaagtgatcattgagatatatgatcataagaagatggcaaaagtgatcattgtgatagatgatcagaagaagatggcaaaa

SEQ ID NO: 76642 - DNA, 935 bp, Heterodera glycines
  Genomic contig location: Contig_ID=SeqID_12902; Location=429..1363; Strand=-
  SCN-specific regions: Sequence locations=1-497,519-708,737-935
atgcaaaatcggcaggctggcactcgttcggtctgttcgccggcccatcgttggcgccagtgctaccatgtaagagtcccataccgtacctccccttgaccccacacattatagtaaccgttctttcagcactgtactcaacttctcggtgcgtctcattgaaactcttaagctcattccgcttctttccgaccacagttgctcgtcttctcctcttcctcaccagtttcaaagagttccgtctcaaattgtcggagcgccaccaactcaaaacattggtcaaccttttggagccgactttggacccacaattgctctgtttgctgctccaaagtgttgcgctggtggcgttggactcgtcgacgcatcgcaatttgatcgaaatgcaagtggacgacccgctcatccaaatgcttctccccgccgacgattggtcagtcgtttcttttctctgaattgagatcgacttttggcttaaccctcaggtactacacaaatcacagcaccaaatttggccattacgtgaaacatcatgcggctcggattttgatttacatcggacttggcgacagagtgggcaatcgcgtcaaccttttccagggttggtcaaatgttaacatcagcagatgcatttcacttcaaaaagatcccaccgattgctccgcccgtcggtcacttaccggccctttgccaccaccgacggggacaaacagcagcagcaacaacaacaacaacagctcaaccaacgaagacgagtacatcttcgagacactgaggacagtgacagtggcgcaggagttcagccgaacggcgatgtcggtggagggagtgctgctgaaaatattgcaggaactgcaccgggggcacagtggcggggtggcgatgggaaacggcacgcaggatgcgatcagagaggagaggtgatcagggcttga

SEQ ID NO: 76643 - DNA, 239 bp, Heterodera glycines
  Genomic contig location: Contig_ID=SeqID_12903; Location=629..867; Strand=-
  SCN-specific regions: Sequence locations=1-74,143-200,231-239
atttgatgtgccttgtgactggtgctgtcgtcggtggtgccgtaccggccggcactctcgatggcatcattgctggaggcggtgacgtcgctggtgaaggcattggcggtgccattgacaccggtggcggcggcggtggtggttcgtcaacgcctccaaaaaacggcatcgccgcactggcggacacgacatcgctcaacaatgaacagcagcagcagcagttgttgcaacagcactga

SEQ ID NO: 76644 - DNA, 163 bp, Heterodera glycines
  Genomic contig location: Contig_ID=SeqID_12903; Location=1..163; Strand=+
  SCN-specific regions: Sequence locations=1-53,75-163
aaattttgatcatttataaacaggttttcactgaaaattagccaatttataggtaaaatttttaaaaattttttgggaatttaatccaattcttaggggtgtaaaagtcgcttttcgcgccaaaaagcgaaatgcgaaacgccaaaaaatgcgaaaggcgaaa

SEQ ID NO: 76645 - DNA, 2638 bp, Heterodera glycines
  Genomic contig location: Contig_ID=SeqID_12904; Location=31..2668; Strand=-
  SCN-specific regions: Sequence locations=1-6,30-501,523-1009,1032 -1107,1133-1639,1661-1773,1806-1894,1924-2253,2276-2424,2446 -2552,2577-2638
  Gene Ontology: Mol. function=protein kinase CK2 activity; Cellular component=protein kinase CK2 complex; Biological process=regulation of cell cycle
ccagtgaagaaaaagaaaatcaagcgagagatcaaaattctggagaatttacggggcggaaccaacgtgatcggactgctggacgtggtcaaagatccggtgtccagaacgccggcactcgtgtttgagtatgtgaacaacacggacttcaaggttttggcatttaattttttggcattggcaaagagcattttcatcaacagaaataaaaaaacagaaacaatgagagagacacgctttgacagactaacaatttttgttggacctaaacccttttttgaaaaaaaaaattgaaatttgtgccgatactgcaaaatttgttgaggaaatttgtatgaaaattggaattttcactttactttacctcctcctgtgccatattcccttggaaactcgcggcaattttctcatttggtactgaattggcacgcacattgtttttttcgtatatttgggcaagaaagacataacaatagtaccgttttgcatattggatacgtccaataatgccaatggaaaattgtttcttaatttatttgttacgtcgaaattagaaattgtgctgaaatacaatgattcatcgttttttttttgttgaaaattgcattcattgagtgtccgcacccgaaattttaaatttttagggcccaaaatgttgcttattttcagtgcaaaacacgtgttaccatgctttgtacgaaaatccattccaaaaaatgggaatccgaaaaatttttcttcgaaaaatttgcttatacctcccccattttgtccagcaattgtaccaaacactgtcggactacgagattcgctactatctgtacgagttgctcaaggcgttggagtactgccattccatgggcatcatgcaccgggacgtgaagccgcacaatgtgatgattgaccatgagaagcgccagctgcggctcattgactggggcctggccgagttttaccatccccgacaggagtacaatgtgcgggtggcgtcccgctacttcaaggggcccgaactgttggtggactaccaggttggttgtgtgggggacagcttcgaattgtttggttgaactgctactacgtgtacaaaagttgacactaaaacccaaaaaaaatttttttttttttttttgtgcgtgcgttaaagtctcaatgtaatgaatgaattgagtggttttaatttttgtttggtgccttaatcgggtgcaccccaaaatctcgccgcccgaaatttcaaatatgtgttcagctaaaaaatccattcatttttcgatcgtgacaatgagtcaatggcaactcgtacaataaaaaagtttaaaaaacaaagcctaaggcttaggcctagccaagcctatgtgagttttcaggttagtttttttgtttgcggcgagattttggcccgttccccccaccttaatcattcgaccggctcttgtaattcttcgaacgtttcgtgtgtttttttccaattcgttggtcttgaatctttgggacaaataaagtgccaagcaagtcttcaagggtagatcattcgcagcgtataaaatgacacaattatggcccagttaaataatgctcacaatcaattttgtttaaaaaaaacttcactgcatttttttataattatgtaacaatgcgttcatccatcttccctccccacagtgttatgactactcgttggacatgtggtcacttggctgtatgttcgcgtcaatgatttttcgaaaggagcccttcttccatggacacgacaattatgatcaggtcaggtccataaaattttaagaaatttttgtccaaaatttaaaccaaatttgctgttctgtttaagttggttcgcattgccaaagtgctgggcactgatgaactgtttgaataccttgacaagtaccagattgagctggacccgcgcttcaatgacatattgggcaggtcatcaaagttagacaggggaatgcaaatgtggcaccatgacaattagagagatctgggttttgggattgtctggccgaggctttttgttcgacagttgaccaagctcgggtggtccgataaaaaaagcccgttttaccgtgggccagggcatggtattttcaaagaaatttttgggaatagcctcggacggccagtaaaaaacaaaagtccgtccgtcgagtgcccgagccccttccaatttctgatgaaaaaaaggatttgtcattctataactcaaataattccatacccatttctttgatggagatttgttcaaattttctgaatttttaagaggcatttttaactgtggcaaaaaatttggagatacaaatcggttaggtgaaatttataataaaaatctgttctgactcttgaaaaaatatgaatacatgttgcggcttcgttttgaaataaaaatcgtaacagattggtaattgaatttatttcttaaaaaccaaattttattcccagattttttccttacaaaaatgtttccttaccaaaatttttttcaaaactgaatcaacaattaatctctcttttattccagacataaccgcaaacggtgggaacgctttgtgcacagtgagaaccagcatttggtgacgccggaggcgatcagctttttggaccgattgttgcgctacgatcaccaggaacg

SEQ ID NO: 76646 - DNA, 1457 bp, Heterodera glycines
  Genomic contig location: Contig_ID=SeqID_12905; Location=53..1509; Strand=+
  SCN-specific regions: Sequence locations=1-97,126-521,587-633,695 -842,952-1002,1025-1080,1112-1352,1380-1457
  Gene Ontology: Mol. function=tyramine receptor activity; Cellular component=integral to membrane; Biological process =octopamine/tyramine signaling pathway
atgcagcgattgggaccgttggaactattccttggcacaatgacctatttggtgatcatcggcatcacaattctcgggttcgcattaatttaccatctttattatattaattattagtaaattaacggacggttttcgaggaaacttattttattatattttatcgagagaaatttcataatatccatatacagtatcacaacatgtaaccatatcttactgatgcgtttttaagtataacattgatataaactagtattttatgatagtattaatcatgttttgggtaacatcgatacagtattcatggaactacaaatttacattataccgtccaattataccgtatattttaaaattttcagcaacactttggtcatcctggccgtgttcagctacagaccgttgaaaaaggtgcaaaactactttattgtttcacttgctgcatcggacatgatggtcgcaatgctcgtaatgccattgcatgtcgtcaaattcttggccagtgcgtacagtttaacaatttttactttattttttttgaataattttaaaatttataaattcatttttattttctttatatcccctttaaattgagatttttccatcaaatttaaatcgtttgacatctaatttttttttgttaaatgtatttaaaattttaattaaaaataactattttttaaaatttctgggtgagcccttcaacttttcctccaatttttgtttataaacagccatgtgccaaaaaaaatgcgtgacgaattggtcaaataagcgccattttatgctcgtgggaaaataaggggtcagctgagcgagtgctgacaaaagcattcaaatatttgtttaattaaaaatatattttcgaaattaaatggaaatgataaaaaatttaaacaaaaataaaataaaaatcattttgtcataatttttttttgttaaaatcgtaataattctttctcaactttataatttaagagatttttttgaattattaaaatttaagagttttttaaatatgtcggtctttaaaggcaaaaaaatttaaaagaatactaaatcaatttcattttctgataaaatttcaaaaatacaaaagaattgactttgaaaaaatagtgcaatattatgaaagtgaaggagctgtataaaaatatatattcaaatcataaaaataaccaaatatatcattctcgatttactattttcatgcctgacttttttttaatttgaagttggcacaacaaaatgccaaacaattttttttagatggccaatggttgctcggtgtcactgtgtgccaactgttcactacggcggacattttgttgtgcacatcatccattttaaatctgtgtgccattgccattgatcgctactgggccatccataatccaattgcttatgcgcaaaagcgttcgttgaagctggtcggcggaatgatcattatg

SEQ ID NO: 76647 - DNA, 580 bp, Heterodera glycines
  Genomic contig location: Contig_ID=SeqID_12906; Location=512..1091; Strand=+
  SCN-specific regions: Sequence locations=1-169,208-217,239-270,301 -323,345-580
  Gene Ontology: Mol. function=serotonin receptor activity; Cellular component=integral to membrane; Biological process =octopamine/tyramine signaling pathway
ctggaaaatacgcatttcatttcatatacaagtgtaattttaatttctggaaaatacgcatttcatttcatatacaagtgtaattaaatttatggtaaaacttttttcatttcatatgcgtattttcaatttgtattttacaaatgtattttgatttctggaaatgggtattttcagtttgtattttacaaatgtattttgatttctggaaatgcgtattttcagtttgtattttacatttgtaatttgatttccggaaaaaaacgcatttcctttatactttaaaatggtaatttaattcccggaaaaacgcattatcatttcttactttctataattgccaattttgcataggtttgggtggccagtgcggtgatctctgtcccgccactgatcggctggaatgattggacctcgcaacagctggtcgatcactgtgagctgacatcggacaaagcattcgttgtgttctccgcttgtggctcattttttctcccattgctcgtcatggtcattgtgtacatgaaaatttttttgagcgcccgaaaacggatcagaaaaaatcggggtaagcgatttg

SEQ ID NO: 76648 - DNA, 1221 bp, Heterodera glycines
  Genomic contig location: Contig_ID=SeqID_12907; Location=176..1396; Strand=+
  SCN-specific regions: Sequence locations=1-76,98-448,472-883,905 -941,964-1022,1074-1221
  Gene Ontology: Mol. function=tyramine receptor activity; Cellular component=integral to membrane; Biological process =octopamine/tyramine signaling pathway
atgtcttgcgagctggcggatatgcagccgaagcacaagcgttcccatcgccttccggtggcggcaacgtcagtgattgcgctggccagcgcgaccggtgcacaaattttacggaagcgaacactgacgaaagctccatttccggacaaaaggggcgtggtcagcgttccggacgttgtgggcgtgcccattccgcacacagtgggcggagtcaacgcaaaaatgcctcagggaggcggcggaatttgccgcttgaccgcgtgtagtgcctcaatgcactcttccgtgttgtcctcatgttgtagtgtgcagcagccgcagttgtacgtgccgaagctggcgctgtacattgatggcattcaagcggaggaggaattggacggggacagcggacacgggggctcaaatgtatgttgggcatgaaaattataaattaattttgttgccgatattttataaataattttaataggtaaaacattctagtttggtttaatttaccaattcccattgtagaaagacagtcccgagaatacggtaactgtcccagcgtctacggtgctaaccaccgctccagctgcaattagtcattcgcctgctgcaaaaagtcactcgctggtgccaacagtcgctgccgctccatcaatggtcgcactgacgagctccgcgagtatgatggcaatggcgagtggtggcgagaggacgccagctgagagcggcacggaagtggcggcccacaaaaaggcaacaagtgatacggtggagctgaaaacgcacctaaaagcgagttttcgagaaaatatcaaagaccgaaatttgtaaaaactctgctgggctagagggttgggaattttctgattggccatgctctggaattctgagaaaaaatctatgaaaatgcctggaccaggggcaaaaattctgacttacgcctatgaaaaaattctaatttggaaccaataaaccccaagatctaagtccagtccaaggatgagctatggaaagtatattccagtacactgaaatatacaatttaattattcaatttgaataacaattttatttatatttaaggagcgcgaaaagatcagtgtggccaaggaaaagcgtgccgccaaaacaattgcagtcatcatttttgtgttcacattttgctggttgccattcttctgcgcttatgtgatcatgcctttctgtacaagctgctatttgcacccaaag

SEQ ID NO: 76649 - DNA, 1552 bp, Heterodera glycines
  Genomic contig location: Contig_ID=SeqID_12908; Location=449..2000; Strand=-
  SCN-specific regions: Sequence locations=1-93,115-168,208-304,326 -343,365-408,431-598,620-1101,1123-1127,1219-1517,1539-1552
atgccgtggcttcacattgcgcacatttctcgcgacatcagcgacgcaatggccttcatgcatggcaaaggatttttccaccgcgacctgaccagcatggtaagaggcgggaggagttgtgcaataagtcctccccccccctcctcgtgtggaagtttttaaaaagtcaaaaattattttaaaaaaaaattttttttttgaaaatttccaactgatttttttttaattttgcaaggtaaaatgagttgcttccggaaagatttttgctgcaattgtttgattttttattggcacctctccaacatctttccctcccaaataaaaatttttttttgaaaatttcataattggggaaatttggacaattttttaggcgtcattcccctgcagagtgacttttcaaattactattttttctacaaaattttttacttaaattttgggcgcccatataattccattcaattgcgccgaggatagataaataaaacaaaaaagttggcaactttcacagaatgtgttgctcaaatctcaaccgtccaccatgttgccgatggctgtcgttgcggactttgggctggccacccgaataccggacaattttgacacaaaactgcagcaggtgggcaccgcggattggaaggcgcccgaggtgctcagcgagcagtactatgacgaaaaagttggttaaaaaaaatgtttaaatttttacaaccccatcaaaaaggggcagttgggtgaaatttcggcctttttcaataatttattgtttttgttttttcatattaataactaattgtttaaatgagcatgtgccccaattttcagtctgatctcttctccttcggcatcattctgtgccaaatgattgccgccactgacgctgacccggacaagggcgtgtttcgcaccaaatcttttggcattgtcagtagtactttaatgcatgatctacttactatataattgtcattaatttgcttttttcacattttatttaatttaatgtccatttaaggattttgctaaatttgagcaaaagtgcccaacggatgtgccaattgagctgctgaaatgtgccaaaatgtgctgtcgcgtgagtgtttatttattttgaaagggaacagaaaatttttaaaaacaaaatttctatttaaaaatttttttttatttttttgtaaattttaatatttgaaatttttttatatataaatttttctccaatcatgaccaattttgtgttttttagaaggattttttctgaaatttttgtctataaaattgagatttataactctcgaaatttggctcgtaaaatgccatttcatatttcacttttgtttttctaaaccgcagttccggcccgacaaacgtccctcatttgatgcgctgttggaccgcttttgtgcccacatcatcccatgcctggcgttggcaatggcaacagacaaccatgacgacgagagtgcgctggtgttggacttggacgacgacaacaacgacggcattgccatgggcggcatcatcaatcaatcaatgacacataaataaa

SEQ ID NO: 76650 - DNA, 89 bp, Heterodera glycines
  Genomic contig location: Contig_ID=SeqID_12910; Location=1381..1469; Strand=+
  SCN-specific regions: Sequence locations=1-89
cacagtttttttttgccctttgtgacacacaaattaaattgaaaaaattggtgagacctgtgctgattgaaccacaaaatgaaccgacg

SEQ ID NO: 76651 - DNA, 787 bp, Heterodera glycines
  Genomic contig location: Contig_ID=SeqID_12911; Location=152..938; Strand=+
  SCN-specific regions: Sequence locations=1-210,240-440,481-526,548 -659,690-787
atgccaagtgcaatcaccgatgttatgacatgcgttgccaacaatcttatcaatgaggcggtagattattagtgttattgaatcaatttcaattcaaaagcagttatttcaataattaaggatactcaacgtatggaaaagttattgaaagaactggtatatgtggctatactgaatttagtgcacaattattggacacttcgttggggcataaaatttttaataataatattttttaaggtcgtcgtccatcgaatatttcgcatttattgacgatgtaattcttataaatatggtttggtcacttgaatctcctcaattccacgctaatggttctttggcaatacgcctacatgactgcataccccagcagcaaaatgctatcatattacatgacttcacgttttttattcaaattttctatcgctgtaattagtcagtttttttttattttttttctattttgataatattttttttcattagtttatttgatttatctcagtagttgtattcaattcttacgtataatttttgaaatatttatcattgtctgaagatgtgcgggatttcaggcgggggccgaaggccccccacgaggccgcgaagcggccgagtgagtaccttgggcgcagaaaaattattaaggaggagggttcattatttatttattttttacaaaattaattcataagtatatttacagaaactgctctgaaacgcaccaaaatttatttacaagttgaataaggcactctgactcttatattatcaaaaagggagatga

SEQ ID NO: 76652 - DNA, 348 bp, Heterodera glycines; identical to SEQ ID NO: 62244
  Genomic contig location: Contig_ID=SeqID_12911; Location=1136..1483; Strand=-
  SCN-specific regions: Sequence locations=1-1,24-160,190-348

SEQ ID NO: 76653 - DNA, 875 bp, Heterodera glycines
  Genomic contig location: Contig_ID=SeqID_12912; Location=1015..1889; Strand=-
  SCN-specific regions: Sequence locations=1-22,44-197,234-277,384 -475,597-770,792-805,827-875
atgtcattcaaaaatttgccggttggaaatttgaaagaaacaattggttattgggaaagaaaaaactgtgaaaatggaaaatttcgggtaaaaatttgtggggaaaaaaaattaaacgtacaattagcacataaacaactttagttttgcccaccaacaaaatgtgtaatttgcatgagaagagaggtacaaaaaagaaaatttctttaattaattataacaattatttttttcgagaaaaataattcttttttacccaaaaaatgaattttttgggtaaaaatttatacaataaaatttttattagttgcttaaaataaattatttttaaacatttttttgttaataaaatgggaaatttttaaaataataattattttaaagccaaacaaatgtaaaaatctcataaataaatgccaaaaaaagaattcttggtaaatcaaaaataaaattaaattaaagatcatgttcactcaaaaatatttttgaatttatatataatattaaaagattttttaacatagaataaacaaaattgaaatttaatctaaaaaaaagataaaatttttaaaataataattttttttgaaataaatgccaaaataaatttgaaaaatttagcgccttttcgcttttgacccctgcggccatttgtgcgcatgtgaacaatgcgctgaactgattgagaagagtgcggacaaaaagtgtccaatttgtcgagcacaaattgtgaagaaattgcgcatttaccgtccataaaattttgggccgatcaaaaacaatgcaaaatgttgaaatttgttggaatttattattattgttgtaaattttgtaaattgaacagttcccccgttcatttggcaagtgccaataaa

SEQ ID NO: 76654 - DNA, 1834 bp, Heterodera glycines
  Genomic contig location: Contig_ID=SeqID_12913; Location=478..2311; Strand=-
  SCN-specific regions: Sequence locations=1-155,178-228,250-456,480 -492,514-540,595-891,919-979,1023-1258,1280-1361,1392-1635,1657 -1697,1725-1754,1777-1834
atgcccgtcgattcgttgtgcgaattttctggcgatcattgtctgatcagatattttgagagcactgatcagtggaaaaacagcgcaacaagcgcactgaatcactggctttatgataagttcagttggacattagccgataaggtaaaaaaaaagttagcaaatgcaaccaaaattaatcttctcgatatccttcgaaaggccttacaaagtgtattttcaattagcttaaaaaattccaaagaatttcgcacttctgaaaaagttttgacaatttttgtgccttttaccgaacatttaatttttatgagtcaatgggaattcgtacaataataaattaacaagcaaagccgaaacggagcataaagcttaggcataagcttaagcctttaggcttagtaaaacttgtacgatttgtctttctataagttgtttaagagtttttcaccaatcccaaaaatatgacattcaataacaatatatccctaattaaaaaatgaagatgtatcaaaaatttacttatgtatttcgttgaaaaacatttattatttaataaataaaaagttttataaataattttttttattaatttatccttattctggcacttttgatgcttttttaggtggttgatacaatataataaaaaaaaatttcagcttgtattctaatcttaactgaattgttaaggaacacttttttcttaccgccaattttgactatttaattgaagtggcaactaaaaatcggcaaaatgacacaaaaatcagcttgaaagatgccaacctaatcgacttgttttggcataatttggcacaatcggcaaatgaggggcaattatggaaacggttgcgattggttgaccagcaacaaattgtgccgatcatcaacgaattatgcaaaataaaatggcacaaattaatgaaatatgaaagcatagaagaaagtacaaaagtaagttgaaagttggttaaaaaggaattttaaaatttaattctcataaatttataaattcaatttttcgttatttaatcttcgtaaatttgtaaaaaaagtgaaatatataataatcattttatttaacttctttggattccaaatgtttagtatgttcgtctattttataagcaattttcccatgtaaatcagagccatattgagtaattaaaaaaaagagcgtaaaaataaaatttaaataacggattaatttttttgtttttttggttttcaaaagcattaatgctcaattttttgcaagaaacatgttttggcactttccgatgttttaaattaattaaattcatttttgacaaataattgaatattttgcattttttccgatttttggtgcatttgcccccatatatttttaaaatctaaatttataaattgtccatttccatcattatcttttttctcctccatttagcactttttaatgatagaccccttttgcactctgtggccaaatgtgcaacaaaaagccgaacattttgccgacaatgcgcgggtcattgaggcgtttcgccgttgggtgtttttgccgcgcgcccaactcggcacggaaagtgcccaaattgtgcacgcgtcggtcgaacttttcgctgctcgaacaggcgcaaatttaatggacacgtggtggaaatggaggacaaatgagatgaacatttttagttgcattggtagaacagtaatgctattattataattattattatttaaatgaattcatcgaagaattttttttaatatatcctaaaatggcaaaaaacaaaacagaatttttttttacatttttgctgttgctaatctacaaaatttttccattaataaa

SEQ ID NO: 76655 - DNA, 313 bp, Heterodera glycines
  Genomic contig location: Contig_ID=SeqID_12914; Location=272..584; Strand=+
  SCN-specific regions: Sequence locations=1-313
taagatggtttaaagaaggccatttggcaagtggaactgaattgggtgctagaaaaaagtttgaagggttaagaaatgaaccaatgctctctgaaccaattttgatgtttcctgacatggaaaactacgatgaggatggttaccctgtaacggaagaaattgatgctcattttaaagaccccgaaagaaatgttgtttcacaaatttttatatagaattttgcataccgggaaaatttttaacatttgagtgtacttttgtaaagattttcaccaaaaaagaccattttttgaattttaagccatctttttta

SEQ ID NO: 76656 - DNA, 823 bp, Heterodera glycines
  Genomic contig location: Contig_ID=SeqID_12915; Location=70..892; Strand=-
  SCN-specific regions: Sequence locations=1-196,218-409,431-509,533 -587,612-823
atgcccagcccaaccccagaagtgaccttcaaagatcgttcagtgcatgagattcacttggagaatggctacacttatgttattgagcagaacttaaaggtttcttccgctcgtcaaaagtttttgagagtttctaaaattgtcaatttttcccacttttagcacttcgcctcggttatcaccgttttagccaagttcagtgagcaaattctgttgcaaccgaccgaagacggtttgatgctgtccgcctcttcctccgcgcggtcggcttacgcaaaagtgaaactgtgccgtcagttttttgaccggctgagggcacgcgaaaatttggggccggacggcgaagtgttctgtcggctggccacgaagagtttgatgcacattttcaagttagttgctttttcctattccaaaaatttatattttttaacgaatttttctaatttgcgattggatttccgtgaatttaatgccgaatgttttgcagaagcgcggcccaatcgtccgtcggccccgtcccctcgtgctcacttgaggtaattctgatttaaaaatttaaatttttgcccatttcaatatacattgtcttatatttccattttttaaaatttagttggacccccaatcggactttgcctacgtccatctccaatgtttgtccggcattcggcgctgttttgtgctgtcgttgcgtgagtatgccatggtctgtgacaatgtgttcaacgagcggcaacggctcaagaatcgggtgaccgcccacgccaaaatgctcgccactcttttgagtccgttggactgcagcgatgtaagcggtggatga

SEQ ID NO: 76657 - DNA, 1558 bp, Heterodera glycines
  misc_feature (713)..(713): n is a, c, g, or t
  Genomic contig location: Contig_ID=SeqID_12915; Location=1200..2757; Strand=+
  SCN-specific regions: Sequence locations=1-208,244-267,289-291,348 -349,371-519,541-611,656-765,807-939,1049-1141,1163-1239,1261-1558
atgatagcaaaattgttggatttggttgacaaagaaaaaggttatagtccaaaacatgctggtgcccaactgaggtaaacggttaatgaccatttgaaaaaacgtgaattagaatagccttatcattttaaaaaaaaatgtaattttctattttttcaccgagaattgcatcagactataaaaaaacgacgtggctttttgcttcctctaaaaattaattatttaaatgttaattcataaattgatttgttacttccctttattttgacttcatttcataaaatttctatctttataatataaattattatgactatttcaatttttgttatacatatataaaaaatggttgtatttttctttggaaattatgaattttcctttttttttttgcttttgagttttctacgttttggcctacctgaatttttttttttgaatatttttcctgcgtaaaagtggactatgatcacgaattttatattttagatcagtgatcagtgataaattttatgccaggaaaaatatttcaggaaaactcaaaagaagcttttctatcaaaatttccaagacaaaccaaaaatatttattactttatacaattttagcggaaaaatattaaattaaaattttttaaatttcttaaatatattaaggataggaaatggaaaagtttgtaaactttttttatcctcaattttttaaattaattnttgtcacagaagaataaatggaattcaaaataaagaaacgaaaaatgctttcttttaatttattatttttaataatttttatttttattatttcttcgaattttgcgttcgctggcaaaagcaaaaaaggcaaagaaaataataatgcatttttggcacatgaaaaggagcagcaggaagtggcagaaacaagcacaaaatatcaatgcccggaaaagacagaaagaattttaatagataaaaattgtgaaaataaataaaaataatttaatttaataaaataaaaaaggctttaaaaggaatttcaattaaatttttaatttttaaaaatatttgttaatcaaaatgttttttttgagatgagagtgatgacttagttcatttggtgacccttttcaaaagtttaattgtcaaatttattgcggctgaaaatgaatttatgaaaagggatttgaaaatttttcaattgaaatcactgtatttttttatgaagcaaataattggcgaaatgttcgcttttgcgattgaaatcggcacgaaaatggccacagaaagcaataccaaccaatggttttttgatgcaattgaaacaatgcgaaggcgatggcaaaaaattatggacaaaaagcaaaacagtgaatttgaaagcattggcgacggcacaatttgcaatttgtacaaatttgggaagtcatttgtccaattgttggaaaaaagcactgaaaatgaggcaaaatttgagaaaaaagtgcaaaaatatttggagaaaaagcgcataacgcaattctttgcttcggtgaattgaattttaatcgaattaaaaaaatttttggaatttattttga

SEQ ID NO: 76658 - DNA, 1052 bp, Heterodera glycines
  Genomic contig location: Contig_ID=SeqID_12916; Location=1075..2126; Strand=+
  SCN-specific regions: Sequence locations=1-94,137-189,211-542,564 -579,601-614,636-826,855-946,968-1052
atgctatcgcatgatatcaaattggttgctaatgagaaaagttattaccaacagtgccgaagtgggcgggttccccttcgtttgggaaaaaggcaaaaattatttcttttattctacaaaaaaaaaaaaaaattttcagatccaaatcccggattttccccccgaattccttcccgacactttttttttgaaaaagaaaaattttggacatttggccaagaatttgagtgccaaaaaacatgtaaatccgggcctggcgatgtccatttatgcgatatccccgtttggtttagatatatttacgcctacaatatgttcaattacaaaatcaacgttgtgaataatgttgtccaaatcaatatgccgaattggaatttgccatattttgtgtttttggatgatccaaacgaattaattgatcagaaatcaaatgaattattagtttatgaacatcattcgaaacaaaaatgttttgtcacacaagattataaatttgataaagcattgcccaaatgtgatccaattactttgtatgaattgatcaaaatgacaaaaatcattgtcgaaatgcaaaatgatcaaatttggattagcccaaaggacccggaaattttgaaaatcattgtaaaatttttgaattatttcgatattgaaaaaacaattacggaaagaatggcattttctgccgaaggcaattattgcattttggcacaatttgtgatggatttgttggagacagcaaacggagcaaattatttgccagacattgatattatcgaaatatttgttgtacagacgaaggaatggtgtacagatcaacggtgggaattaaaaaaaaactttaattaataattcaaacggtgctatgacgttacaaaatggatgtttgtcaaaaaccgtcaaaatgaaagattttttcatataactttgtttaaaatggaccaaattttcattttttatatcatttgatagccctaagtgttttctataaacatgcaaaatttcaaaaaattcgttaagcttcaagaaagttatgaccaaaaatgttcaaa

SEQ ID NO: 76659 - DNA, 377 bp, Heterodera glycines
  Genomic contig location: Contig_ID=SeqID_12916; Location=3217..3593; Strand=-
  SCN-specific regions: Sequence locations=1-154,176-179,210-248,272 -292,346-377
aattacgaattagcaattttatattcgaaaattttgcagttgataattgttgctataaccacgatgtgtgctacataaataaatatcagaaacgttacgattgtgatattaaattttgcaattgccttaatgaatatcctaattgctttctaacaaaagtctgttctccaactcatatcttaaatattttattttttagaatatattatgctggtcagttcatattttttgagaacttttaaagaaggataaaaataattattttattttaccgtcaatagatatgcatatgtattttaaattttttattgttatgtaaacttctaatatatatatatttatatacataatcatatgagttggcggttttaagaaac

SEQ ID NO: 76660 - DNA, 1553 bp, Heterodera glycines; identical to SEQ ID NO: 12917
  Genomic contig location: Contig_ID=SeqID_12917; Location=1..1553; Strand=+
  SCN-specific regions: Sequence locations=1-864,886-957,994-1118,1145 -1408,1431-1449,1474-1484,1514-1517,1548-1553
  Gene Ontology: Cellular component=nucleolus; Biological process=growth

SEQ ID NO: 76661 - DNA, 944 bp, Heterodera glycines
  Genomic contig location: Contig_ID=SeqID_12918; Location=514..1457; Strand=+
  SCN-specific regions: Sequence locations=1-323,621-626,648-649,673-944
atgattagaagaggtataaaagtgattatgagaggtacaacagtgattagaagaggtacaacagcgattagaagaggtacaacagcgattagaagagtgattagaagaggttcaacagtgattagaagtggtacaacagtgattagaagaggtacaacagcgattagaagaggtacaaccactgtcgaaaaggtacaataattgttggagaggtacaaaaattgttcgaatggtacaataatggttaaaaagggtacaatcatggttttaaaattaaataattaaggaaatcgtttattaaaaagtaagattaaaaattgatgtaattaataaatttttaaaaataaaataaatttccttttattaattaaaaagagagtttaaaatgtacagggattgaatatttatttaaattgaaattaagaaattaatattacaaattctaatttaaaaaatacaggagttctttaataaaagtaaataaattattattttaatttaaaacatttttcacaaaaaaataatttaatttaaattaaaaatttttattttttatggattaaacaaaactatttatatttattaaaatgaaaattaataatataatatttatttaatttgaaatgaaattaaacatgcaaaagtaatcaaaaaatgcacataaaaataatgtacaccggccggattcgaacttccccccccctcaaaatgatgcctcagaatccccaatcacacagggattctgaggtcttaacgatgtcaaaagtaaaatgtgatcacgtattcgtgatcagcgtcataaactacccctaaagacatgtttttggaatattttcggtgaaaaaattttttcactcaaaaatcctgtcacccccctttggtaccgaatcacaaaatcacttttatttttgtatcttttttttaaaatgtgataaaaatataaa

SEQ ID NO: 76662 - DNA, 3337 bp, Heterodera glycines
  Genomic contig location: Contig_ID=SeqID_12919; Location=1053..4389; Strand=+
  SCN-specific regions: Sequence locations=1-323,345-473,495-1016,1067 -1206,1230-1729,1751-2010,2032-2446,2468-2603,2626-2942,2964-3337
  Gene Ontology: Mol. function=long-chain-fatty-acid-CoA-ligase activity; Cellular component=lipid particle; Biological process =gametogenesis
gtgacaggaggcaaacgaattgagcaggaacttgccgagtttgaccttcccttttacatcgtcgcattggcctttttcctaaaggcgttcttccgtctgtatgacttgctcgtcttcatcccattcaaattatttgctgaccctgagctgaaaaaggaacgctctcgtgagcgaaaggttttgcgctttcaaaagtaaaaaaagcaaataaaacggaggtttgctttaggccatgcccatcgatgggaagccgacttcgtcctggagacacgtcgataccattggcacggctctgtacaccgaactgtttgagggctgtccgacgcttggcaaaatttgggacaaagcggcacagttagtaattggctttatttatttatacatgcgtttatgtttgaattgaggttacaccgtggacacaattgcatgggcacgcgcgacattctcaatgtcgtcgaagaacagcagccggacggaaaagccttccaaaaattggcacttggcaaatacaattggatgaattacgaacatgttgatgaagtgattgtggaagttgcttctggactcagcaatttgggcattgtccaaggacaaaaagtggtcattttctctgagaccaggaaggagtggatgatctcggccatcgcctgcttcaaattgggccttccaagtgcgctttaccacaaatgatctaatacttttctaaatcgcccttttcagttgtcaccgtttatcccacgcttggtgacgaggcaattgcttttgccttggccgagtgcgacgccgttttggcgtttacttcgcgtccccttctgtcgaaagtgttcgcttccgtcaaagactgtcctcagctgaaacgcgtcgtttacttcagcgaactgcacgcacttgccgaggtcgccgagaaagcgcctgatgcgataaaggaagcgttcaaaagtatcggacgcgaactgtacagctttaacgccctcaaggcactgggccattcgcaaggtaaacaaaggctcccccggaaattttaatttaaaaaaatctagaaatcttaattaagaaaatttattttcaatagttttttgagaaaaactcttggaaaagatggggtcgaaatgggtaaactcagaattaggctcattttcttaataaaaggcaaataaatgcctttgataagccaatcaaaagaagtcaatcataactaaggaccaattttctctttttgtcccctcaattccacactgacaatccaatgaacagctttaactgtttcattgcagcaaaactcgagcggaatgtgcagccggacgacttggcgatgatcatgtacacgagtggcaccaccggaaagccgaaaggagtgcttttgtcgcatcgcaacatcatcgcgacggcttcgggacagagcgctgtcatttcagtcaggtgaataagcaaaaaaaaaattaagcctacactgccgacaattcagtaccagcgacacaatcattggctatttgccgttggcccacattctcgaagtgtgcgccgaaatcatttgcctgtccaaagggtgccgagtcggttactcttcgcccagcactttgcatgaccgtgccgtgaagattaagaggggaaccactggcgattgcgtcgaactgaagccgactttgatcgcttgaggaggcgggcataaaggtgggacacgacgcaatttcaccgccggagaaaagagactcggccttttcagtaccacttgtcgcccatttgtccctttctcccccgttcagacttatatgaccgtcatggggctgcatcctatggcattttatgcttcgcatgctctgatcggtgcttttagcattctcttcgtcgttggcgccagtgccgttctgatctcttccgcatttgcggtcggttggcgggaatggcattgtcccgtcaagagtgcgctattacgccaattaagggggggggggcatttgtcgtccatcccttcccacaactaccgctgtttctgctgactctttctgttcagttcgtctccgtttcgttgtttctgctcttggcactgctatacgccttcagttgcattcagttgaccgtccttttctgcacgttcactcaaaagggacaattggtccaattgatggttcgtccgtccctttggcattccgtccctttttaaattcgaattctccccgaaaggtcggtctgtccttccaattgctcggcctgctcagttggaagttcagcccgcccctgcacagtgtcggccgttgtctgttcgcttcgcttaatcccgtggctgcctttggtctcggcgtccaaatggcgtgcactttcgaaactcgaagtcggtatttgccaattcagtacgtggtccttatgtcccattttgcccttttgtacttacaattacctaattaacactgactaattgcccattagtgtttctgctcgattggccccatctcttctccggctcctcccatcagttctccgtcggcttggccatgcttatgctgctgttcgactccgctctcttctctctgctcactttttactttgactccgtttggcccaccgatgaaagcccccggaggcatccgctctttttcctccaggcattttttgattgtttcccaatttgaattaaaacaccctgtgaaaatcagcactttggcatcggtctgtccaattatgagaaagtgacaccgtacggagaggacgaagacggggagggatcggctacggtggccaactccgagaacaccgaagtcgagacaacggagaatcggacggcggacatcgaagtgcgcgggatgagcaaagtatgggagtccaccggactgatggcagtgaacgcgctgagtttccgcgcttaccggggaaaggtaagcaatgcgatgccacggggggcggggggagggggggggcttttatcccgcgggcttttgccactttaccattttttcattaattaattttcacaagcggctaattagtgtggccactttttgcggcaaccatcccattgccatggtcaatgtcaatatttcttatattctgcccattttaccacgattcctcgtctttggcatgtccccgctcggcttcgtctcccctccccccccccccgcacattccccgggtcggtgcaccccaaaacgtcgtcggccgaaacgtcgtcggaagactttttgaaccataactttgttcactgtcaatcaaattaagaattgttgatgttgttcgatagctctatgtgtttattattaatttgcaaaatctcaaaaattttggttaagtatcaaaaaagtaatggccagaaggaactcaaaaacccagtaattcgaacttt

SEQ ID NO: 76663 - DNA, 208 bp, Heterodera glycines
  Genomic contig location: Contig_ID=SeqID_12919; Location=4182..4389; Strand=-
  SCN-specific regions: Sequence locations=1-208
aaagttcgaattactgggtttttgagttccttctggccattacttttttgatacttaaccaaaatttttgagattttgcaaattaataataaacacatagagctatcgaacaacatcaacaattcttaatttgattgacagtgaacaaagttatggttcaaaaagtcttccgacgacgtttcggccgacgacgttttggggtgcaccg

SEQ ID NO: 76664 - DNA, 1056 bp, Heterodera glycines
  Genomic contig location: Contig_ID=SeqID_1900; Location=2370..3425; Strand=-
  SCN-specific regions: Sequence locations=1-84,161-170,193-303,325 -461,485-519,541-730,818-965,987-1020,1042-1056
atggaaaatgatcagaagaacattttggaaaaagtcagtgaattggagaagcagacacagaaaaaggtgaatgaattggaagagaaaataaaaataaataaatttaacggtaaaaatattttaaattaaataaattatacaaatatttatttaaaaatatcgaattatttactttcaggggttttttaaattccaacaaaattgttgggatgccaatttttgtcatgataatctcgaaatcattggtgacaaaagtctcattgtccatcataagggaaatggtaatggtatttttaaaatttacataaaaattcaatttcccttaaaaaggttggcgctccgtcttcgctaaatatccgattgtgctgaataagcatttgtccgactttttttactacgaaatttcagttatgaaaaacaacgaaaggcgaaattagtaagcgaattttgtataaaaagtgaaatattttaatatttattttttctttattcagtcggggcatcatcaccttcggattcgctgttaaacagcagacaaaattggatgaatcaattcgatgggaaaagggcacttatgcatttgacaattatggcaatattcggattaacggaaaaggaaatgaatcaaatgcccaatattcctacggtgttggcgataccgtaggaattggcgttcatttggccactcgacagatcattttcaccaaaaatggacttcgtttgggttagcaaataataaataatataattttacgattttaaattacaatttggttaattgtctattttatctaatttattttatgtttaaaataatcaaaaatcccttaactttttcacagatacctctgattttttggttgctccatcttttgctgatggttctctttatccattcgtttctttgtttggctctggtgaccaaattgaggcgaattttgggcccaatttcaaattcgatttggcgactctctgaaggaagaattaattattcactaatgttttcgatcaatttgctctttttattcatttttatgtttttattcttcaattaaa

SEQ ID NO: 76665 - DNA, 378 bp, Heterodera glycines
  Genomic contig location: Contig_ID=SeqID_1900; Location=499..876; Strand=+
  SCN-specific regions: Sequence locations=1-154,176-179,210-249,273 -293,347-378
aattacgaattagcaattttatattcgaaaattttgcagttgataattgttgctataaccacgatgtgtgctacataaataaatatcagaaacgttacgattgtgatattaaattttgcaattgccttaatgaatatcctaattgctttctaacaaaagtctgttctccaactcatatcttaaatattttattttttagaatatattatgctggtcagttcatatttttggagaacgttttaaagaaggataaaaataattattttattttaccgtcaatagatatgcatatgtattttaaattttttattgttatgtaaacttctaatatatatatatttatatacataatcatatgagttggcggttttaagaaac

SEQ ID NO: 76666 - DNA, 906 bp, Heterodera glycines
  Genomic contig location: Contig_ID=SeqID_1900; Location=4867..5772; Strand=-
  SCN-specific regions: Sequence locations=1-28,50-69,135-300,337 -339,363-386,468-567,590-604,628-689,711-906
atgtcatcattaaacactttttcatcagcggatgaattttctcctctccaacgtaaataattaaaacgcaataataaacattttttaattttcaaatttgttaaaagtaattttttaataatttttcatttttagcaatttttccaaatctgagcacatcggaggaaatgagtgttctgattgcccgaattgctgagctgaatcgagcgcaaacaatggagccatctgttgccagttctgaagtgtttggacaagacggatacggtagggaattttgtataattgagtggatacagtatgaaaattatacaataaaagaaatggttttgaaattttattctgtaaaatttcataaaatttgttttgtttcaaaaaaagtaatggccaaaaatatttagaaaataacttttttatttaaaatagagccaaaattattattttaaattttatttcataaattttattttgaggaatgaatgatgatcagttcagtctggaggaagaagaaggaaaagaacagcaagaagacaggaaaactccgacaaaagatggtaatatacaaatattagaaggcattttcagaataatttgctaacttaacaacattttaattttatttaaaaaattgcttcaaatttcagtttcggaagatcatttgaaagcaattttggagagaattggtgaaatggagaagcagcaacaacagcagacaaaaggcgagggcaatttaacgaaaatgaaattttcgggcttttctttcgtaactgcgcaattgaacatttttcgaatcctttaattattgagaacattttgactggcagcagcagaattaatacaatcagagagaatcttaaaactcgaccgattctgcgaaaaaatgctaaaagcataggaataattattaaa

SEQ ID NO: 76667 - DNA, 108 bp, Heterodera glycines
  Genomic contig location: Contig_ID=SeqID_1900; Location=3734..3841; Strand=-
  SCN-specific regions: Sequence locations=1-108
ttaagctgctgaggaacggttcttacaatcgcaaaatgatcagaagaaaattttggaaagaatcttcagtgaaatggagaaagaacagaaacagctgcagacaaaagg

SEQ ID NO: 76668 - DNA, 1677 bp, Heterodera glycines
  Genomic contig location: Contig_ID=SeqID_12920; Location=1261..2937; Strand=+
  SCN-specific regions: Sequence locations=1-314,380-811,833-1043,1081 -1107,1132-1200,1224-1295,1317-1326,1358-1421,1450-1485,1533 -1579,1614-1677
atgaatgtcggagattgtttttgtggtgaagccttgtatcctcttcctggtgaacccattgacctgacaagacaggttgtccaattaccatgtgagtgcgcaccatttcatattggctgcattgctgccagcttaattcggagtatacaacttcaaccaaatggtcagcgacgcggaacttgtcctttctgtaggagaccgtcattaacagaggaatcacttttacaaatcaatggcaacaaattggtaaaatatcaaatgcaaataatgttatgctcaataaatttgactcttgcttctaaagttggacctttaccaccaccgcaaccactgcaaccgccactgccgccaccaccgccgccacttccaccgccgccacttcctccgccgccgcaagagccaccggtgcacattgatccacctgtacctcttgaagagatgcagccacagcagcgaagacgtcagattgcagcgattatttgctcacgccgaagcaatgaaggcaatgggcgagaattgcgaatacattggcacagtgctccttaccgaaatgacacttgggaaccggaacaacatataagagatgttagtgtattctagctccattcaattttaaaacccgttttttagcaagccccattaatctatgccttatggcatgaacgacatgataatggagaaacaccttcccatgattatgtgtttccgttacgtccagctccgtggatgacaacaattagggcaggaagagatcttcctgaggtagaatttgctcattcaactgctcgtcgacgtctgttccaggaggcgaatggtatgatgattgtccaatgcaatatggaagaccatatttggaatatcaacccagttgtgaatggagaacaacatgcacaaccagcacaagctgcacaagaggatgtagctgctgacattgaaattttaggtataaataaaatcattgctgaaaatatagttttattaagaagagatcgtcgtcaatccgcagggaatgcccgaaaatgagttggaaaacaatgccatcgaaattttagaccgtaataaaaatacaaaaaataagcattatttacttcatatatattaagttgttcaacaacaacaacaagctgctgaagctgaacaacctgcttatgaacacgttcgtcaaagacacaaaaggggaaaggtaataaataaagattcaaccaattttattatcattatatattatttagaacttttgtggggcagagagacgtcgcagacgtttcaatcaacgagctcaaaattaattcatttgttttgattgtttttgtctatcatttatcattatttaaacaatttatttattgttctttatttgtttatgtgcgtacacttggtcggagtccttactccccagtgtttcattcatgcattaaatttctgttttatttattttatttgttttggacataacacttggttggagtccttactccccagtgtttcattcattcattcatttctatattttgttctctcatttatttattttgttttgttcacaacacttggtcggagtctttactccccagtgttgcattcattcatttatgtttatgtttgacaaattgcatttttttgttgtatgcacatacacttggtcggagtctttactccccagtgttgtgtgtttta

SEQ ID NO: 76669 - DNA, 477 bp, Heterodera glycines
  Genomic contig location: Contig_ID=SeqID_12920; Location=3243..3719; Strand=+
  SCN-specific regions: Sequence locations=1-409,433-477
atgaataatcataataatattgatccacttatacttgatggaatttcatcggctataaattcatttgacaccgaagctagaaaccaaataatgcaagaacaactacgtatcttcttcaattcccaagtaaaaatttagatttttccgattaactaagtaatttagccacttccaacaattggatctcgtttgaacgcagtctactcccagattgttgatatacgtgctcaagcaaacataacaattgcacctggataccttcaacatagtattcaacaaattgaaaatcatcttgccgattccttgctttttcttttggaatggctccacgatgaacaaatgttagcagaagaaattgtaaacagtgatgaaattttgtcagatgagaatttgcctgagtttgatgaataatttgtttgtttgttttatgcacacacacacttggtcggagtccttactccccagtgttgtgtttta

SEQ ID NO: 76670 - DNA, 581 bp, Heterodera glycines
  Genomic contig location: Contig_ID=SeqID_12921; Location=51..631; Strand=-
  SCN-specific regions: Sequence locations=1-93,385-399,432-557,579-581
atgagaatagagcaacaaattagctgcacaattggcatcgcacgtgatcgaatttatgaatggaagagggaattgggcatgaattgtcagttgtttttttgaaaatttaaaatttgaaaattaattttactttgttttttgaaaatataaatttgaaaaaattaattgtctgttgtttttttgaaaatttaaatttttaaattaattgagagttgtttaaaaatttaaatttgaaaaataattttactttgttttttttaaatttaatttgaaaattaatattcagttatttgaaaatttaaatttgaaaattaattatcagttgttttgttgaaaatttaaatttaaatgaaaattcaaattaatttttattttgttttttaagtgattcaaaaatatacaaaagaggaaagggaaaaatttgttcaaatgtttttaatgataaagaagaaggcaattgaaaaatatccacatttaaaagtgacaaaaattgaggagaaaattgctgagaaaattggggtaaatgttgaaactcttagaggcatgaagcgaagacaaggattttatggttagtaattaaa

SEQ ID NO: 76671 - DNA, 496 bp, Heterodera glycines
  Genomic contig location: Contig_ID=SeqID_12922; Location=221..716; Strand=-
  SCN-specific regions: Sequence locations=1-120,142-387,409-496
atgttttttcttttttttctcatcttttcggctaatgcaactggtccaacaaattactataacaaaacatccgactacactgattatattgggaacaatatttatcaggcttttcatttggaacaagaattggacaaatccgatcaaaacagtcaaaatgatcaaaatggagacaaaatgttttcaaatttgacggaatctgatcaagttcaaactgatgaaaattcgactgaattcgaaccgatggaggaagaaaattcaccaaattttttacggcataatgatgccgattatggcatcaggctaaatgttgaagacaattatgatttatgccgacaatttgttttacaatttgatgcaatgaaagcggcatttttgaaaacccacaaaaatcctgagcgtaaaaaattgatgagaatagagcaacaaattagctgcacaattggcatcgcacgtgatcgaatttatgaatggaagagggaattgggcatgaatt

SEQ ID NO: 76672 - DNA, 762 bp, Heterodera glycines
  Genomic contig location: Contig_ID=SeqID_12923; Location=199..960; Strand=-
  SCN-specific regions: Sequence locations=1-18,43-196,218-500,529 -561,583-741
atgctgatgaagctcttcattagtttattttcttctgtttttctctttatgccatcattttctacaaaattgtggacaaatactgaaactgattcgctaattgactcctctaatcgttctgttgatgatgctaatttgggcaatgttttgccatcggaaaatgatgatgcttttgtgtctattctgatcaaaactgatcaaaagcaaattgatcaatttcttgaagaaatttatgacgaatgtggagaaaaaaaggagaaaaatttggaaataattaacaaaatattaaaaattagaagaaaaaatgataaaaaatcattgaaaacagaggaagatgaacaaaaaattaaaattgttcatcaatttattgaaatgcaaaatgaatttgacgaaaatggaaaacgaaaatatgaaaatgtgaatgaaattgcgaaaattattggtgtaacacattcaagaatttaccattggattgataaatatggattatcacgtaaaacaatttttaatttaaaaaatgtaataaatgcattttgtttatttaatccaatttaagatttgaaaaaagacatacaaaatgatcgacgaattgcaattgttcaccaattttttgcaatgcaaaaggaattggacgaaaatggacaaccaaaatatcaaaatgtgaatgaaatttcaaaaaaacttggtgtctacagttcaacaataatttacagatggatgcacaaattcggattatcgcgtaaaaacttatttttaatttaa

SEQ ID NO: 76673 - DNA, 2259 bp, Heterodera glycines
  Genomic contig location: Contig_ID=SeqID_12924; Location=494..2752; Strand=+
  SCN-specific regions: Sequence locations=1-240,275-277,300-352,374 -443,466-466,520-543,580-646,670-830,1140-1174,1227-1337,1395 -1611,1655-1732,1927-1933,1972-2130,2189-2259
atgccgccgtctgatctcaacgcgtcaattgctaaagtgcaaaatgattttgcactcaaattgttgcgcgaatttgccgcgttttacggcagcgcttccgcgtgcatttcacctccggctgttgcggtaacacttgcgctgacgctgtccggtgccaaagacaaaacgtcggaccaattaagccaagtgttggcaaaaggtgccataaaatgcgacccaatggcatttagtcacatgcatttttggaaaatttaaaatttgaaaacctcaaaattagctttttgggattttaatttttgaatgactaatcgcattaatatatttttgactaattttttccgaagctttattgtatatatctttgtatatttgaaaaagctcatttacttcttttttttattgcataaactaacaggaaaaagtctttatctgttttaaatctgcttggtgatgatgtgtgctggccaaaaaaatttttactcaaaaatataaaaattcattaaaaatttacaaaaatatcaaaaactcattaaatttagccccaaaaatatgaaaaaattattaaataaacaaaatttaggaacgccaaaataccgcattttgccccattttggcgcccttttgaatttgctgcatggagggggcaaaaaatatgccaaatttactgtcgaatcggtgtgcaaattgtgcttgaagtcggacattgcgttgtcagatgcgttcaaggcttctcttgacaaatattttggtgctcaccttgaattggttgattttggtgagaacatgaaacaagtgttggccacaacagcaaaggcaaattgaatttgtgcatttttaaaatttattttaatgaaaaaaatgtgcaattaaatttttatatcgcatttatttaaatttgaaaatgaatttatgatttttaaaatttattttaattaataatgtaaaatatttttgtatctttttaatatttcatttatttaaatttcttttaaagaatttataataaaatttaaaaaaatattaatgtatttatatctttataaaaaaattagtaccaaaaataaatttataaaataattttacataattataaaaaaaattgaaaattaaaaaaaaaactttctattaaatttaattttggtgtagaaaacgaaaattgaaaaaaatctttacgataatatataaaaatgagattttttaatatacaaaattttattttaaataatcccaaacaatgatgcaaaatatttgtcaagatcaacaaaattgtggttgatgcttctcatggagcagtcaaagaaattctgaagccggaattattcaatgctcaaacaaagtaatttaaaatattttaaatttaattaaattttttaaattttctttatttattttaagcctccttctgttgagcgcattttatttcaaaggcaaatgggcagaaaaatttgatccggatttaacacagaaaagggcattttttgttggaccaacagatcaaaaagaggtcgtcgttaatcattgtaaatataattgctaataatttttaaactttattgtaggtttatatgatgcaaaagacgcatttctttgattattatgacgacaattcggtaaatttaattaattattttttaaattaaaaattgataataaagactaattaaaaacaccaatattatttgaaaccgtgaaataaaaattcattaaaagttattggcatttatttagaatcttaaaattaatgaatttgaaaaataaatttctatttaactatatttttatttaatatcaaaaaataagttttatattaacaatatttttttccattttaattataattaaaatacaaattaaatttgtctttctttacattaattaaattgatcaaaatatgtaaataattttattaaatttaaataaattaaacaggtatacaaaaacaaatctgattataaagagaaaatttctgtttttaaggtccaactcttggcaatgcaatagtgatgaagcatcaatgtacttagctttgcccaaggagcgttttgggcttgcaaattttctggcaaatttaaccgtcgattctctgttcgaaatggcacaaaaatgtcgaaaagtcaaattgaatgtgagtttaattcttttaaatttaaaatatttgaattaaataatttattaaaaatttattttaggtggcagtcccaaaaatcaaattagaacaaactgttgaattgaatgaaccgttaaaaaagttggggcttg

SEQ ID NO: 76674 - DNA, 478 bp, Heterodera glycines
  Genomic contig location: Contig_ID=SeqID_12927; Location=1221..1698; Strand=+
  SCN-specific regions: Sequence locations=22-144,167-352,375-478
atgtttgatggatattttcctttgttgaccgtcttcaacttggcctcaaattggcacttctttcgccacgtttcgatgtgctggtggacaaaatttcaaacatttcggttggaatgtaaaatttttttatactaagaaaaatgaaaatttctttgtttttaatttgaaaaaaaacaataagaattaccaatgcagttatatatacaaagaggcagaaatttttcattgcacatttaaagattttcaaaaattttaatagttttttatgtgttttttgaaggattttatgcgtaaaatatttaatggcctccaagtaggcaagtttttttgtgtgtaaaaatgagaatgtttcaattttttaaattatttttttagggttttttccaaaaaaacgaacttcaattttcagaatattaaagtggtgatcattctccccttttgatcgtccatatcttaagagaacatttttttcttaaaa

SEQ ID NO: 76675 - DNA, 354 bp, Heterodera glycines
  Genomic contig location: Contig_ID=SeqID_12927; Location=2008..2361; Strand=+
  SCN-specific regions: Sequence locations=1-131,167-354
atgcttcacaacacggtgattgaggtcatcgaccgagtgtgcaaagagatggcaattcgccagcacaaggatctcctcttcggaggaaaaacggtcattttcagcggtgacttcaaacagtcgctgccggtcgtgcctcatgaaggcttaaccgctcaggtgacagcctgttttcaaacgtctccgttgtttggtcaattcaccacgatgaaattgaccatcaaccagagactgggccaaggtcagcaagtgtacttgcaaatgtgccgccaaatcgggctcggagaaaccggagagcacttctggattcctccgcagttcctcgttaagagcaaggaagagctgatagattat

SEQ ID NO: 76676 - DNA, 188 bp, Heterodera glycines
  Genomic contig location: Contig_ID=SeqID_12929; Location=7..194; Strand=-
  SCN-specific regions: Sequence locations=1-87,137-148,170-188
atgtcatcgttgggccaccatcgttctcgtgatcgggaacgaaatgttgaagcaagatctgaaagtgcggtatgttgcatggacaacattttttcaattaaatgaaattaattaatttacattactttaatatttaggcttttgctgtgaaataattgggaaaatttttattttctgaattcattaaa

SEQ ID NO: 76677 - DNA, 389 bp, Heterodera glycines
  Genomic contig location: Contig_ID=SeqID_12930; Location=1520..1908; Strand=-
  SCN-specific regions: Sequence locations=1-169,194-389
ccaaaaaattacaatatcactggccttgtcgaccggtctttgcaaattccaatttcaaaactacgcagtgttttcttggcttatgcccaggctcgccttttcgatttggaggtgaggaaaatttttttccagaaaagcctggcaaacgacccggtccaggccaattttcattattttattattttttattttaggactttgctaattgttgtttgtcttacattgacaaaaatgcggacactgtgttcaaatcggatgaattttttgcagagattgacgaaaaaaattgtttaaaaattgcaaatcagtggagaaatttcaatttaggaagcattaacttttctgttatgctgcccccataagaatggcatgatcccgaaaagaataaa

SEQ ID NO: 76678 - DNA, 1328 bp, Heterodera glycines
  Genomic contig location: Contig_ID=SeqID_12931; Location=189..1516; Strand=-
  SCN-specific regions: Sequence locations=1-70,93-498,521-542,589 -750,782-1328
atgtcagacattcaaaaagaatcagaggaaaaaatggcaaaagcaatgtaaaattaaaaatgccaatttcaatttttgttttccttttctcagtttcatttccggcgacggttggctggcggtgttcgatttgctcccgccttctcaacttggccttggaattgcaatggtcagccatcgttttgacttttacgtggatgaacacttcaaaacgcgcaaatgggcattgaaatttcttcgaattcgacgtaaaattggagaaaatggcaccaaggaaatggaaattgccaattacgatggaaaaccgatgccaattccgaacattcagttgccacgcaaagtcatcggattcaaatgcatcaagatcacgtaaaattggtggaaaactttagaatcgggcccgctaaaaaccgcccaaaatgaattccaatcaatctttaatgacttctaatcaggcccatagttaaggggggaatcctcctccccccacccacgaagtgaaaaatttttcaggaaaaaatgtgatattttttgaaaactgcataattttcttgttatatttcaataaaagctttaaaaaagaaatttcacgacgtcgcttatcgacgcaaaaaaaaagtcttcccccccccctcggaaattttttttctggctacaggcctgcctccaatcattataaaaaatagtcccgaggcgcggaaaaaccaaaaaaccgccttttgaactggtttaattcacaaaaaattgaccaaaaatagattttttaaaaatgagttttttcatcaaataaagtattgatgataatagcgctgaacgagtaaattgtattaaaaaatcctacgcaccatcaaaacatttcccaattcattttcagtttcatcgactccaatgccatcgcttttctccaccgttttcgtccacttttcgcctcctctcgaatttatctgtccatttatttcaaaagtgatcgcattttggagttattgcacaacattttgcccatcatcggaaaaaacatttatggcatggaattgattacggaacctttccagcgtttgcgacaaatcgttccgtcactgtttttcaccgaatgtccatctcttcgctttgtcttccccacttttgacgatcttttcgccgaatttccatgcgatgacagtgccatggcgtcgcgtggacaggcactggcaaaatggcttttcactccccacccggacgatgtgccaaaggtgttcaaatgtgctgtccaggaattcgttgcaggaagaaatgtgccgttgaacgttgaagggcgaaatttgccgttgaaaattgaagcatttaaaacg

SEQ ID NO: 76679 - DNA, 119 bp, Heterodera glycines
  Genomic contig location: Contig_ID=SeqID_12931; Location=1898..2016; Strand=+
  SCN-specific regions: Sequence locations=1-70,93-119
aaattagtcaaaatacatttcagattcgtgattagcgacctttaaaaccccggataacaaattagcatggttttttatattaaaaaaattttgcaaaacaaaaggtcctcccccctttt

SEQ ID NO: 76680 - DNA, 1686 bp, Heterodera glycines
  Genomic contig location: Contig_ID=SeqID_12931; Location=2230..3915; Strand=+
  SCN-specific regions: Sequence locations=1-113,176-321,365-1686
atgtcttccaaaatgattctgtacgttttgcgcattcctgtgatgccagaaggaacggagtgtggaagaaagtgggataaaggacctgagagaacctctaaaagaggcgcccgtagctcagttggttagagcacggcacggattgctggggtcgtgggttcgagtcccaccgggcgagttaccttttatgttctacattccttctctattttgccccttccttctcatttttttagtctgtacggtgtgccaatgttggttggatgttgcgccattctttggatgttttgggaccgattcaaaaaaccaaaaaagaaaatgtaaaaataataaaaaaatcttaaaaaattgaaaatttaattttcagtttcatttctgccgacgcttggctttccgtgttcgaattgcttaagcgttctcaactgggccttggaatcgcacttgtcagccaccaatttgacgcaatggtcgacgaaaatttcaagacgcggcgctgggcgctgaaatcctttgaaatttggtgcgacgatggcgaagatggcacgacggaaatggcaattctcaattctaccaaaaaactcgtcgggagttacagaattcaagtggttcatctctttgaaggcaaatcgttaccaattccacaagttcaattgccacgaaaagttagcggtttcaaatgcatcatcatctcgtaagattggccaatttctaattttttgccaacattacccattcatttatagttacatcgaccgcaatgccatcgcttttctcaaccgttttcgtccgcttttcgccgcctgcccaatttggccatccaaacgaacaatgatcgcattttggaattgattgtgcacaacattttgccaatccttgaaaaacatcttcgtggccttgaattgtccttcgatgttttccaccgtttgcgtcaattcgtcccgtcaattctcaatgattttccatttcttcgcattgtctctgtctatgcttccgatctcttcaccgaatttccggccaatgacaatgccatggcatcggatggacaagcgatggcaaaatggcttttcactgcccatccaaacaatatgccaaatgtgttgagatgctcgttgaacaaggaagatgggaattgggcttcgcggattgaagcattcaaagcggtgcttaccaattgatttatttgccatttttacgattttttgggtttcactgacctgacaaaaatgtttatttttcgcccaattcatttttacgatttaaatggaccaatggttacagtttagatggcctgattcttttcagaaaatgtgatttgaaaaatccgtttaaagtgcactttggctttttgtgatgaccccaacatcattttgtttttttaatcatttttttcacattttaggcatttgcctcggcttcatcttccgtcaatttcattgtcgtgctttggtttccgcaatcatttgctgactccgtcgttctctttgatttgaccaacgaattgactcatgaacaattggcattgaaaagaactgtctttaacacccgctttttgctgatccgttctccaattgtgcgagacgaaagcaaatggacaaaatgggaagaggaagcgattggctgggaattttttgatcaatggaacagaattgacattgaaattaatgacgaggagcacatcggggacgg

SEQ ID NO: 76681 - DNA, 1298 bp, Heterodera glycines
  Genomic contig location: Contig_ID=SeqID_12933; Location=899..2196; Strand=+
  SCN-specific regions: Sequence locations=1-1298
atgcaaaaacctactccttctaaccgccccaattcctctgtctccaaaacccttgcctgcgggcttgaaaaaattgtgaatttgagtggaaatgagccactctcggtgccggtgctggcggatcggagtgatccgctgggactcaagtcggtccaacccgacgcgttgccaatggagagtgctgagggcaccaaggaagtggaaataatggaagtggatgaaatgagtggagaaaaagggaaaagggatgaaatgggtaaagaaaaggtgaaaagtggtggaatggaagaggaagaagaaagtgagggcagtgaaagtgaactgctaggagaaggtggatttgacaatttgcaattgaaccccagcctgagggcgggaaataaagcagttgaaaaggaagataaggggaaaccctatctggtcgcccaagtgagaagcgacggtgtgatcgcggcacggatgaaacttttctgggatttcccggaattggtctttgtcccttttagcctcttcgacaacgcccgagccgatcgaaatcggcgatttgttccgcttacgtaagtgtgagtggacgaagagcgaaacaggatgggaagagcgcggagattggctgtatgaagtgaccggacggctgaactaccaagccacggcaacggacgtaagccaattgcgccagcgcatcctcactgaggccgtcggcattttggtcgatgtgcaaagagcccgtgaccgacacgtcaaagtggccatggtgtcagcacctgagctgagctgcgtgatgcgcacctaccgtcgccacttcccggccgatttcacggatacgacatccgctaccgctccgttgtccgtcttcaacttcggcagatcaacagtccgccatgggtgctgtattcacagcagtttgcgtatgttttgccgtctgattttggtaaaaaaagaggcgatgaactgctcgttcatcacgcaaacgtcattgctagcgttgagcctgagccaatgggctatgagttccctttcagtgccgaactgagctgggcgaaggtccagctgggtgagaaggtcatggcggcggctgtcgcagcgcagtcgttcgatgtgaaggctgatctgcggaagcacactctgttcgtcgagccggtcgtcatcaatgagatctcgacaagaagcgtgatcatccagttcgtcatgccggtgccgagcatcgaagagctgacggaattgtgcaaaatttgggaggtcgatttggcggtgggttgcaaagtcaatccggcaaccaaggcaaagccttgcgcgcatgg

SEQ ID NO: 76682 - DNA, 173 bp, Heterodera glycines
  Genomic contig location: Contig_ID=SeqID_12934; Location=119..291; Strand=+
  SCN-specific regions: Sequence locations=1-173
ctgaccaacaatcgccatccaatcagcagacattttttgtctcttctgccgcacagtcactcaacgcgggcaaacagccagacaaaatgccaagcaaacacaaattctacgaatattacacgttgggatgcatcagcatgcgcactgaggtggcgaaagaagcaattaattaa

SEQ ID NO: 76683 - DNA, 649 bp, Heterodera glycines
  Genomic contig location: Contig_ID=SeqID_1901; Location=48..696; Strand=+
  SCN-specific regions: Sequence locations=1-13,246-267,317-359,386 -499,521-547,570-649
gagtgtatctgttcaacaacgtcaggaacacccataacaatgacattggcagccaacaagagcagcagggacaccaacaacaacagcaccaacatggtgaacaacgacgacgaccaccaaatggtggtggtggtggcatggcggaggagagcgacgacgaaatgatgatggtggtggtcagcaacaacaacaacaacggtaatgaccatgaccagcaacagagacgaatgacgacgatgatgatggtcaacggaagtggtgggcgtaatgatgatgaggatgatgacggtggtggtggtgatgaggatgaagatgaagacgacggcttttacgccattgatttgggccaaccaattgaccaacaacagcaacaataacaacaacatgaccagtgatgagactgacacatgaggagtagggggaggaggagcactaaaatctcaaacaattgtttttgttttttttgaatttttttgcacggggccggacataattttggattattttattggtttgaagcccaaaaatcacgctttgaacgccttcttctccacgctgtccaatgaggagatttggtttatattgtccattgggaactggcccaaattttgccaattttaccgcaaaatgccgaccgctaaaagcgcaa

SEQ ID NO: 76684 - DNA, 1358 bp, Heterodera glycines
  Genomic contig location: Contig_ID=SeqID_1902; Location=823..2180; Strand=-
  SCN-specific regions: Sequence locations=43-135,164-210,253-311,333 -756,790-807,905-1220,1242-1358
  Gene Ontology: Mol. function=ubiquitin conjugating enzyme activity; Cellular component=endoplasmic reticulum; Biological process=male courtship behavior
ttaaaatttttaaaaatttatttaattattttatttaaaattggaaagtaaaataatggccggtgtcgcattgcgccgtttgttgacagagtaccgacgtgagtttattgtgcatatatttatttacacacaattaataacaataaaaacaaacaaattaattggttggtaaaatgatcagctgaatcaatcacaaatgggtgctgctgtattaatttgtcaagttatttaaaaatggcagaaaattcgggtaatttttgaggaatacaaaaaacccttacattttttgatgtgtttgcacccgttaattggaaaatgcccaaaaatattttattattcaatgaaaaatttctaccaaataactgaaggggttgttgttgcactgaaaattttcacgattttcgcccgcttttcagagctttgccacaaccccccggagggcattgtggccggcccggcggatgaggaaaactttttcgaatggcactgtctgatttctggccccgagggcacctgctttgagtacggcattttcccagccaagctcacattctccgaggtgtcatttttgccgaccgatggataataaaatttgtttatttttactacaggattaccctctcagtccgcccaaaatgcaatttctctgcgacattttccacccgaacatttacgcggacggcaaagtgtgtatcaggtgaggggaaagggcctccattttgtacatgtacacaacaatgtttgattctggttgaaatttggcatttcatttattcaacaaaatttaagaaatatacacaacacaacaaaatttattaattattttaaaatttaatcattgaacaaaaaagcaagatttttttaaaactcaaaaaattatttaaattttatattttttttaaaacggaaatccacaaaaaaatttagttgtattataaaaaaaacaatttcaatttttttgcatatgagttagttgcctgtgtaatatttctatgggaggattcaacctcataaaatttggtttcaatttttggaatttctgcgctttttttagcattttgcacaccccgggcgacgacccgaccggttacgagacgagtgccgaacgatggtcccccgtgcagtcggtggaaaagattctcatctcggtggtgtccatgctggcgggtccgtcccttgccaatttgatttggcgttgacattggcttttttcgtggcattttgcccatccatcctttgcagagccaaacgacgaaagtgcggccaatgtgaacgcggccaaaatgtggcgtgacaaccgtgcccaatttgagcgaattgcgcacaaactcgtgcgcaccacactggtaaaacagggg

SEQ ID NO: 76685 - DNA, 1320 bp, Heterodera glycines
  Genomic contig location: Contig_ID=SeqID_1904; Location=104..1423; Strand=-
  SCN-specific regions: Sequence locations=1-55,77-123,145-460,482 -1186,1215-1280,1302-1320
atggcacgctatcgccaacggggccatcatcgtccgtccgaaaagcagcagcaaaaccatggccacattttggacaaagatgacgccaacacttcccatttccgtcactcaattcaacagcaattccaagaagatgaaaatggtgtggaattttttgccactacggtaaaacggctcgattttttatttaaaaaaatggtatttaagcggtttttcgttggaaaaattatctattttgactctattttggctttaatttcaaaagccaacgatttttttttgccttttaggatggcaattcgactgtttcccactacatttgtatggcaccgaaaattgtcaactttttgctcttacaactcattgccagtcgcatttttttgctcattttccaatgctgcatcaattggattatggtggacgctccgaccgacgcgttcaaaggcattccgccaacaaaaagtttttcgaaaaagattttaattagtcttggaattaagttcatttggtctgatcaaagacatttattttgcgtttcacgatttttggccaagaaaacaacaaaaaaagtgttttggcgctactttaaaaatgccgcttttgaattttgtcaaaaaccaatggagggcctttggttttcaaaattagttttgtcgtaataacttgtgaaaacttgttcgcatatgttttcggcgcggtcattgatcaggaattcgataactttagaccaattactaacccgaactcaacaaaaagtcgaaaatttagttcgagtttttttttttgaatttaggtgcggatcacgaattggttcaaattggtctcagattcattatcaccgacatagaaaaagcttatttgaacaatttttacgagtagagatatcttacgaaatgattgcagactgtgaaaatatcgagaattcattgaacacagatgccacactgctcgaccggctcgtccaaggcacattgaccggcctcagttgttgggatggccggcactttttgcacattgccgaattcggctaccaatgggagtccaatttggcatttttcccactgtttcccgccctgttacgcatgactggccaactcttccagcaactgaccggctcggcactgagtttgttctccgccatgttgattaccggcacggcgttgaacaatgtgttaaatttacgacgttttaaattttaaaaaatgaaatttttaggcactttttgtctttaatgggcttgtgctgctcagacttgccttgttgctgaacggtggaaatctgaaagaggccattgtcacggtgtacatgcactgctggtag

SEQ ID NO: 76686 - DNA, 147 bp, Heterodera glycines
  Genomic contig location: Contig_ID=SeqID_1904; Location=1270..1416; Strand=+
  SCN-specific regions: Sequence locations=1-10,32-78,100-147
aaaattccacaccattttcatcttcttggaattgctgttgaattgagtgacggaaatgggaagtgttggcgtcatctttgtccaaaatgtggccatggttttgctgctgcttttcggacggacgatgatggccccgttggcgatagc

SEQ ID NO: 76687 - DNA, 1572 bp, Heterodera glycines
  Genomic contig location: Contig_ID=SeqID_1905; Location=19..1590; Strand=+
  SCN-specific regions: Sequence locations=1-374,396-826,848-987,1009 -1572
gacaatacactgacaatttgaacattgcggcgcctggcgttgttactcagcatgtgtgcaaggcgtccaacctcaaccagttccagctgagtcagatcaattcgctgcacccggacactggcgttgtcggcgtttatctgtcgaccgaagggaccaaagttctcccatttgtcaaagccgctgcccagggcttacgcgaaatggcatccaaaccgatcagtgacgagcttctccaggtgagacaagcattgtttttggagtggtttaactaattacgaaacgaatttaacatcaaaaataccaattaattccatttaattaaaggttttaagcctatgtagttccgatttcacaaaaaaatgattgagtcctgtctttatccagacccttggtttttaaagattctttccttttattgcacaccattatttttatgaatttttttcatatgccaggcttgcaaattgttggccaagggaaccgcactgacacccgacgaattcattgcccttctgaagacagtgactgcggacgatgtgaaaaaggtgaatccaattttccaattggatttcatgagtacattttttgaactccgttaccaagcccgctaaaaattgagtttaattttttatttgtttttcaaatttcatcttttcaggctgcttccccaactttgcgccaaagcccatacttggccggcgaggttcaccaggccgggcccaccgacttggcccacgtggcacttgttggtcatggagcgaaattgacggacgagaaggcggttgcaatccaagcagtgctctgtgctgccattggtcaaactagttcgtctattttcttatccaaaaaatcagtttttgaagaaaaaacccactaaacattgaaattaaacgaaacatcttcaaattatcgactttccgaattttttttttaaaaatatcgcaaaattactaaacttttccattggtttaggacaatacactgacaacttgaacatggcggcgccgggtgttgtttcccaacatgtgttcaacacattgaaccaccagttcgcgttattaacaaaattaattgtcgttaaaataatcgtttaagatccgttcgccttttttccactacccatacggttgatcttatggttattttatgtgaagtacaaccatttcgaccacattccctgtttaggattttcccgtcctcgaagaacgcgttgaacgtgtccgcaacgaattgaaagtagaagcggccgagaaggtcgctgaaattgttaaagtcaatgcgggtgtggtgaaggaggccgccacatttgcgaacagtacacaacgctcggtgtataccggtgtgaccgctgtcgttggcatttcgcttaccctctttggtgttctgttgtcgctcctgtgggggttgttcggcagagtcggttccgtcgaggctaatttgagcgctctcaaagttgacgttgacgcccgttttgagaagctcactgactccgtggaccgccgttttgaccgaatggagcggggcatcaatcggcttctgacaaaaaatggatccggtggtattgatgactaa

SEQ ID NO: 76688 - DNA, 1089 bp, Heterodera glycines; identical to SEQ ID NO: 1906
  Genomic contig location: Contig_ID=SeqID_1906; Location=1..1089; Strand=+
  SCN-specific regions: Sequence locations=1-305,327-401,426-466,490 -739,761-1089
  Gene Ontology: Mol. function=cleavage/polyadenylation specificity factor activity; Cellular component=mRNA cleavage and polyadenylation specificity factor complex; Biological process=mRNA polyadenylation

SEQ ID NO: 76689 - DNA, 1051 bp, Heterodera glycines
  Genomic contig location: Contig_ID=SeqID_12939; Location=71..1121; Strand=+
  SCN-specific regions: Sequence locations=1-744,767-923,945-1051
atgtcatattattggtcattagtgtattgtgagtgaatatttccacctccaatttatcattttgcgcaatttgtgtaagcgaacggccagcaaatgtctcatcgcaattctcggagcatttaacacatttttgagtagaaatgtgctgaagaactttgccataatggcgaatgaccaaaaagcgcaaatttttcagtcgcgaaagagacaaaaaggcagccaaaatgtcaatattataagcggaatattcgaggtcttgaagatttggacaacggtcaatcagcgtcagcaaagcctgtggacggaacagaaatttaatagtaattataaaactcaatcaattaattattcagtacctcagtcgtgactttagcaagtcgtaatattatcagattagcaagaaatcggacctacccccccccccccccattctaagtttttttttggaaaaaagcgccaaaaaagtgcatatgcggtaaaatgagaaaaatggtcacttcgcgctactaatagttttagaaaaaatcttatttttggggtccgaatcttagtttttgcctcatctgtccttatttttaaaaaaaaacttgcagccctgattaaaatggaaaattcattttccaatttgtaccctccaaaatcattcaaaatctacaaaattcttttgcaatttttctctcaatttttgaattgtttttcacttgatattttcctttttcttctttttttaattgcttcaaatgttctaattattctcttttttgttcagtatttggtcccattttgtggtttgatcacttttggtaatattttgatcattttgcatttgatcaattgattcggttccattttctgtattttctttgccgaatattttattaaaatttggtcggattttgcaggattcaatttcaaaagcaaagaaaatataaaaaatattatatgtcataaattcattttggaatatcgaatttattgcattaaatgaatttgtttaattttttgttcgctttttaatactaatattaattttatttgtattttctcttca

SEQ ID NO: 76690 - DNA, 252 bp, Heterodera glycines
  Genomic contig location: Contig_ID=SeqID_12939; Location=1638..1889; Strand=-
  SCN-specific regions: Sequence locations=1-252
gttgccgttccgtgctgcaacggcttcacctcgttggtgttagcattacgctcagctaacattggaccgggtgccgatgttttgatgccgtccataacatttgttgctgtctcaaatgccgtcctcaatgttggtgccaatcccgtgtttgttgactctgctgatgaatgggactacaatccaagttggtctctgctgttacgagcggcaactcagaaaaccaggcacgaaaaaatcttggaaacgttttga

SEQ ID NO: 76691 - DNA, 383 bp, Heterodera glycines
  Genomic contig location: Contig_ID=SeqID_12941; Location=174..556; Strand=-
  SCN-specific regions: Sequence locations=1-169,191-347,370-383
atgtctcatgaaaatgtcggaaataaaatcttggtattcatttctgggggtagtaagcaatactctattaaatttcaaaatgaaagtgacggacaagtttggtataaaactaaaatcagaggtaaaaaactaatttatatagaaaattaaatagttatttagggataacttttaacaacaaaaataaattcaaacacgaggactttaaagaaatggttttaaattatgtcgacgaaaagagaaaatatttcaattatgataaatttggaccatctagagacagtaaaatattgtcccaaaaaatgactaaagagtacaaacccgttcaaaaaaaaggaattatcgacgaaaattttgatattattccctatggattttggtga

SEQ ID NO: 76692 - DNA, 1310 bp, Heterodera glycines
  Genomic contig location: Contig_ID=SeqID_12941; Location=1217..2526; Strand=-
  SCN-specific regions: Sequence locations=1-95,131-267,301-509,553 -610,635-678,700-707,740-847,883-939,967-1066,1097-1140,1162 -1171,1193-1310
atggaagattattacccggattcaatgaaaaaagatgaattcgaaaaatttcaaaaaaggtataaagaaaataacgatacgccttttttattaggtaaaaaagttatattattttttaaataaataatttcagaggatcaattgaaaatttattgtggtcaggataccgaaatattgctaaaggcactcttagcaatgcgtaaaatttttatagaaataacaatggatgaacttagtcctaatggcttcgatgtgtttaaggttagaaaacaaatttcattttttaaaatagaatttagacttcgaccacaattgcgggggcggctattaaaatttatcgggcgaaatttctaaaggtgaaacaaatagcaatagtccctgagggggggggggggtttgaaaaaaagaacaatcaaagtttttgccataaaatatttcgagtggtttatgtttaaaaatggggttaaagcgagacatgcgggaaacgggggagaactaaacatcggaggttaattttaaaaaacaacttaatcattaaattatatttttaaagggttcaatgttgattttatatgtggaaaatataagaagattatagaatttcaggtactaaaaaataaaattaattatttttgaattacacttttagggatgcgtttttcacggttaaaaattggattattttcatttttaaattatcttttaggatgcaaaaaatgtttaaaaccttttcaaatatgtcccaatggaaaaatagcggaagaaaattttgcaaaaacgaaagccagactcttcaaactaaggaaaatttcaaagaaatatggcttaaaagtcgaagaaatatgggttaataaaattaattaattttatttaaaaaaaaatcaatttaggaatgcgatgtaaaaagaatgataaatccacgagataaagaaaatataatgctgaaatgaaaaaatattttaacatgatccccgataaaggtttgaaagttaaggtatagtttctaaattaagtgtttaggaccaatagacccacgagaagcatttgcgggtgggcgaacacaagcattttgtttatattttaaaacagaagaaaatacggagattaatttagcggacataatttcgctttacccatcggtttttaataatttcttattttgacatatagttaaatttaggttaattattttacttcatacccagtaaaaacacccataataatcatatcaaaaacccatgacgttatgtggcaataccccgaagacattccctatgacagtataaaaaagtctttgatacactaataaa

SEQ ID NO: 76693 - DNA, 738 bp, Heterodera glycines
  Genomic contig location: Contig_ID=SeqID_12942; Location=998..1735; Strand=+
  SCN-specific regions: Sequence locations=1-224,338-408,438-509,551 -638,668-738
atgctgaatttcgattctctgctactaattttgttcattttttatttccaaattcctttttcactttcggttgacaatgaatgccgtggtgtcccaactgatcaaatggcaccacttaaatacgcttccgatcagtggggaaagccaatggaaatcagatttgctgatgattccaaaccgagatttaacgtattcaaaaagataattttgatgtttttttttggaaattttatttaaaaaatatcaaaattttattttatctttttgtatttttagacaattttttttattttgaaaatgacttaagaatttttaagaataaattgatattatttaagacacacagtaattcaaaattaaatttcaatattctaagctatttagttacttttttatatttttaggacgtatttaaatgtttttaaattattttaatacctcttttcctaattttggataactaaaaattaaattcataatatgaaaaacattcactattgttggttttctttttaataatttaaaaaattataactaaaatatattttttcagattcgttttgggtttaccacggaaatgaatgaaaatttgcccaaaaataaatgtgtgcttatcaaatgttttgacgaatttacagaaaaaaattattttaatgtattaaaaattgcagaaaaattaaatgagaataattcgacgaatgaacacattatcaacttaattgacttgtaaacatttaa

SEQ ID NO: 76694 - DNA, 1220 bp, Heterodera glycines
  misc_feature (1057)..(1057): n is a, c, g, or t
  Genomic contig location: Contig_ID=SeqID_12943; Location=1676..2895; Strand=+
  SCN-specific regions: Sequence locations=1-275,300-332,354-406,428 -449,492-657,679-787,851-902,953-968,999-1220
atggacatttggtcggcgggaatcacaatttttgaaataacactcacaaaaatgttgggacatttcgaagcatggcataaagtttcattggttggcgaattgtttcgaaatgccaaattgaatccgtctgatgccatttttatatcggctggttcaaatgtttggtggcaaaggtattggcaagtgatttgtgccattctgtccgtgtgggacgaaatgccaacgattgcatttcttttgggggtaagttggagaatatgtaacttaagtcaaaaatttattttaaaaatccatttataaaaaaggcagcaaagtttatttaaggcaaaagtctaaataaaataatttaaaaaggtaataccgtattttctctaattatccccccccctttctgagggggttgaaaaataatttccccgtctccatttataccccggggggacaaatagaatttttatttattcgaaaaataataataaaaattaattattctaaactgaaaatcgtttaaatgtcttacggcactcgaaataaattaaaaaatttttgaaagtgtatttttcaattttcttgcctttttcttacagattattttcaaaaatgccaaaatatgtgctaaaaaaaatccaaaatagcccatatctttttatgtgccaaattatttttatgtttttataagtcgctctaaatcaaaaattgttcggagaaaattccatttttttgtgtttctctcgccataactaagcggtaaaaaaaatatgtaaaaacataaaatccgatctatattaataaaaatgaaaaaagaaagtttttgaaaagagaaaaaaattaaaaataaaagcaagaaaaattgcataaagaaagaatttttgattatttaaacacaaccgaggcaatgaaagttaaatttaatattttttctcgataaaaaaatttcatatttaaaaattttccttattcgaaaaagctataaaatattttaatattcattaaataaacaaaaatgagtttttttttgattagattttacgtgttttcctccctaaaaatcctttanaaaaatttttaaatgcctttttcggaattttcgtgcgtttttttcaattttttggtgcctattatagtgcctttttcgcgattttggtgcctttttagacggtctctaatcataataccattatttttagaaatatgtaagcattgagccgcaaaagcgatga

SEQ ID NO: 76695 - DNA, 1109 bp, Heterodera glycines
  Genomic contig location: Contig_ID=SeqID_12944; Location=1744..2852; Strand=+
  SCN-specific regions: Sequence locations=1-79,101-969,991-1024,1046 -1109
atgataccacttcagaatatgcatcgacgtccgaagactggccgaactcccaaaacaacggaaagacaacggcgtcagcttgttcgactcgtcaaaagtaatccaaagttgaccgctgcagatgttcgacggcactcagctgacgctctcggagtccaaatttcacacagtacagcccaatgcattctccgaaagcaaaatctgaatgccagacgtccggcacgtaagccactattgaaagagtgccatcgaatggcccgtttgaactttgcgagggcacattcgcattggacggtggcggattggcggagggtgatatggtccaacgaaagcaaatttaatttgttcaatccggacggggcaattcacgtccggcggcctccggggaaccgtttcgaccccaaatacacacgcgggacaatgaaatttggcggtggtggcggtgtaatggtctggggtatgacggaaaaatttgaccattttcgtacgggatgtacagggtgctttaccggggtgacacactcggcccgttagtccgaattgagggtaatttgacacctgaaggataccgcaacatcctggaagaccgaatgttgccgtttgcccgtgaacgtctcgctccaggatggacttttcagcaagatggagcggccatccacacggggcaactgctgatgggtcccattcgacttctccctggcggtcggcgtctgcgtttgccgggctgatttcgcttgaatggagttcccctgcttcgtccccgccgttgagcaccgatttgtcacccattgaaaatttgtggcactttgtgaagcgaaaaatcgccgggaggcacttccagtcaaagccgcaactctggcaagcagtcctggaggcttggaattcaatcccatttgacacaattgacaatttaatcagctccatgccccgacgtatcgaatcagttattaagtcgcgaggtgcaccaacgaaatattgagttatatggaattatattttgtgttgttaaacatatgaccagtgctttttgaggataaaaaattttgagatcaaatattatttgctacagaaaacggaatgtgatcatttctatatctttggatagccca

SEQ ID NO: 76696 - DNA, 297 bp, Heterodera glycines
  Genomic contig location: Contig_ID=SeqID_12944; Location=2943..3239; Strand=-
  SCN-specific regions: Sequence locations=1-23,45-297
aattgttgtcatgatttttggacatgccattgttatgatgactgttgtcatgcctgttgtcatgacacttgtgctttttgccatgatatttgttgctaatttggcaactaattaggctgtttcaagagcatttttccgagagtgaacatatgatgatgaggaaaaaaagaaatttaaaattactattcataaatgttttttttaatctattttcctatgacattcctaattatgaactaattaaatgttggttgcgtaaaatacagtcatggtcatatgtttaacaacaccaataaa

SEQ ID NO: 76697 - DNA, 371 bp, Heterodera glycines
  Genomic contig location: Contig_ID=SeqID_12945; Location=276..646; Strand=-
  SCN-specific regions: Sequence locations=1-16,38-371
atgaacacaaagaacgaaaaagcaagttcaatttttctcgaagcctccaaaaaagagacagagagatcgtggagagaggttgtagtcttagctgaagaaatcgaagagtatgtcaaatccggtagaggtgctctgaatcgtacaataaaaacaagagaaaaggccccatacgcttccggtgtacgagatttgttccttaagctctctgattcaatttgggaaatttacacaattttggacaaggtaaattcagaatcggataaagcggaatctgctcggcgtgagtttgagagattgaaaagttttgatcaggcatcaaagctagaagaaagagccatgtcttcattgattgaatccacacgattgcacct

SEQ ID NO: 76698 - DNA, 244 bp, Heterodera glycines
  misc_feature (156)..(156): n is a, c, g, or t
  misc_feature (169)..(169): n is a, c, g, or t
  Genomic contig location: Contig_ID=SeqID_12945; Location=1339..1582; Strand=-
  SCN-specific regions: Sequence locations=1-208,230-244
atgaccgtgtacttgtattgctgcgccttatcggatccggtgataatccctggacgcccactgggacaagttacggcggatgttgtttttattgagtttatgcgccggcaacaatcctatcaggacgtcaaccttttagaagaaaggatttctgtngaaatgacaactntttttcgtgccacagcggtaggctaatacccccatgaattaaaattgtatttttattcagaagatgaacatttaa

SEQ ID NO: 76699 - DNA, 1444 bp, Heterodera glycines
  Genomic contig location: Contig_ID=SeqID_12945; Location=1945..3388; Strand=-
  SCN-specific regions: Sequence locations=1-188,211-1079,1101 -1111,1136-1444
cggaacagaacgatgaagaagttttcgatggggtgtccgacaaaggcccaatcaatccgagggacgcttatgcgggagggcgaacaatgcctttttgcctgtacgcaaaggcaacagatgaagttgagatagcaatgtttgatatcataagtctctacccattcgtaaattatggtaaaattgattatttttctgtttatttccttgattaagacaccccatatcctgttggcgtctcaaaaattgtggtgagcaggagttttgaagtgaattggacatcgcccgatgatgttccctacgacggactgttgatgatggcaaaaaatgtgaaaaagtttaaccaccccgaggaaaaaagggcattgtcggggaccttcacctcgattgaactgcggaaggcattggagttaggctatagagtaactggattcttcagggcctatcattatgaacaatttgacagccaactgttcaaaggttattcggatctttcttaaaataacagtggaagcgtcaggctggccgtcggatgtgaaaaacgaagatgaaaagagagcattcattgaaatttacaaggctaagtatgacatcagccttgactacgaccaaattgcctttaactctggtcttgggatgattgcgaaattagtaagaaaacaaataaaatcaaaaaaaaaaaacaaatagaaattaaggggttgaacagtttgtggggaaagttttcgatgaggaatacactttcttcaacgaaaattgttaatagcatggaggagtgcgctgagatggtgaaagatgatacgatcgaatttcgacaccgattatgttggatgaaggggctgtacgaatgattttcaacaaaaaaccagaatttattagggagcataaggtgtctaatatcgtattgtctctgtggactacgagtgccgcaaggataaagctatacgaatacattgagcaggtttacaaagagaagatgtgcaaaccattgtattgtgacacaggtgttttcagggaaataatttccataaaattttaaatttagattctctagcttttgctcatccgaaggggaaatgtccattgaaggaagggaaatttttggggtaacagcataatttttaaaaaattttataaacatttgttcagtgagatgactcgagaatattcggacagtgacattttggagtatgtgtcggcgggtccaaaacaatacgccttgaagcttaggaggaaaaaggatggggtgatctggtacaagacgaaaatccggggctttacattgaataaggacaatagagtggattatgaggagttcaagtcaatggtcttgggctacaaggaaggagttaaaaaagtgtttcgctatccagagaagattgggccaacaagggatagcagaatgctcgatcaatatttaaatgttttgctctttgggtattattaa

SEQ ID NO: 76700 - DNA, 577 bp, Heterodera glycines
  Genomic contig location: Contig_ID=SeqID_12946; Location=618..1194; Strand=-
  SCN-specific regions: Sequence locations=1-34,57-116,164-262,285 -337,368-537,565-577
atgacaattataagttcgtttcttttgatgggagttaattttgataaattaatttttatgtcctttctcggtgcgtcccctagttctttttatccttgttgttttttcccctttgcaattttattaataattatttttgttcatttttctaataattaattatgaatttgcttatgagttattttttaagattgaatttttttaaaatctttaaatccacttggtagctttcttgacaaaacacaaaaatgcttttttatatctagtatacttttcaattttagattttatatatcgtttaatttagtaatattgatgtcttatatattcgatttgcattataattattttatttatgtttattttagaaacttcttttttcagtttatttgaattaattagtgtttccattaaatactttaaacatttattaaaaccttttatttaacagtagtatcaggccgcaaatcttgttccaaattttcggataaatgcgccgcactgtgtgcggccggtccatgcgcgcctgggcgcagcgcttttctttccttcctttcttctttgcattcaaaataaa

SEQ ID NO: 76701 - DNA, 3707 bp, Heterodera glycines
  Genomic contig location: Contig_ID=SeqID_12947; Location=63..3769; Strand=+
  SCN-specific regions: Sequence locations=1-156,234-333,355-580,628 -809,831-2681,2703-2898,2920-3115,3137-3199,3245-3664,3690-3707
  Gene Ontology: Mol. function=actin binding; Cellular component=actin cortical patch (sensu Saccharomyces); Biological process=endocytosis
atgattgaaacgcccggtttggccaagaaagcaaggcatttcaagatccaagacccatcaacccgcattgcattgattgatcaaatcttgaagcagatcagtgacttcgaatttgacggtgtacttctcgacttcaccggtcattcaaattaactcattaaaaaaattaattaggataattaattaaatgctttatttaattagtattattggtgtttaattattttaattatcatttttgtgttaaaaaagtgcctcaattttaggcatcaatttgtcaatggatcagattggaaagcatcttgttgattttcttggcgattttctgctgagaaatgcccaagaatacataaaccgttcaaagatgaacaaagacgctaaaaaactaattatcagtaattaattaacaattagtatatgtataataattttaaattgcttttttagctgtacgaattgaccacgacgaaattgaccacattcaaaccgaggctttttcacgcctcaatttgatggaactcatttcatttacgggcgtaagaactgaatcggaccaagcggaattagttgaaaaattgggtaatttaaataaagatatttttgtttaaaataaattaaaattttatagaagacaaactcagtgttgacagaaaagtaatcacggacaaaatttgtgaagtacaatcaccgtcaagacgattcaaaagaggcgcagggtaattagtggcttaattaatgcttctaatgatacataataattaagttattacacaatttgcaaatttagtttccctcaggccgctttgaacgttgggcaagaaaccaatttttcgtcgcgaaggcatattaaacaaaccttttagaataataaatgtattggtacattttagaaataagcgatcaccaccaccgtcgcccaaagcaaaagcaggagcacacggctcacccaaatcaccaaaacaagcaaagcatggatcacccaaatcatcactatccaaagcaaagcttggaacatccaaatcgtcaccatccatgacaaagcatggatcacccaaatcgacaccatccaatgctaagattgggtcaccaaaatcgtcattatccaatgcaaagcatggctcacccaaatcgtcaccatcaaaagcaaagcctggatcacccaaatcaccatccaaggcaaagcctggatcacccaaatcaccatccaaggcaaagcctggatcacccaaatcaccatccaaggcaaagcctggatcacccaaatcaccatcgaaagctaagcctggatctcccaaatcatcaccatcaaagaaaggccatgtatcaccaaatgtatcaccctcaaaaggcaaaagtcctcaaaaactactgtcaccaaaagcaatgctgcaaacgcacaaaagtgcaccggtatcaattaaattataccttaccattagagcaattaaataattagcatagaaaaatagtgatataaccaagcataataattctcgagcatcatcaaaatatgttcttagagcagtcagtaatcattaagtttgaacaccaacagcgccatgatccaaccacgaaattatcaccaatgaatgccaattttcgggctaaacactcaccaattatggcacagacgcactttgatcttaatcacacacgcaatcggccattgcataagcattggtcaacaaacatgcctggctcggcttacgctgatggacaaatgtcaccgcttcgtgcttcatcatcaatcgttaacattgtcgaacttcaccgacttccgacgccacctccgagacatggcttaaatgagcaacaacaatcacgaattgtgccaatgaagccctgcttttcacgatcaaagtccgagttgccggcaaaagtgctgtcatcaccggcttcggcaataaatgcaaagaactggcaaaacctggcacactcatcagtgagtagtgatggatcagatgatttcaatttccggatgaaacatcaccaatatcaacattcaccggctgtgccaataaattcgcttgcaaaaagccaaagttatgtgactttgccaacatcgccgccgccgcgtttcaatgcgtcaccaagtgccgatcagcaaaaaaagcattttgttgcgatgccatcatcgccgagctatccgcttccggttccatctcctaacactggcaaaatgccacaatttctgccaatggcagacaagtcctattttgcatatccgaaaagtagcagaacagcaaatcgttcatcgggctcaccactgctcgggcccaaaccaaagacactgatcatcgtccgcgattcatttcctctaacatcaccaagcaaaagtaaaagtgccagtgccgtggattaccaacaccgttttgagcagtttctttctccaatcaaaagcaagaatgccgccgctgtttaccatccccaaccactgcctttgccaccaaatatgccgtcaacttcatcgacccctattaaaataggccaacaacattcatcagtaattccaaccagaattggccatcattatccatcttctcctaatagaattggccatcataatttgccacaaagtattagtaaaacgcaggtaccgttaatgatgtagtattgatgctcgagaattgtagaattaatagatttgatcattaattgactggcataaaaaaattccttaaattaatcattttcaaaaaatcacattgttaaagcctgcgttggcccacatcctggcacatcattcgccccatttgccggtcggaagtgagctaagtccagctaaatcactcgacagccatcaccaacggcaaatgccactgtttgcgggcaaaaaatatggccaaaaccaccagtcgcctcatatgtcaccaacaaaactgtcaaatggtaatgtctcaccaccacaatcaccatcacatcgtctacaacaggtgaaaataatggaattataaaattacagaatttctgattggaaactccgtggattctttagggggggggcttaatattaaaggtggtagggaattttcaattcaaggagaggctccttattcagacgggcttctaactttgaggggctttatcccccccccaccgcgcactccctcataaaaagggggcttttaattaaggaggcttctaatatggtgccaagaccgagagcctgaaaatcataattctaccatgtgcctgatccattattaaaataataataattgttaaataaattatatatatttaagattatcaagcggcattcacagacaaaggatttgtccagggaaaaagtgcaacgacaacaacaaagtccgctgttacagcacccatcaattcgcgccctaattggcctgcccaattcgccggctgacgaccaaaacccgcctccgccattcacgccggaacagcacgcgctgcttatggacaccgtactccgtccaccgtccggtcttccgttcgagagtccacgatcagcgccgtcaccgcttgagctgagcgaggagcaacgcgacaaactgatcgatgccatccaaggacgaccacagccaggacttccatttgaggatgaagcggaacatgaaggactacatccggcacaccgtgtcaattcggcacatcttgaacacgttttggatgccatattccgtaagccgcctggcctaccatttgaggatgatgaagaggaggaacacagcagcaccaacatg

SEQ ID NO: 76702 - DNA, 474 bp, Heterodera glycines
  Genomic contig location: Contig_ID=SeqID_12948; Location=1117..1590; Strand=-
  SCN-specific regions: Sequence locations=1-3,25-446
atgggtaataatggtatgttgagtggacaattttttttactctttcttaattgtaaatttaggtagttttgagcgcattgttgaggaacagcaaccgccaacaacacccgtaccgcattctcgaaaacttcttcgtgctttgtggaaagaacgaattttcatcgtgttggtcctgatcttcgccacactggtcgttcagtatctctactggatgaaaacattgtaatgatgaggggacaagtttttttgacggttcaatttctttgttattttacttgtttatgttcggatataaaaaaaacaaatacttttttgtttttgttaaaaatatctcataggcacagagtaacaggtccaccaaaggtttttttgggaaaggattacccccctcatcttataaatacggtatgattaaggaccaaaatagggatagaaatctgtctactcttttttaatgggttttaaaaaattaaa

SEQ ID NO: 76703 - DNA, 407 bp, Heterodera glycines
  Genomic contig location: Contig_ID=SeqID_12948; Location=1..407; Strand=-
  SCN-specific regions: Sequence locations=1-223,247-407
ggggggaaacgtagtgcacccggacaaaatatcgccgcagaaatttaaaagaaaattttcaaactttgaaattttaaagaaaaaaattctttaaaaattcagcgctttttttgttgttgttgaaattttatgataaattactgttttttaacgaaaaatctttcaaaattttcaatgatttttttcttgaaattttcatattaaaaattttcagattttcttctttaaaattttttttttaaatttctgcggcgatattttgaggcgcaccccaatccatgaacaaggggtgcgccagtcagaccctcatacgtcggacgtttggcgcagggggggggggggggggtgcgccaggaccaatttttcttacgtcggcccccaatattccccggcgacgaccttttttt

SEQ ID NO: 76704 - DNA, 867 bp, Heterodera glycines
  Genomic contig location: Contig_ID=SeqID_12948; Location=2196..3062; Strand=-
  SCN-specific regions: Sequence locations=1-21,43-867
atgcgagcagtgcacacggaatgggtacaggtgagaaaagaacattggggaggggggcggggaattggccggcattttaatctagggggcaaaaaaaacacgaaaagccaatccaataattaggggtattgaactaggggttgcggcgtatctcgtactcaccggcggggcggggggtcataggccgtcgtttcgtttcttttttttgaacggggaatgtaacacctttttattcaaaaaagtcatttaacatctgctagcctcagttaattgctttgtttcggttcattaagttgctaatttagcgtttgtctgctgccgtccctttgaatttgccttccgtcgccgtttctctccctttttgtcgcgttgcgaatgcgcccattcggggcccaatgttcgaattgtcaacgaaaaagtgcccagcaaagcattggacaaaacttcgtccctttttgagtgttgtttccccacatcaaaaaggcgccctttgaaaagtgcgctgaggccaaattcggacgaaggcatttacaaattatgcttctcctccggtgaccaactaattacagaacattgataaaccattgttgatttattcattacaccaattagcaaattgttaaaacctaaggctaaatacaatctcacccaaaatggtaaaatgccctatttgctggtcagcattgagcagttttgtttacattatatttataaaaacgaatatttaaaaaaaccatagttaattactttttcatctgatttttttaatccatttgtgtatgtatgttgctctggtcctcattctttgttcaatctaaaaaattatgatcaatcacattttttcaaatttaaaacaactttaataaa

SEQ ID NO: 76705 - DNA, 644 bp, Heterodera glycines
  Genomic contig location: Contig_ID=SeqID_12950; Location=1787..2430; Strand=-
  SCN-specific regions: Sequence locations=1-2,25-349,371-422,468-644
atgggccggccacagattacacacaaaacgccgagcaaagcccagcagcggcttcgctttgctggccaatgtttggtgtcctccgtccgttccgttgacgggacactgataggactttggactctcgacttaatgggaaggaaagtgagaggggggatgttatttggccacctctttatggactatcgcggtgagaacaaagaatcatttttgatcagtattcaatcgcgattagaatagggtaacattggccaactgatcagagataatttgcgaaaagaaagccatatgatttatgcaatcatttggaagggaatatattgataaatgttaggtgaggagttaagtaagaaaattgaattttacaatgaataataaggggcaggattgccagatttgggcttttaaactcattttgtgggttttttttattagttaaaatatttttttatattttaaaaattttagctggattaaaaaacgatactcgcattgccaattttcaaagaaaaaaaatgaaacaaaatatttaatgcgttttttaagcagcccaatgtataaatttgaaacgaaatagtccaaatctagcgaaaaaatggtagaaccaccaaaaaaacccgcacatatttctcaatcaaaataaa

SEQ ID NO: 76706 - DNA, 1077 bp, Heterodera glycines
  Genomic contig location: Contig_ID=SeqID_12952; Location=2715..3791; Strand=-
  SCN-specific regions: Sequence locations=1-106,133-1077
cgcctatgtctgctcaaactcggcgtatgttggctgcccagggcgagtctcaactcagttcgctggacccttcgtgtgttggggtttgattgtttcctcagcattgtatttttatatatatttttaaaattagatttgtgctaatatggcaacagatcctcatagtttcgtgggcgattacttttttcaaggttttcgacagttagtttttgttttttaaattgttatttccagaagccagacgcgaagccatagacggtcttcaggtgacacatgattcaaatgaatttatggtgaatttgagtgagccatttaaagttgactgaacgtgtgaaatggatccttcacaatttggacaatcatcgtccttcacagaatcgcccgaaatacatttttgtctttcgggacggtttatcggagggtcaatttgcgatggtccgttcatgaacgggctcttcataatttacaaccttttcaggcatgtaaagaggagttgatggcgattaaagaagggtgtcgacagttcgattcgaaatacaagcccaaagtccgaattggctgacccaacccataaaatgaaccgtttttagttcgtcatgattatcggtaccaagcgtcacttcaaaaagtttttcatcgaagaagagccgaaggaaggcggacgacctttctcaaaaaatctgtacccgggtacgatcatccaagaaaaatgccgagcggacatcaccgaattgtgcgattttttacaggaatataaaaaaatatttcgccctttaagttttttgcaaccgcacgcgccactcaaggcaattgcaaagcatcaaaatggaaattgaaatgcatttatttaggggactggcaaaccggtggaatatgccatgttggagaacgaaataggtgtcaaaatggacgaactgcagggactgataatggcactttcgtattcccatcaggtgaaaagggacagccgaataaatgcgctctaaaattgcaccatttttagattgtcaacatggcggtctcaatgcccgagcccgtgtaccaagcggacgaattggccaagcgagggaaaaataa

SEQ ID NO: 76707 - DNA, 349 bp, Heterodera glycines
  Genomic contig location: Contig_ID=SeqID_12953; Location=663..1011; Strand=-
  SCN-specific regions: Sequence locations=1-54,76-221,243-349
atgggcagggacaaaggtattcggatggcagagccggagatcgtctcattcgacagccccgaggttggtcaaacaccaattttaattcatatttttgtcaacaataagaaaccttgtccctccctttactccgttacagaactcggatcaagaatggatggccatgttcgagcgatgcactgtcaaccgaattcaattcatactgctggtggacgaaaggcggaaagacacccatggacttttgaagctttctgaggccattcacaaagtgacgacgcaacacataacgttggagaaggcccttgtgagtgtaaacactcaattccttctctttatctgtaaatcgtga

SEQ ID NO: 76708 - DNA, 2025 bp, Heterodera glycines
  Genomic contig location: Contig_ID=SeqID_1908; Location=1068..3092; Strand=+
  SCN-specific regions: Sequence locations=1-125,151-664,686-785,816 -833,856-967,1004-1465,1488-1579,1601-1849,1887-1898,1920-2025
  Gene Ontology: Mol. function=UDP-N-acetylgalactosamine transporter activity; Cellular component=Golgi apparatus; Biological process =galactose transport
atggttcgacaagcacacaaaatatcccgagacaaaggccaaccgtccttcctaagttcaactgttgttctgaacacagaatgtaagttttttttttttgaaaattacaaccccctaaacaaattgtgttatttcagtggcaaaacttgccttgagctgtctgtatttaacgttttcatatggatcattcacaaagtaagtgttacagtaaaggcctactttttttcattatttcctagtttttcttcatttttttcagattttgtgtcgaaatttccgcagccttcttcaaaaacaaacgggaaacgttgaaagtgtgtgtgcctgcgctgatttatgttgtgcaaaacaatttgtatttctttgcattgaaacgggttgaagcaacacttttcagtgtaattttacatttctttttttttgtttatcacaaattcctccatttttgatatgtttatttttttttgtcaagatcacttatcaattgcgaattttgaccactgctctcctctcaattgtgctcctccgtcgcgttttttcccgcactcaatggggcgcactttgcatttcccttttcggtgtttgcctcgttcagtttgcctcttccaccacttcaggcaaagggtgagtgaaacggggaaaaaagaagcgaatagttaggattaaaaacagaaaaaattgtaatcataagagtggcggttatttgagccacaaattatgtcatgtgaaagtggtgctattacgttgctaaaatacgattgggcgatcctcaaaaaaaaaccaccaaaaaaatattttttttttttttataaattcactttggtaaattaacgcaataaaatatttttaaagaaatgctggaggagcattgtctgctggacaaaaggttcacgatgaacaattacttggccttttgaccatcatcattatgtgttggacttcggcatttgcaggtctatttcatttcataattattaaaataattttctacaaaatttattttgaaggcgtttatttggagggcgttctcaagcaaagttcatgtgatatttggacacagaacattcgtctgtcagtgattacgcttccattcgcttttatgacagtggtcaacgattcgaaaagcattcagaaaagttttcttttttttttgttgttgtttttcgccttttttaataaattgcctcacaacctaaatcatttttgtgtttacgggtttaagatggattctttgccggatggaattggctcctttggatagttttgttcagtgccgccgcttctggcattttagttgcggttgtgatgaagtgagtttttaatttttccagttttccatgcgctcttttattgttgattcggaaaattagtcataaaccggaaaagtatcttccacttcaacatttcaacttagaaattttagaaaatcataccataagaaaaaaattttgagaaaaacagtaattcatcataaaatttataaaaatcgctgaatttctaaaaatttttatattttcttatggaaaaatttaccaagaacttttcttacaaaatttctaaatggaatttaaaaaaaaaattctcttgggaaaagtcctgctccgtataatttgtcccttcacgactttccttatgttcaacatttgtaggtacgctgataacatcaaaaagagctattgccaaagtgttgcccttggcggcaccgccctactgtccattgtcatcggtgactcccaattttctgtgctgctactggtcggtgtttcgcttgtgattgcctccgtgttcctgtacacgttgaacccgccgccaagagtgaaaccgtccacacccgaagtgccagcgcatcacccacaagacgacgacattgatggcttggaggaacaacaattttccacggatgacgacgacgacgaaactaataatggaagcaacagaattgttgaactgaagttggacgacatcaaacgaattggacgagaagctccggctgacaatacttttctaagtgagtcaggggattaa

SEQ ID NO: 76709 - DNA, 2762 bp, Heterodera glycines
  Genomic contig location: Contig_ID=SeqID_1908; Location=3545..6306; Strand=-
  SCN-specific regions: Sequence locations=1-17,46-456,479-994,1017 -1160,1229-1253,1275-1326,1348-1584,1627-1901,1938-2388,2410 -2526,2549-2762
  Gene Ontology: Mol. function=URM1 activating enzyme activity; Biological process=protein modification
ttcaggtgtgttacatattcttgatttttatttttatttaaaaccaaaatttaaagacaagaacgcattcgagaaacaaagggttggtggttaataagtgggaattttttgaattaaatttttttagtgctaattattggcgccggaggattaggctgtcccgtttcaatgtatttagttgcggcaggtggcattaaaatgccgttttatgttttttttctgatttaggcattggacgccttggaattgttgaccatgatgtacttacttagatttagaaataaatcctgacttatttatgtatgttcaggtcgtttccattgacaatttgcaccggcagacaatgcacgaccaaaaacgggtgggccagtccaaagccgattcattgaaagaatcattgtccaggtggtcaaacaaaacaccctaacattgtcattcatttccaaaattgattcttaattgttttatgaatttggaatggattttgtgggacaaaggcttgaatttccagcaaaattatactattttttccaaattggaaatcaattttatctgcgcgactaattcattcatcaaaactttaagtaaatcgaattttttttagaattaacaatgaagcgaatgttgtggcttataacgtgttgctcaccagcaaaaatgttcttcaattgtttcgtgattatgatattgttgccgactgttcagacaatgttgccactcggtaattagaaaaaagttcagaaatttaaatgaatgcatttagaaatttttagttgagagagcgggtcacgttaataattatttttaaatggaattatgaaaaccgaaaggttactcttttgatttacagaaaagtttattaaattgcattttacatttttatttagttaagtttttaaaaaaaaattgtttccccaaccataaatttccttacccccccccctataaaaatgacgagttttttttataatattggttttcaattatagatatttgatcaatgatgcttgtgtgttgagtggaaaaccgttggtatatggaagtgcgcttggttgggagggccaatttactgtctacaacaatggaacggtttgaagcgaggaagcaccaaaatgttgagggcggggtggaaggcggatttaaaatatagtttctggcactttttttaaaaagattttctttaaaatttttctaaatcaaagaaaaatatataactaaaaaaaattaactgggttttcttaaaggttttatgagccattaattaagacaaataaggcgaagccctttgtctgtttttttaaattgctttctttttaagaattgtccttgcttccgctgcatttttcctgatcccccaagtcctgaacatgtgatgagttgctcagaggcgggtgtgcttggccccgttgttggcgttattggaagtttgcaggccttagaaatcatcaaaattgctgtcagcggaaaatgttttcaaaatttgatgatttttgacgacaacttttgtttccattttagcatcatttgccggaaatttgtggatgtttgacgggtttgaaggcatatcaaaaagaatttctttggtattttttttataatattaagttgttgtttttttaattttttcacatttatagagagagaaaatgtcgaattgtgcgatttgcagtgaaaatccaaggattacagaattacaagactatcaaaagttctgcaggtcggatccatcagataaggtgaatttcaattattgtttaaatggttgcatgacattgtgcctcggacatttgggcctaggtaaaaatctggttcaatttgggtttccaatcccctatggcctaaacaacataaaataagcgatataaaataattaagtgtgtctgataatatgataatcattcattaaaattttcaaaaaataaaaataaacaaattttcaaataacggaaatagtttattgggagcattaattctgctgtttgaatagttgatgtttttctaaaattctgacgatcaaattcagacgcagtcacttattttaactgtagtaaaccgtcttaagtttgaacccgatcttagaaaggcgcaaatgttagggtactcgattcttacatggcgcaaatgtctgcacattgttttaatctatttatgcgcttaaaggttcgctcattatgtttactttcggctgaacaacgagtgtcgccaacggaatatttaaatttgaggaacaaaaaaataggcggttccttcattttgttagacgttcgacctcccactgaatttgaaatatgccatttgccggaagcagaaagtttattattccaaatgaaaaataaataaatttatttgcttacaattaacagattttccctgggaggaattgagaagagcaaaaatggaaatgataattgacaagataaacaacagcatggaacgcaaaagtccgacaattaacggtgcaggaaacaatgggaaaacaaaaggtaaaccaaaaataaaattaaaacgactagaaaaattaaaaatatagtagaaagtggaatgttggaatgttttaaaaaatctgttttaactaattttataatatttgcccctgttcagtctttgttgtgtgccatcatggcaacgactcgcaattggctgcgtgtcatctgcacaaacagttgtcagaggccggcattggcgaccggttcatcgttcgtgacattgtgggcggaatggatggatgggcgttggaggtggacgccgacttcccgcgctat

SEQ ID NO: 76710 - DNA, 699 bp, Heterodera glycines
  Genomic contig location: Contig_ID=SeqID_1909; Location=67..765; Strand=+
  SCN-specific regions: Sequence locations=1-318,340-699
  Gene Ontology: Mol. function=SH3/SH2 adaptor protein activity; Cellular component=plasma membrane; Biological process=programmed cell death
atggcgtccttcaacccttttgcttgggaaagttttttctttggaaaattggatagaagcgaggccgaaagaatgttggcaccttgtgaaccgggcacttttctgatccgagagtccagcacagcgcaagactgttattcaatttgtgtgaaaggttgtggtgtggaattttcatttctttttaatgataggtaaattgtttttcttttttgaggtgtcggtgatcattccaatcattttttgattgaaaaattggttaccaatgaatctggtggtgctccattgtacagagtaatccaaaaaatatatgagagttacataattgatttaaaattgaattcccagatttcaaccctccaatttgccgatatgcattctctgctaaaccatttcaaagttttcgcattggagccagtcccgatcaagttgataaagccattggaaaagccatttttggagaaagtgatggccaaatacaaatttgaatcagaacggatcagcgatttgtcctttgagcgcggtgaacagcttgaaatactgggaaagccggaacagggctggtggttggcaaggtcagcagggagggaagggcatattaaaagtgaatctaaaatcattttttttgccaggaattgtttgggtgagactggcatgattccggctaaccgcgtgaagccggtaatcattcttttcttgtaa

SEQ ID NO: 76711 - DNA, 1866 bp, Heterodera glycines
  Genomic contig location: Contig_ID=SeqID_1909; Location=1141..3006; Strand=+
  SCN-specific regions: Sequence locations=1-176,206-288,326-859,892 -1098,1122-1137,1159-1575,1608-1676,1699-1766,1791-1845
atgagtgatgattattttcgaacacagtgtgatgattgtgacgatgcactgagcgtgctgaacccgagcagtacaaacagcagcagcaatggttgcggttctgcgggcaatcggtcgagcgcacattctgtgggcgaccaacaattacatggagaggtacatttaattggaaaaacaaaattatagaaaaaaattataataatttgcgtatttttgtatttgtgaaaatttccaaaattaaaaaaagaggatgattaaaaaagagaggcgtaaaggcagcatttgctctatttaaatgttttctaaaaaaattaaaaaaaaaattctcacgaaatcaaaacgaaaaatttaaatcgagaaaacgataataaaatttttctgaccaataaaaaacgaacctaaaacccaaaaagtgccgaaaaagacgaaaaccaaatttcgaaaaacaatccaacttccccattcataaactttttgatataggcataaaacaccttttgtcaccaacaaaatttgattttctattaataaaaataattttcttcaattttgaacagcaaaaaccgacagacggagacagtacaacaaaattggtgcaacgacagcaacaacaattgcgcgagaactcgtgggtggtcgtcaaatttggacgtcagccaagcatttatgacaacgattcattgaccataaaagtgggaaacttgcgttctaaaacatttaaggaattaaaatcaagaattctttaaattaaaaaaatgagtttttcgagaattcaataatatttttttactttctactaaaaaaaacttaattttcgatttttttaattatatccaagggggctcctcttttatctatgttttgctaatttacaaattaataatgaaaatttagtaaaaacgggacacaatttgtaattaaacaaaagctccccttttagcgaggccaatttttgtatctccaagaaattttgtcaaatggaatgtgccgaggcacgaatgaaagcggaaaggtcggactctttccaatcacttatgtggaggcggccaacattgagccgagcgaaagcccgtggaatatttcagcgaatgcaaatccaaattgttagaatttattttaaaagttttgtcgcaaaacttttaatttcaattttcacaacttaagaatatggaaagataattaatattttttatgttttttgtactgcgacaacacttgataattattattggggctgaaatttttggattttaaccaatttttttatttctggatattattttgcgagagaaagcacagaaaatttggatgacgacgtgaaaaaagactgtcacccgggcttgggtaaaattattggtgctttttgagcgttttttgcttaccaaattcggcacctattgatgggtttttatgcggattttagcactttagtgcgcttattttagcgatttaaacacaactattaaattccagccttggtaattattttgtacatattattacatcctcctatttttatgtctttatttttattggcattgttttccatctatttgcctttgaatatatatttgcttaaatattcattatttttaaatttgtttaaatacctaaatgtcttaaaatgttttcaccccggctctcaatgttttctcttaaatcggaatttccacctgttgccttccttcctttctttgatctctcgccatgttttcaaatttgttcgacgtcctttaacaacaatttcattgtgacacccagtaaacacattgtgttgtgtgttgttttgtattcatttccaattttcacaatttgccttttctctacgccatatcatcatcattttgtatatatgtacacacaaca

SEQ ID NO: 76712 - DNA, 727 bp, Heterodera glycines
  Genomic contig location: Contig_ID=SeqID_1909; Location=3067..3793; Strand=-
  SCN-specific regions: Sequence locations=1-195,217-497,519-727
atgcatgagccgtatcttggccttctgtatttgatgagacagaattttgattgtgccaaattcgaagaaaatttagaaagtatattggtaatagaatgtgaaaaatatcgaaattatttggacattttgtatgaatatttgttcaaagtatatgcaaaaagtagggaatgcattattatttaataatcattttccataatattccattttttatatctgaaaaatttcatataattaaattttgaggatgaaaatttgggttttataacttgtgattatcttgctaaatgaggacaaaatgcgaaattataaagcaaattttggcaatttggatgaaactcttcgcaagaaatttgacaaaaaattgcaaaaattgttcaaaaaagcaagaaaagaagaaaaaagccattggagcattgaaccttaacgaaatttttcaaaattttgcaggctaatagaggatacatagggctatcgaatgataccaacaatgttggatttggttggcaaagaaaaaagttatagtccaaaaacatgtgttcgtacgaaaacggcctggccccaaatagagcggattgattttttcaataatttgtcaaaatacacaattaatattaatggttattgaaccgaaatgaaaagcaaaggtaacatctgctacataattaaattcgtagaatttgatggttttattctccgagtagtaatgaaaatttcatttaataaa

SEQ ID NO: 76713 - DNA, 921 bp, Heterodera glycines
  Genomic contig location: Contig_ID=SeqID_1910; Location=1..921; Strand=+
  SCN-specific regions: Sequence locations=1-336,378-921
atgccaatggattttgaatatattgttgccaacgtggccgggccgggcacagattctgcatttcttgacgaagattttgagggctgcaattgtacggacggccaatgctgcacgtcggcagcaggcggttgcagctgtttgcccggcaaaagggacaattacaatccgatcaccggcaaatggattgatcaggggggcactgatcagcggcagggtgtgccacatttggagtgtcaccaggtgtgacggacggctgacaattctgttaatatgcataatttttcacgggtcaatcaatgacaactggtaaaaaggcaatttcaaaaaatagtggactttttataaaataaatttaaaaaaaagattttatttaaattcgtttttttaattacaaaagtgtattgtacgaagcattttgtattgccttttgtacaaattctcatgtcattacaccaatttttcagaattgtgtgtgcgcatgggagccggacaaatgcgcaaatcgtcaagttcaattcggtgtccgacaaccgatcagggtgtctgtcgataatttacaaaattgaacaattatctcttatttgccattttccgatcaatcattcaagcatccttttcgtcatcaacaggttgccccgtgtacaaatggcaaaggcttcggcgtttttgcttccgcgttgatcgaaattggcacttttgtgatcgaatatgttggcgaagtgcttggggaagaggaggcgcggcgccgaattaacattgttggacggcacgagcacaattatctgttcacaattcgcgaattcttcggaggtggagtcatttagaacagaatttttcttttttacactgatcaattgtgaaagcctcattattgataactagggctgggatttttatgtgctaaaaatcctgaaatatgta

SEQ ID NO: 76714 - DNA, 83 bp, Heterodera glycines; identical to SEQ ID NO: 55537
  Genomic contig location: Contig_ID=SeqID_12957; Location=114..196; Strand=+
  SCN-specific regions: Sequence locations=1-83

SEQ ID NO: 76715 - DNA, 878 bp, Heterodera glycines
  Genomic contig location: Contig_ID=SeqID_12958; Location=952..1829; Strand=+
  SCN-specific regions: Sequence locations=1-162,185-321,344-350,372 -557,579-744,766-878
atgtataaatttagctccgaagtgaaggagaatacagcattcctaaagaagcttgtctccaccagatcagaacaaaagaagaacgaattaatcgaaaacgctacagctgaccaaattttggcaatcgttgaaatttgtgcaaatatattgagttttagttttaaactaacgaacaaacaaaaaagaaggttggcacaatacgccgatttttatagagaaattgccaaatctcgttcagagaaaacggtaagaaaaaggatacaacaggggagtggtatagccctgggagctgtcttgatacctgtcctgagttttttagcccaacatttattagaaaaaataacatcatgaaatttgcaaagaaaatgttaatgattcccgaggcggaatatttggctctacggattgcgatgaattggctctataaagaaagacgtacggtaaaggggatacttgaaaatagaccacagaaggtggtgattgagaatcatgtacccggtccgaacgctgcaccatatctaggcctcaataaccaatccaaaccacaggagaccgatgaaccacggaaaataattattcctaggaaaagacttaaagagcaaactcctgatcctgaatcagataatgatacacttgaggagttaactccggaaccccaaacaccatccacactcaaaacacccgttccgaccaaaactattatacacccgacccttttaaacggtttttttaggtacgtgaaggaaaacaaagatttatttaaaattacggcggccggaaaggtacagtcgaacattgatactgaaggatccaacagtaaaagacattggttgataaatcaaaagtcatgtggggacgtggaaggaaaaaggcaataa

SEQ ID NO: 76716 - DNA, 668 bp, Heterodera glycines
  Genomic contig location: Contig_ID=SeqID_12959; Location=53..720; Strand=+
  SCN-specific regions: Sequence locations=1-2,24-85,115-453,491 -589,611-622,644-668
gtgtttttgatagcactctccaaggatatgcgtgtccaatttatgcgaactattcgcaaaacggtgttcttttgtaatggcaatacagcagcagcagcaacagcaacagcagcactgcaaacggtagccgactcataccagtacagtaaccgaatacggtatgtcaatgtccatgctactggaagaatcaatcggttcaatggacaatgattacgcagcagaaatttgcggaattagattattttttgacacaaattcttttgataattaaagagaattaattaatttacaaatttgacgaacaaagggctaatgaggacaacccaacaaactaatgatgtcgtacacttgtctcaaatatgtataaacaaaaaaaaaacaagaaaattaaaccaaatttattttaaaaccaataaaaagctaatgagttataattcaaatatttaagcaatgtaaaaaaattaaataaaataattaattatttaatttactattttcagaagtgtttttatgcttttgaagtaacgaataacggtcaaatttaattttattaggttattagaggttaaatattcatataaaagttttttgaatagattttaaatgtatagacagataggcatttttatttgtgttttttaaatacaatttcgtagtaatatttaaaa

SEQ ID NO: 76717 - DNA, 438 bp, Heterodera glycines
  Genomic contig location: Contig_ID=SeqID_12959; Location=870..1307; Strand=-
  SCN-specific regions: Sequence locations=1-47,69-118,140-170,210-406
atgtccaaacaatttctgctgttcgctttgctgcttttattgctcccaatggacactttgcaagaatgttcatgggatgggaatctgtgtacgggcagctgttcaacaggatgcgaacaattaagtcaagcaaactgtgcttgtgcaaaggttttttggaattttttggcaatttttaatattttttaattaaaatcattttttatttaggaatttaaagcattcctcaagggaggaagtccacggcacctaaaaaacgcttcttttattaaagtttgaggtgttcattttccaattaatcattttggcacaaatacaaaaaaaaattcagagaagaaaaagcaaggaaaagcagaaacaacagcagaagaacaaaagtgtcgaatgtgatgaagacgaaaaatggataataatattaattaaataattattaataaa

SEQ ID NO: 76718 - DNA, 84 bp, Heterodera glycines
  Genomic contig location: Contig_ID=SeqID_12960; Location=1544..1627; Strand=+
  SCN-specific regions: Sequence locations=1-84
atgaattttgtggaacgatttgtgaattttataaatgatttgtacgattggttgtatttgaacaatgtgatggcttcgtatgag

SEQ ID NO: 76719 - DNA, 3437 bp, Heterodera glycines
  Genomic contig location: Contig_ID=SeqID_12962; Location=66..3502; Strand=-
  SCN-specific regions: Sequence locations=1-938,960-1033,1088 -1334,1356-1364,1388-1410,1434-1436,1477-1517,1566-1606,1629 -1798,1837-1891,1940-2030,2061-2159,2184-2237,2259-3300,3323-3437
atggccaaaaaatgtcgcgatgaagcaaaatgcgacgaaataatccagttgaaaaatgcaattcgcaatttggtcggtcattcgctgtttttggagttggaacgccaaaatgcgttggcactgtcttttggtaattgcaattgccagcaacaaaaactaaaaatgacttattttgccatcacagacattgtggacgatgctcaactttcgtcggaatacacaaaaatgtttttggaaaatgcgacggatgccaaaacggcggagacggcactttcaatgcgcttttgttttgccaaaataatcgaactcttctccaccatttattcccattacaaattgcacctgccaaactcagaagtgtcaaatataattcgaacttttttcgtgctttctgtgcaaaaatgggtcctcaaattgcccaatgttttaatcgaaatcgctgacagaagctcctccaccatggctttgttgttagtccacgattggctggctcagctgtcatcggagtgcaacgaaatgccacaaatgggaggaaaagcgcagaaaatggcgacgacgagggcacttttgaattgggccaaaaaggatgccctaagggaaattcgggcacagttttatgagcaacacacgcagaacatggtcagactgtacgagagcggagcccacaaccgcaacgcgttcagccactttttggagcagtgccaattggacgggaggggcgacaaattccgagtgaggcaattctatgccaatggaggaggatggaaaagcggagaaaaggacgaggaatacgaccgattggtcagcaaacacccaaaagtgaagcaaatgttacgcatcggtaggaaaagcggaatttggaattaaaagggcaaaaacaaaaagaaaagcttttttagaattgaacgacgaagaaataatggaaattcaaatcagaaattacctaaaatatatggatgtccaaacggaacaacaaaaccaaatgacacgcctcaaatatttgctgaacattttggtcttttatcagtggtacttttaaaaataattttgttcttttttaataaaaattatttatgttattttttttgtttttagctttaagaaaaatgcgccccttttgcgcccttccgccgacggaaaaagcgaacaattggacaatcatttggccgaattggaacttttgatgaacggcgcaagggaagcgctttcagtggatgagctcctccaaaacgagactcagctaatccttgttttgtttgagatgaaaaattcaatttttggcgataaaataacgcttaattcaaaaaatttgtgtgagggggaaaactttttgcagtttttgtttattttgcatgaaaatgccattggagaactgatgagaaaagctgaatttacggcacaattgaaaggtaaagcattttttaaaaagtcaggggaaattaatatttattttattttttaattacaaaaatatatcaaaaagatgacagcaaatttgttatcagtcagaatttgagtttaaaatttaaaaaaatgccaatattaaaattataaaattaatttaactttttctttgaattgtttttgtcattaatattccatataaaaataactcaaacaaattcagaaattaaaattgaccaaaatcgtctggaacaaataatttgtggaaactctgaagtatttaagcaattgttgatgaattacaatttcatttatgatgaccctgaaaatatttcgacaaatgaagaaggaaattgccaaaatttcgacccaatttcatatttaagtgctttcccattatcatcatcatcttcatcttcacaatcatcatcagctgaaaatggtgcattataagaagggctgggatttacatatatttacaaaacggaaatatttaaataaatatttaagaaaaaatgtagaatattaataaattgaaagtttagagcaaaaaaataaaattgaaaattctttctaattgaataaaaagatgaaaaaaatgctttttcaacgtaaatattttctatataaaagcaataacatttttgaagtttatggatattgacgttaaaacgacatattttcggctaaaaatgaccttttttcgtgtattctcatcaaaataaagctacagaaagaataattttaaaaatatatccctttaaaaataataaaaacataattcggggggggggccacctgacaaattttatcatttttttaactctctgcgtttacattttttaaaaagaagaagcatcttttaattttattgcaaaattcaaaattttgttgttaagatggtgaagaagggtccgtctgttccgatgagattttaatgcgtttgtacaaggccattttggtggagaaagtgccatcggaaagtgccaaatggcaaattggcattgacagtttatatttccaacacaaaacgacggttttaaattcaataaaagaaattgaattattagcaatgagttcaaaagtgaaggatcacacatcggtggacaaattggcccaattaaaagcggaagtggccgggttggaactgttttccccgctgaaggatgacgatgaaaaaatgcggaaaatttgttggatgaaaatgttttttaaattatttgtgggagtgacaacaaaaggaggagaagcagctcagaaaagaggcgcactgacgacactgagcgtacgcaattaaattaaaattacaatttaaatacgacgtaattaattaacaattatcaatggccgggacagggatttgtgttccaggactcccgttcttggcgatttgtccaaaaaaaccgggttcggtaatctcggcaacccggcaggcgctggccccgtccggtctcaattaattaaagtgcactttcgtttagaaattggacccatctgccaatgatttggttgaaaaggattgtgagaatttgccttatctgagggaatatttcaaaatgtttttgtccgattctcataacatcggagtggttggcactttctcagtcttacaacttttggcacaattctcagaattggtcccattcatcaacaacaaccccatcccatttggctcgattcaaagcagtgaaaatcgtaagtaatctgatttatttggtgtaattagctaattatttttttgcttaattagacaattaatttttaattttcgcagcacaatcaaacgaagacaaagaaatgcgaaatttgtacaaagcttatttgacagaggatgacctggcaaaaataggcaaatatgaagcaattattggcgtaaaatatttgttagatgtcgctaaaaagaacgaagaaaaagaccgaccgaagctgaaagagtggcacaaaattcgaatggccaaagtgcgagcacaaacaatggcaacgctgaaaatgttggacatttacgcggatagtgccgagcaactgtttcgcat

SEQ ID NO: 76720 - DNA, 683 bp, Heterodera glycines
  Genomic contig location: Contig_ID=SeqID_12963; Location=56..738; Strand=-
  SCN-specific regions: Sequence locations=1-381,406-683
atgatcgcgaccaacatttgtgccatccaattgtccgccgcaatttttcgctatttgcgtacattcgtgccgtcaattctcgacgactttccatcgcttcgcattatcaatgcctattatgacggtttcttcgccgaattcccatgcgatgacagtgccgcggcatcggatggacaagcgttggccaaatggcttttcactccacgtccggacgatgtgccaaaagtgttcaaatgcttgttgcgttgggatgacgggcatttcgagtcgaggattgaagacttcaaagcggtgatttccatttattttatgttatttggcatttttacggtctttggtgttcgctgacaaaaatattttgtacggcattcaatttgaatttttcagtttttaactgtttttccctctcattttaggcttttgccaatgcttcatctcccgtcaatttcatcgctgtcattcgttttccgccgccttttgctaattccgttgtgctcttcgatctcactaatgaattgactcgggagcaattgacattcaaatggatggacgatatcggccgttttcttctgatccgttgtccaattgtgcgcgatgaaagcaaatgggcaaaatgggagaaggaagcgattggatggaactttatggatcagtggaatcgaatcgacattcgtgtttcgtga

SEQ ID NO: 76721 - DNA, 507 bp, Heterodera glycines
  misc_feature (55)..(55): n is a, c, g, or t
  Genomic contig location: Contig_ID=SeqID_12963; Location=804..1310; Strand=-
  SCN-specific regions: Sequence locations=1-364,405-507
atgtcagaccgccgaaaagaagcggaggaaaaaatggcaaaagcaatgtaaaatntaaaattaaaatgccaatttcaattttgttttcccttttttcagtttcatctccgccgattgttggctttgtgtgttcgatttgcttccgccttcacaacttggccttggaattgcaatgatcagtcaccgatttgacttttacgtcgatgaacacttcaagactcgcaaatggtcgctgaaatccatagaacttttgccaaaatatgaagcggatggcaccaaggaaatgaaaatagtcaattacgatggaaaagaaatgtcaattccgcaaaatccgttgccaaagaaagtcgtcggattcaaagccattttaataaggtgatgatgcttttttgttgtttcctatttgtaaacgattccttaattttcacagatcctgcttcaacaacaattccatcgcttttctccatcgtttgcgtccaattttcgccgcctgtccaattaattaaa

SEQ ID NO: 76722 - DNA, 988 bp, Heterodera glycines
  Genomic contig location: Contig_ID=SeqID_12966; Location=1151..2138; Strand=+
  SCN-specific regions: Sequence locations=1-8,31-202,225-353,415 -583,606-680,731-750,779-988
atgaggaacctcgcggggggagaaaaagggggcacaaaacttccgcctgaattgccgcggtcagtcgctgacggatgctccgccgccttcgccttcggcacaggcacactaatggcatttcactgccactgccgggttagttgcccttgggtgagcccccacccccggggcataaattaaattaaatgaaagcaaagggaataaaaggggaagggagggagaagcagcaattggacacttcggagtgtaatataaacgcaaaaatgagcaataattacatatttgattagatgaaaaatggtaaaataataaatactaaatgaatgtataaattaattccaaaaatgttcctcattttttaaaaatttatataaattttctttttttttaaatataaaaatattctaaattttagctaataattgaaaagtattttaaaatcgattttactatgaacaaaaatacaaattcatataacttaaattataatgagttaaatcgccctttttggaattagagtgactttttagcactttaaaaaaccctaatttggcatatggaatgtaaaaaaatttaatgggtttcagtacatatttgaatatgacaaaaaatttgttaaatatatgaaagaattttgtatcagagtaaaaaatttttcgagtttttcgtgacggaccatgtaaaataataacaattttttgaaaaaagtataataacaaaaaaaattattgatttgacagaaacttttgcaatattttttcttaaaaaaatttaaaaagcatttttttcgatggattataagcgggcgaataattttgaagaatgaatggcctgcctgtgcctgtttagtagtgtttttttatttttggcatttttcgatcagttgaaaaatattttggcaatttttgggtttttagtagtgctgttcgagaccaaaattttacgagacgacactgcagaaggggagactttcattgtttggatttga

SEQ ID NO: 76723 - DNA, 1807 bp, Heterodera glycines
  Genomic contig location: Contig_ID=SeqID_12967; Location=1926..3732; Strand=-
  SCN-specific regions: Sequence locations=1-1527,1549-1807
  Gene Ontology: Mol. function=glutamate/aspartate porter activity; Cellular component=membrane fraction; Biological process=protein targeting
atgccaccgttaaatgttaccctccgttggctcatttccaccacaaatcaaacgaccgtccaaacgacgaacgaaccgttgatgaaaccggtgggagagcaaattggaaattgactaattaattaatgggaggaaagggcaactttttagattttggagtacaccaacgaagtgaacgttctcgggctgatcgtcttctgcaccggctttggcgtcattttgagtattctcggagaacaggcgcggcttatgaccaacttttttattgtgctcgatgcagtcagtgagaattaggccattaattagcccaaattcacccccaggtgataatgcgttggatttccgccctaatgtggtgctacccaattggcattctgtcgttggtctgcaaaaatattttggacattgacaatttgacggaaacggcgcaggcattcccttctcattaagccttaaaaccaataaggcttcaggcgttggccatgtacgtggtcaccgtcatctgtgggctgatgatccactcgctgctcactttgccacttttgtattatgcgatcactcgccaaagtccgttcgaattcatgactggcatggtgcccgctttggcgctaattcaaaacgaaaagcctttccttttcagctccaagctatcgccaccgcttttggaacagcttcaaggtgaaaaaagggcttcaaaattttctgttactttttttctgtgtgtttttccctccagcggtgccacccttcccgtcacttttcgtgccctcgagcaaaatttgcgaatcgatcggcgagtcactcggttcgtgctgcctctcggcgcaacgatcaccatggcatgattaatgaccatttggcatccattccgaaaacggcatttataataccgtaggatggcacggcactatacgaagcggtggctgtcatttttattgcacagcttcacaacatcaaattgacggcgttggaacttttgacaattaggttaaccattgaattatgagcctgttcaatttgttcttttacagtgtgacaactacggtagcatccattgggtctggttctgtaccggctggtaaacacaaacttaacttatttccttttaatgacaacaatttttggccttgataccattctgatcgttctggtcactgttggtttgccgaccaaggacctgagcttactgttgactgtcgattggttactgtaaatttaaacgcattcgcctattgtacctccctttatgaatttgcagagaccgaattcggacgagtgttaatgtgctgggagatgggttcggctgtggaatcgtttcgcacatgacaaaagagcgattgatcgagtcggacaacgtcgacctgatcagacagctgaagacggacattggtggggagggcatttcaaaattggcactttccatcgaatgccaacgatttcattcccaaaattggcaatttcgaatcgaaatgcccattttattgccaactttgaagagttgctcaatgcgccgaccacttcccccggctccgcccttctgacgccaaacgcgtcgacgcggacgcgcgaaagcgccgcgcaagggacggcgaagcgcactcagaacaacgcgcagcagcagcagctgcaaattccaaatgcaaagaattcgccgtcttttttcgttttcccttcgcccgcggcgcaaacgaaaaattttcaaaaaacgcaaagggaggggaggaaaagctcatcagtgtcagcagcggagaacggacaagtaaaaggagaggccatttggggaaataagcaaaacacaactaggtaa

SEQ ID NO: 76724 - DNA, 4206 bp, Heterodera glycines
  Genomic contig location: Contig_ID=SeqID_12968; Location=1..4206; Strand=-
  SCN-specific regions: Sequence locations=1-146,169-479,502-541,563 -584,607-665,687-783,869-1042,1115-1120,1154-1250,1310-1392,1430 -1581,1605-1737,1798-2086,2111-2145,2167-2217,2264-2383,2440 -2522,2544-2660,2705-2781,...
  SCN-specific regions: Sequence locations=...2803-2850,2872-2910,2932 -3091,3188-3509,3751-3771,3837-3971,4040-4046,4068-4131
tctcggcgagatttcggcggcgagatttcggcggcgagatttcggcggcgagatttcggcggcgagatttcggcggcgagatttcggcggcgagatttcgtcccgtcccctaataaatatgctaactcattaagcccaaatatgaatgcattccaaaagtgtggctttgtgacggcgatgtgacctgtgccggcggtgaggacgaaagtgaggcgctgtgcggcgtcaccaaaaaggcgtgcaacaagggcgagttccgttgcaacaacaaccactgcattcatgccaggtgggagccgaaggatcggccgagtggggagggggtagcaattcgttcaatcggtgctgggacgttagtcaaaaaccatcaaatgaaaatttttttgtcagaaatttatttataacttggcataaaatgtaccaaattttaaaatcttgatatttttcgatagctctaagtgttttctattatcttgcaaaattttagaaaaattaattaagtttgaaaaaagttatgacttgagaagctcagaaaaccaagttttttcaacatttttggccataactttttttgagacttaatgaattttgttgaaattttgtaggctaatagaaaacacttagggctatcgaatgatatcaagattttaaaatttggttgcctctgagcaaagttatatcaaaaaatcttttcatttgaaggttttttgactaacgcccattttgatggtttttgactaacgtcatagcacccatataactattgatacttgttaagtgtgcttataaatcaaattttattatttattaaattaaatgtttaattaatttttttttaaatatttaatttaatcaaatttaatttaatgttttgtttagcaagtgattcggcgtgcgccagtgttgcaaaatgtcaatgtgaccaattcgtccatgcacgcgctgcagctgctccacccgagcaacaacattgtgctgagccgtttgaacatttcggacaaccgcggcatcggtgtcaacattttggccacaacattacaggtaaagtgaattgaattcaatggcaaaacaagttcaattaaattgaataaaatttaaattggaaaaaattaaaaatccgtaaaatttgaaaaaaaatttaaataaaatttttgcaagttgtgttattttatttttaatttacgtttttagtttgaaaacacaaaaaatttttgtaccatcaatgtttcagggacaataaactcggcgtgaaaattttgaaaaaatttaactaaatttttttgtttttattttatttttttttaatttacgctttttaatgggtccaaatcggttggaaacacaatatatttcatcccatcaatttttcggtgacaataaaattgcgaaaataaagaaattataaagaagataatggatgatggataatttaatcggtgcttaagaagaaaaaaacaaaaaacaaaaattttcgaaaaaaaacataggtaaaatttttcgtttttacaaatttacgcttttaaacaattttttctgtgacaataaaatcggggggattaaattgtgagataatgtgaaacggtgaagaagataatggacaacgagttgtattgtattgacattgtataatttaaaccgaggctaaagttttcgtagatttttctgaggccggaggcaatgaacaactaacaacttaaccaattaaattttcaggaccaattaaatctgtgatcgaactataaaaaaatgttcattaaattttaaaaatccgaaaaatttaatataattttattttatgcatttcgcagtcgacaatcgactcaatgtcaagcagtacatctgcagctgcttcatctacaggccattcgtcccgtgtaccgtatggcccaatcacaataccgtaccatgtgccgggaatgcttaacatatgttcaatgagcaaacaagtgaaggtgagaaatggcgaacaataaaatataattcaggcacaaatcaaaaaaaaatttggaaggtttcgccataaaaatttgaaataatacgcggtttcaacaggcatccgccccattgtttataaaaaaaaaaactgaaaattttaagaaatttggaaattgtaaagattttttctacacttataaaattaacctaattttatcatattaaaattttatgctgccaacgaagaattagccctgattaaatccttgaaaaattatagagaaattataaaagttctttaaaaatttttttttttaatcattaattactttttcctattttcggatttctaaaacggataaaacgaattgaatcctgtgaattttaaatgaatttttgtggcattaattcttcgaagggcattttcattccaccggataatggaaacaattaaaaaaaaattttcaacttttacaatatatttaaataaaaataataattaatcgaataaatgcacaggtctcagggcgtgtcctactgtactacaagtacgattcgtatccagtggactgtgtgaaggtgttcagcagcagttggtccaggtccaccaccaccactggtggtggtgttcaacgtccgttgggcttccgtctgttgcaagcaaatttctaccaggggccggctggcgtgccgaggccggacgccttgcatatttatgcgggcacaaaatttttgtaattttttttatattaaatttattcatttaattcggcgccagagggttcgcaaaatttgtgaatagtataccaaatgaaaatgtgacaatgaccacaaattttacacgacaaataattgttttaattaaaagtagatttttaagagaaatatttacgtgtgtggctcagtggttttttgtaagataataaaaggaaaaagtaagtgaaaagagatggaggttcgagcccgctccacaacatttatatttttatttattttctaccaaaaaggaagtgaaaagagatggagcggttcgagcccgctccaccaacatttattgtattttatacaaaaaagattaaaaatgcttatttttggaaaaatatttgagtttttcaaaccaatatgactctcatcattactgtctggcaatgtttacatttatttttattagcatttaaattttttacaatttttaattaaatatttattaaacatatttttaaaattttttaaaatgtttttacatattaaagttcatccaatctgttacgcattttcaatgcttcatctgatttgtccggtagtgttgcaacccaaaacccatttctcggcatacatttgcgtgccaccgccgcagacggcgattacggtaatgccatagtcaattaacaaccaattatccgtctccctaattatgccacctgcaccaggttttttggccgaagttgcagttttgccaacagcatcgatcagcaccaagccggtggatgaaatttcgttgcgagtttcgcgtttattgaacaatgaccggggcgcattgcgatatggaaatattggcgaagtttgtgccaaactattaaaaattaatttcaaaaatttaattaattaataaattaatataaaatttttaaaattaattttacaaattaatttagttgtgatctttagaatattcaatgtgtttaaagaaaattttttataattgaaattgtttgttgatgttatattttgaggatttttcgtataatttttgaaatattaaaaaaaaaatttttatttttacaaatttcatataatatataaattatttttaaagagtttatgggtgtttcagagtttttttaatatatgaatttattgctaatagttttttttaataatcaattaaattaatttttttagatgggcccaaatgtgatcattgaacagtgtgtgatggacaaaaatggatatcatttgtatggcaacatttcaacatcacttcaagctgctgaactccatttgcacaacacaatggcactttattttggatttggattaataattaattaaatttaatatttattcataaaaatatttatctaaatttaaataaattatttttgaaacatagaacaacttttctttttcaattacattcatcttttgggtgctttactaattataaattgttttttttcggggttttttttggtgatttattttatgaatgaaaataaatcaatcattttgaattaaaaaaaataaattttaatttttttatattaattt

SEQ ID NO: 76725 - DNA, 771 bp, Heterodera glycines
  Genomic contig location: Contig_ID=SeqID_12969; Location=1..771; Strand=-
  SCN-specific regions: Sequence locations=1-135,188-201,334-382,621-771
gtggtctgccgtgagttagggtttggcccgcaaaatgcttacagttggcttacaccacaatgggactataatccacaactgcgcattctgaagacatacatggaaccacgagaatgccgaggttgagggagagcgtaaattaattaaataataattataaaaatattttaattttttgaaaaaatttgattcgaatcgagcaatttaatttatactaataaattattaatttaatctaatttttaaattattattattttttaaaattgattcgaatattttaatttataatgaaaaaatttaatttaattaaaattttaaaatatttaatttttcaagaattttgttcgagcgactaaatttttattgaacaaattcaaacttaattttatttattttaaaatattattttttgaaaaaaaatatggaataaatttcaaatttaatttttattttatatcaaaatcttgtcttcttctttaacaaaaaaaatttatattttcagcaaattattatttattttataattaaataatttcagttctaacatttataatttttccaactttcaaaaaaaaaatatgaaaaaatgttttaaacaaatttaaaaattaataaatgttttcacaattgtaggctttgaatgccgtttggagagctgtgcacttcgtctgactgccacattaagcgattggcaatgcatcaactccgagcagttcaattacgtgcactgcgggcctgaaggcaggcttttccggaaaaaaatttttt

SEQ ID NO: 76726 - DNA, 1265 bp, Heterodera glycines
  Genomic contig location: Contig_ID=SeqID_12970; Location=1256..2520; Strand=-
  SCN-specific regions: Sequence locations=1-138,165-260,282-333,355 -485,507-680,704-740,762-799,821-876,898-1060,1087-1243
  Gene Ontology: Mol. function=structural constituent of cuticle; Cellular component=extracellular; Biological process=cuticle biosynthesis (sensu Nematoda)
atggccgacttcgaagggcgtgtcaaagcttaccgtttcgtggcttacacgacggtttctttctccatcatctcacttttgtcggtgtgcttgacactgccaatgctgaagagttacgtgtccaacgtgggcatgaaaatggactctgagctcagctcatgccaggcaaggaatccggcacaaagttcgaagtgctaaaagtgccattttcagcacaatgccaaagacatttggtccgaagtcagtcagctgaagggaatgcctctgctggtcgccggaaaccgtactgcgcgtagcgcatacggtagctgccaagagtgttgctccggcggtgcccaaggccaacccggccaacccggacagcctggacgacccggaaaccccggagcgcccggctcaccaggacagcccggacaaaccccgcagacgccttgcgagcaagtgcacccggtaaatgcgggttcaatctcgagttccaggaggtctagaacttgtattaatcattgcatgttcagcctccatgcaccccgtgccctggcggtcagcccggtaacaatggcccacctggacccccgggagcgccaggagcacccggccagcccggcaccggaggaggacagccgcaacccggagagcccggcccacctggacccaatggccagcccggacaacccggacagcccggagcgcctggacagcccggacaacccgcaagcccaccgccaacggagcccgctcctgcaggcccacctggtagaccaacattcgcttatttttcaacgaaatatgccttgtttcaggagaggctggtgcacctggacagcccggtcagcctggagcccctggacagcccggcgcggccggacagcccggcccgaagggacctcccggaggcccaggacagccaggcaatggcggagccccaggccagcccggccaacccggacagcctggaaaccccggagagcgcggaatctgtcccaaatactgtgccgtggacggcggagtgttcttcgaggacggcacacgaagacgttaagaaaagcgattctgatcagtggaagaagaaaaagcagaaaaacagcagcgattgccctcccctcccccggtgcccttctccgtccccatttcccactgcctttctttcccttcctttttttattttgtttagcttttccaattctcccaaattcccccccccctctgaatttcttttctttgtaatcgccgctatgccaagttgcaaaacatcagcaacaaataaa

SEQ ID NO: 76727 - DNA, 580 bp, Heterodera glycines
  Genomic contig location: Contig_ID=SeqID_12971; Location=79..658; Strand=-
  SCN-specific regions: Sequence locations=1-580
  Gene Ontology: Cellular component=cell wall (sensu Fungi)
atgaactcacctaatttaaccgtttttaaaccaaatgatcaattgattaactccctaatcgctttcatgttacagaaaagccatggcctaatacaagcggagaatgagttggacattgtgaagcgcaagtgcgtgatcaacgaggactaccgacgccatgttgccattttggaggtgcacacgcgcgaggaggaaattgagcgtgagacggcaaaagcggtggcggagattaaaaagaaagtggccaacctgagcgagacgcggtgcccaactgttgttaccacggccattagctcaacttcgactgttagcgcggccattaacacaactccggaaattagcacaactccgaaagttgctacggccattaacacaaccccaattgtcgccatggccattaacacaactccggaaattagcacaactcagaaagttaccacggccattagcacaatcccggcaattagcacaactcagaaagttgccacggccattagcacaactccaactgttgccacggccattaacacaactccggcaattagcacgacttcgaaaattgccacgaccattagcacga

SEQ ID NO: 76728 - DNA, 1884 bp, Heterodera glycines
  Genomic contig location: Contig_ID=SeqID_12972; Location=1022..2905; Strand=-
  SCN-specific regions: Sequence locations=1-195,217-283,325-424,448 -688,717-936,974-995,1023-1186,1208-1245,1311-1450,1472-1779,1803-1884
  Gene Ontology: Mol. function=histone acetyltransferase activity; Cellular component=nucleus; Biological process=regulation of transcription, DNA-dependent
atggatcagcacgataacaacaacgatttgtctgatcaacatgatgaagtgaagcaaaatgatgatcatgaagatggtggtgatgccgaatgcgatcagcaaatggtggataattcggtggcactacacaatgctccatcgtcaccggtgaaaaagcatggaaaagcaaacggaaacggagcagtggcagtagcaaatgatgaggaagaagaagagcaaaaagtggtggtggtgcagcagcagcaacagcagcagattggcgaagatggccaacaaaatcggcatgttcatggcgatgatgacaatgatggtgttggtgatgatcagtcatttttgacaaatgtgttgagacggtctacgagaaagcgtacaaaaagggacaatggaagtagcaccaccacaatcattcattatgctgaccaaatggaggaggacgaagaggaggaaaacaatgaacaagacagtttggcagaccatcgggaagaagccgcttttgccgtgccattattgcctcgaaatgggccaaaaaaacgttcgtcgcccaaaaagatggcaaaaaagaggggacggccaacaaaattggaggcaattattcgaagcatggaattggcaatgaatgcgaatggggcacggaggaaaggaggaaaaacggtggcgatgaaaaaagggggacgaaaaatgaagacgaaggcgcaggaggaggatgaggaggaatggccaaggcggaagcggtcgtacacgcgaaggaagtcaaagggtaaatgatgagtcaattcaaatttgaaaaaataatatttgaacgatacggattccttggcgaatttgaaatttagaaattttaaagaaaaatttaaaaaaacttggatcccaattcaaataatctgaaaatgtactcacaaatctgaatagtcaaagaatggggctcatcgccggcacttttttttaaatttaatcatttttaaatacaaaatttcccttacttttcaagttgatcgggatgaggaggaggaaaaagatgatgaggacaaaaaggagagccaaagctgtagcaacagcattgtgccaccagcagaagaagtgctgccggtggaagtgaaagaggaggaaaagccaaacgacgaagcaatcgcaaacgacgaaattgaagtaatcatgaagggcatggaacggcacttccatcgcaaaaggggcaggccaaagaaaaaggcgttgttggcatcgccaacagcagcgactgttaatccacaacagcagcaacagcaaaagtgccaaccgcagcaacaaccccaacaacaccagcagcagcaacacgcaagtggagggccatcatcgagatacacaacggcacaccctgttactgccggtaaaggggggggggcttttccatgcattttgattgattaaagagggacacggtgcgcagtgcgtttttaactcaaactaaaaaatgacatttaaaaattctatcttcccataaaaatatgtatgaaattttgaatttatgagtggaaaaaatctatggacgggcgaatttcgcattttttgagttttggtttcgagttgttcaatgacctggcattcgttaatgaagcattgtgttgtgttgcagcatgctcctccacctttgtctgcttcatgtgcacagctgttgagaaggatttcgactcgttcggtcgtcatctccgttctcatcctgaacaatggaaacagtgcactgtttgtccacaaaacagcaacaataaaatggaggaggaccagcaacagatggaggaagaccaaaaacaacagcagcagcaggagaataagccgaaaaaacgacgcaatttcgaccaccccgtccatttcttgaaacatttgatcgaatttcacatgaattttcaacag

SEQ ID NO: 76729 - DNA, 364 bp, Heterodera glycines
  Genomic contig location: Contig_ID=SeqID_12973; Location=316..679; Strand=-
  SCN-specific regions: Sequence locations=1-364
atgtcggagtttgaaagtgaatgcagtggcactgccaaactgaaccagttgggcccggtcgaaatcagtgccgacactctgtacactacgctggttgtccatgctgttgaacaccacgatggtggtgcccaagaaatgccatcaaaaaacaaaaacaatgccaacaccgacggcaccaccattgacggagggggacaacgacgacaaattgttgatgaagaggaggagttgaaggaggaaccgatggacgtgcgacggggccaaacgcaaacaatggaagcagacgaagaaggaggacaatgttgcaacgaggctgaaaagagcggcggcaccgcttcatcccttgacaaaacatcggatggtg

SEQ ID NO: 76730 - DNA, 1391 bp, Heterodera glycines
  Genomic contig location: Contig_ID=SeqID_186; Location=153..1543; Strand=+
  SCN-specific regions: Sequence locations=1-77,100-461,483-486,508 -511,533-623,682-770,794-1158,1182-1289,1313-1354,1376-1391
  Gene Ontology: Mol. function=general RNA polymerase II transcription factor activity; Cellular component=transcription factor TFIID complex; Biological process=regulation of transcription, DNA -dependent
atgcaaaaaccgataatcgtaaatataattgctctcgctaatctcggtaccggaattaaactaaactctctgacgatcaccgaatgcgaatttaagtataaccctagaaaattcaatgcctcggttatcaaatgtataagccccatcaaagccacggcattattatgggaatccgggaaaatgatatgtctggggacgaaaagtctgatagactgtgaaaatgcgataaaaattttcatagaaataattaagggctcggggtgtccgggggcttcttacaccggacacacgattgaaaatattgtttcgacctttaaattcggacatgaaattgaactgaacgaattcagaaaaaatcgtcgtgccttttatgaaccagaaatattttgcggtttaaatttcaagcggggtaaaagcatgacagcgttaattttctggaccggtaaagtcgtaattacgggaactaaaaacaattctgaaattgaggaaatgtatcatcatattctcccctatttgaaaatggctcaaaagaatttaatgagacgataaaaatttttatttattgagacggtcccgaaattcttgcagatgacctacttttgaaaaaaattttttttcaatcctaatttattattcatttttcaattttatatttaaattgaatttaaataattaattttactgtaaaattcattaatttgctgcaattattaattaaattagcacttctacaatccattatcgattaattggcgcggcggcggcatcgtggcgcggggagggagggcgtggaggaaatgcaaaaaaaaaacacactttggcaaattttcaaaatgagttttaatttcaggatcagaaaatcatataaaaatctcaggatttgagaaaataccccaaaaggtttgggatcaaaaaaaaggaattaattttttggaatcaaaggaatgcgcatccatcccttaggatttggttcttggcggtaaatgtccacggcggctacttcaaagggctgcgcccacgggctcgtgcgggaaacacccgcaacctttaggggtcatatactacttggggctataaaagtcaaactaaaatgctttttacaccttatcccggtaaaatcagagagtgaatgacattcttttaatctgaagaaattcggagaaaaaataatggacataaaatgagaaattcaatatgattttttaagaaactgaaattaacaaattgatcatcacttttatagctgcgttttcgaattcaaaaagattttctggacctttggataaaagaaattttatttaaaaaattttttgttcacttttcattttttgtttagcaaattttaccttttctcaaaattatttaattattttttctcactttctgagaca

SEQ ID NO: 76731 - DNA, 2935 bp, Heterodera glycines
  Genomic contig location: Contig_ID=SeqID_1911; Location=670..3604; Strand=+
  SCN-specific regions: Sequence locations=1-431,453-456,499-531,578 -782,804-1068,1090-1824,1846-2070,2092-2865,2887-2935
atgtcaatttattccggtggactgttgaccgacgtgatcgctgctgatgacgggccaaatgcaactggtggccaagcgttggccaaatggttgcacattcggagaaaagatggacatcctaagcgattagcttgcagatgtgatgatgtgtctgcagcaaaagaatgggtcagcaatttcaagcaggtcgtcgcttcgggtgttatgtggtttcgtaaaaaataaatcattaaattgcttaaagcaactaaattgaatatccttggggtatccgggcccggcgatttttgggaaaatcggagttgaccgggttttgagaggctaggcccggaaaccggcattgaccggtttttaccgggttatgattagagctcgcaacaaggcacaaaaatcgcgaaaaagatttaattttttttattaaggctttttagggagcaaaacacgtaaaacttaaccaaaaaaattattttggtaatttatattatgaaatattttatagaatgtttttagaataaggaaaatgtttaaacctaaaatttttatcaagaaaaaataaaaatttttaaaattttatattcttaggggtgtatttttttcaaacgaaagttaacaaagcattaaatatcagttttaatggaaacgcaaacatttatgataagacaaatttttaaagccgtttatatttgtaatataggcaacaaaatccttgcttggcatggttttagaacatttgcggtcacagccaaaaacgacatttgcggctcaactttttcggccccaacaaaataaaaacttcagaaaattattttccatccaatttaaccggttttatgctctctaataagccgccgattcaagtcttctcgaaagaaaattcttaaccccacccaactagaagcaacgaagaggaggaaaagaatatcagcgaaacaagtcccaaaatgatgaagaaagaagtataaacattgctaggaaatctcaaatctctacagtttcaatggtcggtgcaagagttggtagactgactagcaactttcaatctctggtggggtttggacaaccccaatttttgaaaagaattactagattagttaaagttcggcgtaaattttaagaggaaaatgaattttcgataaattaacctattttgattggggtcgaaaaatttgggaagcaaatatcgtttttggaattaaaaaagtaattatttggcgttccgttgaccgcaaatgtccgatttccagcaggccgcaaatgtctggaccgcaaatgtcttatcacgcttggcattattcgttactccttaggtttctcttcatccataaaatttcaaaaaactacccaattcgaaaaaagttatggtcatacctaaaactcagatctaatttttgcaaatagtcatgattttatatagaataattctgcatggatatgagttgggcatagatttgtttgtgtttaggcatttctctgtgccacaaattgtgctcgctacacaattacattggacacgtcggcgccaattgagccatttgaattggtgaacgaacaaaccaaggagaagctgacactaaatcaagtgtgcgagaacgtatttttttttcgatggagaataaagcgacgctcaattattgggcggacggcggcagtccaacggaaagccaaaaattcgacaaacgatttgaacactgtcatcattgctttgcacggcacttatggcactaattgcattgggtaagaagcaagcggcatttgctattttttcaagtgttagtcgaattaaaatgcataaatttagtagagcacgaacaggtattcgagctggagttcggacagaaaaatcccgcgggtcgcgcattgtgtagaccgggatttaacccgggaaatcttatccgggccgggctatcccgcaaatccggggtttcaagcatccaaactcagtaatttaggtcattgtcgccaccgacagaaacgtgtcaaaacaatgaaaatggcatttgataacaatcacgtgcgccgattggttagcggagaaagaaacatgggaaatgattaatgatgatacggtcattttggattaaacatgggaattatctgggaatgattaatgatggatgatacgattattttggattactgtggatatgaaccgaagtgcttaaccaaagtctggcataagctttgtgtgttttatgcagtgttgccagatgtgatgatttatcatgattttgatgatttcaagggatcaatgatgattttatttttgagatgatgatttgctgatttgtgaatgtgatgattttcgagaaatttgatgatttatgctgcttttctctacatttatgagttcaaagcgcaaaattttcaaaatttgctaaaaatcatcaaaaatgctattttagccaatcgtcaccgccggcacccaaaattcatctaatttttgaaaattttacctataaattgccaattttcagtgaaaatctgtttaaaaatggtcaaaatttccaattttcccccggcggcgcctaaacttcgtagaaattaacaaaatttagcggccataagccaaattaggtatgctctatcaaaatataacagcacaaaattactgtttaatcagaacaaataaaaaaaattgtttttttgtgatttatgttgaatttcgaacgaaaatctgtcaaatcataaaaaatgacaaacaaaaaaataaattaaatcaaacccatcagtggttcaaaatgatcagtcatttctcaaatagctaattcacttcttttccggagacaaatgggtccatcattcattcagacgatcttttcaatgaagggaattttggaaaattcaaaaaaaaagcatagaaatcttgaatttaatatttttattttagctcagtagtttgaaaaaagcaaaagcctgggttccatgttggacctag

SEQ ID NO: 76732 - DNA, 507 bp, Heterodera glycines
  Genomic contig location: Contig_ID=SeqID_1911; Location=6602..7108; Strand=+
  SCN-specific regions: Sequence locations=1-507
tttggcaccaattaccaccgtttttccatgtgaacgaatttcatttccttttagaaaaggagttaccaggggtaaaatgtaattttcacccatccaccattcttgtggacttgtgattttggccaaattaaggtaaaggagttggttaagcataattcgacctggactgatttcggttaattgccgggcatagatggtttgagggcgaagcatttgcgcagaaatgacggtggctgatctgaaatccccacctctgtatcgttttaagttggttacaaaaccgggttgaaatgaaccaatgaccaattttatcacctccacctctatggcaacagcttgaacgttgatcctgccttgtactaaccacgagcgcaacgaatcgaccgggtttaagtcataggacaatctttcaaatccctccttccactcaaacttactgaccacaactgtgtctcccatttgaaggcgtctctcggcacttaccaaagtatcaggaattcccatgaa

SEQ ID NO: 76733 - DNA, 1668 bp, Heterodera glycines
  Genomic contig location: Contig_ID=SeqID_1911; Location=7880..9547; Strand=-
  SCN-specific regions: Sequence locations=1-375,397-424,447-504,526 -913,935-1114,1136-1297,1319-1558,1580-1668
tctgtcagagcacaggaaaatattacggtcaaagaagtactggacttagatgaacttgaggacattgctgagtttccaatttgtttaagcctatcaattgaccagcggttagtttttgatccattcgttaatacattaattcttagaggcaaagatggtaattcgtacaatattgatttaaagaaagagcaaagggccgaccctcaaatctctcaatttattaattttttacaaactggcaaattttcgaatgaaatagaccaacagaccatggaatctcttactgatcaagccaaaaacctcgttattgactcaggaattttgtattttaggtaccaggatcagtcaccacgaatttatataccaatctcattaagatctcttatttttgactcatttcactcttctcctcttggtggagggcacatggatttaaaaaagacattgaagaaatgtcgaaaatattattggcctttcctatattctgatattttaacatggtacaaacaatgtattacttgtcagctaagacattcaccgacgcctgcattcagggcagaaatgcaaatggtccccgccaatactttatttgccagagttggtttagatctagccggtccttttcctattactgaacgtggcaataaatacattttaaacatcatttgttggttctgtaaatatgtaatatccgttcccttacccgatgccaaatcgcatacaattgccaaagcttttcttagtaattgttatcttaagtttggtggttgcaccgaattagtgagtgacgatgcgacagcatttacttctgagttctttcgtgaattttgctcgttattatatattaataagaaatatgcagttccacattggtcgcaaggaaatgcggccacagagcgaacttttagaacatttaacaatattttgtcaaaatatgtcactaaagagcaaccagattttgatgaatttttagactatgccaatttttgttataatacatctgttcattccacgactcacgaaaccccatattttttaatgtttgggcgtgatccgattttctgtattgatcaaataatagatcctaggattagagaaccaattgcatttactgatgagacagaatttaaacagaaattagtaacctctcttcggagagcatggaagataaccgcagaattacatgctgaggcacaggagaaaatgaaaattcaatacgataagactatgagaactcctaatttaaagattggagacagggttttattaagaaattatgatggtaaacgtaatacatccaaaaaatttcattttccatggaagggtgcctttagaattatagaaattgagggaatatatgccacaatcactagctgtaattcgcctcaagcaaatccacggcgtgtccatataaatcagcttaagaagtgttatgaaaatttagggcccgcctgcacttcacctaggcttagtgcagaagagagaaatgctctcgcagagttagaagcggatgaaattcacaatttgccgggtcactcacatcctactgatataccaaaacattcttcttctcttgatcgtgaatctgatgatgaaatacccgctaatgagcccaatattgataataatgaggttgaaacatcactaacaccgccaaaatatggtcta

SEQ ID NO: 76734 - DNA, 3539 bp, Heterodera glycines
  Genomic contig location: Contig_ID=SeqID_1911; Location=4154..7692; Strand=-
  SCN-specific regions: Sequence locations=1-183,205-577,599-1577,1599 -1641,1665-2022,2044-2102,2124-3019,3042-3181,3203-3539
caacattcgtgctaatccaagcaattctaattctaatggtcaaaaaacgttcagcccatcgtcggaacgaaaacatggccgcctcgaacgcagctgttggtggtaaggaagtggcgtcagccacaccgattattgagtctttggaagtggcgtcagccacagagcaaattgaattgattgagacggagactattccgcaaaatttggagtcatttgaagtagcgtcagctacacagaaaggattgataatggaaacggcgtttgccgtcgagaaagtaattgaaaccgataagactcgtggtatttccgcaggtcttgaagaagaatttgaacgaggcatggaattgggagaaggtcagtacgtggaaagaaacacagaaaatattgaaatggaaactattcaagacttcactgcgactcaattctccaatgtctcgtggtcagagccatgtgccatcgcttcgcctgtgccaatgtctccaaatgaagaacatggcacggaaggcggtgttctgaaatatttggtgtgtcaaaccgacgtgaaaagtgtcgttggtgggaaattgagtggacaaggtccatttttcatgggaattcctgatactttggtaagtgccgagagacgccttcaaatgggagacacagttgtggtcagtaagtttgagtggaaggagggatttgaaagattgtcctatgacttaaacccggtcgattcgttgcgctcgtggttagtacaaggcaggatcaacgttcaagctgttgccatagaggtggaggtgataaaattggtcattggttcatttcaacccggttttgtaaccaacttaaaacgatacagaggtggggatttcagatcagccaccgtcatttctgcgcaaatgcttcgccctcaaaccatctatgcccggcaattaaccgaaatcagtccaggtcgaattatgcttaaccaactcctttaccttaatttggccaaaatcacaagtccacaagaatggtggatgggtgaaaattacattttacccctggtaactccttttctaaaaggaaatgaaattcgttcacatggaaaaacggtggtaattggtgccaaagaaagtctggactctttctgttttccctttaaccagttttcagtgcgattgatgggagctgcggccgctgtccaacgttcattcgaaatggagaaattggcgaagcaaactgtcaatgtccaactcgtctggcagagaccagaagtacgaccggatgaagcgcaaacgaatttgaaaaaggcacaacgcgtctctttcgaatggttgatcaacaacaaatcggcggttgccgatttccttgaggcatgggaggaggacacgccggtcgaagcaaaagttgcgcgtgactcaaaagcccaatgctgtgcagttggccgagtaattgaactgtcagtaaatgaaaccgctccgggtaactttctgatgaacgtgaaaatgtttttgagttacagggctaaaaagggctacgacaggggatgggaagattgggaatccattctcgatgaaagggaatctaatgtgattccaattcctaattacggaggtctccctttcagagaacaggcatttgaactttcagtcccgtcggatattgcagaagggcaatatcccgtctcaaaaattttaaaaatattgatgggaatgggcaaagacggagcggaacaacgaccaaccgttaggttgtcaagtaacgaaattgcggtcggtaagttgaacgaggaccagcgaatcactcacggattgtttttggacgacgagtcccgtgtaattttcatgcaggctccggcaggaacgggaaaaagtgtgtcagtagcggcctgcatcgcaagcgtgctcaaaaaggaccgtgacgctgcaattttggcagtttctcctttgaatgtcgcagtgtgtgagttggtgaaggacaccatggaaagtttgtcagaaaaggtggcaatgttggcacttttctctgggcaaggaaaagggcgttacatggacaggatcaggcccctgggggacaatcttttagttgaagctgtgcaaagggatggaaatgttccctccgctgaaggaaccgagccgaaaaaatggagtgataataaaacatttaagcaatacgtcgatgactttaacacagcaccaagacgggcacgcgaacgaacgacgactgccgcgcttctgaaacagaccaaataccgagtgtacttcatgacattggctcttgctgaggagttggcattggatttgggcaacgtaactaaacagcagttacgggtacacttaccgagtcaaatgacagttattcgtggtaagtttgggtttgagtcaattttggaagtgctggaaacagcaaaaggcatcgatcgcaccgttctctcaaagtgttaccgatcgcacagtgccattgtacggtgtttggacgcgggagtttactctccagcaggtgatcggttggtaccaggaagaccggatgttgaaatgtcatcgtttttaaattatatgggcccacgcattgtagccgaaaattgtccgatcattttaatccatcaaaaatcatcgactcaaatggaaagtatctcattttcctctcacaatccagagcaacgggaaacagctcttggatttttgggaataatccagggaacctttccaggcttaattcaagttgtgtgtttttaccaagcagagaggaaacacatggtaagtgaaatcgaacggagaaggtggccaaatgtcaaggtgagtacagtcgattcgattcaaagtcaggaagccgagcttgtccttgtcatcacgactcgctccgcggctggacgatcatcggaagctgacactggcaaggaattctgggcggattgcgcgagaacaaccgtggctctctcccgtcccaaatttggattggtcatcatcggagatttgtcgttgatttggcacaaagggaccgtgtggagacgtttcattgacgaaacattaaaaatgacggttgcggtaaccccggagtatttaaaccttatttccaatccgtttccgtcccgggtgggaaaatttattgcaaaaagggatggcacagttccgatggcatttgaattttatgccgaaagggacagtactttaagacacgatagtttggcgtatcagccaccaataaataatttcgtaaataatttttccccttccccatttttcacaggcggtttcaggccattcgcagctcaggcaaatgtgtttccaccgatcagttcgggtcatgctcaaccgccggctttctcacacggaatgatgatcattgacacctctgtgcgccctcctccaatcaacatgatcgctggtcacacaatgccaatgccttcaaattgccctggtccaagtacgcgaatggcgccgtatccgccacaatatttgccgtcatacgccgaagccgcccaacaagccccgtcaaactcgaacagcaaccgaagaatcgatgtgaagtgctatagatgcggaaaaatcggacacttttcaaaacgatgtcgcacctga

SEQ ID NO: 76735 - DNA, 890 bp, Heterodera glycines
  Genomic contig location: Contig_ID=SeqID_12974; Location=651..1540; Strand=+
  SCN-specific regions: Sequence locations=1-109,146-147,169-172,201 -335,357-461,495-574,619-850,888-890
atggtaaatttctcaaaaaatcatccctcaaattttttttcttaacaaaattatgtcactattcgtcattattttggacttttcgccattattttggcatttttttagcatttttattatttgtttttttttttttgaaaaaaatggtttgataaataaaaattccatttatccccccccccccgggtggggggggggggtaaatgcggacggggggattattttctaacccctcagaaaggggggataattggggacggcgggattaatggagacgggggggggataaaaagagaaaatacggtatgtagaatttttgattttatgactatgcattcatttaaatcaatatattttccacaaaaaaaaattccaaaatttaaataaacaattctttatttatactcaacaaaacattaacgaacagcatttaataacccgaaataaaaaaatgattatccaaaaaataaataaataaattattcatttaatatgtaattcattcaaccaaaagatttgtctattatgtaaaaaaattttaaactattcttttgtttaggaagctgcaatggagtaataaataaatttatttaccaaaactatttttaaatttaaattcaaactaattttaagggctttcccgaacacgagactcagcaggcggttgggccttcacccgtttctcgtcttagcggtggtggtggcacaccaatagcgactggcgaattgcgccaacgacaaattggcagtgccgaactgcagcagccaacaacggcacccgctattctcggattgaacacgaatgtgtaaaagaggaaaagaaattgaagaatgccattattatcgcatgtttattaaaattaatttttcattttatttatatttttgta

SEQ ID NO: 76736 - DNA, 1396 bp, Heterodera glycines
  Genomic contig location: Contig_ID=SeqID_12974; Location=2832..4227; Strand=-
  SCN-specific regions: Sequence locations=1-195,217-347,369-480,502 -514,691-709,850-985,1035-1106,1131-1396
atgctttttcacccatcccgccaaagtattgcaccgatttttgtaaaagttacacgctctgtcaccagccgagttggtacagctgctggaagaaccgccacctgacgatgacttggtcgtagttgacgaggtacttgttgaagtcgacgtcgacgttgaggttgtagttgaagtgctgctgtccgatgacgtgcatgcattgcacattttggcacaattctttttcagccatgccgaaaattggccgcatctatttttgtaagcattgcaagctctgtccccagccgcgttggtacagctggtggacgctccagaaccactatcgccagacgatggtttggtcgtggttgatgatgaactgctggttgatgtacttgctgaagaagttgtactcggagtagttgatgtactggtagatgaagttgtactggatgtagacgatgtactggttgacgaagtcgtactcgatgtagttgaagtactagtcgacgaagttgtagtgggtgtggttgatgtactggttgaagaagtagtagtgggagtggtcgatgtactggttgatgaagtagtagtgggagtggtcgatgtactggttgaagaagtagtagtgggcgtggtcgatgtactagttgaagaagttgtagtgggtgtggttgaagtactggttgaagaagttgtagtgggagtggtcgatgtactggttgaagaagttgttgtcggggtagttgatgtactagtcgacgaagttgtagttggcgtagttgatgtagatgtgctggttgaagaagttgttgtgctcggtgtagttgatgtactggttgaagatgttgtagttggtgtggtcgatgtactggttgaactagttgtgctcgtacttgtactactagtcgatgttgtggttgtttcttcctgtccaaaaaccgcaacatcattcgatgcgctcaacagcaaaagaaggcacaccgtttgataaaacataattaggaattaaatattaatgattagaaaataattttaaaaattaaaaaaattttgaatgaatttgttggcgagttttgccattaaataatgcactaattttcggatagagaccgataattatgcactttatctaattaaaatttgttcacctttttgcagtttaaatccacgttcattcaaatggtggagaagagtttccgccgaatttcaattaagtcattgttaagctgtgctaacaaatgttaaaaaagttgaccaatttttttggtgcttaatttttttcaatgaaaattgaatttcataagagcaattgattatatatgagttataaaatttgactaggcgaaaaaagttaattacattttctcgaattgatgaatcgccaaatttttttctttcaaggattcttaataaa

SEQ ID NO: 76737 - DNA, 3239 bp, Heterodera glycines
  misc_feature (210)..(210): n is a, c, g, or t
  Genomic contig location: Contig_ID=SeqID_12976; Location=201..3439; Strand=-
  SCN-specific regions: Sequence locations=1-149,171-330,361-660,682 -947,970-1100,1122-1177,1201-2090,2112-2371,2396-2892,2914-3011,3033 -3239
  Gene Ontology: Mol. function=small GTPase regulatory/interacting protein activity; Cellular component=actin cytoskeleton; Biological process=response to pathogenic bacteria
atggcatattcgcccgtcgttgacactcatccgtttgtgccttctcctccgcaacgctttttgggcgcgtcgttgggtggcggagttcaaccgccttccaagccatcaattgggcaccaatcccaagtcaagaacagtcgcgggaagccaccgccgccgccaactccaccgacggtcattaatcagcaaaaagaagtattttaacaattngggtggatggccgatttgaattttcccataatcagcaaagtccaccggtgccaaccgcggcgagttcggtagcatctccgcagcaaagacagtcggtgctaacagcggtgagttcggtggcgtctcctcctcctccaccacctcctccgcccccaccgccactgttccaatcaaagccaactctgccggacaattcatggccttccaccagcactgaatcaaaggcgtctttcgtcgatccgactaacaataaacgttccgaccttctgcaacaaatccaacaaggcaccaagctgaagaaagtgggcccaccatcaactgaacgaacgcccgtgccaacaaacgcaccgactttacgggacaacatgatggaacagattaagcaagggactaccctcaaacatgtgagtttgaaaatgttccctcataattgtatcaatttcttagtaccaaatggaatttacagatcgaccagtctgatgtggaaaacagtcgttgttctgctggaggcagtgcccaagaaattggtgtgctcacaggcgcattagccaaagcgttggaggaacaaagcaggcacgcaatgtactcgattgaaaattcggcattggcttcaccaacttcctccacttcgatgtcttcaacaactttctcgacttcggctcgttcacctgtgaagcttcaatttaagtcgttagacaaagcattgcctacaaatccgtgggaatcgggtaaatgatagaagaaatttggaaattaaaattttaactttatttgggacttgctttgtattactaacatagtcatatttattcagaattggatgctttcctcgagctttgtggtcagtccgctgttttctcgtggaacgaattcgaagactcgacatggtaattttttgtttccaacttttgttcgaatatgcatttttttagttctttcgacaaatggtcaaaaattggcgagggggcatttggagaagtctttaaaggacttctggaaaatgcattcatcgcattgaaggtttttttgttctttttttttgcactatttcaaatattttctaaggttattccattcgctgtcaacgaggagcagtgttcgaagctcgtcaatggagactacctgaaaccagcaaaattcatcttcaacgaactgttcatcaccaacgagcttacaaagctatccgaggacaccggcagtggctttgtcacgccatcattcacacaattgcgcatgagcaaaatcgtcagaggtatttttaatggagaggcacttaaaatttgttggctaatttgggtttgtggaatgttaatgttcacaatcaaaatgctctgattgtgaatgcaaaaacttctttccgtttaggatgtttcccgtgcaaattgctgaaggcctgggatgccttcaagaaggcaaagcccgaattgtcggagaacgaacggccagacatttatgccgatgaaggtctccatttcgttgtcattggcctttcctatgggggaaaagacctggaggcgtatgcggttagctttcaaaaaaaattgaaatgaaaagtttttttcgcagataaaaaatggccgcgaatgttactccatcttccatcaaatcgccttgtccctggcgatcgcggaagacgttctcgagttcgagcaccgggatctgcacgccgggaacattctcgtggagcagtgcccggccaacgaaaaaattcggtaagcagcacaagcaatacactgggaactaatattattgttaaagatacatgtaccgaggagaacgaatcgatgtcgtctcgaatggggtgcgcgcatcaataatagacttttctatttcgcgtatgaaaaaaagtaaactcttaaatttttctcaaagcgctttaattttttcattaatttgttttcccaaaaccagagggtgttctgttcttcgttgatctcagccaagacacgggccttttcgagcaaaatggtgtcagcaatggtggcgactaccaatacgacgtctacaggatgatgaaggcggcggtcaggtggagagaaacgaattttttttacataaagaatatttttagcgaagattgggcctcattctggccccaaacaaatatgtactggatgggttacgcggcaaagaagctctttaacaaccgcttcatcagggcgaagagaaaagaagcgattgaaaaactcttttcaaactttgaaaacaattttgaaacgattcatgattttattgtccatcctaattttttgtctgtatttactgaattcacttccgagtaaaatttttattactgctattttatttttgtcgtagttaaatattcatttgattgctatatattttttcaatttatattttttgcttttatggaccgcttttagacaaatattggttcaggaatgccaaagaacaaaaaatccgggagcaaatctcagaatacgggttattgttcagttgccataggctaaaccttgtcatgttgttgctctttcagctggcgatgctgatgacatcgacgcgatccttaaagactttgagttggagacgaacgaagctaacaaaaaggcggccaagaaaaggggaaagggtcggaatttagtcatttttttaaagtattgagttttatatttaggaggtgcaagtggtcaaagcacggaaaaacatgctgaaaatgaggccgatggtgcggtggaaaaagccgaagaggcccaggattggacggcggcgattaatgcactcaaaccgattgaccagcaatttacggaccacaagtacccccaaggacaggtataattttctgaaaaggaaaaatgccaaaaccgtacgctcagatttgcgagtatcgaagtgacaaagacgacagaacggcgatcaatcggatgaccagcgaagagaaaaaggctttggacagcagttacgaagagatttacaacgattttcgacgtgctgcagaatcgcacagacaaacgcgaaagtacgtgaagtcatggattaagcccgggatgaagctgatcgacatttggtag

SEQ ID NO: 76738 - DNA, 702 bp, Heterodera glycines
  misc_feature (681)..(681): n is a, c, g, or t
  Genomic contig location: Contig_ID=SeqID_12977; Location=19..720; Strand=-
  SCN-specific regions: Sequence locations=1-25,47-191,235-257,280 -409,462-702
atggcattggcacattttgttttgattgatgattgtgatggtggtggtgggtgtcgaattctcatgtgatcagagatgatcatgctagtggaattctagagaaaaataaattttttctacgtaaaaatatttgtttttaatgaattttttctacgaaaaatattttttttaaggtgtggaacatgaggtggaacatgagttttgaaaatttgataaaattttaaaatttaaccgtcgcttcttctaaataactaggagacaaattttttaaaatttaggccgtacaatgcccgaccacgtggactggaaaagtgttaagccaacgcacagctccgtttcatttttctacattttattcaaattgtttaatcttggctctgcgcttgttcaactgtgcctgtacatattcaatttttttttaattaataatttgaattttttttttcaaaaattcaaaatttcagcattaattacttcatggtgcccgccaattacacctattggggctttgatgtgctggccgatttggttgccggtcgagactggtcaagatccaggctgttccccagggtcagattccattcatgcgcacacgagccaattagcgtaatttaaattgataaatttttccaggtgacattttgcgacttcaaaattcgtcaaccagcccaacaccttccngcacatcgctttcaccctcca

SEQ ID NO: 76739 - DNA, 2647 bp, Heterodera glycines
  Genomic contig location: Contig_ID=SeqID_12980; Location=400..3046; Strand=+
  SCN-specific regions: Sequence locations=1-95,117-243,265-2200,2222 -2245,2277-2452,2475-2484,2506-2647
atgtcactttatctgctcgcccaattgtcgtacggaatcactttggtgttccaagcgcatgtcaactatttaatcagtcagtctggctttagcatttattaaaaaaggttaaaattttcagccgaccttgaatcagccatcaaatcatttgctcggtttccggaggaaaacaagcgagaaaaaactccgcgcaagtccacgggccgtaagcgtagacttgccgaacttgacggagtggtggaagcagtgatggcagtgccacggggcatggagcaggaggatatggaagaagaggacgacgaaggggcgaaacgccgacgcatttctgcgccacggaaggcatcaaaattggacttggcagatccggtcggtggaaggcaatttgttaacaatgcacttttaattcgttctccattttttagagtgcttatgtggaccagcaacttcctgctgctcgcgatgtgaacgaccagtcgatgctgatggatgagagcagccgcttggacgacatgttcatggaccagacggttcagccggcattgcccccgcccgattgggtagctgagccgaacgattcgctgccgtttggcgagtcggcggagggagttcgtcgtagcagtcagcagaaggtgtcgatgatgagcattttgatgggcgaggacactctgatggaggaagtgggcaagacagtcaccgtggcacccaatttaagcgcgttgcaaccgcctgttgaggttggcatttaccgactgcatttgaaaggcaatttcactccccgaactttgccatcgctttgctgttggcctaaattgcaaggcttattaatttaggttaataattgaattcttcaggatctcgaattggaattgcccatggaaatgacgcgtgatccgatctacaaaaaacggtccaccgatgaacagcagtccatcgatgtcgttgccgattctgacgatgtgcgtttgctttccatgccgaatccattccaactttgccgtttcagcgcctccaattggatgctctgcctgacattgaccaccagccaaagagtgcccatccgaagaaaaggaagcgccttttggtggacgaacagctccaattaggaaatgtgagatgagagggagcggcagaaaatgaagtgaaaatgcgcaatgcgtttcagcaagaaatgatcgaccgttttaacaattacggcgatttgttgcgcacccgtgacgacttgcacagggaaatcattcagcccgacaagcccaccctttcgcaactgctcgacccgcgtccctatcacatcaaaggtgtggctgtacttttactaaaatcaaaattcacattcatttagcattgaatcccgaacttttccctctgtttgacactgtccgcgctgaacaccgcgaacgaccgctgacctttgacgaagcgcaggccatgacattcgaagttggtccttttttgagttcatctccctcttcgtctgtcttagtctttcccacttgttaaaggatatgcaaaaacgtcgtttggaattcgatcttcagtcgtggcattccaacgacgaaccgacgccgctgcggcaacgcgtggaagagagttttggggacgcaggcggagagcagagacgcgaagaaacgcaagggaaagagaaagtgtcggtgagcgatgcattggtcgaaacggcggacaaagaaaaagagggggtaagtgagcaaaagcaaagaagaatggaccatcgaattgaccgtttttgaaactgcctaattccattgaacttctacagaccgcagaattggcagcacatcgtccgtcgtctgtgctggaaggggaggcaatgcgccgtgacacgacgggggaagggaaccgacgaatcaccggtcaaacgattagacttaatgcccaatttactaattggataccattttttagattattcatttggacagcttgggaatgagtttattatggccgatttggaccgaactcagccgcctccgatggacgaaatagtggcggacacggaacttatgcaggagtcggtggtgacgaaggaacactcttcgatgggaccattggacgaacagtcggtggacgacaacaccagagatttgtacaggtgggagagaatgctgtcaacgaaattgaaaacaacccccccccctcccaaaatattccactgacaatgaatcaaccaattcaattcacaaccatattttaacccaggatttcttctttaaatccttataagttagagaaaataatttaaaatttcttattaaaaaaatcagaaaaaacgtggttgtaatcccgacgatgcttcgttaagccgtctcaaccgtggtggtgttgcgtcgtttgaagagctgctcaaaagcgaatcatttggagagactaagagacttccgattactcgtgcggttgtcgcccggaaattcttcgcacttttgagtgagtgtcttcatttgaggatatatattagttttatgatccgaattaaaaaatactaattgaaatttaattttgcatgttttcagatttgctcaaacatcgcatggtcaaagtgcgtcagcgtaaaccttacggagaaattctgatccgagcgcgcaatttggagaacgacggagaacagccgagttttaccgagcatttgcagtga

SEQ ID NO: 76740 - DNA, 642 bp, Heterodera glycines
  Genomic contig location: Contig_ID=SeqID_12980; Location=3569..4210; Strand=-
  SCN-specific regions: Sequence locations=1-543,565-605,628-642
atgccgaaaattatttctgacttttttctacaacaggctttgttcgtcgccgctttttcggttgcttcggcagaacaaacagtcactccggggcggcacgacgactcgctgggccacagatgcaattattcggggcccggccactgtccctcgggtgacccaaagggacaaaatgccaaattattttgccttttccgatcaccatcccctgaccaatcatcagtcattgctcttccattttcccagggttcgcctgtgtcaacaccaaatgcgttcgtcgctgcttcttcagtggcaattgccccgagggcttcttctgcaaaagcaatttcatttgcgtgcgaaaggaatgcgccgcgggggacaccgaatgttgcgcgaattgtgccgaggcaatgccaagcgaacagagaagaagcggtgaatgatgcccttgtgtttcagatatgcatcgatcactcggagtgtccctccgatgggtggggctgtgtgctgctcaaatgccgaagagtcggtcagtgtgccaactttctatggcttttggtcaacggttgttttgatgctccccccccccttcggcttcagaatgccgtgcccgccccgattgtccctccaattggccatgtctggtccggtttctaa

SEQ ID NO: 76741 - DNA, 495 bp, Heterodera glycines
  Genomic contig location: Contig_ID=SeqID_12980; Location=5508..6002; Strand=-
  SCN-specific regions: Sequence locations=1-224,246-303,325-336,360-495
atgtattattatgactccatcggctcattcgtttcctttcttttcagaatcgcccatttgttcacttatggcgccagtgagtcgcgctgcgtttcccacccaatttttgtgctccttcccccccccttttcagaatattattcctatttggtcgctcgggcgggcgcttctctgatttatgagcgacttttcgccgacgatcccctttcgggacgcaatggtctcaaatgggcaaaggttggtgccgacagaggaaaatgccaaaaataatagtgaatgacattggcaaaattttaattgaagtttcacggtgtaaaatatgtcgttaatgcgttttctttccccaatgattttcaggtgcaatcccacggcggtgagcacccgtccgatgtgctgatggccatggcattggactcgccggaagggaaggcgccgaccgccgccgaattggtcgccgcattggacaggcactcgtcggcggagaatgccatgtga

SEQ ID NO: 76742 - DNA, 736 bp, Heterodera glycines
  Genomic contig location: Contig_ID=SeqID_12980; Location=4580..5315; Strand=-
  SCN-specific regions: Sequence locations=1-646,678-736
atgcgtttctccgctcctcgtcaagtgctcaaatatttctataaacggacaaacgcattttgggacaaatcgatgctccacaaggagcgagtcgcatatggaaagctccggctgaagctgtacggcgcgttggtgctttccatgtggtatatgtagtaagtgccggtgaatgttttttgggcggattcgctatgaagccgattcgccacttaattgtgacagaattatgcaattccaattttgctgcctttttgtggtacccctggggccagttttggtgccccaatttccacttttctccgctatttttctgtcagtgaattcgccactcctccgcccgacgtgcgctttgacatacggtggttcttcagcagctcatttgccaattatgtgcagacaaagggtgccggtggcttggacattgcggatgagtgagtgaaaatgacaagttaccgtaggaaatggcatggccaacaaaggcacgggcttactgtaccgaacaaaacactaaaatttaatcccctttcaggaccatgtacaaacagttctcattttcgaagggcagattgttggagaatgcgctcgaaacgccggagggacaagcgatgggattgtccgaaaggtttcactcatgagagggacaagcaacgaagaagaagaggaggaggaggaaaagcgacgatcacagaagaatggcactttaaaagcaaaccgagaacagtcacacattctatag

SEQ ID NO: 76743 - DNA, 1096 bp, Heterodera glycines
  Genomic contig location: Contig_ID=SeqID_12981; Location=439..1534; Strand=-
  SCN-specific regions: Sequence locations=1-351,388-596,632-1096
atgagctccaacaatgcgttgactgaaatgatgcggcgtgagaagaaaaagttgctgggaaacgtcgacgtgcaggacccactggcctttgtcattccagcaacgttacgcgaaaaacgtggcgaagacatcgtcttgtatgacagtcgaaatgttaggcatggcgaaattctttgtgactttgaaaaagccgaaatggcggccgtccgcgcggttttccccacggcactgattaagtgctgcatgttccactacgggcaaagcctgtacaggaacttcaaacgacttggtctcgtgcatttgtacggcgagaagacagaatatggtgaggcagttcgcaacacattcaggtaaaaaattaaatttagatttaaatcataattttttccagaagggttctctctttgccgcttttgcctcccgacattatcagaagagctttctcaattaggcgtcttctcctcctggaatgccagtgttcttcctttacttctctcgaacaaacatcggcttgacacagcgccagttgttggatggtgttaacgcatttggagataatccactcaatttttcacccattggcaatcattgtttgtttaaatttatgcattttatttccaaaaatttaatttttagctgcactcgggacaacaatttcgaccatcaattcggaacacagctatgcggctacaccaatacagttcggcatcggctcaccggcaccatcaactcttacgtggccaaccactgtgagtccacgggagcagcttgttcaatattcgttgagcccgctaccgactttgacagctccttcaggcagaatctttaatcaatcatccgtttaaatttaataaaaaattcagttccagcgtgggaggacgaaatcgttcgtgcgccacattttccaattccgctttggaacatgcactcacaggcaacatctgccatcgctcgtacaaacaacggactggaggcaactcatcttcattttatggtctttaagctgaccttcccctcttctccgtatatgataagaaatttatgttcatttttaattcaacttataaattcgaatccttattttcaaatgttatga

SEQ ID NO: 76744 - DNA, 244 bp, Heterodera glycines
  Genomic contig location: Contig_ID=SeqID_12982; Location=164..407; Strand=-
  SCN-specific regions: Sequence locations=1-244
atggaaaatcgcaacttccagtgcccctctaaattttccattgattatattctgtccattcctgctaaaaagccacgtcatggtgttcaagctggagcaggaccatcatcggctaaacccgcgaaggattacgtcaaaaaattggaaaacagtttggaacatgtgccacgcttccaatacgtcaaggccaaatcgaagttcagcatcgaggacgtcccagcgaatcccgaaggattgcttgccg

SEQ ID NO: 76745 - DNA, 829 bp, Heterodera glycines
  Genomic contig location: Contig_ID=SeqID_12982; Location=1084..1912; Strand=+
  SCN-specific regions: Sequence locations=1-224,266-476,509-829
atgcccaaaatgaacaagcggttgccacatgagcttatttgggaaattgtcgctgcaattccgataatgtaccttttcggaggagtttcaaagaagccaggtaatttttcaaaagtattattaaacaatgtaaaattaaaggagctacgcgtccgccatccggcatcaccgttgtcaaccgggcgttcgagatttttcgtgccaagcggcatttttacttcttaaaaatagttggtaatatttaaaataacaataaatctgaatttttagatcgatcttgctcaaaatttcgagaggctctgtgcactgaggaagttaccgtgcggagaattgttcatccaatttggattcatacaatttggtttcgaaaatgaactggaggacgccaagtgtttcgccgactttttggtgtatctatattatggacgatctggccctaccgttacgacgagagtcgtgacttactcgacggtaagaaaaaatataataataatattaatattatttagccgattaaaattggagagctattcggcgcaattctgacgcatgtattgggaagcgcgaatccgctgaccatgaagaagcggactgcaggcggttacctgttgcgccaacattttccgcggcttctccatctctcggcaacagaaatggcatcagatggcattggtcaactggtccgctccgatgggatggaaatgtaccggctgatgaatctgcaccacaaaggagatgttggttatttgattattattgcaacatctcaacaccccggctcgtactattttaatttttcaatcgaataagtgttttttttttgtaatga

SEQ ID NO: 76746 - DNA, 1688 bp, Heterodera glycines
  Genomic contig location: Contig_ID=SeqID_12983; Location=166..1853; Strand=-
  SCN-specific regions: Sequence locations=1-28,52-372,394-468,490 -619,641-653,685-838,860-925,947-956,1016-1061,1083-1092,1114 -1250,1273-1385,1408-1489,1521-1529,1551-1688
atggcgttggaaattgagcggagacggaacagagaaatgaccactggcgcaacacaaactgatcacctcgtcggctcaacggtgttgtgagatttgcttatgacatgcacctgttgtggtgattgaatttggcccactgcttctgctcattcaatttcaaccaatgccgaaccccggaattttttatttttcccttgaaaaatgtttttaaaaattctcaaaatttgaaattttcagaaaaaaatgccatttcgacagggaatgatgctcgaatgccgaggggttcattcaattcccctgcccgtttgtctaaaaaaaattcaagaaaatatatttgaaaactgctagattctccccgtattgtttcccccgaattttttaaataaaatttcaagaaaacaattttcaggtgattttttaaggaaaatttttgaaaaaaaatggttggaaattccaagaaaaaaaatttttcttggaattttctttgaaaacctatggagtactgataagcggggggggggggatgggagaaaccagtgcacttgtttgtcacttcctgttggatttaccaaataatttaggaataattgtccgccccccctccccctcccatttttctaagaaattttaagaaaacattttagaaatcttccaaaattttttataaattttattaaaattattgccccgcaattttgcacatttaaccagcagcgcaatgagtcggatgaagccgaattggacgcgcaactgaagcgggcggcgcttgcacacgccgaacatttggagcgagtgatcaggacacagaagcaaatccacgacatggagactcagcagattgtgcaggtggtggtggtgaaggagtagtgcgaaaaagtgttgcaaattttggtctcaaaaattttcggaaaaagtgccaaaatttttgtgcaacatttttctaatatgcgctatggaaataaattttaaaatattttttcaattcctcaaaaatttatttaaaaaaaaaaaattagtgaacatgtgcgcgtggttttggcgagtatgaaaaaattttcaagaaaaaatgtgcatgttttttgaaaatttcgcacaattttcctaacaattttctttaaatttttcaaaaaatttccgccgcttcgcttatcaacaccgtcagaacccttcaaaatctggcacccaaatagcaaaaattttataatttgtggcgaaaaacgaccaaaaattctgttgtttttttctcctcgacactgaaaatttctgaaaaataatacgggagaaaaaatttttgtccgatgattaaaaaaaaatattttcgggttcttcccaccaatattttttttttggttacgggcctgccatggtaatagaaaatcaatcgatgaaaaatgaaaatttaattttcttcgttcgtttgattatgggcttttttttaccaatttattttttctagtgactaattacaattggaaatgaatgcaaatcgtataaaataattattttagatttttttatatggattttgtcaaacatttttataccaatttgaatttcacatttctttttttccgttcaatttacaggagacaattgccattgagcgggacaaatttggcaaacaaattgataatggactcgtaaagttggcggccattgaagaaatgctgaaaagtcgcgcaacaaaa

SEQ ID NO: 76747 - DNA, 530 bp, Heterodera glycines
  Genomic contig location: Contig_ID=SeqID_12984; Location=667..1196; Strand=-
  SCN-specific regions: Sequence locations=1-269,291-374,396-468,490-530
atgagtgctcactcacatgttaaggagcgcctctttcccgcggctacccagccggcacccgccattgtacagccggctgccgccgccgttgtccctccggcatccgttgttgttctaccggctgccgccgaagccccaccggcagacgtggagattgagctggacattgacggcgaacaattgacaaacttcccggcacaacaacacccgcaacaattgttcccggcacaacaacaacaaccgcagcaattgttcccggcacaacatcaacaacaactgctgctgccacctcggccgatgatttcgcagattgtcgacaatgccgttagtgtgctccaaatgcattttcacaacatgtctcctctgcggcccgcttttccaccatttttcatcaactcgccgtttcctcggcttcagggcgccttggaactcccttctcttcaattcggtcagcagcacgcatttgcgccccctccggcaccggcactccaaattgtcccgttcgatgatgccccgacgcctcaaccgtt

SEQ ID NO: 76748 - DNA, 1128 bp, Heterodera glycines
  Genomic contig location: Contig_ID=SeqID_12985; Location=828..1955; Strand=-
  SCN-specific regions: Sequence locations=1-212,238-753,779-1128
atggtcgaagttcgtcgtcaccgcaaacgctcgcccaacggcaaaacgaagcgaatgccgaaacaggaaagtgccaacaacaccaggacggcaccgcggcatcatcgtcctcaacttcctcctccaattttgccacctcctccgccaaccagcagcagagacaatcaccggcggacgcggcgctaagtgaggaaaattcgaatttggggagggaaaattggcaaaaagtgccaaaaaggaaggaatactgtaacaaagaaaattgctgatcggataatttttcagctgagaaaaggcgaaaagtgagcgaccaagggcctcattcggcatccgttggccgtgccccgtcgataaatgtgccgaaaaacaatgccatcgcctgcggcgatggcacttccgttgcgtcacccctcggcccgtttggcgatttgctaaaaaatgcgttgcgtttcaacatcaaagtgaacaacggcgaaggtggacgaaacgaaatggctgttttccaaaaaatgattttggaaattaaaaattttaaattcccaaattaattaccgaattttgttaattttgaaaaattcgccgagggcatttccttcaaattgttttcgaacccaatcataaatttctcaaatttaattcggtttcgggtttattatccccgcggtcttttagaatcaaaaaatgccactgatggcaattcgtccgctggcaatttgcctccggcgacaacagccactttttcgggcaacgatccctcgtccatggtggtgtcgatggaaattaatggggtacagtaccagggcgtactgttcgccatgcctacggcggaaagtgaaacggcggaagtgctgacggaacgccaaaacagaggcaacaaaaattgaacccattcactattatttattgtttcctcttcagtctgatactgtatttcatttcatcagaccgtaatccgattgttgcctcattagcgtaaaacacaatatgaaacattcaattcattttttgttgaaatttattaggcacagattacggtaacgatttttgaaaattaaattgtgaatcatgaagatagctttatccgttttttattattatatgatgcattaattcatttatgccaataaa

SEQ ID NO: 76749 - DNA, 790 bp, Heterodera glycines
  Genomic contig location: Contig_ID=SeqID_12986; Location=823..1612; Strand=-
  SCN-specific regions: Sequence locations=1-159,181-660,687-728,764-790
  Gene Ontology: Mol. function=DNA binding; Cellular component=nucleus; Biological process=regulation of transcription, DNA-dependent
atggccaagcaggtgttggacctgtacgagctgtacaggctggtggtgcaccacggcggactggtggaggtgatcaacaagaaattgtggcgcgaaattgccaaagggctcaatttgccaacttcgatcacttcggccgcgttcactctcagaacacagtgagaaatgaatgaatgaaaatggcaatttgttttgctaatgtatttttgatcggatgctccttgaggctgattagaaaagcggacataatccgaacacatttgctgatcaaagaaccggcgcgctagctttttaatgggccttattctcagggccactaattacccttttaggttttaccacttttgcgccgattttcgaattgggcgcatttatttttgacttttttttaaccctttctggttcagttaattttgacttgcaaaattgctgtctgaacctttctttttttggctttgtgatcaccactaatcagaccaaaaggaaacggtcccatatttctgatcactttgcctagcaaaataaacaaaatcatgtttttgttgcttttttcagatatgacaaatatttgtacgactacgaatgcaaaatacacaaattcagcgaccgtgcagcattggaagcagcgattgatgcaaacaaacgcgagggcaggcgcaacccgccgccgccgggcgccgccggcgtaacttcgaactccgcgggcgcaacgcccgcgggggcacagcaccacaacggcagcaacaaccacaacaacaacagccatcaccagcacaattattcggggtaa

SEQ ID NO: 76750 - DNA, 968 bp, Heterodera glycines
  Genomic contig location: Contig_ID=SeqID_12987; Location=301..1268; Strand=+
  SCN-specific regions: Sequence locations=1-101,123-968
atggcaatcgaagcgtacgaaacggcgatgagacgagcgccaaaggaccaccaactggcggagaagatcggaaatgcatatgtgaagtgccatttgtacaacaaggtgggatggggaggaggctgatctgatcagtacagagcagagttgtcgcgggacgagaaaaagagtcaggattcgggtcggtacagctaaaacctttcgggtcgggattcgggacgagaaacgggactcgggtcgggacggcattcgggacgagattcaggtcgggatagccaaaatcagtgccgttaagccgactcgctccccaattaattgcttttcctttaaaagcattccttcccgcccccccccaaaaaaaaatcggcgccatttcttcaggcaatcactttctatgaagcggcggtgaaaagcggtcgccacaatttgcgcattcgttttgcggagcaactgttccagctgggcaaccttgagaagtgcaaaaaagtgctgaaggaaatgttggaggaacagggcgaaccgatgggtagcaaaaaaagcaattcaaattttggcgttagttttggcaaaatgaaaaactcaaaaaacaaagaaattgcaccgatgcgcgaacacgttgcctatctgatgctgatgtcacgactgcacattgaacagaacgatttggagcagtcctgcaaggatttgcaacgggcgcgacaattgcaactgaaagtaatcgcccgaggcactgtcgctagcaccagagatggcattgttaacatggcggaggagaagcagctggcagcaaagttggcacacagccgggggcacattacggctgaccgttatcccccaaaaatgccattgcagcatttgtcaacagattgccgaaatgcatgccaacaagcgggactggaacaagtcaattgaactgttcaaagaggcgattggacataatgaaaaggacgtgaaagtgcgtggcgaaa

SEQ ID NO: 76751 - DNA, 1118 bp, Heterodera glycines
  misc_feature (478)..(478): n is a, c, g, or t
  Genomic contig location: Contig_ID=SeqID_12988; Location=848..1965; Strand=+
  SCN-specific regions: Sequence locations=1-39,61-222,244-1118
atgatcgagatctgcttgaatcccgacaacgagataatgggagcggatttgggggagcagcagcaacagctgagccctgaggagtgagtgggcattaggaaaatagagttggtcgagaattggcaattctcgatttaagcgagttgagaatatggtaattttcggcacaactcagtctaggagcggtattttcccgttcaagatcgagaatttgcacttttcgagtcagaaatgtaaagagaagagacagttagtttccgagtcaagacgatcgagatttggctgttttcgagtcaatacagtcgagaattggcattttttcgagttaattcgtcgagaattggcagttcttgagtcaagataatcgagaattggcatttttcgacttagcattaatgattaaaataagacgtataatcagcgattttaagcgcacatgaagcaaacgagtcgtacaaagctgccgaccgtttcttcnaagtttgcgcattttgataattaccaaaataaaaatgatggacccactaaaaattggaaggaattgcgtcacaaatcgatgatggaccgacgctacaaactcacgcagaatttcattcttttggccaaccccaacaaagcgaacacgcaaaaagcattggccaatttcacggagctttgccggacggaagggatgacggtgggtggaaaaatggggaaaatggacatttggccaacatttgttgtcggaatgtcgaatttcgattggcggtttccgacattttatgctcggaattcctatttccgaaatattttcagctgttggaatgccgattgttgaaattttttgagggcatcggcgtcgtacatccctagtgcaaatctcattttttggtaaatgctctgaggattatccattttttgaggaggatgatgccaatctcagcgcgggcgcaattcttggcacggcgcgggcacttttaatggctcaaacagacgccaaaggcaaaggcgcagctcaagagaatggttggggcatgcgtggaatttggaggaggcggaatatttgcagcaatgtaaaaatttgggaaaatgaaaaagggatggtgaagcgacgagactcgagaccaagactttggtga

SEQ ID NO: 76752 - DNA, 593 bp, Heterodera glycines
  Genomic contig location: Contig_ID=SeqID_12988; Location=3566..4158; Strand=-
  SCN-specific regions: Sequence locations=1-144,166-273,296-407,443 -545,567-593
aatgacagcacgacggcgtcagcgaaagcaacacagactgatgcgcatgcgttgttggttggacatggcgcgacgagtgccggcagcagtgggctgagtctgatcagccaagaggaggtgcccgatcaaaactattaaccgaaaaaataaacagattaagcacaggaaaaaggcagaaattagggattactaaatttattagtttaaattggattgaatattttcatttttgaatcatttggtcattggattttttgaagagtgatcaaggctttatcttcaaaatactgatcaattgttgatcggctatccaataattcattgagtattttcaaaatacctgatcaacgccgatcatcatttattattttcaaaatgcctgatcaatgctgatctgccctccaataattcattaatcttttttaaaataatatttcgattttcagaccctttctctgctggcgatcattgaggacgctcttgacgagaccattgaccgccagtcgcgcatcaagaccaacgagttcattgcctcaacagcaagaaaacaggcaaacaatcaatcaatcaccaatcaaattagggcattttaa

SEQ ID NO: 76753 - DNA, 2560 bp, Heterodera glycines
  Genomic contig location: Contig_ID=SeqID_12989; Location=142..2701; Strand=+
  SCN-specific regions: Sequence locations=1-204,226-816,838-1385,1414 -1610,1633-1703,1725-2011,2033-2147,2169-2560
attgttgccaaagaagcggagcagaatgacgacgaccaaccttcgcccatcacggtcggttgttctcattgaaattgggtaatccgtccgaccccatatgaatgcgttattaacaatcgtttatgagaaaaaaaattgtccacattttgctctccattggattgattttttccgttgttcgatttgccctcttccaacccgcgaaaggggaggagagacccacccattcaccatctctgctgctatagccaccatttacccaaaccaaagctaaaattattcccattttcgtatatttgttaccctgaagccatggactgtcccaaaaaagttaaacttccccctgaactcctttcggagttggccaattgccttcattacaattttcgctggtatggcatccgaatttctttgtcctttgaccattttctcgccaaaaatcaaaataaaattcgtcacaataaaattaaggtaatgagttggtcctctgcattaaataattggaaatgagaacaaggaaagcccattacagagctaattagacattgggtactattttttaacttaagcattttctcttgggtcctttttcaaatccgtttatgttttttccaatgcctttattaattaattacaattatactcccaattaattgctcttgcagaaagctgatgaagaaattcgagttcttgaaaaagttattgccgatgcgcaaaaagttattgccgatgcgactgctcgtctcgaatattggaaggagcaccgttctaccatggtctcctttttttacatttttcatttctatccaagtgactaatttattccaaacacagcatacgatgactatgccggtcttgccgcagcaaagcgaaagtacgagtcaacagcccgtcagttcggtactgtaacttcaaaaattgtaaaatttaatgttttttttttgaaaaattttcaaagttgcaaaaatttttttttttgcttggcggggaaaccatgcggggaactgagcccgggggggggggaatagctgctcccgattttacattggcccttggtcagttcagagccgcctactttggctttcttttcttatttttttgtcaaaattttaggtaattttgtagtttgtccccccccccccttttttgaaaatttttttttgccttaaaaacatgtttcatcaattaaattcatataacaaatttttatttagccgcccattgatcctccgattttggagaaagaagaaaacggaggggagccagccgcaaaaagaacgaaagaataagaagaatgaaggaacaaaagggaaagaaaagggcacggcaaaatttgacagaaaatccattgccataatgtttttttggattgtttaaataaagcgtaaattaaatgattttaaaataaaatttgttgatgtaattttctcgcattttcttgagtctgaagtataacaccaggcaaggcattccgagctccaaaaattttcaaaattctgaatttcgtgccatccctggtatgcaccagccatttggtccagtggtagggaaagggacaaatgggcgaaagtttccttttattttgggtacaataattggagaaagaaatggattcatttgccataacttttttctgagtgcaaattgacaaggaataattattgcataattggcgactctttgtggaaaatgcgcaagtgatacggtatttccaaaatgtaagtatactgtagttggtataccgtaggtagttttgtttcctctccatccaagtcacacaaaaattcagatcaccaaaactgactgcccatccctattttgtaccgtataccattttttccattagcaccatacataattttatcattttttgcactgcctttgcaccgagcgaaccggaggaaattcaaattcagagcgtgaatttctgaatatctggcaatcatgtcgatcattggtccgaaaatttttttctgtaaattctaataacatgtttataggggtgttttgaggcgctgagcacgaacccggcctccatttcgaccattcagaaaaaaattaagaaaaaatttcgagacaaatgatcgacatgattgccaaactcttttccatatgccgtaattgtgccgttaatttcggcgggtgcgaatttaacttcggggaccttttttccaatttttctgcgttcgacaccctttcctctcacgttcaatgaattctgctgaaggattcgtttcaaattctcgactattcccgagtccgtccttatctgatcaatgatcagttggtctctgtttgggactcaattggctgtccctcttacccccaagtggcacttttgatcagatcattgatacttaattgcaatttgttcattttccagttggacttgcgcatgccgatgctgcactttctgcacaatgcggtgcccgccctgtttctgctcgtccgacttgcgctgtcgcccgaccggcgtccgctggtgccgcgactgctctgtgccattgtgcgcgcaccgctccgctcgctgctgtggcggcccgtcgcagcacaactgttg

SEQ ID NO: 76754 - DNA, 423 bp, Heterodera glycines
  Genomic contig location: Contig_ID=SeqID_1913; Location=143..565; Strand=+
  SCN-specific regions: Sequence locations=1-262,290-423
atggcccaaaaacctaatttaaatttatttttctccgagcaccagccgcccgctatttgtgaagccgcacaaacactgcgggatgccttcatcaagtggctgttgtgccagcggcttaaaatgtgcgcagtgaaaatgtttatgcgattagaagacgacgagattgatgccaggccgctgcaaccgcctcaaaatggtgcccaggggcagctgctattgtcttcaacagctggggatttaactcaatacaagaccttgttaaggttggtttatttatttatttatcgagcaaaccaaaggcacattagtgcttttacatggtgccaaaagtaagacaaagaaataaaattgatcaaattaaaaatacaaaatgatgtaataaatgtgaaataaaagtaaatcaaatgctaaattctcaggtga

SEQ ID NO: 76755 - DNA, 401 bp, Heterodera glycines
  Genomic contig location: Contig_ID=SeqID_1913; Location=876..1276; Strand=+
  SCN-specific regions: Sequence locations=1-73,95-401
atgaaactgttcgatgaaaaggagatgcgctcattaagttcgactcaacactacatgaaggtcctgcgaagcttcatttcctttctggagacaacgttcggaagaaaccaaactgatctcaaccacgttgggccgctgctcagcggaatgaccataattaagtatcgaattcgtggcattaaaagccgtgcaatagcagaaagggagcaggcaaggcgtacatcgacaaaacaacagacaaaccctcagcacataccatcatacgggactgttatggcgctgatcaaccacccccagattaatgcggcacacaccaacttcagaaacaaatacattcatggggcctctgctgctgaaactgatgatgaatggccgacttacgaagaatttaaattcataag

SEQ ID NO: 76756 - DNA, 1184 bp, Heterodera glycines
  Genomic contig location: Contig_ID=SeqID_1914; Location=242..1425; Strand=+
  SCN-specific regions: Sequence locations=1-497,519-795,821-889,912 -941,963-1184
atgaacgctgaagacaacaataacccaagcccaacggacccagaacacgacattagcaacaatgatgatggcacagcttcggtcgtggacaaacacgacttgatttggcggaccaaagagctgttcgaatacatcagcaagcgggccgctgctggccgcctgacgaccgccagtcgtcaaggaaaagtcacattgggacgggaattcttcgaggaggaactcgaaaatattgataaaggtcggtactatgggtacatttacagagggtacccctataaatgtactgttagtattagttgatattgagttagggtacccctataaatgtactgttagtattagttgatattgagttttactagcatacctattcagaatgccatggaatctacttgaacaagacagcggccgaggctgccaaggactggaacggtaacatgaaacatcgacacgctgccagttgggccactgccatgcgcggcactttttcaattggagcgcacgaagaaaatgcaacatcggaccaccgagttgcaatgcgcgagctgacaaaacgacgggccgctgcagcgacggagaaaatggaaattgaagcaaaatcagcggcgatcaaatcacagctttccattgaaaacgcaaaactcgggctgttgctgaagaagcaacggttggccaaagggcacggcacgtatcacaaagatgtgatcaagtatctggcatcgaccgctaccacctcaaaacggtaaacggtgatgagaaattatacatttatgagcggtcgcccataaatgtatgattgttaattgctgctaattaaataatgattatcgtgagttaatagactcaacgactgtccataactgtaggatattaagtgctcaattaaataatgattgtcatgagttaataggctcaacgactgcgacgatggcaacgaggacggcaacaacgtcacattggcacgcctttttcgagtcaatgccaaagtggtggctaaagacaaattgaagcaaaccaagctgcagaagttccttcgtccgcacaacattgcagaaaaatactcctccggcctcggcaaaaagaaggcaagtttttaaatgagtattccattcaaaacgtacaagtcaactcgtacactgttgtacaaacgcaattcgtagaaaaatcaactcaaattttacaaa

SEQ ID NO: 76757 - DNA, 309 bp, Heterodera glycines
  Genomic contig location: Contig_ID=SeqID_1914; Location=1611..1919; Strand=+
  SCN-specific regions: Sequence locations=1-94,116-309
atgagagaattggagcaatctggcaattgtggtgtactagtaaaattaaaaattactggtagatttctttggcagatgccggacgtacgggctgaggaatgtctggaagagatatccgacaacgacgacagccatgtcagggacgaggcttctcggcatctgccaaaaccgtcactaccgtcagcgtcagccgtttttaggcgtagctttgttgatggtggaaacgagaattctgaggagttcggaatttttaaacgtggatttttgggtgaaggagacgagaattctgaagtcattttcattgattga

SEQ ID NO: 76758 - DNA, 864 bp, Heterodera glycines
  Genomic contig location: Contig_ID=SeqID_1914; Location=2206..3069; Strand=+
  SCN-specific regions: Sequence locations=1-864
atgcttaatttaaatgaaaggcggtacaattgcggatcggcaattgcggactggacaattgcggacgacagttgcggaccgtacttttgcggacgacagttgcggaccgtacttttgcggactggacaattgcggaccgtacttttgcggacgacagttgcggaccgtacttttgcggacgacagttgcggaccgtacttttgcggtcgacaattgcggaccgtacttctgctgaaaaaattaactggaagggtgggcctcgtcagtacgaccccttccgtattgcaaattcaaaaacctaagtgtgtttcggcccttacatagacagaccaaataagaaagctcacagcaataaataaataactgacaatttgaaagcataaataaggagcagaaaagcaaagcataggattataaaatctataattatgtttattttattggcttgctgaaggcccaacaacagcttctacgaatacaacttattaacacaaaaataactcaagactttttccattcatcaaaccatacataagcaatatcgacattgcttttcgtgatcgtccaatttttctatccccaccatctttggctaaattacttatttaaattatattattgcaaattttctcactgtaaaagcggctccgtccggttatgtcttcaatcattgaaaaaaaatttgaataattgaagtctggattctagcaaaaattaaagccaaataagttgaaaatctgttttaagaactcttctggccataacttttttgaaccttaatgaaaaattttcaaaactttgcaggctaatagtgtatacttagggctttcgaatgataccaagattgttggatttcgttgacaa

SEQ ID NO: 76759 - DNA, 1876 bp, Heterodera glycines
  Genomic contig location: Contig_ID=SeqID_1914; Location=3152..5027; Strand=-
  SCN-specific regions: Sequence locations=1-96,145-163,195-340,362 -464,486-543,623-963,990-1083,1155-1168,1190-1491,1513-1521,1610 -1632,1770-1792,1835-1876
  Gene Ontology: Mol. function=calcium, potassium:sodium antiporter activity; Cellular component=outer membrane; Biological process =calcium ion transport
atgccaccattgcagtcatttttggcgtccatcggtcgcgtcgcatccacggcattgtccaccagagtccaacgggtcactaataatcgccatttacccctcctccctcatttttactcaaatgttttagttttttcatttgtttaatgggtttaattaaatttcaattagctcttcattcattaaataaataccatttgattatgttggcttactgtaatttatacagtaaaagccgtgcgcattctttcaaaatttgtggttcctttattggtgcctctttgattagcgtttcacaaattggcccctaattgcgaaaataaattgttgcaaaactgtccaattaaacggctcattctcagtcaattatagtgccccatttttatgccgaaaatatttttctaagatatatttaaagtttttgcacaggtttctctgccatttgttttacgtaattttaccacaaaatatgtctactgatgataattttgttgtacatgaatctttcaacgacacacgtaaagctgaataaattacattgcctaattaactaattaattgcctaattaactaatttattaattaattgcataaataatttattaattaattgcctaattaagtatggcccgccagcattgggtgtgccgatttagtggacaaaaatgccattccgtggtggaaaagaatgacattttggcgcaacacagcaggcattttgctcctcctgttgattggtcttctttttgtggtagttttgattttttcaatttgacttcaattccgtaaatttttacaagaatatttcaacaatttttttttgtaaatatttgataagtacaaaagtaatcaattcaaaaaacaattttcagttaattggcaaaacggcgactgaacttccggaaattgtgacagagaaaatggacagaatttatgtcaaattggagcaacagcaggtgaaaaatgatttaaattcttttaaatttaaattccaatttttccgcaggcgatggccaaattggcaaatgcaaaagaaattcaggtgctaattatgtagtaattaagtcacaattttttggaggcattaataaaaaaaatgtctttttttcaaaaatttacaaaaatgaaatttcgaatttaaaaattatttaattgcttacaactttaaactctttaatgacaaattcaaaaattttgcatattttcagtcgcttctcagcgcaacgatcgacgaaaaaatggccaaacatgaggtggtgaataaatctttttaggggtcaaattggacggcgggggggggggggggagtctaaaagaattggaataatatttataattggaacaattgcaaatttcatccccaaattttcagtcacttctaatcgcaactgatcaaagaattgtccattttttgctgttggcatttcttctgatcgccgccgtttgccttacacttttgctgatcaaagcaattgtcgaccaatttttgaagcagaaatttgaacaaaacaacaacacaacggatggggaagaggaaaagcggactgaagagaaggaggaaacggaagaaaatggaaaaggaggagagaaaggaagacgaggggaggagtcaactttgggggaaaatgatggggaagaggaggaggaagaggaaaagaaacaaaatggaaaaggaagagaaggaggagagaaaggaggacggaaggaggagcaaattttggaggagaatgatggggaagaggaggaggaagaagaggaggaaaaagaggggaataaacgagaggaatttgttagagaagagaatgaggaaaatgaaaaagaggaggaggatggaacagaggcacttttggaggaatttgcacatttacaattgtaa

SEQ ID NO: 76760 - DNA, 182 bp, Heterodera glycines
  Genomic contig location: Contig_ID=SeqID_1914; Location=5877..6058; Strand=-
  SCN-specific regions: Sequence locations=1-50,74-85,109-159
atgatcattttcctgctcaccctgttgtttggcctagtttttgtggtaagttttggattttgttttttcaaaatttacaaaaaaataaaatcttgttaattttaggcacttaaaaattggaaccccactaattacaaagtagtaaagccctataaagtgaattaaatttatttaaaaataaa

SEQ ID NO: 76761 - DNA, 1750 bp, Heterodera glycines
  Genomic contig location: Contig_ID=SeqID_12991; Location=760..2509; Strand=+
  SCN-specific regions: Sequence locations=1-338,510-608,636-894,919 -1193,1215-1661,1685-1750
  Gene Ontology: Mol. function=poly(A) binding; Cellular component =nucleoplasm; Biological process=sex differentiation
tatttgtgaaaaacaaatgtcacggaagcgtaagacggcagcggaggaacagcgaaacaaacggaaaaagcggagcgaccggaaaaaggaaaacggcaaagaaatggtgggtttgaatttcgggaatgagaaggggaatgggactttttttaaaacaaaatttggggtagtttaatgcttcccattttttaaatttgtaatactggggcgccgcaaaaaaaaaaaagtttttctggcatacatttcttaaatctttacagctttattgccgtcatccaccgagggccatcctcgaaaagcaccaacggcgagagcagcagcagaatgccgtcaacgaccagcaacaacaacaaaatgagcagcagcagcaaaatggacacaatgagcaacagtttgacgagcaacaacacgaacagaatgatggcgatgagcagcagcagcaaaatcagaacgacggaggagagcagcagcacgcagaacagcaccagcccaacaacaacaacaacaactcgctcatttttgaggaggaggaggaggaagaaatgacaaatgccgacgaggaggaacagcaaagcggaattgaggccgatgagtcgacgcacgagcaacaacaaccagaagaggaggaggacggcaatgaaggcgaacaccatcaacacgggaatgatcaacagcagagggaggaagaagtgagagaggggcagtatgagctcgaccgagcatacgcgtgctacacgcacagcaacggccaacgagcgttctacgtgaagtggacccgtaagtaaaaattgattggattaaaaaaaattggaattgttaggaggggagcaaattggctagacgataaaagatatccccccgtccccactaattttaatggtcaaaattttggaaaatttacttgtgagggtgactaagggatgccgcccgaggctccaaattataaatggatttaattacacccgtatttgtcggaaacagcgagcggttgagttcagcttgctgaacttcacgcctaattgtgactggtgaatatcccccgcccattattcgcccctcccgggggtaacggtcgagtttactggtgacggcggtcgcttgcagaacttcccgtcccctgggaggggcgaattgtctcatccccttttcgtttactttaggggaaacggttgagtttaggcatgcgacggcggtctcatgctggaacttcccgtccccctttggtaaacgaaacccgaaaaatttctaaattgtaatgttcttggacggcatccctttatagtccttgcttccatgaagagggcttaggcacaaaaaaaaatgttcttgataggttggcggaatcgcgaatggatattgtcagttgattcatcagcaggcgagctcactaatcaatttatgttgacgtccgggagtgatgcgactttggatgcgttaggaggccaatcaattgcgggcacacatgcagattggctaaacaaaaatccaaaatttcagaaatgtaaaaaaaaacttttacatttgaaaaaaaaaatttttttgtttaagtggcgcacaaatggaacactggtgcggcaaaagcatcagaacacgacattctatgggcggcggacacggacaagaggacacgacagacggtatccaattttgtgttgcttttcataataataataacaaacaacaattcccagaattatagcaaacaacaattttcaggcggagaaacaattacgtgcattcatcgacaaat

SEQ ID NO: 76762 - DNA, 698 bp, Heterodera glycines
  Genomic contig location: Contig_ID=SeqID_12992; Location=298..995; Strand=-
  SCN-specific regions: Sequence locations=1-315,337-420,442-660,682-698
atggagaatgaatgtgataatgaacgggctcggacgcaaaaaacgaccagatctgagaatgttacctgcgattgttcattgggtaacaagggtgtcgactgggcaaatgcgctgaacactcctcctccaatcaccaaaaaaagtgagtgttgataattaattggcatgccatgtgtgctcgctaataatctttaatagggcctctctattaaaaggagggaggggggatatcattttctgacaaatgagctcttaatgcgctctatttccccagtttatgcatcaattaatggccatcctcagttcttttgcgtttatttatttttcctattcttcagtaattttataaattttggtcctttataatgatttctgactcttatttcctttctaattaggcaaattagtattaataaatgttttcaaatgaattgaattatttttgggtaatttctctttttacagtaaaccatggtctgtaatttggctatttaatgttttttacattaaaaataatagggcaaggatgcgttggtggctggctcgatgcgaaaggatatggccaaacaattaaaatttattgctttgatggatatgaaatttgctatgcagcacgctgtttcaaagttatgttctaatgactaaatattatttaattgtaaagaaaatgggattcgaaaagccagaagcaaaataaa

SEQ ID NO: 76763 - DNA, 70 bp, Heterodera glycines
  Genomic contig location: Contig_ID=SeqID_12993; Location=835..904; Strand=+
  SCN-specific regions: Sequence locations=1-70
ccctgtctccattaaaggctctgtctccaattatgtccccctttctgaggatgttgaaaaataatccccc

SEQ ID NO: 76764 - DNA, 439 bp, Heterodera glycines
  Genomic contig location: Contig_ID=SeqID_12994; Location=635..1073; Strand=+
  SCN-specific regions: Sequence locations=1-206,228-439
ctgctaaccaggaattagctgcacaatttttcgctgaaaatgttaagccacggttcaaatttgctggagaagacgaagaaatcgctgtgaatttatttgacctgaccagaagtctgattgggatttggaagttttattttaactcaaaagaaggcaaaaaatataaatggaaactgagcaatttatttaagtactcatttgaaccaattttgctaaatgagaatgaatttaagaagaatgaagagggaatggacggaagaaacaaaacagcagcggaaagctcatcacagtcattagcagctaatgagcaaacgggcaacgcggacaatgatctgctgaaattaatggaagacaaatttaagaatttggtgaaaaaaatggcaaaaattgcacaaaaaatgaacaaaacatggcgcacttccatttatttttagccgta

SEQ ID NO: 76765 - DNA, 636 bp, Heterodera glycines
  Genomic contig location: Contig_ID=SeqID_12994; Location=1387..2022; Strand=-
  SCN-specific regions: Sequence locations=1-210,232-636
atgaccagcgcactaattttgggtgccgttgccttcggcgctttcacccatttgggtgcccacgaatgggttgccattgtgatggttttgggcattgtcggatttgccgtttttttcttaatcggtctctttttttgcttctcatgttgcttccggtgagggcacggcactgtaaagtcactttttggcttacaaattaggacacttattgtttattttttcaaaataataaatcgtaattttatgtcaccaagaaaaatcaaaaaacctgctactatgtataattgttgatgcgaataaaaaggaaattatgcaaaaggttgatcggaacatttccatggaaatcttgacacctcagacggcagtaaaaaaaaaagttttggatatttgaaattctcgatcttaagcataaataagacaagtttggccatgaaacaatgtacattttgtcctgcttctcctgcataacggcatggcatgacacaggaaaaaggattgaaattctattggacaggaaagcagcggaaaaagtcgctttaaaggaagttataagttcgactcctcctgcggtgattgtgattacttacaacccaatttaatagtccgtcatggcaatattgttatgagttgaataaa

SEQ ID NO: 76766 - DNA, 1255 bp, Heterodera glycines
  Genomic contig location: Contig_ID=SeqID_12997; Location=149..1403; Strand=+
  SCN-specific regions: Sequence locations=1-166,188-969,991-1114,1136 -1255
atgggaatttgccacaaaattggagagaatggcaccaagaaaatgcaaattgacgatgccgatggaaatccattgccaatcccgcgaaatccgttgccgaacaaagtcatcggattcagacgcattcagatcaagtaaaaactgattagatagaaatttttcataatttatctgcacttttcagttacatcgatcaaaatgtcatcgaatttctccaccgttttcaccgtcttttccccatttgttcaaccactatgaacattaccactgaaaatgtgcgcattttggactactttttgctccatatttggccaatgttctgcgattccatgcatctgatgcttttgaacaccatcctttttcgccgcttccgtcaattggccccgtcatcactcagcgattgtccatcccttcgcgttgtgtggttggatgacggcactttccccgaatttccgcccgatgacagtgccatggcgtcggatggccaagcggtgaccaaatgggtgttgacgccccgtccggatggtcagcccaagttgctcaaatcacctgttaattcaccggatcaatggtcgtcaacgatggaacagttcaaagcggtcggtgattatcacggggcattttattcgttttttgcgcttttttgtcccatttttaggaattttccaatgcttcttctccggtttccttttcaattaactttctgccgtcttctccgcttgactccgctgtgccattcgatctgatcaaccaagcgactggggagcaattgacactggaacaatatgcaaatggtttttggctcagccgttgcccaattggatgggatgagatgaaatgggacaatgtgtggaaggaattgattgatgctcgaacgaacccaattgacattgtgatcaaagatggtggatacgacgacgggtgaacaaaacaattttaaaatgatcagtgcttttatgagtctaatcgacaattgagcaatgttttttcttcagttttctcgacgccgcttcgcccgggccaagtgatcactgatcagcaacagaaatgaatgaattaattgatggttaattgatgcgattatgttaccgaaatgatgtgggcactttgccatttcaatattgtattatgtccaatttgtctgtctgtatttgacctttgcttgctcgcaaatgcgtccatttccatggtattttatttatatgtgataattcatggtgattaatcgtggataaaatggcaaaatcccacccca

SEQ ID NO: 76767 - DNA, 665 bp, Heterodera glycines
  Genomic contig location: Contig_ID=SeqID_12997; Location=1668..2332; Strand=-
  SCN-specific regions: Sequence locations=1-36,92-202,239-328,350-665
atgggggtctgggtgagaaaagagtagggaatggtgaagaaggagaaattttttgagaaaaaaaaaattaaattatttattttcatttaaagcatttgttcatatgcataagtggtcaagtggctaaaccttctgattttattatttctcgcttgggttcaattccccactgggatagaatattcttcatattttctttaccattattttaattgaaattttaattaaaaaaaatattccaactttttttctttcattttaagcatcctaaaaacccaaaaattaatcaattggtctttttttacaaattctgttaacaaatcgcattaaaaaatacaaaatttttcccggcggcgcctatcggcaccgccggccctccttgttccccaaaagtcttgagaaaaacgtgccgcgaaaaaagcggtgttgaaagcaaaaaaggtcattgatttacattaatttacatggccggagaccccttcgcaaaattggaaaattggccgctgatcccttgttttgcaataatctgaattttgaggtctacatctgaattttagtgttctttatcctgaatttgaaaaaaaaacttggtcaccctcaatatacatatacttctgaacaattctaatgctaaaaaacaggcactcgcgcgaaaactgaataaa

SEQ ID NO: 76768 - DNA, 871 bp, Heterodera glycines
  misc_feature (857)..(857): n is a, c, g, or t
  Genomic contig location: Contig_ID=SeqID_12998; Location=12..882; Strand=-
  SCN-specific regions: Sequence locations=1-52,74-109,133-480,502 -553,575-871
  Gene Ontology: Cellular component=integral to membrane; Biological process=erythrocyte differentiation
atgaatctgacatctattcaaccaattccaaatctctataaaaggtccgcccttttcaattttttcgggggccctaaaaagcaaagtgccaaaagcaaaatccttttgatttttcatttagttttgtgattttaataacctgaattccatagttttcagaatcctctcaaaaatttttgttgaaaatactgaaaaatcgcttatggatttttgattcatctctgttagccatcattacgccatgaaattctatgttttaagccatattcactaaaatggcattaattccactaattttcccccatttttttccaggacaggcaattactccgacaatttgtccgtcgatgagctgtggcgtgccaaacatttgtacgactcggcattccatccagacactggtgaaaaggtgcttctgttaggacgaatgagtgcacgagtgccggtcgtcacattaatgtgcgttaaatccccccaacgaaattcttggaaaattttttcagccttggcggtatgctcactttctacaagtcagtatcacgcgtttcattcatttacaagcattgtaaaaaattctgttttaaaatttcaggtcaacccctgcagtttttggctggcaattcgtcaaccaggtagataaaaaaaaattcagaaaatttcttttttacatgattttttcagactttcaacgcaattactaactactccaaccgttcgggcgatgcgttgagcaactcgcaactgttgcaggcgtatgtgatggccaccggtgggaaaaaaaattttctaggcctgttttttttaaaaaaacgtttcccatttttcaggcggtgcaacgggcgtagctctgggactanatcgtgcagtaacg

SEQ ID NO: 76769 - DNA, 834 bp, Heterodera glycines
  Genomic contig location: Contig_ID=SeqID_12998; Location=1324..2157; Strand=-
  SCN-specific regions: Sequence locations=1-41,68-162,185-192,273 -337,383-388,425-429,472-538,594-834
atgggcaaatgtccacccaattttggacgcattatggtgctgttttttgttcaaaatatgaacaaaacattgaaaaagtgggtgaaaataaaataaatttctatatatagttccgggtttgtctaccactgttttacgaatttttttttctcaaaaatttacccaattttatgcataaaaatgctgcgcaagaaaataattattttaaaaaaaatgtttaaagaaaatttgacttttttttattcattaagttaaagaaaaatattttttaagcaaatttgtatgactaaaggcgaaaacattgatgtttttgggccaagtttttcatttcaatagcttaaaaaattatataatgcaaatataaaaatatttttaaaaaattcagttattaaagggtggctcaaaaactgataaaaatttattaccatgaaaaattttctttttttaagaaattatatatatataatatttccggatttgtcctccgtttggcgaatttttttttttacaaaatttacctagcttttcaataaaatgcttaaaaattataattaatgcaaattaaaaaaaaaagatatattatttaaaattatcagttattatggggtggctcaaagctcgttggagtgctatttgaggagtacaaattacacatttatgcgccttgatttgaccgaagacattcgtgccaagaaatactgtgtccaacacaaacaagtactgtacagtaaatgtttgggctgaccgagagtcgaaattttccgatagtcgagaaccgataccgaagccgggtattgacgccgagactcgagaacgaaaccgagactcaataaa

SEQ ID NO: 76770 - DNA, 588 bp, Heterodera glycines
  Genomic contig location: Contig_ID=SeqID_12999; Location=152..739; Strand=-
  SCN-specific regions: Sequence locations=1-260,284-295,322-378,401 -408,432-461,495-550
atgaaaatgatgagaaaaatgaagccaacatttgtttatttggctatcattggatcattttcaacaattttgtgcttaattacactgttccaccaatatcgtccgttgcgaatttcgtcggttgaagaaaacaaaaattcaaacaaaaaattgttgtacactttgccaaatgccatgacaattgggccaaaaacgccatatttaaagagggaaaacatgggcaaatgtccacccaattttggacgcattatggtgctggtttttgttcaaaatatgaacaaaacattggaaaagtgggtgaaaataaaataaaattctatatatagttccgggtttgtccaccaccgttttacgaatttttttttctcaaaaatttacccaattttatgcataaaaatgctgcgcaagaaaataattatttaaaaaaaaatgtttacagaaaatttgacttttttttattcattaacttaaagaaaaatattttttacaaatttgtatgactaaagtcgaaaacattgatgtttttgggccaagtttttcatttcaatagtttaaaaaattatataatgcaaatataaaaatattaaa

SEQ ID NO: 76771 - DNA, 669 bp, Heterodera glycines
  Genomic contig location: Contig_ID=SeqID_12999; Location=1408..2076; Strand=-
  SCN-specific regions: Sequence locations=1-128,151-255,277-669
atgccaccaatttgggttagcctgatgccgttcgccaccgttgcatttgcaaattgtgtcaacatcccggtgatgcgacgaaagtgcggaaaattgcaattagtcaaaacggtatcgatggacctttttgattttcaaaaacaaattttgtgaaccaaaagtcaggcgtccaatcacttactgcgcgtccaattaatggagaccatccttagtttcttaagccatatttttttttacttacttacgtcaatgccaatattttggtagcaaacaaaagctttaaaatctactgaatttttgactaactaaattctggactaacgcaatagacttactcgaaaaaagctgtatttcgtgttttctcattgtaattttctaaatgtcactatttgctcttttctagcattttatattcctgagaccttaagagttcgccgacattcatgcctttgtccaaaatcgggcctcaaacttaagttttttcaatccctgatcgcctaaacagctttaaaacaacttataatcctattaaattactaatttgtgagtattaaattcatgaatgtaacaattaaaattgtttaattttaatcgtaaatttaaaaaatttgacacaatttcttccattagataattcagctgataaagaaaaaaacatatgaaaataaa

SEQ ID NO: 76772 - DNA, 65 bp, Heterodera glycines
  Genomic contig location: Contig_ID=SeqID_13001; Location=64..128; Strand=+
  SCN-specific regions: Sequence locations=1-65
atggcttattcatatgcttctgataaagatttgcgatttatcattcttaaattgaaatcccagtg

SEQ ID NO: 76773 - DNA, 1120 bp, Heterodera glycines
  Genomic contig location: Contig_ID=SeqID_13002; Location=142..1261; Strand=-
  SCN-specific regions: Sequence locations=1-5,27-258,280-510,538 -695,717-756,779-886,926-1075,1099-1120
atgctcattttgctgctgctgcacagccgggtgagttgtcatttcccttcgttttaccaatctgctcatttttggcacattttagtggtcaatgtgactgcggttatcgccaatgccaatcccaatggacagaattataacgtatgtttttatttcttaccttattaaagaaacagcggggaataaaggcggaccgggaacccattagttcttaatcgcgttctcggctaatttagaccggatcccgattccggcgaaataacaaatttttaaaagtttctgatttgggaaatttggtttctccaatacaaagaaagtccagcaaatcctatttatttttttcttttataaccttatgtaaaccagctgaaatttagcgccttcagcgtttgcatgcggaattatcggagaccattgaccgttttacggaggaaaattcccttttgggatatatgaacgatcaattgacggaacaacttgaacctctgacaggtttgtttcaaatcggataccaaaaccaaaaataaataaatttatgagcttaagttttacagagaaaactgctaattttatcggaaattttcttctctccggttttacttgtaaaatttggcaacaccctctttaagcccgaaaaggcatttaaatttgtgtcaaaatggcattcattggtttagaagtgcctccgaatgcgaattttaatctggatgatgttgtgtttcagccgcccctcgaccagcagaacggtggtttgtcattccttttgttccattaaagtcattgtcagttctttccttgaccacacaacacgaaaaataggaatttgcatgttgtttttggcaaacaaaaaaattgaatttaaaatttagacttttccaatgtttccttaatatgaaatttctaatttattaaatttaaaaaaattcatgtggggaaacgagctgctccctgttaattcatccatcttttccaaggggcactgaacaacaatggccagcaataattctccctcaaaatcagcaacagtacgaaagaataagcggccggcacatccatccaacttccaattttgtcatttgttctttttaaatattatgttttgtctgataatgagaataaa

SEQ ID NO: 76774 - DNA, 1807 bp, Heterodera glycines
  misc_feature (405)..(405): n is a, c, g, or t
  misc_feature (408)..(408): n is a, c, g, or t
  misc_feature (414)..(414): n is a, c, g, or t
  misc_feature (424)..(424): n is a, c, g, or t
  Genomic contig location: Contig_ID=SeqID_13004; Location=592..2398; Strand=+
  SCN-specific regions: Sequence locations=1-167,189-219,242-325,352 -858,886-1089,1111-1543,1565-1807
  Gene Ontology: Mol. function=t-SNARE activity; Cellular component =plasma membrane; Biological process=intra-Golgi transport
atgggttcgttggcggtgcaaccaccgagcggtgtgacgaggaatctgacggaggtatggattacgggcgaaagttttatttttgaagcttttagtgttatttgtctgtcaaactagtaattttttgatcacttggagggtcgtattttacgaaaaaattacacaccaaaaaattaaatttaaaaaatggaagatttttttttcttcaaattccatgttcaggtgtttgtgtttctgcggaacaatgcccagcaagagcatttggtggaattgaacagccaacaacgtgtcaatttggacaccggtaaaaaggaattgccatttgcacattgtttttgttattgtatattgcgtttagatgacaaaatgtgcctgatcgccatcgatgagggtaaaagtgttggnttngggggnggaaagatanaggtttgggtcaacatgatcgacgaggtcaactacgaactgaccaggcaagtgttgtgcgcaacaaaagtgtcggttgattggagttaaaataattgccggatttttttaattgcggaagaaagctccttcgttgttttgccaaatgctcttgctattctttagaataaaagctcgtcagaccgcgcttcgagaattgcaacaagttcgtctcaacaaaatttatttgtttacgggaaatttcaatttttgcagaagcaattgaccgacttggacttttccgatgacaaaggcgcatcagcagaagcaggaaaagtggccgaactgacggaagagctcacggcaatgtttgggcacagcaaacggttgataaagtgagcacaaaaaaatacttgcctaattgactgacaatgaacccattcaattttgcttttattttctggtttttattaaaaaacaccatttgaacggatttttgcaaaaaaaaaattgtaccaattataaggctaatcgaagaggacgacacggacaaattggcatcatcatcctcatccttcagcaaattgcggcacaatgttgtcgccagtctgctgttggtgctgaactcgttgatgcatgattttcggacaaggtatatttgtttctaaagagtttcggacattaatgaaatcctgaattttcttttccattcttattcattgtcagccaatccgccttccttcgccaattggactcgcggacagcaaatttggacacttttgtgctcaaatcatcgacaaatgttgtgccaactgctgcttctgtttgtgccggtgacagtgggaccacggacggtgccatgacaagttgcacgagagacgctgacaagcaacagcaggaagaattgacaatcgaccaaattcagtacatcatgcaaaatgagcacgtgtccaaggagcgcgaacaggaggtgcgaagaacaacaagatccccatcccctgctgtttcccccgatttttttttatttctaacttattgttagaattttttcaaaaaaacctatgagcttttggtcattaataaagggtttttggaaatatattaaaaaccaaaagggggggggcccttctggtttgcaaaattttgtgttttatttgagtttgggttgtggattatttgtcttgacatacaatttttaagtctgacaaagagcggacccactctttcgaagcaatttgaaaagcgcattggttattcaggtgctcaaaatcagcaaatcaattctggaattgcatagcatgttcaaggacattgcgtcgatgattattgaccagggcacaattttggacagaatcgattacaatgttgagcagtcggcgtctcgtattacatcggcgtttaaaag

SEQ ID NO: 76775 - DNA, 150 bp, Heterodera glycines
  Genomic contig location: Contig_ID=SeqID_13004; Location=258..407; Strand=+
  SCN-specific regions: Sequence locations=1-150
gtgatttgcggttgcattcgtggcgcgttggaggcactgcacatggaagtgcaagcagtgttggtcagcgacgttccggagcccaccgaactgcgcatcaaagtgcaccgggtgttgcaagagtccatcccggcgggggacgaaccgtag

SEQ ID NO: 76776 - DNA, 1089 bp, Heterodera glycines
  misc_feature (1085)..(1085): n is a, c, g, or t
  Genomic contig location: Contig_ID=SeqID_13005; Location=700..1788; Strand=-
  SCN-specific regions: Sequence locations=1-121,143-270,323-418,440 -614,636-886,908-1089
atgaaatgcgattggcccacccagccattggatggctacttgttgcattgtgcgagagacaatggaattccactgttggacggcagaaatttggacatgaaacgaattatagccatgagagacatcaaagaattgacagaaagccatggcattttgatgtgtacacttgaaccattacgaagacaaggtttaaaaagggaatagttgagccaaggttatttgggcacacaacagcataaaatgaccagcctacctgtttagactggtttcaaaaaaacttataattaaataaaaatatattttaaataaatagtaaatttatgaatttagttggttaggaaaaaattaagataaaagggcgggaagagattctgaaattattccgtgtgattctcaagtcgggaaataagtcattgataaatatggcaaaaactttatattcacaaaaattttgctaacattcttgacattattaacataaaacaattaaatagcattaatttagaaaattatgaattatatgaaggccaaggctccaattcgtattcatcgacttcatttaataactatgagaataatcaatacttttcggatagagaatgcgccaacgagcttttatcaccagaaataaatgataacgaattgtcaagaagttatgaacgaatcaaaccaacatttttcgataaggaaatgcggggagtacatgagagaacagcttcgagaagactcaggagctcctatgaagaccaagctcaccgcgaaagttatgaagaaacggaaaaccgacgcaatcgtctggtcacctattatgataatgacgaatcaccgaataattatagcagacgggagcgacaaagatacaatgatgcaccccatcaacctgagtataatgaagaaatacaacaaaattcgccgatcacttatgacggaagggagtcagagagagatgccttagcaaattaccaaccgacaggctacgatgaaacacaacaaaattcagctcgatcgcagagtcagggtcgtattagggaaagaccaactcataatgaaaaggaagtgccgaaacaaactaaaaacagacgagnctaa

SEQ ID NO: 76777 - DNA, 64 bp, Heterodera glycines
  Genomic contig location: Contig_ID=SeqID_13006; Location=1645..1708; Strand=-
  SCN-specific regions: Sequence locations=1-64
tttcgaactttagcacatattttggcctttttccataaatttcatagcaaaagtgcaataaaaa

SEQ ID NO: 76778 - DNA, 767 bp, Heterodera glycines
  Genomic contig location: Contig_ID=SeqID_13007; Location=1579..2345; Strand=+
  SCN-specific regions: Sequence locations=1-100,122-266,289-415,477 -571,593-662,684-767
atggatgcgcgagtgggtcaacagtgagcttcactgccgaaaatcttgataaatttttgattttgcaattgcaaaaataatcgataacatttatgaggagtaaaattttttaaattaatttgcacccctaattttcaagttttttgtgcatatttggtgcatattttgcgatttttgtgcatatttggtgcatatttcacgactttatttgcatatttatgcgcatattttggccatttttcgtgcattttttgacagccctgctgataaataattgcctaatttaaatttaatcaccataaaattttcggaaaaattatatacacctaaaatgcaaaaaatacggattcctcaaagtttctgataaatgtcgtaggaccccgtcccgcgccagaaaatctaatatcgactgccgaattaataaatattttaatttttattgtttttttttgaaaattaatttgaaatatatatttggtatagcttggttcgaaagcatttgaagaagattgcaatgaatcaaatgatgcaaatgcgacaaatggttctgtgccacagcaagcaacagatcatgagacagaaaaaacgggagttattccaatgacattggataaaaaggcggaaaattcggaggataatgatgctgattcaatggcaacggaacaaatgcaagaaaattcggaggataatgatgctgattcaatggcaacggaacaaatgccggaaaactcggatgaagaatattcaatggcatcggaacaaatgcc

SEQ ID NO: 76779 - DNA, 170 bp, Heterodera glycines
  Genomic contig location: Contig_ID=SeqID_13007; Location=1068..1237; Strand=+
  SCN-specific regions: Sequence locations=1-1,25-118,140-170
cttaagttaaaaatataagaaaattatattctgaaagagaacaattaaagctattgaatgataccacgaaatattaatttggttgaatttgagccaagctattaatttaattattttacccattttttgttttcaaacccattggcagtttttaacaaacgcgccagcac

SEQ ID NO: 76780 - DNA, 1118 bp, Heterodera glycines
  Genomic contig location: Contig_ID=SeqID_1915; Location=395..1512; Strand=-
  SCN-specific regions: Sequence locations=1-89,132-187,209-377,399 -634,658-658,682-894,936-1078,1100-1118
atgattgcaacggtcggttcgaactgcgcggatgggcagggctcaggtgggtcacaaatgatgggtctgttttgaaaaaggcaaataccattattttaatattacataatcaaaaaaatatataattaaatgaactttatattctaatttccaaattgagttggttttctctgtttaaatagccaactaaaataatttaagttttgaataagcaatcaaaattgttatgggctcgtggtttgaatttttcatcacgacggaaatgggtgatatgtacttgtatacacatatttccaacctcaccagtacttattgtattcattaaaatacagtcccctccttaaattagagccgccccctcccctcaaatagagcccccggggtctgtctctattttaggaaatacgtgattttcctagggttgccttgttttttttaaaggcttgttccgtcctgtacaaaaacaaaccctcaatttgttgtcgatattccatgttgtagcggagaatttccgccagactctgatcctgccgatggcaagtcaaatttggagcagttggcgtgtaaatgcacgccttcgtctgtccaattggcaccatacagtcgggctcggcggcacaaagcaaagccatgcaaatttaaattattttattttaactttcatagggagaaaaattctatattttaaagggttaaaagggatcggactcgacctttattttttgaaaaaacttgacccaaacatgaaaatatccgaatatcgggcccagtcctatggaaaatacaagccgggaccaaacttaatttcgacactctgtcaagtcgacactttataccgcctgtcgacaacagttggccgatcgattggaatggaaccgcaaaacaaagccatgcaaatataaatatttatttgtttaatatttaattttttaatacccgcagagatttatttaagccgtttttatgggtatcaacaatcaacgtgaaggggtgaaaatgtaaacattaacaataatgtttttctggaaactccttttttgcctgttcatgttctttctttagtcctttctcgatggtcacaaatatataattcttaacatttttggagtgaaaataaa

SEQ ID NO: 76781 - DNA, 163 bp, Heterodera glycines
  Genomic contig location: Contig_ID=SeqID_1915; Location=881..1043; Strand=+
  SCN-specific regions: Sequence locations=1-163
atggctttgctttgtgccgccgagcccgactgtatggtgccaattggacagacgaaggcgtgcatttacacgccaactgctccaaatttgacttgccatcggcaggatcagagtctggcggaaattctccgctacaacatggaatatcgacaacaaattgagg

SEQ ID NO: 76782 - DNA, 383 bp, Heterodera glycines
  Genomic contig location: Contig_ID=SeqID_1917; Location=395..777; Strand=+
  SCN-specific regions: Sequence locations=1-131,181-288,310-315,339-343
atggtttacactttgaaaatgaacgactcgcgaataattcgtggcaaaaagtttaattgctcattaacatggcttttggagcgctacaaactttcagacaaatacgcaattaaagagaaaattgaagtctgttttttaatttatttttattatatttttattaattttaatcatttttatgtcaaatatcctggccatcccaaatttgtgtttgtgacagccgccaatgacttttattatccctttattcggacggtaattgcaaatgttaaagaaaattttggatgcaaacagaaaataattgcttatgatttgggaacagtgacaaaaaacaaagaatgggtaaaaaatagttttatttattttaaaattaataattaaaa

SEQ ID NO: 76783 - DNA, 883 bp, Heterodera glycines
  Genomic contig location: Contig_ID=SeqID_1918; Location=736..1618; Strand=-
  SCN-specific regions: Sequence locations=1-83,105-566,588-883
atggcattgaaggggcacaatcagtccgatcactgcacaaccgaggcaaatgccaatgctgaaacagggtacgcatcaactcagtgccgtgcctgtgcgaattcgtttttgaaatttcagtttgcgaacagcacggtccgatcgtgttgcccttcgcaaacgtcgcttcatcggtgatctgatcgacattggcaaatttacatttgatactggctgcaaactgttccacaccgccatttgcgacttgggcaaaaaacggaagcgtgaggccgtctacggcaaaaatgagccggcgccaaacccgctaacgagttcaaagtcctgcagagcacccctattgacgagcttgtggaaaaggtgaagaagcagctgagagaagtggcggagaagcctggcttcaaggatctgagcccggtggaccaggaagacacacttttggatgcaattagcgcagacgatcagtttatgaaggtaaagccaattgttggtggacaagccgatttctattgtttaggacctcgtaagagaatctatcgacgattcagtggtacagctgcggaaagtgacggacgaccaggggtggggcgcgcacagaaaaatcccgcggtcgcggatcgcggattcaatttgccgcggtcgcggatcgcggatcgcgcaaaaaaaatcccgcggtcgcggatcgcgcatcgcggattcaatttgccgcggtcgcggatcgcggatcgcgcaaaaaacgccgcggatcgcacatttgtaaaagcataattagaaaattcccatattatcaataatcaaaattgtaaaggataatattatgatgaagaaaaataagccgttcgagattttcatgcgagagactttttcggaggtcattcaaaataaa

SEQ ID NO: 76784 - DNA, 433 bp, Heterodera glycines
  Genomic contig location: Contig_ID=SeqID_13009; Location=13..445; Strand=-
  SCN-specific regions: Sequence locations=1-175,199-203,241-270,292-433
atgctcagtttcatttactcggacgatttgagtgaattggacggagacaacgcgatggcagtgctttatgccggtgaaaattggcacaaattaatttagggggcggttgtaaaggaggggggggggtagcttcttatggaaaacgcaattgcagtgctttacgcgggtcaaaaaatttggagcaaattaattttaattgggtgattaatttataatagttatatcttatatatataaatagtaagaggaagagaattttcctatttgaggctgtgaaatttttggaaaaaaggaatagcgccattcaaaaaagcatttttcagccaaaaagtacggcattgatcgcttggtcagtccgtgtttgcaaattccaattccgaagctgtccaatgttttcctggccttttgccaggctcgtctttttgacttggag

SEQ ID NO: 76785 - DNA, 1395 bp, Heterodera glycines
  Genomic contig location: Contig_ID=SeqID_13010; Location=71..1465; Strand=-
  SCN-specific regions: Sequence locations=1-116,152-331,353-553,576 -792,823-1247,1277-1395
atgtcatcgtcctcaaagcaggggaatccgattgaacggatgaagcatttggttagctcgggagaagacgcggacatccaatttttggtgggggacggagacaaaaaagaggcgagttttttttaatatttcaatttgaaatataatttatgtcaacttttaaatttttcagcttctgccggcgcataaactgattttaaagcacgcttccgaagtttttgaagcaatgttccgttttgactcacagaaagaaaaaacagaaaatggtgagaaaataaaaatttgttgatttttttttgaaattaacccctgctaattgccataattagggatgggattcttagttttttaactattttttctgcggctttaactcgacgagaaatgcacgaaaaacacattctttttcgaaaatttttcatttttagtgccactattcatcactaggaatcactattttggagctttgccactaaaaaaaactatttcggaagttggccactaaaataattttttgccactattttggcgtttcgtcattatttttgccactattttggcatttttgaaaaacttcccaaaattgcaataaaaatgaaaaatataccccaagaatcgacctaaaaaattccaaaaatacacctctaagaaacgaactaaaaattttcaaaattacacccctatgaattggaaaaatttcgcaaaaattcttcccccaaattttttttttcctgttcaatatttgctacgaaaatattttgtaactgcaatcagtgaataaaatctttttccttaattttaaattattttcaaattaaaaaacagctatttaaaaaattacacccctaaatttgtaactttttcgccactatttttaccactattttggcattttttggtcactatttagttaattattttgagattttttatcactaaaaatctcatccttattgatctatcatcgtacctgttgaatgcctaatctactttaaagccttaattattatccatttaccgtacacaaatttattttcaacataattccagggtttattttaggaatttggtgtcctgttttccggtgtccaatttaccagtccacgattggtataaatgatgtaccatcggtactattaccaaataaaatttgaatgattttcgactttttcgagtcgggttagggattcgaattataagggctttcacagttcacagcgcacacaaaaatttgtggatgtcatccgattttttaaattaaaaatatataaaataacgccaaaaaacgccattcgtcacatgttttgttggtatcatctcaaacagtccgtcccctttccctttgtttgtcttttgcttctctctctctctcttttctcattaggatgcaataaa

SEQ ID NO: 76786 - DNA, 2140 bp, Heterodera glycines
  Genomic contig location: Contig_ID=SeqID_13011; Location=17..2156; Strand=-
  SCN-specific regions: Sequence locations=1-109,131-724,747-956,978 -2042,2064-2140
caactgcttggaaatgcagtgccagcgaacaacaacctcagcaatccaatttggcgagttcaattgacgcccgaatttcgaaattttattacgacgcggagagcggaaacacatttgaacaatggttcaaacgttttggcacactaatcgaggacgatggaaaagacttacctgaagcgacaaaagtccgtcttctattgggaaaattatcggacgaggactacaacaaataccgagacagcgtaagtccgacccaacccgatcaaatttcatgggcggacactctcgacaaattgaaaagtttgtacgccgaaacgcgatcgctgtttgtccgacgctatgaatgtttcaaaatcagacaacagccaaatcaggacatcacttcattgatcgcacaaatcaatgcgtcctgtgaaaatgcgaatttgagcctcacaaaggagcaactcaaatgcattattttggtcattgctcttcgagatgagcatcacgacctgcggcaaaagtgcttgaaaatgttggaggatggccagaaaaacggcacagacatcacactgaagcaaattgaagaagagttgcggaccatccaaatggtaaaagaaagcgcactctcgctaatggcacaacccgccgcaacaaacgcaattcacacacgtcctcaacagtggaaggactcaaaaggaaagtcaaaaccttttgtcaaaactgaacaacggagtcacaaccaacagaattgttctaaaaatgtggacaaaggcaaacaccgacagccgactgacccatgtccagcatgtgggtttttaggccattggcgatcggaatgcaaattgaatgatgcaatttgccacaagtgtcagaagaaatgacacatcgccaaagtttgccaacaaaagaacagccagccattcatcagaaaaggccgatcagttctcacaattgaagtgaacacaacctgcacagaggttggaactgctgatcactggtattggcgaattttgatcacagtcaacggcgttaaaatacggattaatgtcgacactggtgctcaagccaccatcatcaccagcaaaacgtggtgcaaaattggcaaaccgaaattgtcgcctgccgacattgaagcaaggaactgcaacggagaagcagtaccgataaaaggcaaatttttcggcatcgtaagcatgggcaacgacgaaccaaaaatgctcacagcatacgtcagtgatgccatcaaacatgacttattgggaatgccatggattgtcgcgctggaagttattcccagggaaataatgttccaagaagtgaacactaagccgacaatcatccaaaaggaagcaatgccaaaggccaaagtgatccaagacgaaaaatcactgatttcggcacttcagaaagatttttctgatgttttcagcaacgaattgggccattgcacaaaagcaaaggcacatttgattttgaagtcggatgcaaaacccgtgttttgcaaagcgaggccaattccgcacggcgccaccgaagccgttaatgccgagttggaccgacttcaacaacttggagcaattaagccaatcaaattcagccattgggctgcaccaatcttggcagtgaaaaagaaaaatggcaaaacccgagtttgcattgatttttctacaggattaaataatgcacgcgaactcaatcgccatccattgcctcgacctgatgacatttatgcggcactcaacggagcagcatacttttcaaatttggatttaagcgacgcttatttacaaatggaacttgacgaacaatcaaaacagctctgcgctctgagcacgcatcgaggattgttccaatgtcaacgtcttccattcggagtcaaatcggcaccatcgatttttcaacatttgatggaccaaatatgcagtggcattccaggcgtttttgcttatcttgatgatgggctcattgcatcaaagacactggaggaacatgtgtcagcgctttaccaacttttcgcgcgattcaatgaatatggcctccacattcaactggaaaaatgcaaatttcttcaaaaggaattgcttttcttgggccacataatgtcttcggaacgaattcaccctgaccccgaacaatcagaattcattcgcaaaat

SEQ ID NO: 76787 - DNA, 569 bp, Heterodera glycines
  Genomic contig location: Contig_ID=SeqID_13013; Location=722..1290; Strand=-
  SCN-specific regions: Sequence locations=1-256,278-307,336-395,417-569
atgtatgcggatcctgccggatcccgcacaaaaatcaaatttgcggatcctgttgcaggattggaattcaaaattttttgccggaccggatccggccggattaatcctgcaaatcctgcattttccaaaaaatgcaggattgcggactgggatcctgcaaaatcctgcgcaggatccggtcctgctccgggctctagtggttagtgcttcaacaataatacagtacttttcttatgagttcgatacctgttgacgttttcttttcctttagttgaaattaaacattaaattttttgactaaatcatcaaaatttaatatatttcaaaataattttgacaaaaaaccaagagaaaaaaaaaattatcagaaattcataaattttttggtgaaaatctgttacaaaatagactttaaatttcaaaaatttttccggcggcgcctgtcggcaccgccggacccctttctcctaaaagtctttagaaaaagaacgccgcgaaaaaaaagatgattcgaaaaacaaaaaaaaaagaaaggcgatcaaaaaattttgggcatttttttgaataaa

SEQ ID NO: 76788 - DNA, 267 bp, Heterodera glycines
  Genomic contig location: Contig_ID=SeqID_13013; Location=2134..2400; Strand=-
  SCN-specific regions: Sequence locations=1-141,181-267
atggtgctgaatccgtcagttgcacgatgtaatttgccaaaaatttacgattggggcaccaaaactgtgtacttccagccccaaacgggcaaagcaatggacgaaaaggcatatgtcggctatatttattttggtaaaaactattttttaatgattttaattaatttatttttaaattaagttccaccaacgttggacccgatgaggttggacattggcaacatttatgattggttcacaaatccacttccatatcaggtcatttga

SEQ ID NO: 76789 - DNA, 98 bp, Heterodera glycines
  Genomic contig location: Contig_ID=SeqID_13015; Location=478..575; Strand=-
  SCN-specific regions: Sequence locations=1-98
atgaacacatcatcttccgtgcgtacaagaagaccaagcagcagaagtccgcttcattcatcgccaacagttcaagccgagccgaagaagccgtgtcg

SEQ ID NO: 76790 - DNA, 105 bp, Heterodera glycines
  Genomic contig location: Contig_ID=SeqID_13015; Location=22..126; Strand=+
  SCN-specific regions: Sequence locations=1-105
ccacctcttctcggtgttttcgtttggcatagttgtaattccaacgcatatttgacggtgaaggagcagaagccgccctaacttcaatcggcaaatcggcacgca

SEQ ID NO: 76791 - DNA, 269 bp, Heterodera glycines
  Genomic contig location: Contig_ID=SeqID_13016; Location=552..820; Strand=-
  SCN-specific regions: Sequence locations=1-269
atgaacacatcatcttccgtgcgtacaagaagaccaagcagcagaagtccgcttcattcatcgccaacagttcaagccgagccgaagaagccgtgtcggtccgtgaaggcaaatgacagaaagtgccgcccataatcagcagatcaatgatggatgatatgatatatgatgatgtaaagatgatgcttatttttaggatatacaatatgtattgtggaataattattgcattgtctgtctgtgctgttgtatatttttacgtgtattga

SEQ ID NO: 76792 - DNA, 585 bp, Heterodera glycines
  Genomic contig location: Contig_ID=SeqID_13017; Location=475..1059; Strand=-
  SCN-specific regions: Sequence locations=34-87,176-363,424-425,563-585
atggcgttgttggcatttatggggcatgccgggtaaaagcgattttacagtacctaaatattgattggctatttgttactgtctccaggacttttgtgacggcacccaagcgtatacgatgagtccatcatatttggtaaatttaaaaacaaatataatttattgaaataaaattggagatttgggacagtcaagaaaacaaattttcatttttgtatcgataatttaaaagataaatcggattggacagacccgggattagtgccagagtctaagtccggcattagcctttttggggggctaaaattggaccaggcttaacatttttgtcttaacttttttttcctcttttaaaatacgatgaaataatatttaaatctttttcaaattggtttaataaaaataatatttaattttttttttcaggtttgtggcccagtcacaaacatcatctcaaagtgtaaccgtgactccattaaacacaatgattgagaacatgagagtgacggaaattagacatggaaaccagaaatagtattcaaaatatcttttttcttcaagaatttttttttttgttaaaataaa

SEQ ID NO: 76793 - DNA, 300 bp, Heterodera glycines
  Genomic contig location: Contig_ID=SeqID_13017; Location=1231..1530; Strand=-
  SCN-specific regions: Sequence locations=1-6,120-120,191-194,287-300
atgttcaattttaaagttttgcttttcttattccctctgctttcatttatcacttatggcgcaattttgccaaattatgaggcaacagcaaagaatgggcccaacgaaacgccaaaattccaaaacaacgatttgattggagacaaatttatgaaatgctgcaaggacaatgaaatttcatgctcagagggtacaattaattaaaaaattggattaattaattgaattttaaatattttagtttgcacttacccaccacctgctttttcattttctgaacaatggtaaaacaaaaataaa

SEQ ID NO: 76794 - DNA, 496 bp, Heterodera glycines
  Genomic contig location: Contig_ID=SeqID_13018; Location=472..967; Strand=+
  SCN-specific regions: Sequence locations=1-82,138-157,179-213,308-496
atgcgcgcgaaggacattagcacatcggtcggtgtgtgtgccctcgcaaataaatgccgtgccgaaattaataatgctatacatatttaatttaaaaaataattctaaatttttctaaaagaaaatttaatatttttcaattttgtttggatttttcttaaaattacatttaaaactcgcaaataatgccatgccaaaaaaaatgctatattcaattttaaaaaataattttaaatttttctaaaagaaaatgtaatctatttaatttttttttgaatttttctttaaaaataaaataaaatattttcctaataatagaacatgcaaattttcatatattttttcaggcgacattggatatactttagaattgagaattccaatcaatctccagtgaccactaatcattaaaaaaatagtcccgaggtgcgcaaaaaccagaaaccggtttaaatcatgaaaattgcaccaaaaatcagccaaaaacacattttaa

SEQ ID NO: 76795 - DNA, 795 bp, Heterodera glycines
  Genomic contig location: Contig_ID=SeqID_13019; Location=105..899; Strand=+
  SCN-specific regions: Sequence locations=1-290,326-655,678-795
atgtactatgccgaggccgagctgtgcgcgaaccggcaattcggaggaatgcgggagcagcgagtgagtgacaggggggagaaatattacattatataatgagcggaagagagggggggggcgagcaatcggaggaatgacagaagggacggggaagcgatcggaggaatgacagaagggagggggaagcgatcggaggaatgacagaagggatggggaagcgatcggaggatcagggcggcgactttaggatcaaaggaggggaggaggactcacaaataatattagggattaattttgtttaattataaaatattttattattgcaatcaattagtaaatgagaaaaataattatggatccaatctgtttttaaataagtcaaaattaacagttatttgtggtgcgactcgcgaacaaatggtggtcacgcggtttgtacgtcaaagataaagcccggggggaattgtgccggcttcgaatggagtgccgaagtgtgctacgggggcagtcaatgtgtcgaagggcggtgcacaaaggcaaaaacgatggacaaagagaatgacgagggaaaagcgaagaaaatggacgacgacggcacggcatttaggaggggcggcgccgaaaggggcgacggatggcattcgacgatcagttttatgaaaaaacgataaacaaattggccgagacaaaagccattctatctgatgctagtgtgtttaattgtgatggagaaattgatgaaatcccaatttttggcactttaatttaaaagtgaaccttttcaaagattca

SEQ ID NO: 76796 - DNA, 101 bp, Heterodera glycines
  Genomic contig location: Contig_ID=SeqID_13019; Location=9..109; Strand=-
  SCN-specific regions: Sequence locations=1-36,58-101
tacattggggcaatggatgttgggctaccgtatcagttattaaaattgttgtttttcaaaaaggatactaaaactgggataaccccattcagagactagtc

SEQ ID NO: 76797 - DNA, 363 bp, Heterodera glycines
  Genomic contig location: Contig_ID=SeqID_13019; Location=1371..1733; Strand=+
  SCN-specific regions: Sequence locations=1-335
aattgttttgaagaaaggagctcaaaaaacgcatttctgcgttaaaattttttcatttggacgtcacttttcgtcactagaaatcacattttggcgacttcgtcactaaaatagttaaaaatcactattttggcgttttgtcactttttttcactatttcgacattttttggaaaattccttaacaaaaatgcaataaaaccaaaaaatacacccctaagaatcgacctaaaaattttttcaaaaaatacacccctaagaatcgacaaaaaaaatttcaaaaagcactcctaagaaatgaaaaaaattttctcaaaaaggtattttcgtggcaagaattttaattttaaaaattattttttta

SEQ ID NO: 76798 - DNA, 2112 bp, Heterodera glycines
  Genomic contig location: Contig_ID=SeqID_13022; Location=1072..3183; Strand=-
  SCN-specific regions: Sequence locations=1-111,144-166,202-314,338 -361,455-502,526-920,960-1074,1144-1330,1363-1519,1570-1572,1621 -1676,1731-2112
atggacaagggcaatctgtggattgtgcccggcttcaccattctcgtgttcgccggcctttggacaacaaaattgtgaacagaaaaagaagaaaggggggggggggagcacaaaaataatttataaagaaaatatttattaatctaacaagaatattcctatttggaattatttgaatttaattcataaaattattaaattcatccatttgttttatttttgttttttacgtatttgctaatttcagatcgaaaatcgcgctcgaagaatcagtttgtcgggtgagtgagcgatcgtacactttttaaagactcaataaattaatatttataattatcattcattatgcatacacagaaactaaaaatatattaaaattatgttttaatgtaattcacaaatatcaatacaattcaaatatatattatgatcaaaaaacatatataatataaaagattgcgatgcaaattatctacataaaatttttttgccattaatacattaatttttgtcaattaaaaaatatttccattaaattgtgtgccctcctttcagagcgggtccatctacgatctgtccggcacaacgttggacgatgacgcgcaacggcactgtcaaaccgcgaagaggtattacgtggcaccggaagagcccttctcgtacgagcacaggtggcgcgaggagcgggaagtgaagaatccggaggtgggtgatcatattaaatttgaaattttgtttattttctcgaattggaattttgtattactcgggttaattttcgatggattagcaaatactgcaataccgtatttggtaaaatgaaatccttctgaagttttatcggtctgcaaaatgcaaaaaaaaaaaaacatttaaaaaaactgagagcaaatttatactttgtgcacaagacaaaagcgataaaaaatgtaaaattaaataaaaattctttatttaaacaaatcactgttttagtggattctatggttttgggcgcccattgtgttcgtcatgtacgtgatgacacgcttttctttggtcactccttctcgaaaaccaagggaaataagtttcaaatataaattaatttaaataatatttttcaaaaaattgaagtatcaatttcaaaaaatttaaatttttcccaaaaatttcaggcatcaatttcaacaatgtcgtgaacgcgtctcagaatgtgctgatggacaacgacggcatcatggaagtggacactgacaagctggacgagcgcattccgaccattgcggacaatttcaaagtggccacctattcacgtgcatttgccggtgcgaatttttaaaaatttcgctttttaaaatttatttaaatcttttataatttcaggcttcattttcttcgagctttcactcgtttttgctcccattgtgctgctgatgttcgtcctaccgttgatggtcggcgccggctaccgtacctggggcctggacgttgcgcgggcgtggtgggaacgcaaggaatggtaaagaattgaaatttgaaaaaattgtttaaaagtattatttaaaaggaatatttaaaaattaaaaagggattttatatttattttattttaagtttttttagttgtactttattttagtatgccttttaaatcaattaaatggctaattttacacctttaatacttttgtttgttaaaattttatttttttaaatttaaatgaataatttatttaaaaataataattgctttgaattattcaatttcttagttttccaaatttcattgcactgtctgtccattttactttgcttcaaattgcgcctgttcaggcatggcaccacccttacgcctgtgctgggcgccgtcgacgagcatcagcagcagcgactgttccagcggccgttgcgcgactgggagcgcagtccgccgcgcattccgttaatcccgaggatcacttactgcgactacaactacgtgtcgctgggcaacacccacacgctgacctaccgctgctatttggatgcgaattggcacgagcggaccgcgctattcacatggtggacaaaatacgggggattaattaacggaaactgaatattgagcgccaccagttgggcgccaataaa

SEQ ID NO: 76799 - DNA, 936 bp, Heterodera glycines
  Genomic contig location: Contig_ID=SeqID_13023; Location=355..1290; Strand=+
  SCN-specific regions: Sequence locations=1-15,51-147,170-352,375 -453,481-665,701-839,861-912,934-936
atggacgatgaagagaatattttacaaaaaatttatttagaattttatttcgacaggaaaatgttcggcgacccaaacgcaatcattttgtatgtcaatcaacccgacctgttcccggtgtgccactttgagcagctccaatttgtgatgttccaagtggaaaagctggccaagcaggacggtaaccatgtgctggtccgtcgggcgtcatttattgaactgcgcaaaaggtgaacaaatttggaaatgtctcaaattgacatccaaatgccattcgagacagggccacatgcttagtaaatagtcagaaatttcgaaaaattggggtcaagatacaggaattgaatctggatcagattttttaatttaaccctatttttgcggtctcatgaccggatcagtatcatggaaaaaaaccctatcatcataatctatctaaactgtggccgaaactttattttaaaaaaaaattaattaattgcactatttctggaggcagcaaggatagcctcctcaattgcccttattatctaagccattggttcatgatccacggatcacttaacgtggatcgaaaaatctgtaatcgaaatccgtatgcataaagaccgttttggtgatcccaggctcacgatccattgttctaaggatccgatcctcgtatcaattttaatttttttctgaaaaaaaaaattttattggattctttgaaaacctaaaaattacattaatccgcagccgaatttctatttttgtttagacttagacttgacgaggccggcgactattcactgtattttgacggtaccaagcgtgttgcattagttcacatggcctacggttatttgcctgaacattatcctgagaaggactttgacctgcgcgtgatgatggagcgttcaacagctatcgtaaaaatttaaatattaaattgaa

SEQ ID NO: 76800 - DNA, 208 bp, Heterodera glycines
  Genomic contig location: Contig_ID=SeqID_13023; Location=1742..1949; Strand=-
  SCN-specific regions: Sequence locations=1-77,103-119,141-208
atgtgtttcgaattttggccacctgttgagggtcgttggggaagaaatgttccaatgtgccgggtttgctcaaaatcttaaaaaaaataaaattaattttatggcatcattttccagcgaacacctgttggattttcttcgttccggcaagttgaagacgaaggtttggcgacagctaaataatatttagaagataattatgaataaa

SEQ ID NO: 76801 - DNA, 184 bp, Heterodera glycines
  Genomic contig location: Contig_ID=SeqID_13024; Location=247..430; Strand=-
  SCN-specific regions: Sequence locations=1-2,24-184
aatttttaaaaaatggcatttttaatttcataaaaaaattatgaatccgtgtacaattggcagcatttttcacatgttcttcaaaatgttaacaattcgtcaaaatatagccaattttttcaccgcaaatcatttttttaaatttaattttccatttaaacaaaaattattacatgaattgacc

SEQ ID NO: 76802 - DNA, 840 bp, Heterodera glycines
  Genomic contig location: Contig_ID=SeqID_13025; Location=793..1632; Strand=+
  SCN-specific regions: Sequence locations=1-92,114-192,214-478,501-840
atggacacacaacgaaaagaaattgaaacatttggaatgcagccatttcatgccattgtaacaccggcgaacacgacgatttggctcaaatgctcccagtggtaagtttcagcgcatttttaattggatttagtctaatgtccatttaatcccaaatgaatttacagcttgcatccggacgatacggaggagttggaggacgtgtggaagcccagtccttcggtcattggaagaaaaatacaacaatttctcaaaaaaattcgtgaagtttgtcactttctgtttcaaatttattttaacaattccagaaaataatacgttctaaatcgccttacgcaaaatctcgccgtgtaaatctggcaacttattgctggcaaaagttgggcaatatcaatgaaaaggacacatcgaagaaaaaatgggtaactataaagagcccaacgtttcagaagacaggcggaagggacaaccaaacggaagtgaccaaattcgtggaagagtaaattggactgaattgagtccacatattcgattttttaactttttaggcttacgaaaaaggacgacgagaacatgagaaatttttatctcggggaccattttgagttggaaatacgcaacattgacgctgcaaaaaaaggatggtatcggtgtcgcaacttaactggaaactatgccgaggacatttcgcaaatttatcatgtggatatattggaacactttcgcactgttatggtagaaacaaaattaattcaaaaaacaaaatgcatgcaaaaaattcagtactcagtagaccaaatgcctgatgaagtgaagaaagccgactttgccgaacgaata

SEQ ID NO: 76803 - DNA, 382 bp, Heterodera glycines
  Genomic contig location: Contig_ID=SeqID_13025; Location=14..395; Strand=+
  SCN-specific regions: Sequence locations=1-382
aaagctgtgctcgaagaagtcgcgactcgattggaagaacacaaaggggatgagacgagcgttgaaagtcaggctgaggaagttacgagtacgacgttgcagcgtggtctgcttcagcacgaagtgggaggaatggaggcacagcaaatggttgtgggtgagcaggcgcaatgcccatctgctgagggtaaccgtttgctgtttttaaacatttaaagaaatgagtaaataagcgtttttaggtgttccgcatgccttcctttgcgccgggtgtcagttccgcgcggattgtgccaacttgcttcgtgccatcggtgctcttttgaaagacttcggcagtgctgcatctgttgacggaggacgcaacaacgggactacctaa

SEQ ID NO: 76804 - DNA, 75 bp, Heterodera glycines
  Genomic contig location: Contig_ID=SeqID_1920; Location=152..226; Strand=+
  SCN-specific regions: Sequence locations=1-75
tccaagtggggaattgaacccaggcgaaaaattatgaaaggtagaaagtttaaccactacacaacatgtgcatgt

SEQ ID NO: 76805 - DNA, 2817 bp, Heterodera glycines
  Genomic contig location: Contig_ID=SeqID_1920; Location=1000..3816; Strand=+
  SCN-specific regions: Sequence locations=1-39,61-236,258-464,487 -565,600-772,794-1257,1279-2817
atgcacgaaagggaattccgttttgaggcgattttggcaccaaaaattgaggaggaggaagtgcaggcgctggtgggcacggagggattggtggacggactcgtccgattcggacgcaacggaaccgtacttgcgtacggaccaacaggtgaacaggacacaaattaaacaaaataatgataaagcgaagagtcccgtggcataatttttaaccctaaggcattttaattattggagggagggaaatccaagaaatacgataatttatcagtgctgttaagtgataacgctcatttagggaccggcaaaacctacacaatggtgggcagccgcgaacggcccggcttgatgagtcgaatgacccgggcactttacgagcaattggccgaaatgggcgacagcgaaacccgcgtttacatttcctttatggtctgatcagcaagcttgatcacttactttgtcagcacacattttcccaaaaaggaactttacaacgaattgatccgcgatttgctgagcacagaaagaaacggtccgttggaactttttgaggtgcggcgaaatgacaggaaaacaaaagccaaacaaacgaaaagcaaattggcaaatgatccattggcctccctttgcgaaggatgagcgtggcaatgtccatgtccccggattgagtcgcgttcgcgcgtcaaacacttcgcgacttcttcaattaatccatggaggaaacgcacggcgaacgaccgaaccaaccgcggccaattcgtaacagacaaagggacaacgaaacgagccaaaactgatcattatttgtaataagtacatcgtcccgatcacatgcccttctgatgatcactttgtggcgagacaatgccgaaaaggggcgactttttctgatcgatttggccgggtcagagagagcgacgaacactcaggcaagaagggcacggactttgtttgacttatcggatcttcagaatcaaggacagcgactaaaggagggggcggcgatcaatcgctcactgctcgccttgggaaatgtgaaatttcaactaaaaatataaatattgtctgattgtttctttttggcaatttaaattcaatgctaattacccccctcccccgagggtcactttattaaggtaataatcttaggtgataaattcgctgtcaaatgcttccgatggccgccgacccgcttatgtgaattaccgcgattcaaaactgacgcgacttttgaaagattcgctgggcgggacgggcgaagacggcgcgggacggacggtgctaatcgcacacatttcgccctcatcgacggcttacaacgaaacgtttaacactttaacgtgagaggggcgctcgctcaaaaaggatgaagatgggctaaaaacgattgatccttttaagatacgccagcagagcgaagggaatcactcgtcgggtgggatggaaggatgccaattttatctaaggatttcctaatttgaagctgccccagcccatccgaagaacagcttccgccgaccggctttactccgacgcggtggaaatgcttcgacgcgaggcgcaaagggcggggcgggcggaagggacggacgcaattgcgcattcgtcgtcactgggaatacgtaaaattagaatggcattccaatttggcattttcgctgggacactttcatcactcctttagtgccaacggatggcaacagagcgcggcgtggaaccgtggccattccgagccgacccttgcagggccattccttttcgttgtcaccgtctatccctccgctgttgaataacagtaattcacttcccggcggccgttctcggccttcaaatgcaccaccagcgaacaacgagtcgaatgccgccactccaaaagtgccgaaattgcctcgcctcggcacttcgctgttcgactctctgcgcgaccaacacttggccaatagcgaacgtcaacaccgccttaggtcagaaaacgtttttgtggttctcatttcttctgtttagagagcggctgctgcaagcgaattccgaacattacgaattggaattggcactgaaggggaggagggccattctgaaggcatgcgaagcgcagcaaacgcacggggagacggagaacgcgcaaaagtgcgaaagggtggcggagagagtgcggacggaagtggcggacaaagagcgacggacgagcgaattggccgacattcggcacaaattggagagagctttgagacggggagagcaaacgctgcagcaaacggaggagcgaatgaggtaaagccgaatcaaagcagaagcgaaaggacgaaagtgatcagtcaatttcagagggttggccaaagaccagcagcaattgcaaatcgtcgagttggtccactcactcgcaacacaacgagcggaaagagagattttggcactttttaatgagtgccatttcattttccattcgattttaggggcggcaattcactcggatttcgctttacaaggcaaacgtttacagaaacaagagaaccaattgaaacggataaagcaatatgaaagaattgtggacagattaattggggcagacaaaaatttggagggtaaaaaaagagaaaaaaaggatttaaagataaaatggcaaaatttaggtgaagaaagagcaaagctgcacagggaatatcgccttttgagaagccaattggacagaatgttgccggtggacaacggactgccgtcgtggaacacacaaatattggcggagagaaatgccaaagcgggacccagcaaaaacgaaaagccgagactgagacaaagcgaaagcatttcgcttaatgg

SEQ ID NO: 76806 - DNA, 86 bp, Heterodera glycines
  Genomic contig location: Contig_ID=SeqID_1921; Location=1879..1964; Strand=-
  SCN-specific regions: Sequence locations=1-86
atgtaaaaattaacagaaattctcgggttcattcgatagttgcgagaaattccccggagaaactccaaaataatgtgaaattgatt

SEQ ID NO: 76807 - DNA, 4565 bp, Heterodera glycines; identical to SEQ ID NO: 1922
  Genomic contig location: Contig_ID=SeqID_1922; Location=1..4565; Strand=+
  SCN-specific regions: Sequence locations=1-179,201-990,1012-1528,1550- 1606,1628-1671,1693-2418,2440-2984,3008-3282,3311-3473,3495-3553,3575- 3639,3808-3872,4046-4110,4288-4318,4465-4565
  Gene Ontology: Mol. function=chemorepellant activity; Cellular component=extracellular; Biological process=neuron differentiation

SEQ ID NO: 76808 - DNA, 336 bp, Heterodera glycines
  Genomic contig location: Contig_ID=SeqID_13027; Location=1376..1711; Strand=-
  SCN-specific regions: Sequence locations=1-62,85-161,217-336
atggtggtgcaattgacttttttgatcagtataaaaggttataacagtctaaagtttttcagattttttcttcctctataaaaaatgttatcaatcttaaaaaaagtgaactcatatttattggacggtcatttttgccaaattattgcataactttggataaatttctgtaaataatttataattttgaacacttatgcaaattcgtttcagagacggtatgccaaagattcaaaatggctgaaaggaaaccattacaaaactaacattcaagcaccgtcgcttggcttttaattgcaaaaattggcatttttttggtgaaaatcagttaataaa

SEQ ID NO: 76809 - DNA, 74 bp, Heterodera glycines
  Genomic contig location: Contig_ID=SeqID_13027; Location=593..666; Strand=+
  SCN-specific regions: Sequence locations=1-74
gtcgccagaagaaagattagttttgcataccgacaaactgatcaacgaactgatcgccaaaatcgacctgaaaa

SEQ ID NO: 76810 - DNA, 314 bp, Heterodera glycines
  Genomic contig location: Contig_ID=SeqID_13030; Location=92..405; Strand=+
  SCN-specific regions: Sequence locations=1-13,44-182,204-314
caaatgataaagctgacaagaaaagggaaaaaggagagggggttggagattcagttgatggcattttctgttctcgtcctcctcctgccaccgcttttgctgtgtttgttacaagcgtcgaaaaaaatagcaccaaaaacgaggaaaaggccgcaaaaaccctgcaaattgattggatggacgaagtaaagagaagagagaatgatggagaaaatttggcgaagtgtcataatgacggaaagaacgacggggccgaagttttggatggtcaaataaatgaacacctggcaaaagcaaattcaaagaaaggctaa

SEQ ID NO: 76811 - DNA, 2158 bp, Heterodera glycines
  misc_feature (6)..(6): n is a, c, g, or t
  misc_feature (41)..(41): n is a, c, g, or t
  misc_feature (99)..(99): n is a, c, g, or t
  Genomic contig location: Contig_ID=SeqID_13030; Location=141..2298; Strand=-
  SCN-specific regions: Sequence locations=1-238,261-899,921-1055,1077 -1332,1354-1543,1566-1702,1724-2004,2026-2158
  Gene Ontology: Mol. function=UDP-galactose transporter activity; Cellular component=microsome; Biological process=transport
tttatntaattaaatttgttttttttcattctgtcgacacnacttcgctcattttgcgattttccaatgttttttcttatcattttgtctatctttttngtagctttcgctcggtctctttgctctccgtcgtcgtttttctcgacgattgtcgcaaagaccgccgcgtggatgctttttatatgcgccggcgtttaatttatcctcaaaatttgcatctctctctcgcgagtgtgctctcattcagtaattgtttcatttggttgcttccgatttaagtttggctgtttcaggatggttaatgtttccactttcgcattattattcccgtcttcggatgacccctccgccgatgtcttttggctgttccgacttttgcccactttgactgcctacggcactttgcttctcctcggctactttatagtccgatgcattcgaaaagaggcgaaaagtagcacacttttcttcgcatcatttagcgtaaaaatgtgtagggaatgccaatattttccgccgccatttccttttgcgattgcttcgccaattcgccgtcggacaatcggccgaacttcggacggcccaaagcgcgaaggaaaggggcacactttcggagaaggaacagctgagagacggggcggaggacgaggagggagggcgcatttgttcagtcggcggcacggcacaattgcggagacggaagtcgttgttggctgactgtctgtccgtgtccgtctgtttcgccggaatccaagtcattttgtccatcctttgtgcatcgatcccccccccccaccgttttcaggtgactttgatttgtatgggcttcttccaggaacgcattgtgacgcgcggttatccccacagaacggagccgaaaaggacagactttttccgggacactcagtttttggtgttctccaatcgaattgtacgtactggcattgacccaccaaatgaccccgctgttttgaggtggcattggcactttccggcgcttatcttttcgtcactcggaaagcgcagcctccgcacgttgcgcccctttacctgcactctttttcctccttctccaatgtcatcgcttcgtggtgccaatacgaggcattgaaatacgtttcctttcccgctcaggtgccattcttttcaccgttggagtgccatttaaagcaattcccccccccccattagactgtgtgcaaagcatcgaaaattgtgccgacgatgctcatgggaatattgctgcgcggccagcgctattccaccagccaatatgcttttgcgctgaccctcgtcctcggaacttcggtgttttttctcgccacttcctcggattcttcccatttcacttccgctcgtggcacttcccattttgaaaaaccttctgagaaggaagaaaaaggcctttttatcgttttggcacaatctttacgggcttattccaacgctgtttcgggttttcttctgatgctcggctatttgctgttcgacgcgttcactccgaattggcagaaaagtaaggatggtttattgttagggttcatttgttttatttggttttctttgatcggtcttggcccattaatttaaatttgagaatggcctaatgaattaattggtttcagaattgctcgaacaaccgccccgaatttcgtgctcccaggtcctttcgtgttttgttgtccgttcgttcgtcccctcatcattttctttccattcagatgatgttctgtgtgaatgcgttcagtgtgctcatttgtctggtccctctcctccaacaatggactttgccctcctccgtccattttctgtttgtccatgagtccgttttggtcgattgtctgttcctttctttgggctcgtcccttggccaggtcatttattcacattcccttagcctttctttgaatttgcttttgccaggtgttcatttatttgaccatccaaaacttcggccccgtcgttctttccgtcattatgacacttcgccaaattttctccatcattctctcttctctttacttcgtccatccaatcaatttgcagggtttttgcggccttttcctcgtttttggtgctatttttttcgacgcttgtaacaaacacagcaaaagcggtggcaggaggaggacgagaacagaaaatgccatcaactgaa

SEQ ID NO: 76812 - DNA, 768 bp, Heterodera glycines
  Genomic contig location: Contig_ID=SeqID_13032; Location=48..815; Strand=-
  SCN-specific regions: Sequence locations=1-227,249-255,278-552,588-768
atgcaaagtgacgaagacatcggcagaatggtggccagtgtgccggtggctatcggcagtgccatggaagtttttgcggagaaattgttgctcgcagcggccgaaagtgtccagcacagttcaaccaaaacgctctctccaatgcacatgtaaaggaagaagcggcaaataagcaaattcttaaagggagaagcggaatgagaaattgctacaatagttagagtggaatttagacttttgcttccgttctttcaaatcccaactttcagcaaaatggccgtttctcgcgttccgcaattttcttttttggagcctatgttgagggatgttccgatgaacccgaaaatggccccctcttttgtacagcaatcgtcttcaacgtccaacggcgaatgaggcgatgctttccgtttaaatacctctcacattggacattcatttaacaaggctttactgcgattgcttcagttaatctgtaaaaatgagacgacaatttatttttttattttatctgttgttttcaaaacggaaaatatttttacgatgcggcggattattattaattaattaattttaattattattttggatagaaatggaggagaaagccaagcaaatccgattgccaaaaaaggcggagaaagtgaagaacaaggtcagtcagtgcccgacttccattcatttccaatttttcctcttaaggcggcggccgtcgttcaaatcactgccgagcaacttttgcgtgaagcgaaggagcgcgagttggag

SEQ ID NO: 76813 - DNA, 899 bp, Heterodera glycines
  Genomic contig location: Contig_ID=SeqID_13033; Location=53..951; Strand=-
  SCN-specific regions: Sequence locations=1-100,122-171,267-380,402 -485,507-575,598-872,894-899
atggcagtgagctgttggctggccgacaaaatgatttgcgacctgtggcttcagcttggcacgccgtatttgcatgccatttggcatttgttggctgcttatgccgggtgaggaaaagataattattgatttttctaataaattttcgcgccctccctggagagagcgctgtccaaaaattgggtttaacccataagcgtccccctgcacggaaacctttagtaaaaggcgaaagatttcatcgtccgaatacagaggaaccagggataaaaaacagcgggtaaaatggatgaatatttggaaaataaaaattatttatgatgagttaaaacagaggagggacaaggaaaaatactgcgttatatttctcccgttgtatgtcttctttgccttctctctttggtgcactctctttcagcgaaggaacaaacgcagcgaaaagcgactaattctttacctttttttattcttggcaagataaaaatctgaagccaaagcctaagaaaagattttaagattagcccttgatttttgaagctttccgaattcgccaaaacaatttcccgatatcaaattccattttggtgataggtttttgttttatttggtgaaggtggttctccattagtagcttttttaggcctaattttttagatgttttcatttttattaaaaaacgacaaaattatgaaacaacctaatattttttagttgttaccgaatagcatttcttttttcggcaaaaaatatttacaaaatgaataagggtcgtttcggcgccagcccaagtttttggactgttaattttttcactgtcaatcaaatccaataatcttggtatcattcgcaagcttaacatgtatattgcttctcaattagaggacccaaaaattattaaa

SEQ ID NO: 76814 - DNA, 351 bp, Heterodera glycines
  Genomic contig location: Contig_ID=SeqID_13033; Location=1094..1444; Strand=+
  SCN-specific regions: Sequence locations=1-109,133-146,236-303,349-351
atggcacagggcaatgaagaagctatcaaaacgaatgcattcactcgccggttcaataaaaccgagaacggacaccgaaacggacaaaagaatgacggccaaacgaaagtgaggcctaagggggaaaagaatggtcaattagtgggaaaaaatcaataatttaattatttacatttaaaatttaattaaaatacaatatatgttgtaattaaaacaaattttcaaaataaaatttgaaagttgtagctaactcctaagtttctgttaaatgctttcctcaagaattaacatgttttttaagccaaattattatgatagaaatttatttttaaaattaaattaatttttgta

SEQ ID NO: 76815 - DNA, 718 bp, Heterodera glycines
  Genomic contig location: Contig_ID=SeqID_13034; Location=829..1546; Strand=+
  SCN-specific regions: Sequence locations=1-203,225-234,257-355,377 -436,504-693,715-718
atgttccttgagcagtttgcgcggcaccatattgtggttgagcagcaccggcgtgtacgccaccagacacgtggtcatcatgtgcagaaggaacagttcgtccaccaattggccgaacagcgaaagggtggcgtggtaataagccgacgcgagcccattaagtgcgagaaaagcgtggggacaaatggccacggggttcacccggctgagaaagggccacaggcggacgacgttcagcaggggcaacagcagcagcggaaggttggaaatagtgttggcaaatcggaaataaaggcaaagacaatttaaaaagtgccaaatttataaatcaaatttttagttgggcaaatcgcaaccgaaaataatggaaataaaattgaaaaacatttaatgtattaaggaaatggatgtatttgtaattagtttaaaatttgggaatttattaaaaattaaaagataaaatattttaaaataattgaaacaatttatattgtttaaaaaatgttcgaattttcttagccaataattcttaaaaaaggaaggaatattgaaaaaataacaacaactcactcggcaacgaatggcacaattttgtatttgttgtcggacagtgactcgcaccagggcatgcccgactcaaaggcgaaccaatggtccattaaagtcacaaattgtcaattatctgacaaaacattttaaaattagattttaaaataga

SEQ ID NO: 76816 - DNA, 1502 bp, Heterodera glycines
  Genomic contig location: Contig_ID=SeqID_13034; Location=1..1502; Strand=-
  SCN-specific regions: Sequence locations=1-171,239-298,320-418,441 -450,472-1111,1147-1166,1215-1300,1322-1345,1393-1401,1430-1502
  Gene Ontology: Biological process=brain development
caatttgtgactttaatggaccattggttcgcctttgagtcgggcatgccctggtgcgagtcactgtccgacaacaaatacaaaattgtgccattcgttgccgagtgagttgttgttattttttcaatattccttccttttttaagaattattggctaagaaaattcgaacattttttaaacaatataaattgtttcaattattttaaaatattttatcttttaatttttaataaattcccaaattttaaactaattacaaatacatccatttccttaatacattaaatgtttttcaattttatttccattattttcggttgcgatttgcccaactaaaaatttgatttataaatttggcactttttaaattgtctttgcctttatttccgatttgccaacactatttccaaccttccgctgctgctgttgcccctgctgaacgtcgtccgcctgtggccctttctcagccgggtgaaccccgtggccatttgtccccacgcttttctcgcacttaatgggctcgcgtcggcttattaccacgccaccctttcgctgttcggccaattggtggacgaactgttccttctgcacatgatgaccacgtgtctggtggcgtacacgccggtgctgctcaaccacaatatggtgccgcgcaaactgctcaaggaacatttgtgagagagagagaagagcatcatgccaattcggattgggttactgatcaaagagaagggcatcatgccaattcggattgggttactgatcaagaatatggcatatattttggcctatttcgaatctcggaaccgaattaaaataaaagtcgaaattcgaatttttcagaaattctcttttatgttcgaatctttgtgtaatgattattttttgttgttgtaatggtttatgatcagtttttgcttgttttaatttattttagaacaaaaatcgaattttcaaaaattggggtttagactttttgttcgaatccggggttcgcgatgggccaagatgggtcgtgattagcacaataaatcagcatagaaaaaattatctaaaaaaatttgcggagggtgacaaaatctacaagtaccttattattatcaacaaagaatataaaaaataacttttattaaattaaaaaaaagcatcttttcattttcttgcaattatttttgttttattacaaaaattaatttaattttaaaaataaatctctatcataataattcggcttaaaaaacatgttaattcttgaggaaagcatttaacagaaacttaggagttagctagaactttcaaattttactttgaaaatttgttttaattacaacatatatgtattgtattttaattaaattttaaatgtaaataattaaattattgattttttcccactaattaaccattcttttcccccttaggcctcactttcgtttggccgtcattcttttgtccgtttcggtgtccgttctcggtttcattgacccggcagtgaatgca

SEQ ID NO: 76817 - DNA, 885 bp, Heterodera glycines
  Genomic contig location: Contig_ID=SeqID_13036; Location=923..1807; Strand=+
  SCN-specific regions: Sequence locations=1-10,32-282,306-380,402-885
atgcttttcctcccacttcttctggtgcttctcctccctttgtactcctccgtcttcgtccaatctgtttcccaacggcgtccggtccgaattacgcccttcctttactccgacgcgttgaacatcgctgcggctggagggtatgttgtgtattttttgaacaaaatttcagggaattttgtggcatttttcagggttttccgccttctcccctcgccgaagcaataagaatttttcaattttttaacatttttttattctcagaagaacataaaatacaacaaaaatttttttttataaattttggcttttctccagttctgttgctcctctgaagaaggaaaatgccatgtttgatgtgccaacaaagtttggctgggacagccaaacgatgcgccagatcactcccttcctctattcatcagtgaacagcggacagcagcaggagagaaagcgatttgaataacggattataatgtgaatgatggtgataatggagatactatactaccgtataatttctaccgttgatggatgtgctctgatcagttataagcaaattatgggaatttgatcattcaaattaataatatcaaaaagttgcgtctgcgtattttataattgtacaagtgcattacatttgtgagctagctgtttttttaatgtacatgccatagcaaatagtatagcaaaattttgctgccttttcatagtttgaattttacgaaattcggtgcccattttttaaatacgcaaatggcgctagcaatgtttatcccctgctggaatctctatcaattcgggttatatctctcaaatatgaactatcatcatatgcaggtttattttccatttagaattctatataaaccaagaagccgaaaa

SEQ ID NO: 76818 - DNA, 2526 bp, Heterodera glycines
  Genomic contig location: Contig_ID=SeqID_13037; Location=154..2679; Strand=-
  SCN-specific regions: Sequence locations=1-450,472-496,596-773,797 -1153,1201-1375,1397-1874,1898-1950,1972-2181,2281-2399,2421-2526
  Gene Ontology: Mol. function=structural constituent of muscle; Cellular component=striated muscle thick filament; Biological process=striated muscle contraction
atggcttccgacattcaaatgatgcacttgaaaagagcatttgattggtatgaagagatgaagtcacagttggaaataatccgcttcaaaaaggtacaaaacttgcttagaactgatggattagctcgcgaatgaaagcaatggtaaaacattgcataccgtacgacatatgacaacgttgtataccgtacgcacaacattgactttggctactgtagccctctaattaattcataaaatcatttttatagaaaatttgaaaattttggataaattaatttctcttcggtttcagcaagcgcttgagaatgagtcggtggaagtgaattcgcgccttgccaacgaagagtcgcgtgcgattgaattgcaaaaggagcggaaacgcaccgaagcggagtgcgagtcgttgcggaaaaacatcaccgacatggacgttggcatgcgcaaattggaggcggagaagcaggccaaggacaaccaggtaacggaaaagagcaattaattaattaattagcaataattagacaaacgaattgaaaattaattaatcaattggcgataattagcaatctaatcgaccattaactaatgaattggcaaaattagcaaacgaattgacaattttttaagttacggacactggccgatgaactgcacaagcaggaactgaccgagtccaaactggccaaggagcgcaaacagcagcaggaacttgcagccaaactgcagaacgacttgcaaatggaggcggagcgaaacgcggcggagaaagcgcaccgacagaaactgcaacaaactttggaggtggccaaagtttcaaattctttcaacggcacgccgtgccttaatttcaataaaacaaattgtcaaaaagtacagatattattttcttttgtttaaagtcgggttgaaaatgaaatggaccgcgagcgtcgtgcacgtgccgagcaggagaaagcgcgccgcaagttcgagggcgaagtgcgcattgcacgcgagaatttggacgagatgggcaagcagcggcaggacatggagacgagtctgaagcgcaaggaggccgaccttttcgcactgtccgtccgttttgaggaggcgcagtcgcaaggcgcgaaattgcagcgacaggcgcaggtcgaaacaaatttgggacaaaataattaattaaaatatttttaattaatttattatttatattttgtgtgccttttttaggagatggacgcacgttgtaaagagatggaggcggaattggaagcggaacggcaggcgcgggcgcgctccgagcgcggccgaggcgaaattcaatacgaagcggacgaactgcaggagcggttggaacagcaggcgcaagcgacgcaatcgcaaatcgaagcgaacaaaaagaaagacgctgaagtggcgaagctgagacgggaaattgaccagctgaagttgacattcgaatcacaagcgaccgcactgaaaagtaataaattgggaaaaaagcgaaggaatcgcagtgatcaaagggaacgaaaaaaatgtaaaatcatcagagggtagggtacaaaaaaacaaaatattaaaattcctttgcggcaattaccatcaaaggactcccataatattccttttcatcacaaaaagaaatcggaaatatttatttttcggcgaggtttgaaaatttgaaaaacccaacgtcctgctacagtttctggtcaaggacaatttcaaaaccaatagcaattttcgaatttcaaaatgggaatgaaaaaatggccaactttatttaatcaattagaccaaggagttaatggagttcattgagtccgcatttatatggatgaggtcatttttgattttgtgaccccttctaaaaatttcttaaattcgttaattttcaattttttgtagaaaagggagcctcgggctgcacggaattgcacgaacaaattgaccaagtgcaacggatgaagaacaaagcggagaaggagcgcatcgcaatgcaacgacagctggagatgcagcagagtcagctagacgacgaggcgaagcagcgcatggatttggaacgacgggagaaggcatttgagggccaattgttggagttgcggctgaagacggaggaacagtcgcgacaaattcaggcagggcaaaagcaaacggagaaagcaaaatggagacatttaaaatcaaacaaattaattaggaaattgagacgaattaattggggaattaaaacgaattaattaagtaattaaaatgaatcattattgaattaccgaaataattagctaaagaagaatattttaatgttcctccgcaggagttgcaattctccaagcagcgcctgcaggccgagtgcggcgagttcgggcgccaagtggaggacttggagtcgcagtcgaccgctaccggacgcctcaagtcgcaattctttgtccaagcggaggagttgaagcgtgccgcaacggaggaacagcgcgagaagcaggcactgagcacgcacgtgaagaacctgcagcacgagttggagcagctcag

SEQ ID NO: 76819 - DNA, 1829 bp, Heterodera glycines
  misc_feature (860)..(860): n is a, c, g, or t
  Genomic contig location: Contig_ID=SeqID_13040; Location=62..1890; Strand=+
  SCN-specific regions: Sequence locations=1-335,358-597,619-639,661 -1045,1072-1708,1730-1795,1817-1829
atggaaaatgctgaaattaaatctcaacgaaaaaataaaaaactcgaacatgaaggctgcctgtatgtcttccatttgttgaacgccgatggtgacgtaaaattttggcgctgtgaacatcagcacggcgaattcaaatgtcgagggcgcattcacacaacgctcaatgacgtcgttctgaagacaattggtatacacacgtgcaaccgcagcgcggcaaatgtcatcgcacaaaaaatcaccaccggcattaaacgacgtgctgctgaaacgatggaaacgccagcagcaatcagggcacacactcttcagcaaattccaacgccagtaatggcgaacattccaacaaagaacgcgacaaaaaaagtgaaaaatctatttatttttttacagttttgagtttaagctggtgaagcgagtccgccatgaaattgaattgccgccgccagtgccggtaacgcttcaagaattggaacttccagagcagtacagaatatacaaacgcaccgaagaaacgcaggagcttttccttcttgccgattctggaacgtataccgatcagaaccgagaaggacaacaacggtgtgtttaatgggaattttcagccatttctttaattttagaattctcatttttggccggctttctttcggaaattgggcttccgaaatgaagtacatttacgctgatggaaccttcgcagtgcaccggcgctcttttcgcaactttacgtcattttggcgcggtacttttttgtcaattttgtttttcaatcattttctccaaatttcagtcgtgataaatgggtgtttccggtccttcactgcctactgacgtgcaagtcgcagtccacgtatganaggatgtttgacatggtccgccaccgctggccgactttttggccgacaaacgcttccatggacttcgaacaggcgatggtcaacgccttccgtgctaaacatccacagtgctcaatcaacttttgcttattccatttggtgcgcaacatgaaagcgcgtcttaccgacgagcaaactcacgtgagaattttttaaaattaatttttaaattctcaaatttagcgtttcaaaacagacgcagcctttgcacgagcagccaaaatggtcacttcgctggcgttcgtgccgctggcggaccttacacccgcgttggcagcactagaagactatctacctaatgagcttgagggcgttctcgattggtcggttgagttaaattttttttcaatttcattagtaaattttaaaggtttgtaatcaactacgttggacgtcttcgaaacaacggcacacgcactcgtccattattccgtcccgaagaatggagtgtgtacgagcgcacaatgaacggcaccaccgcacaaacaacttcgccgaagcgtaccatcgcacgttgcaacatgcgatcggaatcggacaagcacacccgacaatatggaaattcatcaacattttgcgtgagcaccaaaaaataatcgacgtggacttcgaacatttccttgccgggaatgctccgccgatgaaagcaaagcgttaccgtgaagcggacagacgaattttgaggattttggagcgctataatcaggaaaaagcgccgccgcaaatcaacgatgatcaccaatacggccaaaatcaaaataacccgaatttgttcattgaaatgcttgggggaatttcgagcaattatcaaatggattgttaattttttgttaattttatttgttattacattttggataaaacggagatttttaaaaattgagccaaagcgatattttgatgaataattttaaaaatcagaacatgaaa

SEQ ID NO: 76820 - DNA, 277 bp, Heterodera glycines
  Genomic contig location: Contig_ID=SeqID_13040; Location=2445..2721; Strand=-
  SCN-specific regions: Sequence locations=1-208,230-277
cccaaacagcttaacaatagttcccggcgcggctgacagcagcagcattgaagagaaccgacgtttgacatcgacaattgaggaggaagcggtgccaccgccgacgacaccgacaaaaaaggaacatcccggcccatgagttaattaaactttgaaaattgaaaatgaatggatcaatcaaatcccgctcattttaaatcatataataatttgcattttgtgtatctctctcttaacatttgcttgccattttgtgtcggataaagaaaaggaaaaa

SEQ ID NO: 76821 - DNA, 798 bp, Heterodera glycines
  misc_feature (17)..(17): n is a, c, g, or t
  Genomic contig location: Contig_ID=SeqID_13041; Location=508..1305; Strand=-
  SCN-specific regions: Sequence locations=1-133,167-321,344-798
  Gene Ontology: Cellular component=integral to membrane
atattacaaataaaatnttgaaaaaaaaaattctaattgccttttctttagtggggtctgatggacgattcgcagaaggaatacttcacgggttggatcaaatggtgtgaaatgtgagttccacccaattaaaaattaattaaataattaattaatcaattaattattttccaattaatcagccctaattaagcggcacccaatacattccgctctcatttctgctcggtttcttcgtggctgtggttgttgcacgctggtgggagcagttcaactggatctcgtggcctgacaaattcatgatggtcagtcggacgggccattaattaatttttttttttttggaattcccgaaatctcgggccaattctcggtcttgagatttgtggcggctaaatcactgtcgagagagacacattgacatgattctaggccaattccggctctctctcaagtgtaaacctggcacagacaaatctcggtctcaaatcttgaaactgaacccttgagacgaatcatggagggacgccaaattgattgggattgaatctcgagaaatatcgacaaatttccattcctgcgcagtactaatatgtgtgaacaccccccccccccctctgttgatcacagtgtgtgtccacctgtttgccgggccgtgagaatttggagacgcgccgaacattggcccgttggaccagcctccaatcagcgatcgcgtggaccggcatttcggtgcgaacgctgaaacgattcccgaccgagcggcatttggtggagagcaaactgatgacggaagaa

SEQ ID NO: 76822 - DNA, 371 bp, Heterodera glycines
  Genomic contig location: Contig_ID=SeqID_13042; Location=32..402; Strand=-
  SCN-specific regions: Sequence locations=1-103,141-371
atggacatttggtcggctgggattacgatatatgaaattattttctccaattattttgtcattgaaacaaattcaatgacaatcaatcaaggggatttatgggtaaaaaataatttaaaaagttatttaatatttattttcagccaaatttggcaaacaaaatgacaaaaattggcgaattgtaccgcagtgccaaattgtttgagaatccttccgctgtaacacaacaattatttgccaagcttgatttgccaaatggaaattggaatcctggcagaaaggattggtggacacgctattcgggagtgatcttgaacattctcgacatatggggcacacatggaatgcctgaaattgcctgcctattaggc

SEQ ID NO: 76823 - DNA, 948 bp, Heterodera glycines
  Genomic contig location: Contig_ID=SeqID_13042; Location=619..1566; Strand=+
  SCN-specific regions: Sequence locations=1-41,64-108,178-384,424 -426,450-474,496-948
atgcatacattaattccattgccgcccgttgcactgactcctgctgaaataattctttcaaaaattttgttcaatatgcctgctgatggatcttggaagtttctttgctttaataaaagaaaaatacatataataaattttaaattttgataaataaaatgcaaaaaaatattttttgatgttcgatttaagattatgtaacgagttgaaaagcgccaatttgtctacagtttctcttgctttaaatggaatacggtagtttttttaaaattaaaaatggataaccattaacagttcaggcgcagtataaagaaatgtgacgatcaaagaatttggatcaatttgtccagttcggtgatattcgtcatcataaaagatacaaccttaatttattaattaattactaaaataaaatttatatttgaattccttaaaaagagttcataaatatgaattatttaattcaatgatgttacactattttaatcaaaagctgaattaattaattaatccttaaatttggcaatcaaaggccgccttcccctactatttaaggatatcgtgccaaatttggcaatcaaaggccgccttcccctactatttaaggatatcgtgccaaatttggcaatcaaaggccgccttcccctactatttaaggatatcgtgccaaatttggcaatcaaaggccgccttcccctactatttaaggatatcatgccaaatttggcaatcaaaggccgccttcccctactatttaaggatatcgtgccaaatttggcaatcaaaggccgccttcccctactatttaaggatatcatgccaaatttggcaatcaaaggccgccttcccctactatttaaggatatcgtgccaaatttggcaatcaaaagccccctctccaaccttttaatgatttttttcatttttatggcaaaatttaaattttag

SEQ ID NO: 76824 - DNA, 814 bp, Heterodera glycines
  Genomic contig location: Contig_ID=SeqID_13043; Location=521..1334; Strand=+
  SCN-specific regions: Sequence locations=1-106,365-372,396-611,651 -676,809-814
atggtaaagcaacaccaacaggaacagcgcagaaagctggccatgttgcgcgaagttgagaggtacttttaaggggcgtttttagcgaaatttttagcctgtagtcaatttaatatttattttttgtaataataaaagaatattcaaatataaattataatttattataaaattattaaccaaaaaatcaattattcaaatataaattataatttattatgtaaaaattattgaccaaaaaaagaatcaatttaaaaaattttgtaaaaagctcaatataatattatataaatttaaagttaaaattattaatataaaagttaaaaggcaaataatcaatgaaaaaaaaaaaaatttattttttgggaaaaggagaattttattactttttcaacggggtcgaataaatagaaataaaatctaactctgcctaactaacaatgagtgaaaatctgactcagaaatcccatattaattaaataatccaatcaattttctctagctagcattttttttcaatcaaaagcgaaaaccaagggttacaggatcaaaaatgatcaattttcatcaaatccaaaaatattggccaatatctttgccattgttcttgcattatattgaaaaaaaattatacaaataattttaaatttgtagaaaatttctttttcttctcacctataaaatcataattaaaaaaaaaattattaaaattattctaatttacagttgattaattatgcaaattatacaaatagagaacaactaattattttaataatgttaaattaaatattttgttaaaaaatttctatta

SEQ ID NO: 76825 - DNA, 319 bp, Heterodera glycines
  Genomic contig location: Contig_ID=SeqID_13043; Location=2026..2344; Strand=+
  SCN-specific regions: Sequence locations=1-238,276-319
atgccaatcgccaattcggcactttatgccaagatggaccaatgcgattgtgccatgtttgcagactgtccactgggcaaaacgcgtgccaccccggcacagcgatgccggcacagcgcaacgccaaggcacacaaagaagcggcacacagttggcgccgcacaatcgacgccatggacacgaacagaaatgccgcaagccgcttcgtcggaggacattgatgatgccaacgaagatgattatcatgatgaaaaatcagtgccctcactgtcctgccagtgccgaaaacggcagtgcccagaatgtgccaaacatgcgg

SEQ ID NO: 76826 - DNA, 980 bp, Heterodera glycines
  Genomic contig location: Contig_ID=SeqID_13044; Location=1797..2776; Strand=-
  SCN-specific regions: Sequence locations=1-301,323-468,490-736,759 -777,802-930
atgaagcgaaccaacgcatcaaacatcactccgcctcgcgcaaaacgttcaatggcacctgcacaggacctggacccaaacgctgtcgcactcgcggagcaagaacgacaacgcaccctggtcttcattggcctcccggaaagcaatgccattcgcccatcggaacgtgttcaggaagacagggaagccgccacaaaaatcctggaccatcttgaagttgaggcccaaccaaccgccgtctttcgactcggacgttacgacccgcagcgaacaacaccacgcccgctcaaggtggtcatgccaacaaccacacaccaacacatggcactcggaggatggaagcgcgagcgtgctcgactccgttcgcaacaaaatttggcccgtctgttcgtccgcccagcgctgaccaaagaacaactcaaggaagaatatgaagcgcgcgtccgaaaacgtcaacaaaaccctgctcccgtggcaccagcaatgcaacctcgccagacaaatgttccgactcccgtcaaagaaaatgcaccaaaccagaaggaggccagcgacgacatttccaaaccgctggaagtttttgaccaaacaatcctcgtatgttatgaagcattaaaatcattaccaccaaacgacaaaattgttcaccaaattcaatcactcgaaaaacaataccctcgtcttttcaataaatagttctgtcagacctccaaacatttcctcaaaaaaaaatacatttattccagtacttcacatttctcaccaaaatttttcctcaaaaaaaaaaaaaattttttttttctcctacaaccctaaaaaaaacaaccacttttccctttgttggaggtctgacttttctaatttctgcttctccattcaaaatttcaattcttttatcactgctttccatttcacctcatttccgccaaaagtgtaagtggcacatgtccttcttttggttatttttatttttgaataaa

SEQ ID NO: 76827 - DNA, 325 bp, Heterodera glycines
  Genomic contig location: Contig_ID=SeqID_1925; Location=123..447; Strand=-
  SCN-specific regions: Sequence locations=1-34,56-97,126-303
atgattatcactttttttcagcagaatggggaaacactgccgccgccgccaacgcaatttacaatggtcggaggagtacccgtggcactgtcacctgcacaaactgctgctgctgctggggttcaatttgttccgagtgagtgttgcgtggattttgaacatcattaacattgtatagacccgtcatttcccattttcagagaacgattcaaagtatgagacattggccagtttggatgcaaacatctttgtgaagttaacatgcatcggattcgaacctggaaccccccttttggtgactagcacatacatatgtatcaattaa

SEQ ID NO: 76828 - DNA, 1089 bp, Heterodera glycines
  Genomic contig location: Contig_ID=SeqID_1925; Location=1259..2347; Strand=-
  SCN-specific regions: Sequence locations=1-16,39-1089
  Gene Ontology: Mol. function=structural constituent of muscle; Cellular component=sarcomere; Biological process=striated muscle contraction
cacaagtgagcagcaaccaaatgtcggacgagccaccgccaccagcagcgccggagacgcccaaggaaccgccaacacaagcgcaggaagtgccgccaccagcagcgccggagacgaccaaggaagcgccaacgcaagcgtcagaagtgccgccaccagcagcgccggagacgcccaaggaaccgccaacgcaagcgtcagaagtgccgccaccagcagcgccggagacgaccaaggaagcgccaacgcaagtgcaggaagtgccgccaccagcagcgccggagaccaaggaagcgccaacgcaagcgtcagaagtgccgccaccagcagcgccggagacgaccaaggaagcgccaacgcaagcgcaggaagtgccaccaccagcagcgccggagacgaccaaggaagcgccaacgcaagcgcaggaagtgccaccgccagcgccgacacgtcttcagccacgctcagcgcctatcaacagcttcaaggatgtgcgcccggtgctgcgggagatgctcgaccagttgcaccatccgatcatcgacactgtggagcgacagaccgggatggaccgcgagcaggtaaaggaagggaaggggaagacattccccgctctaattttacaatgcttttcagctgttcttcaccgtggtcgccctgttgacgttctacctgctgtttggctcttacaacatgttcgtgagcaatgtgctcggtgggttttcgcctttttttttgtcttcaccgcctccactaatttttgtcatttttcagtcaaaagttacccgttctaccagagcgtgatgaccatccgatcgcaaagcaaaagtgagtcaatttttccaatttttgattttaattaatatcccaatcccattttcagcggacgacacccaatggctcgcctactggtgcgccttcgccctcttctcgctggtcgaccacttcatcgcgccgttcgggctgtatctgctgctgaagacggccgtgctcgtctacatgctcctcccgcagacgtacggtgcgcacaactgcttcgtcaactatgtgcagccgatgatggagcgatttgcggagcgccgtgtctga

SEQ ID NO: 76829 - DNA, 658 bp, Heterodera glycines
  Genomic contig location: Contig_ID=SeqID_1926; Location=159..816; Strand=+
  SCN-specific regions: Sequence locations=1-495,517-658
atgcgccatcatcaacttcgaactcggaaaaacaaaagcgaggcatttgtctttggtctgaaggtgggaaatttgatagagaattatgaaaagttgtcaaaggttttcggtacacgcacgaaaaaaacgtccgatggaggtgcactgtgtgtgctgccatgcccgcgtgacaattgcggacaaaagtgacagcagcatgtccggttttctcggacaaaaagaacaatcatttgcctaagcccccgaaacaaaatgtttgggaggcatttaattcattagacaaagaagaatttaggcggaaattcgacggcaaaaaactcgagcgcgtgaaagccgaaccccgaatcaggacaaattgcggctggatggcgaggacatcgtgctatacgacagtcgcactgtcagaattggaacaaagaacgttgtgctcgtttttgggtgcgaacgggttgtctcattaggggccaaagacagaatttatatttaattttttagagtttggacatttgagcaaaaacagtgcaagatggcatttggacgggacaatgatgccgagattcacgatgtcattacggatcttggtctgcaggtcgaaggatacgcagaaaaattgaaggactacgaaaacatggaagattcaagcatggatgttgcttaa

SEQ ID NO: 76830 - DNA, 53 bp, Heterodera glycines
  Genomic contig location: Contig_ID=SeqID_1926; Location=1029..1081; Strand=+
  SCN-specific regions: Sequence locations=1-53
ttcacattcatttttaccatcgccaccaattgtgtgcacgcgtaatttctgag

SEQ ID NO: 76831 - DNA, 643 bp, Heterodera glycines
  Genomic contig location: Contig_ID=SeqID_1928; Location=843..1485; Strand=-
  SCN-specific regions: Sequence locations=1-63,85-160,182-612,636-643
atgagaagggccctgaatttgaatatcgattatacagccagcgattatctagccatcatacaaatttataatatgataaaatgtaatacaaaatcctaaaccaaatctatgaaaattaatgttgtgtagttaaagaaaatcggatattgcttttactatagaaaaacccaaaataaaatcagattttaatcttctaatatttctcagaaattattctaatcagccgatcaaagccgttgaaaatcacgtcggagaaattgccgcgaaatttgataatctaaaacattattttgtgttgttaccaattgcaaaccgtggaataaaagcgcttttcactgctaaacgaaatgtaattctgtcaaaaatgcagtgtaaacaaacagaaatggccagctttgtgaagaaattcaaaatggagcaaagtgccaaaagataggtaaataatggtggcacgtaatgacattaattagcaaggattcgtaaaaaaataattttatagcctattaattcattcctcatttggcggttacatcaattagagcagaactatttaaaataattcgaaataagcaattaatgcaaaatagaagcacatccaatgagcgcgatcagcttggatttgcatttttgaatttcaaataaa

SEQ ID NO: 76832 - DNA, 1859 bp, Heterodera glycines
  Genomic contig location: Contig_ID=SeqID_13048; Location=1288..3146; Strand=+
  SCN-specific regions: Sequence locations=1-87,110-531,553-572,595 -1161,1188-1367,1389-1536,1559-1568,1590-1714,1736-1788,1810 -1827,1857-1859
atggaagtcgagcgacggaattcgagcaaaaggctgctgctgggcaacaaccaaagcaaaacgcccgaggcattgtgtgttgtgaaagtgagccaaacaaatggccaattttgagctttccacgcgttacaacgcccccttaggcgatattatgccaattaatggatcgtaaatttagcagcgaatacagtaaacatggcatttttggatttattttgtttttttcccaatttcagttggatgccggcgacgacgggggcgaaagtttggccagacgatgttcggcacgcattctgtcgacggtggccaatcagttgagacttcggcggacacggaccagcagcaatggcctttagcagacagaacaccgaatttgccaaatgtacaaacgctttttaaaaatttaattttctctctacgccattcctttctctgttcatttttcgtccattaaaaaagagaccattgaaattcatttgaacttaaaacggaacaataaaatctcaattttaaatagttttatatcatttaaaaatcaaaattcattgtgaaaattttgtataaattacgtcatttgttttttcctttaaaaagcattggtccaatcacaattcaatttctcacaagtcccccccccttcctccgttcgtctctttttctgtccattcaattggccatttcgatcagtgcgttcaccgtcgagtctttggcccctcgattggcctccaaaactgatcggatcacttctcggtcaatggtcggaaacatttcctgcatttcgtccaaatccttctccgagaaagcaacttgagctgaaaacaaacaaataaattaaataatttcacaaacaaaataaatattcagttggatggaaatggggcgatttattgctattaaaacggagcaggtcgtccgtccccccgaattttttttttattcaaacctagaaatttttcataaaaaaaaactcataggaaatttcttagtaagaaatttcaagaaaaaaattttttgagaaaattttcagcgattttttggaaaatttttgaaaaaacttagtagttcatcataaaatttcgaaaaaatcgctgaaaaatttttttcttgaaactttctttacttagaaatttcctaagattttttttatgaaaaatttctaggttttaaaaaaaatttttttaatttttcgggggggggggggacgacgtggggaaaatgaagtgcaccactattaaaaagccaagttttcttactctgcgcggctgtcgccgtttgttgtccgtcgctttgctgcggaggcgcgggcacctgacaatgaatgaacgaatgagacgaacagttaatcagtcggttgttaaatgttaaagtttaatcaaaatcttccaaatcaaaacgggtcaattctatgccgacttttttattcgaaaattggtcaaattaaaatccgaaggaagcaattttctccattccccccccccctccaaaattcatagagactgagacgaatccgggactcccattcccggacttttgagggaaaacaccgggaaagagataaagtggacttttagtccttgaaatcccggcccatcgtcaaatcccgagccaattcaattcagaactcattctctgtttgttatgttagacctgttccgtttgttgttggtgttgctgtgggacaggcgaaaaggaaatgaccaaattgacaacgccttcctttccctccccctgaaaatggaattttagcaaaagggaagaaatgcaaaaactcattcattgtatttagcaattaaaataagaaattgataagggattgttattgtatagaaatttaaaaaatatatttattatttttagaa

SEQ ID NO: 76833 - DNA, 1666 bp, Heterodera glycines
  Genomic contig location: Contig_ID=SeqID_13051; Location=1148..2813; Strand=+
  SCN-specific regions: Sequence locations=1-135,163-315,337-535,557 -619,642-1021,1043-1666
gcaaatccgattacgattatccgattccgattatggcccaaaatccgattaattgcgattccgattacgattacgattccgattcggcacatccctggtatataagttgattttcgtacgagttgccattgaccctttttttattatttaattaaatttattggtaattgtttagcggtgggggtgaatcaaaatctcctcccaaaaatgcgagattcgaaaattttaattttgagtttttgctcaaatccgggttcgggattcgacgtggctcaaaattaatatcagattcgggttctccgctctttgatttttattcaaaaatttatttaactaattattcttcgaattcaaattttaggccattgtctccgcccgccgaccaaaacaacgaaaaaggcgccaatttgtgaacctatggccattgagaaaagaagaaaggaccgaccatttgattacctctgctggacttgatttgatgctattttctctttgaatgtgcttactttttcttttgtttaatggattttcattcaaaatcaaaattagattttccgcggctaaatgttgatatttaataaaatcaacaaacattatgccatcaaaacaaataccaacgtaaatttttaaaatttatttaagtggcttataattttatgtagagcgataacgcaaaaatgagttctgctatctctctccccattttatttttgcgccaaaagtcatttgaaaaaaattgctttaaaatttcaaaaattatcgaaattttaaaaatgatgttgagcctttctctaccctcgagcccattggcaacaatttaaggcgaacagatttgaaaattgttttgataaaaaatgcgattctcgtgtttttctcatcaagtattatcgtaaaaaataggaaaatcctaaaaatccaggctttatccaacgcattaattcttctgctatatattgtgtgacatcattcgaatttggccaaattgtgcttatttctgccaaaaaatgaacaggcggtaaggcattttttaaaagccacaaattcctcacttatttagcctaattgtttcccatttcagttggatttgcaacgacgtttggatggacattttccccacttttgaccatgcccaactcggcctcaaattggcacttctttcgccacgtttcaatgcgttggtggacaaacatttcgatggcaaaagcgaattgacaatttggagaacgatcgaaattagcaagtgcattggaacaaaaccgaagctatctgtgcggatggatgacaaatttgtggaatttccgttgccggaccgtccgttgcccagcaaaatccgttttaagcaccttcatattgagtaattgaaaatcagagctatggcaataaaagcatttatttcattttcagttacatcgatcactccgtcatcgcttttcttcgttccaatcaccaaattttcgacaaaagaggcaccaatttagacttgtggattccatcaccacacaccacggatggccagcggatttgggatgtttttgttcgtgaaatttggccaattttttcggaaaatattcgccacttgggctttaccggtgctgatcatttggacaatttgatggttgcactctccgagaaaagatggacaacccaagcgattgcgttgcgatga

SEQ ID NO: 76834 - DNA, 2366 bp, Heterodera glycines
  Genomic contig location: Contig_ID=SeqID_13053; Location=45..2410; Strand=-
  SCN-specific regions: Sequence locations=1-476,503-988,1010-1290,1312- 1340,1398-1631,1677-1701,1753-1898,1927-2029,2051-2117,2147-2366
tccccttgtcattctgtgcgcactttcactgctgctcgctctgctattttgctcgccacacttctttgggtggatatattttttgttggattaatgccattaatggtgggggggggagaggatgccgtggcttagtggattaagagcttccacagtttaattgtatcgtgggtttgagtcccattcgagtctcaccaagataagtaaatcgttcgtactctcaacaccgaaattaccctcatcgagaccttccaattagcttcttgtttctcgaaaatcgtgactccaaaaacccgagaattttcacgagatttcagaccacactaattttcagtgggtagcacaatgctgcctcgcgcaccgttccggcacgccaaatcgtacatcgcgcactcgcattggacgcctctcctgtgcactgttgtgagttactgttttttgaattcagtcgagaaatggtggccgaaagctttatgttatttttttaatattaaataaatttggaggaacgtggtaattaatgataattgcttaatgataccccccctcattaaataacagcaaaaaaattttaccgtatatattcacagtacatctttatcaaacaatacagttgataacagcccttagctaaacagtgtttatattttagcctggtcagcgtactgtgctttgcactgatgggcgcctgcctgtacggtaatgaacacgtcaacaaaagcgtgcgcgaatcgaccggcgcacttgcgcatgtcgcaaacgcattccgtgtcgcaatggaaacggtgttgtttaaattttggggaaacgaggttatcccaggacagaaagttctgtatctcgaaacttttaccctccattttgtgtgtttttttggaaatttgactccaaaatgatgacaaaaaatttgtcaaatttttcaccgaaaaactgttaaatttctgctttttttttcactggcgctgaaattttcgaaaaaaaattggactaaaaagttatagtccgaagagcaaaaaaaaaaagttttcggattccctcgagactcttgacttggtggtgttttgatttgagattaaagctcgaaacggtaaaaaaaaaattatagcggtaaaaaagagttttttttttgcaataaattaattacctgttttaagttgccgaacaatattgaaaatgcctaataattaagtcaattcattcttaattcttttcaaaaatttcagacacataaattgaatgagtcacaatggcatttgtcgcgtcacatcgatcagcttacattgctgattgaacaaaagagcaaagatgtgatcaatcaaactacggtaaaaagaaaatcgaaaattaacaaaaatgattttttttataaatttttgaattttgagattttattttatgttcagatgatccgagaagctgattcgctgctgactgaactgtcggataaagtggacgagctcaaacaacgcctggggcgcacattggccattttggcggacacgcaatttttggaggcggcaaaacggaagggcgaaagagtggagctggagaggtgatcagagtggcggaataatgagaaaaaagaattaatcattttagtaattaataatttttcttctgattgccgatggtttttattaatgataataatttaatttttaattaatttaattattcatctgagatgaatttatcttagagtaattaattaatatttactattaatcaattaattgctaattaattaattaactgtctaagattgttttgaatttaggatagttaattaaataattaatgactattttaaagtgattttcggtttaattaaaactagggttgttattaattaattgctaataattagtagttatacgtctcagataataaacctcagataattaattaatattaattaattaattaccctctctcagatggttgctctgcctgttgttgcctttgattatgctttccgtgctgttcgccggtgtcattgcgttctgtcgccagtcccgtaaaggtgccatcattttctctggccttggcttggtcatttttctcgtcacatggcttctcttttctgcggcatttccgctcactgtggtaaggccaacaaaaaattaatttaaaattaaaaaaaatagttggaaataatttttagcgggtattttgtaatcgtctatcggatttatgcatttaaaactgtaaaatttagttcatttaaaaaaattgctaaaattttaatgggaattactaaactttttttgaatttttagttacaaatttcaaatttctccaatgaactctcaactatttcacttggattttcaaaatttgtcaaaaaaaaaactccaaaaaataaa

SEQ ID NO: 76835 - DNA, 848 bp, Heterodera glycines
  Genomic contig location: Contig_ID=SeqID_13055; Location=802..1649; Strand=-
  SCN-specific regions: Sequence locations=1-848
atggacagagtggtagtgaggaaaaaggctgaatttgcaaaagcaccgtcaaccaactgcttaccaattgcaatttttgtcacttcatatgctcgtctacacctttatgactatatggaacaagtgctgcgtcttggtcataagctcctttattgcggtgagccaaaaaaaaaattttttttttcacctttattgacctattattcaagataccgattcaatttattacgtgacaaacaacgggagacagcaggtgcctgaaggtgaagcgctgggacagatgaagagggaacattgctcgaggcgaatatacgaatttgtgtccggtggtccaaagaattatggttttcgccattgtgatcgcataaatggagaggatgagcgtgctgaattgaaagtccgaagttttcgtctctcatattctgcgcagcaactgctcaacttcgagtccatgaagcgcattgttttggcacattacaacattgatggacaaatgttaacacatttttctctcacataataatcctaaaattctattccacagagatgatgtgctggacatggaaggtgttcatgttgtcccgggaagcaacgcgtcgataagaatcgaatttccacaaattggccgaactccatgttcggatctgtacacctacgacgctcacaaagactaccaacctcattatgtgaaggggcgcattcgccccagcatggaaactgtaccattcggatttcgtgaagcacaaacggttcaagaacaagctgaacatcaccaacgacagctgaatgattttgatgacaacttattaattgttaaccttcccggatgctcaaattggaatcaataa

SEQ ID NO: 76836 - DNA, 1557 bp, Heterodera glycines
  Genomic contig location: Contig_ID=SeqID_13055; Location=2747..4303; Strand=-
  SCN-specific regions: Sequence locations=156-356,378-452,474-584,606 -1094,1116-1557
atgaggaggagaaggagaagaagaggacaacagcaacaacaacaaaataataataacgatgacgaagacgatgatgatgataatgatggtaacgaggagggagacgacgatcacggtcatgatgctgataatgaggaagaagaagaagttggaacaaatcggtcggtcagactttgctttttcgacgctgaaacgtcccaagatttgccacttcaactgcgtacaaaggttgtacagaaacatgttccgatgctcattattgccgaaattatctgcgaagcgtgtataaatgaaggaatttcggttcattctggtgttggacaatacgcaaatgggtgtgtgtgtggtcctcctgcgggaccaagggggcgtcgctggtgttctcctccgtttctgaatgcacctgaggatgacaatgctctaccagccaatgtccactacaacccacgaagactgtttttccatagttttgacgacgctaccaacaatgacccggtggacgattttatcaactttctcaccggaagtggtccacatggtgtgaaaacaatttgtttatcacacaatggcggaaaatacgacattcatttaatactggaggcacttcaccggcgcaatttgccaccaaagcgtatttgcacaacgggactaaaaattttttcgatgactttgaaagggaaccatcaacgacacgtgatctttaaagactcgctgaactactttttctgtgaattggatgcactaccacgcacatttggattgaacgctgaagttgcaacagcaaaacctttctttccttatctgttcattcggcgtgaaaatttacaccaaagattgcatggtttaccgggcaaagaattttatcagcctgatcacatgaaagcgtcaaagagagattcctttatgagttggtgggaggtcgagaaccgttctgcacgcttccaattgcgtgaacaactcatcctgtactgtatgaatgatgtggcaattctgcgcgaaagtgtgcttcaatttcgccaaatcattgctgaaaatacgagaggactggacccgtttaaaatctcatccacggcagctggtcttgcgttggccaccctccgccgctgctttcttccaatgaacaagcttgttaatgcgccagaaggtggctacctaagggggcggcgagcatctgctgaatcggcacgatacattcgttattatgaaatgacgcatccgggggtacatgttcggtctgcccaatggtcaattggtgaggctaacgtcgaagacactggctaccgccttgatggattagtcacacgtgaaccccctcaacgcaaccttgccattgaatacatgggttgcttttatcatggtaaaaaaaaggtcgcccttttcaaccgaacaaaaaaaaaatgcttaaaggttgccccaagtgttacgctaacgacagacaacaaaaattggcaggtggaaggacagccgaagacctgtatgaacgaaccaagaggcggctatttgaactgcagaatcagcatggctttgagctggaagttgtctggggatgcgaaatga

SEQ ID NO: 76837 - DNA, 2307 bp, Heterodera glycines
  Genomic contig location: Contig_ID=SeqID_13058; Location=928..3234; Strand=+
  SCN-specific regions: Sequence locations=1-166,441-495,579-839,863 -943,1067-1112,1183-1271,1294-1306,1447-1460,1482-1496,1566-1727,1751- 1869,2004-2216,2276-2307
atgaattattcagattcgccaagcagacgagcaagtgctgttgcaaattgtttaccctctccgtcaataatggagttggcaaaatcggcgggtcttttgtccctaaatccgagcggtaaacaaaaaaaatttttggaggggattaaatttcagaaaaaatgccaacataatttaaaaaatactttattaattgaaattatcaaaataattataaaaattaaaattctttaatttatataacattttttttattaaactcaaatgaaaaattaggaattattttctaaagaaaaaaatatatatttttgttaaaataatttataaaattaattttttacaatatttaaaaaatgcaaattaatttgaaaattttttattaattgaaattatcttaataatttataaaatgaaattctttgatttaaataacaatttaatttcgataaactaaaatgataaaattaagctgatcaaaattcattcttaattttaagcaaaaatattttttaaattgaaataattaaaaaaaaaattataattaaaataataaaaatatcattaacaaatttaaattttttgcagatttggtgtttgagtcgtccgtgctcggcattgcctactacgactttgtgctgtcggttagcgaggttgaatatgcgcctgcaccatctgctggtgctgaacatgaacaacaaaaaaacgaaaaatcgccaaataaaaaagcgttggcgaaacgtcgtgtgcacgagacgggaagtgcgccgttgaacggaacgccaacgatgggcggcgctggcgcaaatgcggcgccaattcaaagaaagcgttgccaaacaatggaaaaggaaaagggcggccgctcattggtggccatgttgcagaagcagcgaacagaaatgcaactggtgaacaacaaaagcaacaacacaagtgggggaaaatgaataaataaataaattgaatatttgaaattaaaaaaaaaatatatatatctttaaaaaattatttaaaattaaaattgattatttatttaaaaaatgaattaaaattatattttcttatttaagctatgagggttttttgaaccctacataaaatctttctaaatttcgaaaatttttagaaaaaaactaatttttgaattatttctttttaattaaaacctaaattaaatttattttactctattttccaaattaatctactaggatttttgtaatccaccatataaaagcaacaatttatattctagccaaatactaatttattatatacataaaacttttttcttttctaaaagttcttgaaaaaatacaaaattatttatttattgtatacaaaataaactatgtttttagtttctcaatttttaataattaaaaaaaaatattttttttatataaaaaaaaaatattttcatatattcctttaaacacaaaatttttaatcctaagctttatattctagcaaaaaatgtatttattatatgcaaaaccttttttatttctaaaattaaaatctttttaattttcttttttaaaattaatttttatacaaaataaattccagaatcttcatcgcttctgccaagctttgagaagggttcgatgggcgaaattcaagaaaaatgtgaaattgaagaagcagaaaaaaatagtagcaacaccacaagaacaccatcaaaatcaccatcaatagaacgcaaaaacaacaaaaataattgtaataatacattgtacagaatatttttggccaaatttgatgcccatacaaatgtgcaatggttcgaaagtgtgttggtgccacgggtaaaattttaaatgttaatttagataattgaagcattaaataatttataataatggggcctaattttttatttatataaattacaaagcattatatttttttttattaaataaaacaatatcaaatttattttataaataaggtaatataaaaaaaataaaaataaatattgtttattaataaaaattaaaaatcaatctaattctgggggtccagatcagggtttttttgatctaatacgtcatccattttaggtgggttttttgggatctggtattttctgggtttttgccagaaaatacaagtccaggggcccagacttttttcaaaaatgtcataatagaagcaaaaatgaaaatttacagttgtgacttcctaaatttgctgaaaagttggttttcaaagcaagaaaaaagaataaacataaaaattgaataaacataaaaaattataaaaatagaattaatctattgcagagatatttttaatacaaaatta

SEQ ID NO: 76838 - DNA, 222 bp, Heterodera glycines
  Genomic contig location: Contig_ID=SeqID_13059; Location=79..300; Strand=-
  SCN-specific regions: Sequence locations=1-35,57-132,179-222
atgaattattatgttaatggaaagcataggcatagtaatgggttagaactggggcacaacagaaatttggtctctctaattgcctgcgggggcacttcaggcaattcacaccgcgattggcacatcttcaaaaagtaattaattaggtaattaattattataaaattaataattaattttagagaagacactagaggcccggaactgggatttcagtattga

SEQ ID NO: 76839 - DNA, 303 bp, Heterodera glycines
  Genomic contig location: Contig_ID=SeqID_13060; Location=63..365; Strand=-
  SCN-specific regions: Sequence locations=1-257,279-303
atgcccaaaaaccaaaagtcaaaacgtttctccaaaaagtcttcgtctgcgtcggcagcattgtcaagtccaccagcattgttggacatctctgctctaccaaacccggtctatgaagacatctcatcaccggaaggatcggtcattactggcgccgtggtagccaatacaattgtgtcaacaattgagccaaacttggacaacgcagttctgacaacgctttcgccggaagatgttgatcggatcttcgctgatgatcccgggatggcagaggaggttggccgaactgatcgaggatcctga

SEQ ID NO: 76840 - DNA, 634 bp, Heterodera glycines
  Genomic contig location: Contig_ID=SeqID_13060; Location=2201..2834; Strand=-
  SCN-specific regions: Sequence locations=1-72,96-613
atgggccccccatgcacatcgccaaaaactcctaatgacgagcaaatagtgccggaaaaattagcagttgatgatgaggaagaagtgcagagcaatgaaccgtcagaagctgataattcgaaccaagaaagcagtgaatcgaccgttacaaacagacaaaatgtgaccaaccaaacagttgcagatattagtggtgacaaaagatattctctaagaaatcgattggctataacaaaaccaaaacggttcactgaatgatttttctgtatataatgagtcctatcagccaatattttagataaatcaaaatcatctttgcacaatcattctgaataggcctatcaccaacaaatgaatctgagtaagcaaaaaaaaaaaaacacacatttactcacaaatatcgagcaaatcagtcatgaatgggtaagtctcgaggaaaatggttttaagcttgaaaaagctgtccgaacatttcttgttgccgaccattgatgcgcacacagaagtctcatcgccacagaattgccgggataagcagtgaatgacctcgtgacaacacacgcaacaagctttgcccacggcttggtatgtgcacgaatgccggagggattaaagtaaaagcttaaaaaataaa

SEQ ID NO: 76841 - DNA, 1294 bp, Heterodera glycines
  Genomic contig location: Contig_ID=SeqID_1929; Location=499..1792; Strand=+
  SCN-specific regions: Sequence locations=1-3,25-310,334-561,583 -1007,1034-1294
atgtttattcgaaatatgatttttattgaccatctaatgtcgagattattaaaaattattacaatagatggaaattttacaagttaccgaggtggttgatagtttaactatatatatataggttaatgtattttgataataaattaattagtgtataaaagtgttgtaatgtattcattaaatatctgtatgtctaattattgcaagttttttgtgtaatgttaattaagaaacaataatcactaaatgtaggaaaatgacaattctttgaccaatatgtttttacagaggaattttatgacgagggttagaaatcttattaattaattatgacaaattacaaagaatgttttgtagtgatgtatgatatgggggttaattgttgtgacaatttatgaaccaattatttttgattgaagtgttttatatagggatttttttatagtatgtgtgatgtttttaaaacttatgtgattaattatttcaaattaccgagaatgacttgtaatatttttattagttgtaaaagaattctaattaataatgagtcgtaaattattttgtataatatagctaaaaatcaattaatcatttcaaaggcggaacaatgtttggtgagatggttttacaattatttagtatggataagtattatgataaattactaagattttttggtagtgtatgtatgatatctgtattaattgtaattataaccaattattctttaatttttacaaactgaatatttctagggcaaagaagggttatgatgaaacttaaattatgtgtcacatttttgttgtaattcaatgaaacagaatacttgaagctgagacaaaggaaatgatgaacactaaatgagtatgataattgttgacagattaacttagttatggtattgatggctaggaaatatggcaattaattctaaaatatctgaaaaagaatgcaacttttcgggtagcgataaaccttttttaagtaagtaactaattattacagccacaaggattttagaaatgtataaaaacaaggaaaataataaaaggtgaattttcggtagccaatactcggctctccggtagtcagtacctaattaagctcggccctccggtcaccaatacctcataaggttcggctctccggtagccaatacctaattaaacttggcccgccagtaaccaatacctcgtaaggctctgacaccgaacactgaaaacttcattcttttgactatgaatttttatttttatgcaaattgttatcctcgtggtctaaaatttatatgaga

SEQ ID NO: 76842 - DNA, 1838 bp, Heterodera glycines
  Genomic contig location: Contig_ID=SeqID_1929; Location=2072..3909; Strand=-
  SCN-specific regions: Sequence locations=1-98,120-357,382-469,491 -547,569-650,672-678,700-851,873-909,943-991,1131-1181,1203-1838
atggaatacgtgcttaaactccgtggattgacactcaattatgatgtgatcaacaaccaaggctttagatataaaaacagcaagtcaaacgttatgctcaaacaggagagattgaaccaattaatgtaatatacccaaactttattagacccaatattcgtgatggtggatctgtaatatcaagctctatgcaaaaatgttatcagccttatattgggaagggtattgtaggagccgattataatgttctcaattttggacacactttgtaattgctcacccattataatgtcttttcaccattcattgtaactattttgtcagcacacattgtaataccttcttcaccaatcattgtatctctctcacacatacacatatgtacccttttgtattttgttcaccatttattgtatctctcttccacacgcataaacatataccccatacacacgtacacatacatgtaccccttttatttctctattttatacctcaaattgtgtaattttgtcattttattcacgttttaataaaatacatgaataattaatgattggaagatacaatatgaaaataatttatcatttgggaatgtgattttacgtagaaaatgcataattaagctaacgaagatagtatttgctaaattaaagaaaatatattattaagcggatcgatggtaaaatttgataaaaagtaaggaatagaagatacaattttaaaaaatgcacgagcatgtcgtttttaggtagaaaagtgcataattaaggagtgaacatgcatgcagaattaagcaatggaagttacaatttgtaaattattaagcatttgggaacgtcatttttaggtagaaatatgcagaattaagagaaagaagacacaatttgtaaattattaaggaatagaagatacaatttaacaaaaattaagaaaaataatgattaaatgaaggaattactcaaaaatgtgtaaaaattacacacatggggtgtgtgtgcatgtgtatatgtgtaagtgtgcgtgtgtgtgtgtgtgtgtgtgtgtatgcgtatgtatgcagtgcgtgtttatgcgtatgtaagcatgtgcgcgtgtgtgcgtgtctatgcgtgtgcttatgtgtgtgtattgtatgttttttcgagggtgaggataagtgtgtttgaaagttctgcataatatttattaacttatataaaactcgttaattttaatcataaacacaaacaatgctccttgcctaattcaacgtaaaataattctaattataataaggaacatttacaattccattgaataagtaatattcaaaggaaacaagagaaatagacaattttgaatctaagattgaaccgagaatagaaagtaggtttgacaaacagctgactgactgtatgtgacgagaaagggtagataagggctaattgtatgcgtgaagcaggtcttgtaataggaataaatgaagaaatcatataagaatattgtagtgcaccatagaatcaaggacaattaataatgggtgtaagagatagagatagagaactcagaaatgtggttgaagagagtcaatattaaatagtgagaatttaatgtgagttagtaagcaaacattaggtaatgtatagggaagagaatagtttgataaagaacaagaatacgaacacttggaagataacggttcgagaataaaacatagtgttggaagaaaagatattgaaaaatagctaacggaaacgattatttagacaatatgtaggtctgaaataacagtgaaagtaagcagatataagagtagagaaaatacattacggagaaaaggaaaatattcaaataaa

SEQ ID NO: 76843 - DNA, 367 bp, Heterodera glycines
  Genomic contig location: Contig_ID=SeqID_1929; Location=4135..4501; Strand=-
  SCN-specific regions: Sequence locations=1-367
atggctgagcaatctgcatttcaatcgaaattaatgttactacggttgaagaaggttacccatttaccaattgatactgacataaaaggaaatggtgagaaggaagctgaatttgtaagagagtgcaaagagaaattagagatcttaacccaacaaagatagctgtgaaccaagaagagtaggattgttaaactatgcttgaacaatttgtgcgacatatttctttacgaaattacagcctttaacagactttacttcaataatgatgtactcgattttggagaatatttgggataatcgttcaatagacgtaatggccatcgaggattgaaaggtgtatcatgttttgattacctacgaaaataaa

SEQ ID NO: 76844 - DNA, 714 bp, Heterodera glycines
  Genomic contig location: Contig_ID=SeqID_1929; Location=4996..5709; Strand=+
  SCN-specific regions: Sequence locations=1-291,313-453,550-554,663 -680,703-714
atgctaaacatatccgcttacttctattgcagttctctctgtttccaactattcatccacagaataatgatcaatttgccaagtgttcagttgaaaagttattgatctagaaatatcgcaaacaggccttatactagtcatacattcctttagtacatcaatgggtactaaaagacgctgccttccttaataatgccttagttcctttgagacatcaaataattccctcctaaacgataccagcgctgtcattaaaattttcaatgtcattacattttttctcattaatcgcctctgtaaatacaaattttccagttgagaagatagttgtggtagaatttgtacctagacccttcattatatttgaaagatttatgtggttgtttttagtggatggggatattaaataaattgaggagaaaagttttactatttattgtcagtaacaccataaattgaatttaattttaggtataatttacttaattttaatcaatactattgtatttattatttttattatattttaatacaactttaatttaattttttaatttagttttatttatttttatttttatttaacatttattttcttttaattttaatcttatttttatttttattttactttttatttgaattaatttgaattttattttactttatttattattcagttaatttaaaggagttgttcataacctctatcca

SEQ ID NO: 76845 - DNA, 1156 bp, Heterodera glycines
  Genomic contig location: Contig_ID=SeqID_13061; Location=79..1234; Strand=-
  SCN-specific regions: Sequence locations=1-277,301-418,467-548,577 -874,896-1131
atgagttggcgtgaaactttttgtttatgtttactaggtgatcatgagaatgagaaaagtgagtgaaagtccacgtataaaggcaagctgatcactcaaaatgttaagctaaatctaatcagtggaagaaaccaatttgggagacaattttagcaaatcaatgatcaggggtaaattcaaaacggctatttaagccatcaagagtttgtgaaatttacataaatctatcagggtgatcagttgaaaaagatctaatcgatgcttttaaaccaaaaaatgttgaaatgaaagaccagtgtaatagatcactataaatcagcaaaagaatagatcattttgttggagcaacggcggtggtggcctaggctaaaagaatggaggcaattttgtgtaaataaaaagtgacaccacaccgatcataaataataataactcattaattaaataataataatgaaaaaaaaatcatcaaaatttatggtgataaaccattggcatttttttgaattggaaatgggcacaaacaaacaaaaaaaaaatttacgacacgggtttaaataaagtttaaaaattaatgagagagattttggaattgagaatggaaaaaaagcatttatcaacaaattgctaaagataatttaattattggctgaatgtgtgagaaacgaaaaaaagtgatgaaaaagtgccaaagccttaaaaatttttgtgttttaaaagagaatttgtgtcctataaaattttaaaaatcgggaaaatattttcttaatttaaatatttcagaaaaatcggaatggaaaatggactaattcaataatttaatatagatttttagagttaaccggccatccctttcttgaaaagtgaaaaaaaattttcaattttttaaaatccatttttttgaaagctttggcaaacagccagaaaaatatatgtcatggcatgacagagcaaaaatgagagagctgatttatgagatgatatcattttaaataattacaggcggcgaagaacaaaggcgtgccttttgagcacttactagcggttgttgtttttgcttttttgggatacattgtgtacgcgagaagcacaattctacccgaaatacatgaatgattgaaaacacatacaaaacatatgtaaagcaaagaataaa

SEQ ID NO: 76846 - DNA, 1277 bp, Heterodera glycines
  Genomic contig location: Contig_ID=SeqID_13061; Location=3477..4753; Strand=+
  SCN-specific regions: Sequence locations=1-53,75-158,189-234,257 -618,691-779,806-1160,1182-1277
tattcatttgactgatggcggtggtggattcaaagaagcgcaacttcatacattggcacaatgccatgccaacaatggaccaaaacaaactgcaaataagccttacggaattgaatttcgtctgcctcgggaaggcgaaatttgtgatgatgggtgggaaaaaatagaaaaaaataaaataaattattggaataaatttaccgaaaaagctaaccaatagctgaatataacaccaattatatttgaaattaaattctaaattgatggtaacattctcatctgctacccagcaatgcttcaacgaggcgatcatttggacaccaacagaaattcaaaagttacaagaaaattcatcgttggtgctagtacggtaaaatgctctaaccacaatttctggctaattattaattacataattaaccctcagggcaattctattgcagaagaatgtgttcaaaaaatggcaaaaaatggctacaaaaatggcacaatgatttggcgtggcctcaaacttcgcacaatgcaaatgaaaaaggaccaaaacaatggaagaatcattatttttgagtcatcaattgcttcacagaaacagttgaatatttttaattgttttaaccgaattttttaaaattttaattttacacttttataaaattaaatttatattaaaattattttaagatataatttgagtgcaggacaacacaaattttctgtactttttgctttgaatcaaactgctgtgccattcacgcgcttttcatcggtgaaaaatggtgaaaatattattttatatattttaaatgggcattctcggctttcccaaaatgccatttctcagatttcgatggcagtgccatgcaaaatgatttcctccgttcaaatggtccgtcttttttgtcggattatgccgacctttggcttcttggacttgacatgctgccgatggcacaccaaacagaacagcaaagagaacagctgaagatgaagctgttcattagccgcagttccaaatgctccatggaagcatgggtaaaagaaaggcaacccgacaaaaaaggaccaaattttagggatttaaagattttcctattttattttatgggctttatggaaatgatatatttggcaactatttttcaattttagctatttcggtcaaatttaattcctttaaagtttgtccaagcgtcgcattcccttgtgccatccgatccgaaaatgcaattcaacggttcgttgtgcaaaccaaatccgacggaagacgtatatgaacg

SEQ ID NO: 76847 - DNA, 1049 bp, Heterodera glycines
  Genomic contig location: Contig_ID=SeqID_13061; Location=2358..3406; Strand=-
  SCN-specific regions: Sequence locations=1-334,357-560,652-672,694 -698,720-764,786-884,956-1027
atggtgcacattaagagcattatgaaaaaggaaattgttttggcaattgaaaaggtcatttgtaggtggaccgcggatgattaagcagtttgatacaaaacaaataagctaaaaaatctttcaaaaaataaaaaattcattatgtattcaagagccattccccaaaatgactaaatttgcttttccaagacaggatttttagggactattcctgtaaaattttattacaaacattttgttggaaaaggccgcttaattgtccattggtatataatttaagaatgtttcaagatgccagcagcccacggatttgatgaggcgttccctattcaataatatggaaaataaatgtataataaatttgttaaatgtcagaaaactgccccattcacagcaaaaatatgacgtgtcaaaatcagtcacatttccattccaatgcaaatccgtggcgcttcttcgaccttcattattaacaatcatttcagcagctcatcacccctatccctgctatgatgaagtacgaaaagtgcaagttatcaaattaaaagcaaatgattatcttaaaaaattaaaagcaaaataattattatttaattataatatatattatttaaatttcgcaacataattaaaatatatttttatattaatcatattcgtggtgaaccgaagctacattataactatattacctatttaatggatatttatttaaaaatcaaacacaacaaataattttacattttgcgctaattttagttacaaaaactgaaaacaaatatttcaaacataatttcgtaaaatggttttgcgaggagagtaaaaccaaatttctcaaaaggaaagagaaaaaaatacacaaaaacgagatccgctttgtagccaaaatttaagaataattcttaaattgaattaatataattattttgcttttaatttttaaaataattattttgcttttaatttgatcacttgcacttttcgaacttcgcccaaccttgcacttttttaaatatgagatgtaatatattttaaaaactgaaaataaa

SEQ ID NO: 76848 - DNA, 509 bp, Heterodera glycines
  Genomic contig location: Contig_ID=SeqID_13062; Location=1105..1613; Strand=+
  SCN-specific regions: Sequence locations=1-299,322-509
atgatgacactgttggaacaacttcccggcggtggtgtcgtcaccgccaccgaatctccccaccaaattggccatttacatcaccatcatcagcaaccacaacagcaattaaaggcccagtcggcctcctcaaatgggccatcaaataacagtgccgccgggtcgggccatggccaatcgccgggcggcggcattttgctgtcggcaacttcaacacccgacggcacattgatgccagccggcaccactgatcatcagacagccggtggccatcaaaatgtcgcgcatatgggagcaggtaattaattaatgagtgctaattaagggggaatggttgccttttttgaatcaatcaatgctagtgatcgggactgagattaatgcgagtgttgctctggtgacgggaggttgaaattctcgaaaattgggggaattgatgaacaccgaatttggatacagattttcaggaccgtaatcaaggggggggggggggaggcattcataaataa

SEQ ID NO: 76849 - DNA, 851 bp, Heterodera glycines
  Genomic contig location: Contig_ID=SeqID_13063; Location=25..875; Strand=+
  SCN-specific regions: Sequence locations=1-49,84-486,508-686,781 -801,827-851
atgtgctcgccgggcagctcatccaattcagcaacatcatcatcactgtacaacaacaataaccagcaacatcaacaacaacaggtagcagcttgagccagcctagcctatctattgaaaattgagaaatttctagaaaaaaaatccaccgaatttttgcttttctgtctttgtgtacctgtgggaagaaaccccaaattagttaattaggttcgaatttaccctccctattcatcaaaatacagaaataataaattattctcacgcttttgtgcgtaaaaagagttataattttttctggtgctttatgtctataaaattccaaaaaagggttgcataaaatcgtgagagaggcgaaaaatttaactgaatgtggccctaaactaaaattaatttgtctctaattaatttgcccctaaaaaaactgatttatctctaataaattggacataaactaactaatttgtcactctaatttatttggccttaaactaactaaatttttctctaattagtttggccctaaactaaaactaatttgtctctaattaatttggtcctaaaacaactgatttatctctaataaattggacctaaactaatttaattaaaacaaagcttccagtaattaacaaatgaattcccttccaacatttcagaatttcgctttgtccatcactaacaatcagcagcaccataacaacaatatggagcagcatcagcatcaccagcaacacaaccacggcaacagcaggccatcagcaggaggaggaggaggaggccatcaccacaatcacacgcgggagaaaaagaacaaccaagaggagcgggtcaaacggccgatgaagtag

SEQ ID NO: 76850 - DNA, 1157 bp, Heterodera glycines
  Genomic contig location: Contig_ID=SeqID_13064; Location=610..1766; Strand=+
  SCN-specific regions: Sequence locations=1-59,108-369,391-490,512 -533,556-636,695-731,762-1025,1049-1157
  Gene Ontology: Mol. function=transcription factor activity; Cellular component=nucleus; Biological process=neurogenesis
atggctgtggaaaatccaaaaatgcacaactccgaaatttcaaaacggcttggcgaggagtggaagaagctggaggagttggagaagcggccgttcatcgacgaagcaaaacgattgcgcaacgagcacatgcaggtggtgattggtgattgaccaaaaatgagggagaaaaaactgatcactcactactgatcagagtgaaattcggacaaatttgacacttcatggatcaacaaacagttgttgttggaacgaaaacatctgctgctcttattatttattccttttaaaaaatatttttgtaaaattttgcaaaaacttggaaaaattaaaaaatttccattttatgtaaggttggaagcatcgatgtgtgctgacatcaaggcaatcggaaatcggaattccgacggcctaaaaattttttcggaacagcccaaaaatttcataaatcggaattccgacagcctaaaaaatttcggaaaccggcaattggaatggtaccatttaaatttattatcacttggcaaatcatttatttgtccatttgtccatttcctcaatttatttccagaatttcaaaacaggcaattttacaggaccatccggactacaaatacaggcccagacggaaggccaagcagcaactgcaccaacagcagcacaacaaccatcaccagcagcacagcaacaacagtcatcatgccaagaaaagtggtgccaacaatcagcaacaccaaaatcatcatcatcataatcagcatgcacaatgttcggccggcactgcgattggccagcagcagcaaaatgccgtcgttggccatggccatggtggccccggggcaatgccaaccgcggcagacgcattggctgcttttgatgcactcaaatgcttgccgcaaccggtgaggcgtgatttgtggggcataattgaaaaaaagttggacaggttctctcgagagccttgcgcttaggaaatttaatttttcccatgtttgggcacgtttttctcgactcagtttatcttgaaaattttaaatttaaattttttcgcaacaccacgattgtttaatcctaaatttttgtttcaacttcgttttatagtctcgaaactaattctcgacatccattctcggtaatgcaaatcataaattgaaaaa

SEQ ID NO: 76851 - DNA, 369 bp, Heterodera glycines
  Genomic contig location: Contig_ID=SeqID_13065; Location=695..1063; Strand=-
  SCN-specific regions: Sequence locations=1-293,317-369
atgagtgagtatggaaaaaattgcattcaaataatttgtaacacatgcacacctgtgctggcctcttttccgagcaaagatgccacaaaaaaggtgggttactatcaaaaacaattttgtaaataattttgttttctttttattcaggtcatcaaacgtttgcgccgtgatgaaaatgcaccgcgagtcgaacctctcaatttggagcagttggagattccgaatacctatcgtgtttataagcgcactgagattgacgaggagcaattcctgttggcggacactggcgtttttcaaattcacggacagaatggaccccaacctaagatatcgtttaaaccattaaatgatggtcatttacactattaa

SEQ ID NO: 76852 - DNA, 282 bp, Heterodera glycines
  Genomic contig location: Contig_ID=SeqID_13066; Location=41..322; Strand=-
  SCN-specific regions: Sequence locations=1-282
atgaattatatgaaggccaaggctccaattcgtattcatcgacttcatttaataactatgagaataatcaatacttttcggatagagaatgcgccaacgagcttttatcaccagaaagaaatgataacgaattgtcaagaagttatgaacgaatcaaaccaaaatttttcgataaggaaatgcggggagtacatgagagaacagcttcgagaagactcaggagctcctatgaagaccaagctcaccgcgaaagttatgaagaaacggaaaaccgacgcaaaa

SEQ ID NO: 76853 - DNA, 411 bp, Heterodera glycines
  Genomic contig location: Contig_ID=SeqID_13066; Location=637..1047; Strand=-
  SCN-specific regions: Sequence locations=1-7,29-328,350-411
atgactccattaaattcatttatatttattacaatctttgcaccattcagtggtatatttttgtttggtcaatcgcccggatgtgatcagaacacttttgtcagcaatttggctagcattttgcattgtatgggcgtccgttacccaatactcgtccatatggaaaactcaacgagggcaaaattggatttgaacgctttgaaaaaaatgaagtgcgattggcccacgcagccattggacggctacttgttgcattgtgcgagagacaatggaattccactgttggacggcagaaatttggacatgaaacgaattatagccatgagagacatcaaagaattgacagaaagccatggcattttgatgtgtacacttgaaccattacgaagacaaggtttaaaaagggaatag

SEQ ID NO: 76854 - DNA, 852 bp, Heterodera glycines
  Genomic contig location: Contig_ID=SeqID_13067; Location=1010..1861; Strand=-
  SCN-specific regions: Sequence locations=1-852
  Gene Ontology: Cellular component=actin filament; Biological process =nerve ensheathment
tgtctgcgccgcaagtgtcgctttgactgggcgccgtaaatgtctgcgccgcaaatgtcagcgccgcaaatgtcagcgccgcaagtgtcagcgccgcaaatgtcagcgccgcatatgtcagcgccgcaaatgtcagcgccgcaaatgtcagcgccgcatatgtcagcgccgcaaatgtcagcgccgcaaatgtcagcgccgcaaatgtcagcgccgcatatgtcagcgccgcaaatgtcagcgccgcaaatgtcagcgccgcaaatgtcagcgccgcaaatgtcagcgccacaaatgtctgcgccgcaagtgtcagcgccgcaagtgtcgctttgactgggcgccgtaaatgtctgcgacgcaaatgtcagcgccgcaaatgtcagcgccgcatatgtcagcgccgcaaatgtcagcgccgcaaatgtcagcgccgcaaatgtcagcgccgcaaatgtcagcgccacaaatgtctgcgccgcaagtgtcagcgccgcaagtgtcgctttgactgggcgccgtaaatgtctgcgacgcaaatgtcagcgccgcaaatgtcagcgccgcatatgtcagcgccgcaaatgtcagcgccgcaaatgtcagcgccgcaaatgtcagcgccgcaagtgtcagcgccgcaaatgtcagcgccgcatatgtcagcgccgcaaatgtcaaagccgcaaatgtcagcgccgcatatgtcagcgccgcaaatgtcagcgccgcaaatgtcagcgctgcaaatgtcagcgccgcaaatgtcagcgccgcatatgtcagcgccgcaaatgtcagcgccgcaaatgtcagcgctgcaaatgtcagcgccgcaaatgtcagcgccgc

SEQ ID NO: 76855 - DNA, 541 bp, Heterodera glycines
  Genomic contig location: Contig_ID=SeqID_13069; Location=1864..2404; Strand=+
  SCN-specific regions: Sequence locations=1-72,117-396,419-541
atgtacaatcgaagaatgaggaaaatgtgagctttttatacttctgtgttcaatattttttcttgttcaatgaaaaaaatattttaaaaataaaaattttcatttaaataattttagcccgatttgcacgggacttggaattatatgaaaaaccgggaccggtttttgctttttacccgggacgaaacttttctttttttaacaattcagaaaagctaaagttaaggcaatatttttacatttaagctggatttgcaacgacgtttgggtggacattttccccttttttgatcgtcctcaactcggcctcaaattggcaatgctttctccccgtttcgatgctttagtggacaaatacttcgataacaaaaaggaattgacaatttggaaatcaattacaatttgcaaggacatgaacacggacgaacctgttcttgatataattagcaaagctatgccttggccgttaccactaccggaacgtccgctgccaaaaaacattcgcattaactaccttcagattaagtacttgttgatttaa

SEQ ID NO: 76856 - DNA, 252 bp, Heterodera glycines
  Genomic contig location: Contig_ID=SeqID_13070; Location=254..505; Strand=-
  SCN-specific regions: Sequence locations=1-252
atggacacgggtggtgaacggtcgtcaaaacatttgatgccgaacggggaagacaatgaacaacagcaacaacagaagatgccaaaagtggtggaggtggaaaaattccctgcggcggttgattcatctccatcagtggcggccgacaatttggtggagggacagaatgatcatcaacagcaggacaacaacgagcacttggacagggtaattattactgacacaatgaatgaactggttgaagttatggac

SEQ ID NO: 76857 - DNA, 692 bp, Heterodera glycines
  Genomic contig location: Contig_ID=SeqID_13070; Location=760..1451; Strand=-
  SCN-specific regions: Sequence locations=1-202,223-390,412-542,675-692
atgccgaaacgttgcaagaaaaaggatggcacattaagggaagcgcaaagtgcaaaggttgagcaatcattgcgcgagttgaaagtgagcgaacggtgaaaatgagtttagctcatcgcaattgagagaaaaaccccacagaaaatggccaaagaaaaaaaccaaaaatttaattattgcaaacgaaaattcgtttttcttcttatttatttatttatttataaagaaaagaaaaagtccacaaaagggataaatccacttactttgtggacatatacatacattaatcgtccaaaagtatcggattatacaagcacaaataaaataaaatcgccaagaaaaatataaaatgaggtcaaagtcaaagagatcacaattaccaaatcttttgtaatgaatgtatttgaaaaaattgagcagatgttgtccgatctgtgcaaaagtgaccggcgattgagacggaaattgcgtgccgccgcacaacgacagcaaaaccatcattcatcctcctcctcgtccgccaacagtgacaacgaatttctggatgaggaagaagttggaagtgaggaagaagaggaagcgaatgggtacgaaaataacggagaaatgagaggaggaagtgaggaggatgagggaagagaggagcaaacggacgaagaggaggaggaggaagaacacgcaaaataaataaa

SEQ ID NO: 76858 - DNA, 304 bp, Heterodera glycines
  Genomic contig location: Contig_ID=SeqID_13071; Location=590..893; Strand=-
  SCN-specific regions: Sequence locations=1-52,74-93,116-140,168-304
atgaatgaaacaacaacaattccgggcgtacacaatcgaaagtttgccaatcagaagaggaggacgccaaatacaacggaggatgaggaaagacggaaaaaggaacgaaaacggaagggacggaaacgacgggacacttccgaggacagtgaggaggaggacgaggaatggcacgagtcaggacgacgcgaagaggtgaatttctcggcatttttcaggtcttatcctcgaaaaataattggaattttattataaattacaggaggtacttttttgggttttcggcttttctagttcgggttag

SEQ ID NO: 76859 - DNA, 438 bp, Heterodera glycines
  Genomic contig location: Contig_ID=SeqID_13071; Location=1..438; Strand=-
  SCN-specific regions: Sequence locations=1-169,191-411
aggtgttgcccaaatggaagttgtgcctggtcggtgctgccatttttctctgttttgccttgctttacccgagcgtcttctcaccgatgctttccaatttgttcggcggcggtacccagcggcaacagccggcggccgcggaccgaccgatgcatccgtcgatgatggggacgaaccaacagcagcagcagaggggtacaaattttcccttttttacgaaagatataagttgtcagcggcattttgccggttggccaaccctctgaaattctaaatttaaggacgaattttttttttttgaaaattatacatcccccttggccacgcctggtactttcctcacaattaagaacgtgcccatcgccctcccccacaccatccaggcgcatccatgcgaataccggacatgcacaaccaacagcagcagcaacaacaggg

SEQ ID NO: 76860 - DNA, 1056 bp, Heterodera glycines
  Genomic contig location: Contig_ID=SeqID_13072; Location=651..1706; Strand=-
  SCN-specific regions: Sequence locations=1-743,765-782,807-869,891 -947,969-1056
atgcgtttcattttactagtaaaatggggtaacgattagtgatttcgccgttatttattaaaaccaaaattcaaataatcttttaaccgctgtcggaccactaattatacatttgaattacctaattgctttttcatttcagtcaaaggacccttcaaattctcgcaattccggtcgcgatcacaactttttcgaaggcctctattttgagggagagataccacgaggttttgttttattgttaatttggaaaatactgaaagcagaggagaaatccctggtcttacaattagtattcggcaatctttggattaataatcaaaattttctataattccctttatttcggtcattaaaggcagaggagaggccccctccccaaaaaaaccaccgggtccgaatttcttatttttcattcatgttcctcaaattgaccattttattaaacgaatgaaaaatatatgaatttttaattgccttcccgtcttgtatttttgaatcgaatagaaaaaatcatcggtagaaccacctcccattttcccggatatttttggtttacttttcagttaccattttttcttaaatcatttctattttccatctttcaatccaatccagttccaacccactcaccccttttcccattttccccaccgttttgtcgtccatcggatgaccattcaaatttccccctgtcccctcttctcccgatttgtttgctttcccctcgccccaccaaactcaaaatgcatttttaagtaaattctccacttttctttgctcattccctccttcccctgcttcagatcggatcaaacagaagtacactttgtccagcggaccgggcggttcgaacgtaaacagtcgtaagtccattcattcattcatttcaatggtttttttcgccgtccggtcgaggggtgttaaaactaaatccatcgcccatgaaaatgcttttcccatttttggacaaaacaaacaaacatttcctccgctttattaataacagcgttcgaattgcccattcattcgctaaaaatgtcaaaaagcaataaa

SEQ ID NO: 76861 - DNA, 540 bp, Heterodera glycines
  misc_feature (375)..(375): n is a, c, g, or t
  Genomic contig location: Contig_ID=SeqID_13074; Location=331..870; Strand=+
  SCN-specific regions: Sequence locations=1-299,321-486,523-540
atgatcagcaccgaaattgaacttcccatgcctcagcgggtataagtcgtacaaacttgcggtcttttgcatattgtagagctttttatgctgtttccaatgagcctactcaaaatcttcccaacccccctacgaattttttccgaaaaatttcctgattttcagtgtattttgggttgtccagatcacgatgaaggagtgatctgatcatgttggtgcaaaagacttttttgatcagcgtcaaaagttatattagcatgaattatttcagatcatatatactaatttaatcaacctgagattttataatcaattttaaacaaatttgatacgaaattttaagtggtgctaaagatatgaccatgactgtaattnagtaaaaaaataattggatgaaatacgatcggggttcccgataatttccccgaggggtagggtctttttaatttaatttatttaccgatgatctaagttatctggttcttttcataaatcgtaaacaaaagaaaaatagaaaagttattgtctgttgtcaatcga

SEQ ID NO: 76862 - DNA, 1321 bp, Heterodera glycines
  Genomic contig location: Contig_ID=SeqID_13075; Location=208..1528; Strand=+
  SCN-specific regions: Sequence locations=1-100,136-207,229-638,660 -786,808-1321
atgaggccagcaagaaatataaaggtcctgttctgccgtacgacattacagaagccgatttcaaatgtgtcaatgcttttcactcgaaaatttttgtaagaaaattaaaaaaaaattaaaataaaataaatttttcacaaagggtccctcgtgtggcgacccgaaattcgaaatggtcaaacattgcgcaaaggtaatacatgcaatattccttaaataaatattattaagtatgtgcttttatgataaattaaggtgaaattctacggagacacaccgccggagaatgggggaattaatgaggacaataaaggcgagaaaaggggaagggattaaagcagttttgataaatctttctcaaatttcactttcaaaaggaaggaattcggtaaaatttgaaaaaaatcccagcaaaccctctcatttaaatgtgttacgaatttgagccctaattacgcaattatttttgccaaattgtgctgcagatttgcttctgatgttggtcgacgggtgtttggtgtgtcttaagggcgaaagcgacgaatcgctgcgagtcaccgtcaaattgcgactgatttacactttgtccgccggctcattcttcaccgcgtgcgacgtgacgaccatggaaaccgagtaaaacaatggataagagacaaattaatcaaatacagttataggtaaattctcgaccataacccaaacaactccaaatttcctgaatctcaaaaaaataaattaattctgcttacaattaacatgaaaacacaaatcccaacggttagttgcactttttctcagtttatttaaaattcgctttgttggtctttgattaaaattctattaatgagttggaagagaaattgggagaaagtgattacccactaattagccagagaaagaatgaaattagctcatcttgtgcttttgcagagaaatcacagtgactttggacaaaaaagacatcgccaacaaaagggccgtccccccaaaaagtgtcgtctccgcgtcggacgacctcagcaacagcgacaagcgagtgaagaagcccaaagcagccgaacgggtggcgaaggacgattatgacgagaaggacgacttgggggaggaggtgctgtgcccggacaaatgtgtgaggaaggaggacgtggaggagaagattgacgagggccaacgccacttcggcacattcacattgcccggggtgttgctgcagcgcaaatgccgtgcatttttcgcgctggaagagccgaccggcaaattcctgaaagttcagctgaaagtggagcacaagtgggccgacaccagcaggggaaactaa

SEQ ID NO: 76863 - DNA, 1629 bp, Heterodera glycines
  Genomic contig location: Contig_ID=SeqID_13076; Location=626..2254; Strand=-
  SCN-specific regions: Sequence locations=1-159,210-716,738-1629
atgccgaaaattgcgctcggcactcgcgccgactcgggcgaaagcgagcgacagtcgtcgccagatactccgctgggcatttgcttggacccacacgaagccaattatttggatgtggcggtgctgcgatgtcttctgatcagaaattgggcggaagagggtaaaatggaaataagaaatataaatatgatgaaaagttaaacatttttcataatgagcggcgttccgtactttcaggcactttttgggctgtgcaataccttttgggtcgactgattgccatgcgacagcaccggtgcacccacgagggcaccttccgttcgcgcttcaattccgattcggcaacaattccaaccagaaaaacgtccaaaactgaagctgcgaccattgacactgtgagcagagagagaagccttcgggcggggcaattcgttgttttgtttggcattgaaatgccaattctctccccaccccccaaggagctaaatgatcattagcttttatcttttagaaaggctatctcacctgggccgatctgcaagagcacaacggagcaacgttcagcggtggcacaaaacgaacggacaaaatgcagccaaaggacacgcgggaagaacggacagacgaagcggtggcgggacggacggggaaaggggtggcatttgagagggatgagatgcaactgcagcagaggagcaaaagcgacggcaaacagcaacagagggagcggcagcaaacgctgggcgcggaacggacggcggaaagacggcgccgcatcagtctcagcgcaatgccaagcgacggtgtggcgatgttgccggggacgacttcgggcagcgtaaaaacttaatttattgctaataaccatgaaatttttcattttaagatgccgcgtccgagcattagctcaccgcgtcgcatgcagcgtgcctccagcatccccgcctcattccctcgcctgactgaactgctccaaggctttgcctcgacctgcaacagtcccgcgatgcaacaacggcgtcgccacgagcaaatcgccccggagaaaacagagtcaaaacggaagaactcccatttctttacagaggctattggcgccgccagcttcattgaaccaaacgggcacctttcgtttccgattgtgctgaaggtgttgggcacgcttatggaacgttgttgcgttgtgcgcgtttctgaggttggcgaatgggggcaccgtttagggacgctaattgttgttcattaagtaattagcagatattaattaattgttatagctaattaactcatattaaattaactaaaaaagattaatttccattacagcaagaagggctaattcaaattaattgttcatttaattgaagctgtgttcatctaattgtgcattatcttgaggttgtgctcactggttgtgacacttttctgaatatgcccggctccgacgcggccgaactgttcccaaaagtgttgcatattgtccttcgcatttccctccaactcggctgctccaatggatgcaacgaaggcgttcacacgccacaagccgagtttctacgcataaaagtgcgcaatttgattgcccaaatgcaccggacaaagtcagttttcggagacaaaatggcataa

SEQ ID NO: 76864 - DNA, 1503 bp, Heterodera glycines
  misc_feature (1461)..(1461): n is a, c, g, or t
  Genomic contig location: Contig_ID=SeqID_13077; Location=1..1503; Strand=-
  SCN-specific regions: Sequence locations=1-226,248-472,653-686,710 -1503
attgcaggatgcctcgtgcatggtgaccaaattggtgccatccctgcaaatcctttttccctccgtcagactttcgagcgtgtaattgtccaaaacattctgcacgggatcagccccagcctttcggatgccattgggtccgtctcccgttggagtttggtccgtgccgcgttccctcacattgtgcaggtccttcgctaattccatcgctcccttttggcacgtgccaaaattattcccccttttcagtgttgtgccgcccttttgaccgaacgttgtgcggaggaagaggacgtgccaatgagtgggtcgctggtcaaatcgctctacatcctccactggttgctcattgacgcggcggcggaatgcaatgaaaataagtgagtaaaattaacacaaagtaaaattctaataacttttcactttcaaaaccaatcccctatgtctctttcttattcactctaccacagtctctctctctctctttctctctctctctctgtgtctccctctctttctttttttccctctctatctctccctctccctctctctctctctctctgtctctctctctctccccttctttccctctctctccttctctctctctctctctatttctctctctctctctctctctctctctctcacatcgtctcttctctctcagatcagtctattatcccttttctcccccttcccttgcaccgatcagttttaccaatgacagtgccgcgagtggcggcggcggaatgccaaatgtgcgtcaactgacctattccgtttcctctgtccaattgttcgtttaccttttggccccgcttttcgacattgtgcgtgaggatgagatcaaaggccattatcggctggaaagcggcgttcgcctgtggcaatgcctttggcaaagtcggctgcccgagttgatttgtttttgcgcgccggtcaaacagcggcgaagtcaaatgccacaaatgaacagcacaatgccatgggcaaagagggcgcagaggtgccgaataagtggcaatagcattttgagactattggggtttagcactgctgccgaacaggggatttacattggggacaacaaaccgtccgcctctctctcctccgtttccggcgtttccggtcgccgtcagtcgcaacttccaccagtgacttcgtcatcccaaccgatggcatttacggtctatcagactcatctgatcccgccaccaaaacctcctcgaactgatgccaaagtgctcaaagagttagaggaggccaagcatcggacgggcgaatgcggcgacgacggcactgccgcagcgacaatcgttcggtcagtgagcgattacaaagcatcggagcagcaaaagcaacagcaattgctgaccaaatcgcagacgacgggcgaaggatttggggacggatcagcacgaaaagcagcagaaggacaacggaatcggtacaagngaggaggaagaggaggaacccctttcacctgattttctccct

SEQ ID NO: 76865 - DNA, 1621 bp, Heterodera glycines
  Genomic contig location: Contig_ID=SeqID_13078; Location=236..1856; Strand=+
  SCN-specific regions: Sequence locations=1-596,628-913,935-990,1039 -1043,1072-1144,1183-1347,1369-1413,1435-1621
atgtcaccaaatgacatgtcccgcactaattatgctgtagtttctcgttgccgcattggcaaaacgtcggccgttcacaatcagatcggtgccttcaattcgggcatcaatattctgtccgtcaatttggtgccgtactccgtcaatgatcacccagctgttttggctttggccagtttgtgcccgattttctggtccatgactcggttgtcgcgcatttgctcgtgcttcttggctcatgcgtctggcggcatgtgtcctttttgtggtaattagatgttagcaaatttgttaaggaaattgagcaaaaaattgaaaaaaaaggaaaaaaataaataaaaataagcattttttggtgacttttttcacactttttgggatttttatgacttttctgcgctttttgtgactttttgaggcaaaatttgaaatgcatcaaagaaaatgccgaaaaatacaaagaaaattccgaaaaattaaatttcgatcggtgaaaaggcaatgaaacctggatgaaatttttcgtaattgttggaagaatcatttttttttgcctattttagttaactatttataaaattaagtgcctaaaaaccgatctctatttataaaattttattctataattgttaaaatgggctttttttaactttcgcctaatttttcaggacttttttacatttttttcgtgctttttggatttttttgtgactttttttccatttttcgtgaattttttgcgtttcttatgacttttttgtgactttttggcgattttttgtgacttttttagtcgactttttgaagattttcagtgacttaaattcccagccctaataattaatatttgcctatttttgtgaaattcgatgcccataaatacacattaatattcctcaccttgggcagatttgattgtaataaactttcttttctgccctatattttagtaaagaattttcgcaaaaaaaaaacagtcaaaacgaactcaaaatttttaaatttttattaaaaaatttcattattaattgaatttttctggctttttttttataaatttgaaaaaaataacttattgaaaccggagtaaatcttttttttcacttttttttcattttaatacattttctttgaattaattcataaataaatccccacatttgtgcctctgcttctgtttgtacacgttgcgcagttgtcaagtgttgttgcacaatattatttgcatttgtcaagtggtgttgcacaatattgtgcacatttggccaagaatgttgcacaatattgtgcacatttggccaagaatgttgcacaatattgtgcacatttggccaagaatgttgcacaacattatttgcatttgtcaagtggtgttgcacaacattgtgcacatttggccaagaatgttgcacaacattatttgcatttgtcaagtggtgttgcacaacattgtgtacatctggccatggctgctacaaaagggttgtacagaatagtgatgctcgagagtcttgatgtcatctggccacgactcgactcgtggaaaaggtctcctgcctggtttttgggatctcgttccgaggctcggggccaattcttgaaccgagaaaagttctcctag

SEQ ID NO: 76866 - DNA, 493 bp, Heterodera glycines
  Genomic contig location: Contig_ID=SeqID_1930; Location=51..543; Strand=-
  SCN-specific regions: Sequence locations=1-298,321-493
atggagccgtctctgctcagatatttctgtccccgtcagtttcgccgattggccaccacttccttttgcactttgagcccacggcaccgcataattgccgagggcggaatgccaccgttggagtacgaatttgagcgcgaaaagtgggcgatgggcgaacggtttggccgctacggactgcgcggaggggtggacattagcaaactgtggccaaccgttgaggtggcggtgcctttgttaacctggggaattaacaaaaagtaacaaattcattgattctataaagttattgccattttaaacaaatttttatttttgtctcaaatgtccaaaaaatgcgaggaaaacgctgaaaaattttgtttttcaggaaattgaagaggtcaaagcggtgcgaaggttcagaacggcgaaggaggcgcaacacattgcgaaaatggagtcagttttggagcttaaaaagagcaaaatcacatctatttcaaaacaatag

SEQ ID NO: 76867 - DNA, 2775 bp, Heterodera glycines
  misc_feature (1600)..(1600): n is a, c, g, or t
  Genomic contig location: Contig_ID=SeqID_1930; Location=3318..6092; Strand=-
  SCN-specific regions: Sequence locations=1-94,116-423,446-735,757 -813,838-1056,1078-1718,1740-1915,1937-2052,2074-2696,2720-2775
  Gene Ontology: Mol. function=electron transporter activity; Cellular component=cytosol; Biological process=malate metabolism
atggcgctgtacgtggcgttggccggcattcagcccagctggtgtttgcccgtgcaaatcgacgttggcacggacaaccaatcgttgctcaacgagtaaattttcgaagaacatttaattttcagggttacgagtgaacatgtattttcaaagtttttacaattgaaatatattttttgcacattttcagcccgttttacattgggttgcggaggaaccgtgtccgtggcgaggagtacgaccaactgatcgacaatttcatgaatgcgtgcaggaaaaagtccgtctgtttaagaaggggtgcaatgctttccccccccctccgaattaaaaaaaaaataaagtgaaattttacaaaaaaacaatttcttgaatttttctaacattaaacattttcgttcctaggcctaccaattcgcaagaatatacatagaaaatattttttaatggaacttattttttcttgaaacactcataaaaaacttttccatatgtcttttccccgttgattcatttttcagatacggacagaatgtgctggtccaattcgaggattttggcaataaaaacgcctaccgattgctcgagcgataccaagacgaatattgcatgtgcggcattttggggacaaatggcattttacaattgaaaaaacgatcggcacattatctgttattttaagctagtactggaagtctcaaaattatagctaaaaatcccttttataccgctggaaaaatgaaaattcttaaaatttgtttttttaattatcccccccccctccccctccttttgatgttcccccgttttgaggttcaacgacgacatccaaggcaccgcctcagtggtcgtcgccggactgctcgcgtgcacacgagtgaccaagctgagaatgcgcgacaccaaatacgttttcttcggtgccggcggagtgcgtttttttaaatcgccgcaaagggaaaaaagcgccaccggacaaattcggacaacttaaaaaaggagttgtactcaaaaagctggtccgggctgtccagttgttgtcccccattcgaatcgaaatataaaaaataaaattttgcccttctgtttaggccgcgttgggcgtggcggaaatgtgcgttcgccagatgcaaagtgagggactgtcctttgaggaggcgtgtggccaaatttacatgatggacatcgacggactgatcaccacacagcgcaaaaacattgagccaaggtcaattcattggcagagggaactcgatgggtttttcctgggcctggatttttgtacaagaaatccaggttcgggtccgaatttcgaactccgaaaaggaatccaattccatgtttttttcaaatgtcgaactataattggatgggatgtccccatttcctttcacatccctccgattttgttgtatttgcgagccgtcacttttcatttcaccccacaggcatttgccgttcgccaagaatttgcccgactcgcagtctctgcttgaggtcgttctgtcggttcggcccggcgcgctcatccgcgcttcgacggtccgtggcgcattcaccgacgacgtcattcgcacaatggccgagcacaacgcacganccgatcattttcgcgttgtccaacccgaccagcaaaggcggaatgcacggcggaggacgcctaccgagtgaccaatgtcggtggcacatttttttacaatttgaatttggcaatttctctagcccagggggaggtctgtcaaagtgttcggaaacaaatttgaaaaaccgtgtcaatgcaatgcaatttaacatatatttaactcttttgtgtgaagggcaccgcgctgttcgcctccggcagtccgttcaaaaatgtcgaattgggtggcaaagtgtacaaaccgggccagggcaacaacgcgtacattttccccggcattgccctcggcgtcattctgttcaaagtgtccaccattgacaacaaactgttccttatggctgcacgggtgaacattttattcaagaaaatatattcggttttctgtttgtaaagaaagtcgaaggcgttttttggaaatttttcaaaaattgtacccaaaacccaaaaattcttactttcagatggtcgccgagtcggtgaccgaaaagagtttggccgatggtcgcgtgtttccccggctcaaagaaattcgggagatttccatcagaatcgccatgagagttgcggaagagtgttaccgggtgagacattcattaatttgcagccacgacattagcaaactgtccaccaataacagtggagagggatgccacgagatttataaagaaaagtggaaaaacataaaatttggcacattgtttggccccaggcccgtttcgaattatattttgggttaacacatttaatttatgccgggttggcctaacgattgggagcgggtacacttacatttccgtctttatggcattcatatgggaacaggacaatttaaatttatgcaggacggcacggccaagctgtacccggagccgacggacaaggaaatgttcatccgctcacaaatttattcggttgaatatggcgaactgatcaacgaaacctacgattggccatcgcacgacatgaagcacggcttccccgtccccgtggtaggttaagacgaaaaagactcacttaaaaattcaaatgtcttaattgtttaaaaacccatgtacctaattaattattaattaattgtccattgaatgccataaatgcaatttaaggtccgcagagacagcatggacgactga

SEQ ID NO: 76868 - DNA, 934 bp, Heterodera glycines
  Genomic contig location: Contig_ID=SeqID_1931; Location=49..982; Strand=-
  SCN-specific regions: Sequence locations=1-116,139-612,634-934
  Gene Ontology: Mol. function=electron transporter activity; Cellular component=cytosol; Biological process=pyruvate metabolism
atgcttggtttagacccggagcagctgcgtctctacaaattgtatcgtccggagcgcttgacgcccagcgtccggggcgtcgacctgctcaaaaacccggggctgaacaaagtgtgtgggaagggggcaggaaaaaagcgcaaaacagacactttctccgttcttttgcccgacgatttaaagggcaacaaaacgccgtttatttgtgtgaaccgctaaaattgtggagcaattccatttgaagactttttggtggcattaatcccccaagagtcacggaaccgggaaaatgtcgaaatcccttcagaaacaaacattttttgaagttgtgatttccagggaatggcattcactttgtacgaacgccaatatttgggtgtccacggccttttgccgcccgcctttatgaccagcgagcagcaggagtaccgagtgatcaccaaactgcgcaaacagccggacgacttggcccgctacattcagctggacggactgcaggtggtcagaggggggggggggggctaaaaacatagtagttttttggcggggagacaaaaaaactttagggttgcatcgtcttttaggatttttcaaattttagtaatgccttagaatttgttaatatcaattggtgtcgtcttggaaatgtttgagaattttctacggaataattgtgtacaacagaaaagggagacggaataaaagtcaatcaaattttaaaaaaattgattaaatgattcccaaatattgcaggatcgaaatgagaagctcttttaccgcgtgctgtgcgaaaacctcaaggaactgatgccaattgtgtgagagttcgggtggaatttactcccaatttaataaaattgcctgtcattttcagttacactccgacggttgggctcgcatgtcaaaagtatgggctcatctacagaaacccaaa

SEQ ID NO: 76869 - DNA, 1061 bp, Heterodera glycines
  misc_feature (338)..(338): n is a, c, g, or t
  Genomic contig location: Contig_ID=SeqID_1934; Location=135..1195; Strand=-
  SCN-specific regions: Sequence locations=1-96,118-419,449-471,508 -766,788-885,907-934,956-1061
atggacaacgatgccaacattttggagaccgaattttgccgttccgtcatccgttcgtgtgccaaattggcctacgaacatgcccaagtcggtacaaaaagaaggggggcggtggggacaaccccgagagtctcgaccctctgttttgcttttgagggaagggcgatttcaaaaaccaaaaagttgcctcttcccgtctgtctaaatgtttgattccattccacttacaatgaaataattttccccaggacatcatcgacaatccgaagaaacaattcgccatcgccgaaatgccgcccattcattgtgaccgcaaaattcgtgacatcaaacagggnggtgcgcaatttggacttaattgcgcgcaaattgaagacaaaacggtaggcttaagccaattacttattgctaaatgtggcttatgtacaaaaaataataatttttggctctttcaaatccatttaattgcattttttgcaaaatttattccatttttacaaaaaataggtttggcaaaggagcactgaagttggaattgcccaaactgcgctttgacgtggagaagtcgagcaccggcatttggcaaccgcgcggcattcgactggacgaagttggcacattttttaactcaaattgctttgagggaacaccaatattcattttcgacaatctcaattcccaataatccattcttcattactcatttttcagcgcaaaggtgccaactttctggtggaagagttcatgttgctgtgcgttttataaatgcttttcccctctttttgaatttcgctaaatgccatttcagtgccaatatgtgcgtggcacgtaaaatacacgcctttttcaataaatcggcactgctgcgtcggcatcctccgccgaagaagagggaaatgaagaatttggtagaggaaacctacaaaaagtcggagaacatttgccaatattcgttcaattaaggtggacaaatgcgccctcctcggcatcaaaatcaattcaattagctccaaaacgttggccgactcgttgaaagtgtacgagcaccgggaggagtacag

SEQ ID NO: 76870 - DNA, 752 bp, Heterodera glycines
  Genomic contig location: Contig_ID=SeqID_13080; Location=555..1306; Strand=+
  SCN-specific regions: Sequence locations=1-209,232-302,324-474,496 -688,710-752
  Gene Ontology: Mol. function=transposase activity; Biological process= DNA transposition
cagagttcggggtccatcagacaacagtgctcaattacctccatcagctcggcttcatcaacaaaaagggtgccgaagttccccatgcactgacccaacaacaaaagcatcagcgagtggtcacctgcactgaacttctcgcccgtttgagtgctggaatgcagctttcccagctgatcacgtgtgatgagaagtgggtttatctcaacaacaaaacggcacaaaaacaatggctgaagccaaacgaattgggcgagccgacccccaggcgtcttcaacatgcaccgaaggtattgctgtgcgtctggtggtgttcatcagggttggcgcgctatgaacttgttccggctgggcaaaccatcaacgccgacatctaccagcaacaactgcagcgggttcatgaccaaattcgtcgtcctccattttctgcaaaattccgcggcggcgtattccttctccatgacaatgcacgcccacatgttgcgttctcaacgcaacaaaaaattgagcaacttcgatgggcggttcttcctcatccaccatacagcccagacatcagcccgtgtgactactatctgtttcgatctatggagcacttcttgagagggaaagaatttgctgatcaaaacgaggtcgaaaatgcattggatgacttttttggatcgaaaaatgatcagttttataaaaaggggattgaaatttgcccgaacgatgggggaggatcattgatcaaaatgtacatcattgattga

SEQ ID NO: 76871 - DNA, 1895 bp, Heterodera glycines
  Genomic contig location: Contig_ID=SeqID_13082; Location=1029..2923; Strand=+
  SCN-specific regions: Sequence locations=1-66,88-135,157-178,201 -330,370-436,458-539,585-977,1015-1114,1200-1895
atgagttgcaactcaaagccatcggccgaatgtttggccgatcggatgaagcgtgtgttgagcaccggcgaagacgcggacgttcagtttttggtcggaaaagacgacaacaaagaggcgagcttattcagctgcaattaattatttgatttaattgggggattaattgttttaaatcaaattttaatgttaattaggtgatttaatgtaagttttgaatttttgtaagcttttgtcagctcataaactgattttgaaaatggcttccgaagtgttcgccgaaatgtttcgctgtgacgacacggaggacgaaagtggtgatgaaaattcaaaataaattttaaatttttactattttaaatttaaatacaacaataattcattttagcggcttgggaagtgattaacagcagcaacccaattgtggtctccgatgttgaggtggtgccattcaaaataatgctcagttacatttacacggaccaatcgcacggaattaacggagacaatgcaattgcggtgcttcacgcgggtcaaactaattaattttttaataatcaattaatttttttttttgaaatttagcaaaaaagtatcgcgtgaatgggttggtcaaactttgcaccaatgttaccatttcggaactgtccgacgtattttttgcgttagctcaagcgaaactcctcgaagatgaggtgctggcctaaaattgagaaaatatttatcttttagtaacattccaatattttagttttgtcaactttccaaatatttcaatattattttagcaatttgccaaaatttaaacattttaatttagcaatttgccactcgctgtttgatttacattgatcacaatgcccacattttattcgaacagtccgaccaatttttgaaaattgaccaaaaattgttgtgcgaaatttttggccgtgatcagctgaaagtcattggagaaatgggcatttggaaaactgtaaaatataataatttattattttttaataataaatagagttgtgcgggaccggaaaattttgccgggaccgggacttgcctggacctgataagccgggaccgggatctcgattttggtcccggaccgggaaccgggaatttttaaaaattcaaaaagaattcaaattctaatttatttcaaataaaaataatacaaaattgatttaataaatcattttttaggctctcctttgggccgatgagaaatgccgtcagaatggcattgactgctcgggagacaatcgtcgtgccgtgcttggccctgctctgttccaaattcgttttccactcatccccaaagaggacttttcggaacaaattggtaagcattttaaatactttcatttaattaattgatttgttttttagtgccttccggcgttttgacaaatgacgaaatgtttgccgttttgctgtaccattcgagtcgcgaaattgcaacagaatgccaagctccgtccgagctcaaatttgccaccattcggcgcaattacatttgcaagcggacttttttggtgaaaattgaacagttttctgcgcttccacgtgcctccgataagaattacgagccaattgacagcgccgtggtggacatcaaagggatccgatggcaattggactattcgttttttttattccaagtgaacaaaaaatccggttactttcgcctttctctcacgtgcaaccaaaatgagaaaggtaatactcagctgagaaatcttaaagtgattaattgcgcaattactaacacaattaagctgccgattggaagtgccattgttggacaatcacacgaacaatggcacaacaaaaaacgggcaaaaaatgcgttgtctgggagagagatgacatttttcgtcgctgcaggccagacttaa

SEQ ID NO: 76872 - DNA, 706 bp, Heterodera glycines
  Genomic contig location: Contig_ID=SeqID_13083; Location=1121..1826; Strand=-
  SCN-specific regions: Sequence locations=1-249,272-399,421-532,591 -595,617-706
aaaatgctccccattccatggctcaacttttcgcaagcagcaccgaaacgcttacagctgcgccgccaggcgctatgcgccgatttttgaaaagttaacaaaaacaggtaagcatatctcagttcccaaatttttttgttgtctttgccccggttagaaaattgtaacgggagatcagtttccgaaagcaaaaagaaatgggtcgataggtgccgaaattgccaagtgcggggccccatttccgagaaaccccccccccccccccccccccgtttttttatatatagataatagagatttttttaaagaaatcgttataacgttctttttaatatcataaattgaaaaaaaaccatttatagtgccataccattcattttcattatgaaattatttcattttcagtaaatattaggaaaaaattaacttagattgtcctccacaacttgtgccggtgcctggcgaaggcgctataccctacagatattgctctccgtcggcaccaattaacgatggcattcaggtccgagacatattatatttataatagtatttttttaatgtttaacttgtatttttaataaaataatcacatataataatacatatttgaaaaagggatgcggtataaacagacattgccaatactcaacaacactcgaacgctacatttgttacggacttgagagcaatgtccgactaccaa

SEQ ID NO: 76873 - DNA, 400 bp, Heterodera glycines
  Genomic contig location: Contig_ID=SeqID_13086; Location=258..657; Strand=+
  SCN-specific regions: Sequence locations=1-73,102-364,387-400
atgagtaccgagatttctaactcgaaattggttttaatgatcctaatgacccacctgccaactttccagtgaaatttaattacttttaatttgtttttattcgctaattacccatttatccatacttttcagtgaccaaagacacaaacaatcgtctgatgcgttcgctggtgatcattttgttggtcaatgtcggcggctatctgatcaatcggagcgtctatcagttggccttctccttccagcaacagctcggctcttatgtccgcgtttggcaattcactttcatttccggctctctgctgaacatttgctcagccgccaacgcaccgattctttttgtgaacaggtggaaaattagaagaaataatttagcatttttaaaatggcctcaaggtta

SEQ ID NO: 76874 - DNA, 423 bp, Heterodera glycines
  Genomic contig location: Contig_ID=SeqID_13088; Location=662..1084; Strand=+
  SCN-specific regions: Sequence locations=1-359,381-423
atggtactgattgggagagatttgagagtcaatatttcgcctgaaggaatacgctgccgcctttcacttatttttcggcattttctttactgaaaattcaaatttgccttagaaggtgcaaaaaagttccaaaataagaaaaactcataaaaagcatgctaaaatgcttttcaagtcattttaatgccattttgaggtagcagaaaaaacgcatttgacttaaattcccagcactagtaaccatcaaaaaactttagtgaaaattaaaattaatctaatcaattttctgttttccaaatgtcagaaaaagaaaggttggccagcagaaactcgtggagtttcggaaccaaattttgttggtggataaattataaaaaggtcatcggcagatcttcaacaaaattaagtagttttaggaaaaca

SEQ ID NO: 76875 - DNA, 524 bp, Heterodera glycines
  Genomic contig location: Contig_ID=SeqID_13089; Location=1360..1883; Strand=+
  SCN-specific regions: Sequence locations=1-10,122-320,354-371,408-524
atgccattggaaaagaaaaagaagcgaggtaaaaatggaaaaaataaaatataatttaataataaaaaagcaaaaataaaattaattaaacatatatttaataataaaaaagcaaaacaaataattaagaaggtatcaaaaaatgaatacgatacagtcgaatggcagaatggaaaacgtggaatcaagcaaaaaatgtagtaatttggtcgtgatggccaacaaaacggggagcaaaatccgagaaaacaattggaaagaaaaaaactaaccaaatgaattggaattaaattttctagaagattttggcgttggagcgcaaaaaaatgtaaaaaaatatataaataaataatgaatagcgccggggagccaaaaatatttgaaaaaattaaaataattgattttaaggcgcaaaaaagtgcttacatcagagaatggcacgacaaatatttggcggacatggaaaaggtgttgggacagaagcgaactcagccgcgaaatctattgacagagcaaaagtataa

SEQ ID NO: 76876 - DNA, 1772 bp, Heterodera glycines
  Genomic contig location: Contig_ID=SeqID_13090; Location=216..1987; Strand=-
  SCN-specific regions: Sequence locations=1-9,31-398,433-690,712 -978,1002-1213,1235-1286,1316-1772
atgggaaacggaattggaagaaatgaaaagaatggattcaaagttggcaggtacggtatgtttggggtacggtaagtgcgggagggaggggggggcattgatagggacagaacaagtgccgttctcgtactgacctgcttgccgtttcgttaggtcattgtccaagtgccgcgtgttctcttcggcatttttggcacggcaatactccgaaagcacaacaaatgaaagaattaaaagcaaaggacgacggcacatggcaaagaatggagagagagagaaaggcaaagtgagagacggacagacagtgggaggaaagagcgacggaaatgagcacaaaaaggcgaaatggccgaacttgcccaatttattggaaaatgaagtgacgaaagacgagcaaaagaggagataattaagggaggggggaggagggaaccggaagagagagaacaaagggatgggagtggccaagggatgggcaatcggcggcagatcgttccccccccgtcgcatttgatcaacaaacattcctcgcttggccattctcaccccccccctccctcagtccccgcaactcctcccgatcggacgattcactgattcattcgttcattgtccactcccccctacactgtccaattgttgctcatcattcattaatcggtccattcattcattttccggagaaagacaccccgcgggaagaaaaagaaataatgaatgggtaatgagcagaaaagtgcagagaaacaatttggaagggatggaccaaaacaaacataaaaaacagagagaaagacagaaattaagaaaaggaagcaaatcaaagccaacaaaaagcagacaaaaggacccggggacatggacaaatgagcaacaaaatttgatagtttttgtttgagtcttggacctatgattaatattataaccgggttttgtaccaatccccggaaaagacacttaaaatacatttatctcatcaaaatttaaaaacaaaataacaataagtcaacagaaatgtcactgtccatttgacaatttgagatgggcgtccaaagtccgagtgatttgtccaaccaacgcatccatcgtggaagggatttgccgcaaagaccgatcgaacatttgggccatttggccttgcattttaatccgagagtctttgggggacaattcggagacaaaatcgacgggtaaaatgcgactatcgacgacaaaagctaaaaaataaaagttaggacagaaattgaatcagaagtcatctcacaagcagaagctacggaaaaaacaaatttataaatttaaaaagattaaaaatcagaaaaacgaagtttaacttccaacccgaattataaactcaaaaaaagacccaaaataaaaaaggaatttctatttattttataattcctctcagatatataatatttatatagaacatattttatttgtgagttatgtgaccaaaaatggatttgtcgtgaaaatggatttaccgataggctgtatccatgcgtatgcgtcactcgtgttcgccatttggtggatgcaccgctcggggtcctttccgaacaacaaacatgtgcactcgtccaccaacaaaggggtgaccgcactgagctgactctgttcgaataatttgcgcaatatttttgctggctcagcgcaaagttcgactccgttaagtcgaaagctatgaaagggagaaaaaaaagaaaaagttaggaaaattaggacaaaattcaaatctgtttcgacaccataaaaaatttattaaa

SEQ ID NO: 76877 - DNA, 1095 bp, Heterodera glycines
  Genomic contig location: Contig_ID=SeqID_13090; Location=1563..2657; Strand=+
  SCN-specific regions: Sequence locations=1-6,28-395,417-617,639 -793,815-1095
  Gene Ontology: Mol. function=SH3-domain binding; Cellular component =lamellipodium; Biological process=hearing
ctcccccctcccttaattatctcctcttttgctcgtctttcgtcacttcattttccaataaattgggcaagttcggccatttcgcctttttgtgctcatttccgtcgctctttcctcccactgtctgtccgtctctcactttgcctttctctctctctccattctttgccatgtgccgtcgtcctttgcttttaattctttcatttgttgtgctttcggagtattgccgtgccaaaaatgccgaagagaacacgcggcacttggacaatgacctaacgaaacggcaagcaggtcagtacgagaacggcacttgttctgtccctatcaatgcccccccctccctcccgcacttaccgtaccccaaacataccgtacctgccaactttgaatccattcttttcatttcttccaattccgtttcccatttttaggattcggtgttccttctgcgtaagctccccccgcccctctccgaattcattttccgttgcttttcagttacggtccgtgtgcccctgcccatggcccagtcggatggtactgaaaatggcaaaaaaaattttggtagtttgtctttaaagtgcgccacccattgctgctttgccgcccccgcctcttgctcccgtgccgcctcctcctccggcgcctgccggacgactgatccctcaggcaatttgtcctctgggcattaaataattcaatgcgtccccatttcattgaaggcattgcctggcgccccttgtgagcccggcgtggaatgcaccggggggagtgtgtgctccatgggcatctgtgagtgcctccatacttttcttcccttatatgccttcccaaggtctgtgtccgcctgaactcgttcaggaaggcaccgtttgcgtgtcgcgcaccatttacggggtcgtcccgccaccgggcggtccgccgccactcccagcggcacccgcctatgctccgccgcctcctgccccggttgtccaattcgcaccagcgccattcccgtcgtccggtgtccccgcctttccaatggcagccgcacctccgccactccccgcatgtccaccgccattccgcgcagcgtgcgtcgccaggcgaagt

SEQ ID NO: 76878 - DNA, 646 bp, Heterodera glycines
  Genomic contig location: Contig_ID=SeqID_13091; Location=237..882; Strand=+
  SCN-specific regions: Sequence locations=1-119,141-149,179-575,597-646
  Gene Ontology: Mol. function=protein binding; Cellular component=SCF ubiquitin ligase complex; Biological process=induction of apoptosis by intracellular signals
cactttgcccaagattgaacagctttgttcagaacttttggttaacgaacagctggagaaaatcagtctgatgtccagggaagttgtgcaacgggaaatgatgcacggtgagttggcaataagaggagagaattgacttggccaaacacagtttcaatttccattttcagaccttcagaacatgtacattctgttgaaacctttgagcaacgccttgccagttttgatgcaagaattcgaaatttatattcaaaagtcggggatgaactgcatggagatgacaatcaacgaacctgccgaatttgtgtccaacattcagttgctgcacgaaaagttcacgcagatgatcagcaccattttcaatggggacaatgaatttgttgccggattggaacgtgccatccaatcggtggtaaaccaccgagacgatccaaaacagccaccaaaaatttcggaaaaattaaaccgctacattgactcgttaatgcgtaccaacagcaaaaggggaaagagtgagcaggaacttgacgcacttttgtcaaaggctattctcatctttcgcttcattgacgacaaggacttgttccagaaattctactcaaaaatgctctcaaatcgtttggtattcgaaattaaattgccatga

SEQ ID NO: 76879 - DNA, 1008 bp, Heterodera glycines
  Genomic contig location: Contig_ID=SeqID_13092; Location=104..1111; Strand=-
  SCN-specific regions: Sequence locations=1-296,318-323,368-529,551 -558,581-672,736-794,818-846,868-1008
atgaccagaaaaagcaaaaatatgttaatttttatggatttggttctcttacattttttgaccttttgtcatgggttcgggtccgcccgaccggtggttaattattttgatttttttcctaacaataagtattattcacctagcatcttttggtgggtgcaccccaaaattttgccggaacataatttcaccaaagaaatctttttttaaatttattcaaatttcaagaaaaaatctttgagaatttttttttgtataaacttttttagcgattttttgtaaaaaaaatcactgaaaaatttttctaaataggaatttctaagatttttttcttaaaaaatttttaaatctattttttaatatttttgcggcgaaatttcggtggcgaaatttttgtcctgtcccctttttggttatattagttacttttttgttaaaaatttattagttttgagtgtttttgactcaattttttaaattaagagaatttgggagtccgaatgatatcagaccatttccctattgaagtgattttgttgcttacattaatattcgccgaattttatttttaatttttaaacttaaactttcatgaaaaaatcttattgttagaaaaatttttgtgaaaaatttttgtaagaaaattcaatgaaacatttttaaatttacagcgatttaattttatgatgaattagtaagttttttcgttttccaaaaaatgctacaaaattttcattcttgaaatctcttaactttattcctaattgtaagatttttcttattttcaggcttctcctaaactttttaaattttttgtgcttaatgattatttcgctgatattttaaatgcaaattgagtttattttacaacagccaataatgctttttaattgtttctactatgtaaaaatccgttattaaaaaaatcttaatttttggggtcaaaatcttaggtttaacctagtttgaccttattttgaaaaaaaaatttgcatccctgcaaataaa

SEQ ID NO: 76880 - DNA, 1762 bp, Heterodera glycines
  Genomic contig location: Contig_ID=SeqID_13092; Location=1..1762; Strand=+
  SCN-specific regions: Sequence locations=1-102,124-244,266-294,318 -376,440-477,499-531,554-561,583-676,706-744,789-794,816-1232,1256 -1407,1430-1762
ggtcacaaaagcaccaccgttcctcatcgatgttcgatcagaaatgttctcttacatcaaatgccaacggattgccaaattctcataagaaaataaagtaagatttatttgcagggatgcaaatttttttttcaaaataaggtcaaactaggttaaacctaagattttgaccccaaaaattaagatttttttaataacggatttttacatagtagaaacaattaaaaagcattattggctgttgtaaaataaactcaatttgcatttaaaatatcagcgaaataatcattaagcacaaaaaatttaaaaagtttaggagaagcctgaaaataagaaaaatcttacaattaggaataaagttaagagatttcaagaatgaaaattttgtagcattttttggaaaacgaaaaaacttactaattcatcataaaattaaatcgctgtaaatttaaaaatgtttcattgaattttcttacaaaaatttttcacaaaaatttttctaacaataagattttttcatgaaagtttaagtttaaaaattaaaaataaaattcggcgaatattaatgtaagcaacaaaatcacttcaatagggaaatggtctgatatcattcggactcccaaattctcttaatttaaaaaattgagtcaaaaacactcaaaactaataaatttttaacaaaaaagtaactaatataaccaaaaaggggacaggacaaaaatttcgccaccgaaatttcgccgcaaaaatattaaaaaatagatttaaaaattttttaagaaaaaaatcttagaaattcctatttagaaaaatttttcagtgattttttttacaaaaaatcgctaaaaaagtttatacaaaaaaaaattctcaaagattttttcttgaaatttgaataaatttaaaaaaagatttctttggtgaaattatgttccggcaaaattttggggtgcacccaccaaaagatgctaggtgaataatacttattgttaggaaaaaaatcaaaataattaaccaccggtcgggcggacccgaacccatgacaaaaggtcaaaaaatgtaagagaaccaaatccataaaaattaacatatttttgctttttctggtcatttttggcgcggagccaaaaaaaccgaaaattggcaatagcaaatcgactattaagcacaaaaaattctctctcctcctgggctatgaccctcccccgcacagtttcactatatcttttaacatgtgaaaattttgaaacaatatacctagtccaatcctacgtcattggagcctggttttgccgctgatcatggtaaaatttaaagcattgaaaatcattcagttgcgatgttcacccgatacagttcatgcgcaaaacgcattggtcgccggccaaacgccgctgcattgacgccaaattttttgagtccgtgaaaatttaagcactcgctgattgattgttttcgtttaggagcaacaatcgcggtgaatggaatttcaatggtaaccatgccaggcggttgttgtgcggacgtggcaatttcaaactggagaacatgttcaagagggtgagatcgttggtttttcaatcgaatcgctcccaaaatttgtttagtttttctccattgccccgcaatttcatcgagcacaatcggactgtgaggctctgttgcaagtttgcctctcctacggcatggattttgtgaaatttgttgaccgaaattgttcatctttccccgactgcttctacacctcctccaaaaagactca

SEQ ID NO: 76881 - DNA, 396 bp, Heterodera glycines
  Genomic contig location: Contig_ID=SeqID_13092; Location=1327..1722; Strand=-
  SCN-specific regions: Sequence locations=1-293,316-396
atgaacaatttcggtcaacaaatttcacaaaatccatgccgtaggagaggcaaacttgcaacagagcctcacagtccgattgtgctcgatgaaattgcggggcaatggagaaaaactaaacaaattttgggagcgattcgattgaaaaaccaacgatctcaccctcttgaacatgttctccagtttgaaattgccacgtccgcacaacaaccgcctggcatggttaccattgaaattccattcaccgcgattgttgctcctaaacgaaaacaatcaatcagcgagtgcttaaattttcacggactcaaaaaatttggcgtcaatgcagcggcgtttggccggcgaccaatgcgttttgcgcatgaactgtatcgggtgaacatcgcaactgaatga

SEQ ID NO: 76882 - DNA, 1036 bp, Heterodera glycines
  Genomic contig location: Contig_ID=SeqID_13092; Location=2246..3281; Strand=+
  SCN-specific regions: Sequence locations=1-491,515-890,912-1036
atgccaacagatggaaatcgctttcctaaaatcacggaaatggcttatatgtcggtgccgcgggtgttgttccttgagggaacggagcaaatgtccgcgcgccatttgtcatcgatgtcgcaagacggcgaagaaagcattgagccggtgcaggtcgttacgaatgtacacgtgcgacagctgaatccgcagcttaatgacaaggagcggttcaagtacgaggaattgcaacggaaagtgccaagtgagtcgtaggttttagcccttccttcagctgtttgttgcccaggcgtgcttctcaaacaatccgatttgacatgcaaatgcactttcgctcaggaatggcccggagtcgtccacctgcttcagactgttccaaaaccagcctgtctggttgcgcacaatggtctcaactttgacttccgaattctgtgccacgagttgcgcaagagcgacctgttccgtacccatccgatcccagaacaggtgacgcttaaaattgattgggttttctggttacaattgttgttcaaccaggtttatttcctcgacacgctttcctgcttttacgaactcgagaaggagtacaaccgcgagatagaattaacgatggaaaatgttgattggactcttggtgggtcactcacacgatggcaccaattttggctttccaattccagttttgtcccaattccaaccgaacagcgaaactgtcgttgcaactgccgagatagaggaaactgtacaacaaaatggcactgcttctgagggaacacaaaattccaatggtcacaaaagcaccactgttcttcatcgattgttcgatcagaaatgttctcttacatcaaatgccaacggattgccaaattctcataagaaaataaagtaagatttatttgcagggatgcaaattttttttttcaaaataaggtcaaactaggttaaacctaagattttgaccccaaaaataagatttttttaataacggatttttacatagtagaaacaattaaaaagcattattggctgttgtaaa

SEQ ID NO: 76883 - DNA, 562 bp, Heterodera glycines
  Genomic contig location: Contig_ID=SeqID_13094; Location=20..581; Strand=-
  SCN-specific regions: Sequence locations=1-69,91-154,197-319,341 -529,551-562
atgcttaatagattatctcttgacgacgattttaccctgcgtttggacgacatttacactgttggcgttgtgcatttcaaaaatttgtttccatcaaatccgtcacctcaagtgatcaccgcgcgacgtattgttgaacgatcgaaagcaatcgtaattaaataaaaattaaaaaacgaaaatttattttaatattgacaacaaattttcagagcactccaacagttgcacaagatttagcatctaccaagaaaatacaacaggtgggaattgcttaatttggcatgagccaaacatggcacgggccaaactcgggcccaattcggcacgagaaaaactcggcacgggccaaacttggaccgggtcaactcggcacaggccaactcggcactagccaaaactcgggatgggtcaactcggaacgggccacactcagacacgggccaaacttggaccgggtcaactcggcacgggccaaacttggcgttggactgcggcgagttgactcgtatcatactattttaaacagaatatttttaaatgtgaatttaaatgaattaaa

SEQ ID NO: 76884 - DNA, 643 bp, Heterodera glycines
  Genomic contig location: Contig_ID=SeqID_13095; Location=250..892; Strand=-
  SCN-specific regions: Sequence locations=1-100,158-253,275-284,308-643
atgtcggaacaacacatggccattggcatttatgaagcatggtaataaatagtcaagaaaattattggggtcactcaaaattatgttcagttcttagtgctttttttaaaaaaaatatttactttttctatgtttacaattttagttttttttaaatctagaaaataagtgattcaaggacttgaagccatgaatcatagatttgacaaaattatataggtttttatttcatccggtaaaaacggttatcgtacccggaaaaaacaaatttaaattactcttggtaaaatttatgggtttaaaaaattccatagaaataatttgttgtagagttttttttatgtaaaatggattttgaagggtctccgaattggttcattttcaaaaacgaaaaaatcgcacaaaatcatgaaaaatgtgataataaaaaagggaaataatcaataagacacatccattaatgcaaaataatcaattgatttacaggaaaagttatcgtgatccaaatgcaattgtcctaatggtgtcgaacaaattcagtcgttggcacgaatttatccaaattgacctattaatagaagaaatatcaaaaaagaaaatcaaaatcatttatttgagtctgtttgaatgcgctgaaaagtaa

SEQ ID NO: 76885 - DNA, 360 bp, Heterodera glycines
  Genomic contig location: Contig_ID=SeqID_13096; Location=485..844; Strand=-
  SCN-specific regions: Sequence locations=1-8,62-131,153-212,235 -262,287-360
attctctcatataaaataaaaatgaaaaaaatattatgttcaaatttattaatattaaaaagcttaaaaactaatttggatatgaaaaaaaaacaaaataattatttacagggttggggaattgaactttagaagaagaaaaaagtatggaaggcacaaccaccaggccaccgacgctcacattggctttacattctttgaaaatgatattgaaaaggcaaaaaggaaaagcttcatatctcggccagaagcttcatttagcaaaaataaaaaaaaatttataatacaaaggggggggtaatctacctaccctgaaagtttcattcggaagtcccatggtcacttgggtacctctccttt

SEQ ID NO: 76886 - DNA, 822 bp, Heterodera glycines
  Genomic contig location: Contig_ID=SeqID_13097; Location=102..923; Strand=-
  SCN-specific regions: Sequence locations=1-128,150-822
  Gene Ontology: Mol. function=protein binding; Cellular component =lipid raft; Biological process=signal transduction
ccccccccccccctttgcagccgatttcgacgacacttccagcatggtgtgccaatggatgttttggcttctctcttggcttctccttctgttcactttccccgtctccgtgtgcttttgcattaaagttggaactcaaaatcaaatccaataaatggccttttgttgacatctaatgttctgttttttgccaccgctctttttcggcaccttttaaaacattttcaattccggggattttcggtttaatttccatttgcaaataagcgattaattgacagatagtcaaggagtacgaacgagctgtgatctttcgattggggcgactgatcggcggaggcgccaaagggccgggtaagcaattggaagtgatcggaattggcaaagcgttggatgccaaattaaatgcacggaaattgctgccattgccccaaaggtcttttctgggtgatgccgtgcattgagtcgtttgtacgtgtcgaccttcggaccgtctcattcagtgtcccaccacaagaaattctgacgaggcatcgaccaaaacaatgtttggcatttcgttgtgccattttagggattctgtcactgtttcggtggacgccgtcgtttactaccgaattttgaacgcgacgataaggtaagaagcaattagcggacaaatgaacgaaacggaggcaatttgaacaaacaaattccaaaagtgtggcgaacgttgaaaatgcgcaccattcgacgcgacttttggcacaaacgacgatgagaaatatgctgggcatgagaacactgtccgaaattctatcggacagagacgcaattgcatta

SEQ ID NO: 76887 - DNA, 419 bp, Heterodera glycines
  Genomic contig location: Contig_ID=SeqID_13099; Location=437..855; Strand=+
  SCN-specific regions: Sequence locations=1-110,133-419
gatgaatgagaacagggagagattctacgagccgggaatgactcaagcggacgtggcgaaggccgcaggtcgccattttaccgttacagaattattatgctgtacagtagcccagaaaaaggaaggcaaaaaccatttattttagtcttaattcttggttccaattcctttataaatcgttttttgggttaacaaatgccatttcgggagggttgcactgggcgtattttcctcaaatagtaaaacattttccaggcgaggaatggcgccgtttgcccgagtcagagaaggccaagtggggacagagatcggcggaggaacgaggacgtcaaggggggcaaggcgagagaagaaaagggcacggatttgggatgattaaaactgtgccattttcagatgtggaggaagaggagcagtaa

SEQ ID NO: 76888 - DNA, 129 bp, Heterodera glycines
  Genomic contig location: Contig_ID=SeqID_13099; Location=1411..1539; Strand=-
  SCN-specific regions: Sequence locations=1-129
cccccgctgaaagaagcacccgagacggattggagttgccatctgtgcgtgaaggaattcggcgccgaagcgtccattgcgaaggcgacaaaaagcacggaagacggcacatcatcaccagccaaatga

SEQ ID NO: 76889 - DNA, 1793 bp, Heterodera glycines
  Genomic contig location: Contig_ID=SeqID_1935; Location=5974..7766; Strand=-
  SCN-specific regions: Sequence locations=1-53,75-132,154-382,409 -555,582-620,651-855,939-1031,1053-1404,1426-1445,1468-1593,1617-1793
  Gene Ontology: Mol. function=DNA binding; Cellular component=nucleus
atgcctgaatttcaactccatgggtgagcagaaccaacccacctacaaaaatcaaaaaaaaaatatttttttttgttaccccctccaagacactcttcactaaaaaattgagtgaaatttttctggaaaatccacaaaaaagcaccacaagtccctgttgaagtatggaattttttcaaaaaacttagggcttttacttacataatttggcttctttttcactctccccgtctttttagtggtggtggtcaaccgaattcgtcgtcgaatgtgcctttgcagcagcaatattttgccactttccacccgccacagcagcaaagttacgaggcatggatgagcgcctatcagaattagtgagtttgcagggggtaaattttgcaaaaaaaaaaaaaaaaaattttttttgtttggtggcgatttggccattacgaaacaaaaataatattcgttctttagcatgaaccaaatggcggcggcacagttctaccaacagcagccctatacttctgctgcacatatggcacaacagcagcaacaggtttggcctgggcgacaatccccccacccctcccttttctgatcgtaaccttggtttttcctgatgcatggatttttgtccagcttcaggcctttttcaaaatgtcaaacccttttaaactttcctatttagcaacatttcaatgagcttttgcattcctctttttaggcctacgcattttttggcggacaaatgccaccaaccgtgcagcaccaccaccaccagcaactgtttgccacgccaatggttccaccaccaccgcattttggtcaggcccaacaaaaccacaacaacatgatgatgatggctgtaccgcaccagcaacaccaacatcagcaacagcaacaacgcgctgacgaagcaccggccatggtgcagcaacaacagcagcagcaacgaatggtgggcggcggcggtgttggcgaagcggcggccgcggcaggtgccggtgcggatttgttggacattgtgtacaagtcggtgcgcttcgcactgttggccatggtcctgtacgtgtacgcgtcactggaacggtgagtgtttgctatgcaatacagtagtgctttggtggtaccaacttgatagtagggtgggggaaaacgtttagcccgattttcaaacggccaacgaaaaaaattttcaacgatttcttggacaaatttttcttttaatttcttataaatacggaagaaacggggggggggggctagcgaaatgttcccaagttttgcttcgtcacacatgtctagtcttaactgaacccaagccggtcgtaaaatactcaaaattatgtgccgtattggaaagccaacattatttgttcatggcacatgcctaagactctttcatcacagttaaccccctcttcttctcactcactcccataatttcattccaaaaattttgcagtttcttcctcgtcctcgctgttgtggcgttcttttggtttgtccaccgtcggcggaaccaacagcagcagcgggacaacgccgctgcggcacacgaaaatggtgccattgccaatgtgttgccaccacagcatgcgcttccgcaacaaaatcaacggccaaatgacaacaacacggaagcggacggaccaccggcggcgactgaagcggaggacacaacatcgaccgccagcgccagtgttccgcaccagcccagcgcatggaacgtgttcttcacggttgtgcagtccttcttcacctcgttggtgcccaacccgatgccggcaccgttggacatcaattag

SEQ ID NO: 76890 - DNA, 486 bp, Heterodera glycines
  Genomic contig location: Contig_ID=SeqID_1935; Location=5035..5520; Strand=-
  SCN-specific regions: Sequence locations=1-57,94-486
aaatcattgactttaaacttcggtttgtttccactacttgtacacacaaattattgcttatttaaaaacaaaaatttctttatattttttattcctttttttcgttcattaactgcacacagaagagacgcaaataacaaattgtgtatgtgtcagaattatgtataaaacagatggattaaattatcttcaaaaaattttgttaaaaccgatcacaattagtaaatgaatgatgggacagcaattgccgtttgtcaatgtcccgaactctacaaaaccatcgattagtagtaattaacggttaattagggggaattgcttaattcgaaggaaggcaaaaaaagtgtaatttccgcagcgaaaaataacaattatactaccattttgacggatatataaaaatcctccaattatcccatggcgatgtttcacgcgacggccaaacggtcgaactccgtctcctttgccaacatttctttggtccac

SEQ ID NO: 76891 - DNA, 1048 bp, Heterodera glycines
  Genomic contig location: Contig_ID=SeqID_1936; Location=256..1303; Strand=-
  SCN-specific regions: Sequence locations=1-519,541-1048
atgatccaccgttttgtacaggaaaagtgtaataatagtataaaaggagtgcagcaaaatttgtgagtttgcgattaacgagtcctaaaataaaattaaaatactgccccccccctaaattagagcctctctcccctgcaataaagccccccccccctccattttttgaaggattgaaaaataaagcccccgagggctctattttaagaaatatacgacatttgtgatggtatttctgacaaattttgtcagttttagtaaatgcattcatttcaatgacttaacggatttcattaatccaatcttaagagataaagacacagtattaatactatccgagcaaaataatgtcgacaattgatggcaccgccgcaacttttcaattgaccattcgttgcgccatgcaatcatttcccgaccacactcttgaatgtccggctgattggaagtaaattcatgtccaaatttttgagtttttttccccacaaaattaggattttcaactttgttcatcatgaataaacctgtttttcactgttcagaacttttaaaaacagacaaaaaaaaatgaaaatctgtgaccaaaaaaagtctttgggaaatgccccggaagataaaacactgtgccaaaattattgatgctaattgatcacaccaatttcagtgtgctccaactgaaaactcatttggccgaggaatgcgtcacaaagcccgacccgtcgcgccaacgtttgatttacgcgggccgttgtttggacaatgagcaaaaggtgcgcgaagtgttggcccaacgccgggacggaattgtgcgcaacgaagttgcggagaaacaggtgacgcattaatcatcattggtttggaaggtctggggaggggagaaatttgaaaatctgccaaaattagttagtttggcatggcaaaccgtgccaaattgggcggggttggagtgtccctcctctttttttggggtttcgcaacaatttaatgggacggcacgtgggggagaattgtgcaacaaacacttttaatttattgagttagaaataaa

SEQ ID NO: 76892 - DNA, 574 bp, Heterodera glycines
  Genomic contig location: Contig_ID=SeqID_13100; Location=2116..2689; Strand=-
  SCN-specific regions: Sequence locations=1-382,404-455,484-574
atgccatggcattttggaacttggcacactcattccgacaattcctatcctgcattcatcaacattgttggccatgtgctgattgtggagggcatatgtgcgactgtttacgtagacatttacgtgagatgcaatagttgggcatttacggtgatttggttggccattatggtaaatgtttttccttttactaattaattaagcgtgagtttggtaaataggtcatttaaaatgaattcttttttgcatcatggtataatatgcaaatgaccaaaataaaatgtaaaaatatatatattccaaaaagccataaaagtaattgaattttgagttccaatcccgcagcgggatccacaaatttgaaatttccggtctctaatcacaacaaatcaaaaaccgaaaagagagccacagttagcaattagctaattgtaagaccatataatattgaaattttatcattttcttttattttcttaaaaaactcgttctttagggtgtaatcaatgattaatttaatttatttttcagaaattacccatttgatttttggtttgatttacttttaaataaa

SEQ ID NO: 76893 - DNA, 878 bp, Heterodera glycines
  Genomic contig location: Contig_ID=SeqID_13101; Location=740..1617; Strand=-
  SCN-specific regions: Sequence locations=1-79,144-146,168-527,614 -785,821-878
atgttcactgtgatttttgctgaaggcctttttggaggtgcctcatatgtcaacacattcgacagaattcacaaaacggtaaaaatatatttaaataaaatatatttttttaattttaattaaaaataaaaattatttttaaacagagacaattaaatatttactaaactatacaaaaaaaaaatcattttaaattagaggaatgactttatattttatggcattatgcgaatttgtataatgtaaattcttaattatttttttatgaatatttttaggcccccaaagaactgcgcgagttcagtctgtcaattgtggcagcgagtgactcattcggtgtgacaattgccggcttttcggccattctgttgcacaatcacatttgcatgctttacggcacccatttatacatagaaaataacacaacttatggcaaaagagattacagaaaataaaaaatgatacggtaacttacatctggcccaagttttcttattgtatgaacggtataatcattatcttaattgttaatattataatattaatcattcattatttaattatgatcaatattaatatttgaacaaaaaatatgtcaaattatattaattttcgataagaaaatcaaatttcattctgtacaattttgatgatatcttcttgggtttctttaaaaattcaaattacatgttcatgctctgtcgccccaagctgaggtcaattgtttaaagtacgcttctttgtcctgattttcttgttgaattcgttcactaattggccttccgaaatttttaaaaaaaattgaaattgaaaattaaaacaatgcttttttatgctcctttgagaaagtcaaatttaaatcagtgaagtaaaataaa

SEQ ID NO: 76894 - DNA, 1401 bp, Heterodera glycines
  Genomic contig location: Contig_ID=SeqID_13103; Location=101..1501; Strand=+
  SCN-specific regions: Sequence locations=1-145,168-178,221-283,313 -808,830-1374,1397-1401
  Gene Ontology: Mol. function=tRNA guanylyltransferase activity
atgctgagcttgaatttttgcgaaaagcaaaattggcagatgcagggactgcaacagcgggaatttaaaccatcggagtttttaccgaataccttttccgatgacatcggatcaaacaacagtggattttacgaattgaaggtactttttaaacatttgtttttataccgttatacccatttataaatatataaaggtaaatgaaattttaaataattttgggcacttaacatctttttgggagagatgatgggaaaacaaaggtggatcttttacttatagtttcaaaattttttaaaaataatgttcagtttggtgtaagtttttattttgattggtcaatacaattgtcagattcaacaaatataacacgttttatatttaagtgtctgataactcatcagggacgttcaagcaattcgggtcattatgtcgcgtgggttagggttggagatgacgaccaaaaaccgaacactaccaaatgggtggtctgcgatgacaataatatttcgccagtgtctgaggaggaaattctgaaattgtctggcggcggagattggcattgtaatgacatggaactgattgctttctcacattcacacactttaaggtgcttatgttcttatctacggacccaaaaagattccgaagctttgagagccgaaagacgagtaaaatttgatgttgattgacactattcaagaatttcgacagtgtttttaccaagataaatttgtttattttgagtacactgttgtttttaatgtatattgttaattcgctagaatacatttgatgaaatgcttttagttttctttttctttagcattatgacaataatccgtgattttttgtgccgttcgtcgtaccaatcgttggctcatttgtgccgtaatcaaattcgcgtttattctgtagaaagggagggggcgggcacggcttcgggcattgaacacgcgctcaaattcaacaaagcgggagcagtgcacaaaaaagagttgaaggattacaaatgcgtcgaatatcttcaccaaaataattattccttttatgacaaggaggtgggaaaattacaaaaaatataacggtcaaaatatactaacttaagccttcattgaaaaaaaatacatattcgggttcgaaataatttaatgccatattcatgatcagcgctctctaaaacccttaaagcatcacaaaactgctcaaaaccccctttttgtctctttttgtgggaagtaaagccgatgattaccaaaatgacataaattcctttttaagtgtgagctgcagcaatttcgcgtggtgcaaccgacgaacaaattgcctgacaccgaaccgaagttcaaatcatcttaaaccgattgatttcatgaaaaattttgttttttaattaggaaa

SEQ ID NO: 76895 - DNA, 1274 bp, Heterodera glycines
  Genomic contig location: Contig_ID=SeqID_13103; Location=1629..2902; Strand=+
  SCN-specific regions: Sequence locations=1-428,450-582,604-1182,1219 -1274
atgacgcagaaggaattgaccgccgaattaattgaacaatgggggagggagccgaacgcccatcagaagttgctttttctgaatgaaatgacacagtcatttccgaatggcactttcccactcattggcattgaccgtaaaaaggtgggtaattcgaccggggggcattcgctggtccgatgtttccgtttataatgcgcttttctttcagttgtttttgtcccatctcttcgacacttgggctttggcctctgagcaaattcgtcttcaacaattacactttcttcggattattttgcgcgacaaaaacactgttgatttggactgttacatttccattttaacacttttaagtcgcctggcaaaactatcggctgattattttgaagaatgcaaaagtgaacctatagaaagtaggctttttatttttgtttcccattcaatttcaattttgagttgtgttggagtctgagaaatgtcttatcaatttgctattcaattctgcaaaggctcgagactttttttgcacacagtgagttttctttcaatttgtaacgaattcgtttattttgtgggtttttgaaaaaattggttccctttttgtggttatttacagaaagaaaccgtttgaccgattgatgtcgcgcattcgttctgtcattgccgttttcgacgggtcgaattcgttgtttgttggtttcgactatttgtccgaatggtcattcgttcaagtggaggaattgctgctttatgatttgaaaatagcgttcataacaacggcattagtccaacaacttcgggtggataattcacattgaatgagcttaattgaggccctttcatttttagaatgaatgcgtaaatgacacagacaaaacggtggtttttctcagtgttatcatttgttcgttggacaaaatgtcaccaccaatggccaccaaatgcgtgaatgaggcactgaatacgttgtttaatgtttaccatgacagcaaagtgttcgaattggtcggttcgtttgttggaaattccggaatgattttttattaaaggaaactgcaaaaaaatgtgccgatgaatgcgcgcgaattgtgaagagtgcacatttggacttgggaacaaagcaaaatgcagtcaatttactctcagttttgacttccgctttgccctcgctgtgtccgaaggtttttattttagtttttttttaatttatttttttaaggtcgacacaaaaggagcgtacgaaggatttgctgcaaaggatggatacgacataa

SEQ ID NO: 76896 - DNA, 425 bp, Heterodera glycines
  Genomic contig location: Contig_ID=SeqID_13104; Location=399..823; Strand=+
  SCN-specific regions: Sequence locations=1-194,217-251,273-425
ctcacccggtcgcttttggttgtcaccacagtgttcattgtcctcaaccttcctaattatgtctatcgcatttccatccaatttttcgttatcagtgaacaggtaaattagtcaaatggcacccaaatgatggaatgtcaaattaccgaggccagcaaatatttcgggactctcgagttcgttaacacttcgtcctttcagatcaacttgagttttgccgcccacgtgctgttgtacacacaccacgccatccttttttacatttacattttcaacagcccacaagtcgttggaatgctaatggtttttgacaatttgtcccaacttttgctcagatgcgcaaaaggcttattccgacggcacttaaactgttggagtgttactgtttgaagccgcggcacctcaacgatttttcggacaatttg

SEQ ID NO: 76897 - DNA, 608 bp, Heterodera glycines
  Genomic contig location: Contig_ID=SeqID_13104; Location=2911..3518; Strand=-
  SCN-specific regions: Sequence locations=1-141,163-487,514-608
gaaatctctcgaatcggaaccaaagctgatcgaattattacaaaaattctgtaaaagtcagttcggcgtttgtttggacattctccacgaattgcgtgaccaggttgttaacagaaaaaggagttttaacatatttgttcgcttttagtttcatttttcattctttagcttctactcaatatttatttggcacctcacatcaacgtcctttacatttctattcgccaaagtgccatcattcaatattttgactcatatttcacggctgatatcgctcaaatggcagttgaatttaggacgactgcagaacaggcaatatttttataatttgatttgaattttctcctattttttagatggagtcggaattggtcactcttatcgagcgtggtcaactgaaggcaaagattgattcctataacaaagtgcttcatgccaaattctctgacaatcgcaccgatacttatgatcggtgcgcatttttgtcattttttaaattatttatttttttaaggattatggcattgcgcaagcagtttgaccacaggattaatgccatccttctccgtgccgcaattttgaaccataggatttacgaacagaagtga

SEQ ID NO: 76898 - DNA, 1575 bp, Heterodera glycines
  Genomic contig location: Contig_ID=SeqID_13105; Location=128..1702; Strand=-
  SCN-specific regions: Sequence locations=1-263,288-576,598-667,689 -851,920-1088,1112-1575
atgttaaagcggcaattaaaattgatgcttgtgttctgctgtttgtcggcatgtctgggaatgattcgaaagtcgccgccatgggcaactggcaaaagtaatgctacagtaccagatgatgaaaatacagtagcaacaccgtcgaagaaagtgaagaaacccgaacaaattaaaccatccttttcaaaagtgccagttgaagtcaaaatccgtgtcaatattttttgcaatgaaccaattcatgtctatgtcgcggcgggagattatggtaaaacaaaacaaaaacatactgtagggtaatagacggattttatgcgtcaaaatctgtacaatttgttttatacaacggtaatttcactttccagtaaatttagggtttatgaaacactaaagtcagttaaacgattacgttgtataaaaaataataattaagaattcgatttgcaagtggcacatacacgacgcagaaaattgtaagaaattattaatgataaataaaaatgcaaattctcatcctcggttccaatcaatttttagtaatttttcaaaaatgtttggcccggattttgaggcattacaaaaaatatatatacccccgaagaagcttcaaatttttaaaaaggcacctccaagagatttatttcctttttgttacatccacccaatggggatattcgaaaccgaaaaattcggctagactcaagaccgatacttgacctcgaagtcgatcagaaacaaaaaacccgagacttatcaagtcgagacagagactcgacaagtcattaccccacagccgccgaatgatgttcgatttttttaggcttctcccattttaacctgaagcacattccatttataagaaaatacattaaaaataaattaattttattaaaaaaataaaaattaatttaattaaaaagtcgtcatgacattgacaaaacattggatgcatcagacgaaacgaaggcccaaccgttcaaagacaacggacgactttttgtgacacctgaaaaaatggagaaaatatttttcgaaatgtgtgaacgcttttggtccagcgaaaattatcatgagcaaaaagcaaattgcttggattttgttttcaattttgtgaacacattgtgcgagggaaacgcaccaaaaaagacggtaaatttgcgcaaagggacggacatttcatcaacagggacagcatgtcaatgcaaataaccgagaaaagattagacttggctaatgacgagttgtacggggaaaactttgaaaatttggagataaattctaaggagaaacaaaaaatttgagaaaaattcaaaaatttctgagatatttgagatatgagtggcccacataattttcaaaatttgagtccaaatttttcattacaacattttgttcttttaagttatggcctgataattttattgaatttgataaatttatgtccggaaaatatgaaagaagcgagctttaatttatttgatcccacatttcctcaatcggcgctcgataggaaacccgattaaattgccgaggtaattttttcttttttggttaaatatttgaattttaaataaa

SEQ ID NO: 76899 - DNA, 78 bp, Heterodera glycines
  Genomic contig location: Contig_ID=SeqID_13105; Location=1952..2029; Strand=+
  SCN-specific regions: Sequence locations=1-78
atgacgaattcaatgcaagcaaatacaatcaaatgctggacgcctacttatttatctcggcacaaagatgttaaattt

SEQ ID NO: 76900 - DNA, 208 bp, Heterodera glycines
  Genomic contig location: Contig_ID=SeqID_13106; Location=504..711; Strand=+
  SCN-specific regions: Sequence locations=1-82,205-208
atgtctcgtatcgctctattggtccttttggtcgcgctgttctgcgcttgcgctttggtcgaccacgcatccgcgcagtattggggcggacgcggcggttggggcggaaggggtggcggatggggcggaaaccgctggggcggtggatggggcggaaaccgctggggcggtggatggggcggacgcggtggcggatggggaggccgag

SEQ ID NO: 76901 - DNA, 502 bp, Heterodera glycines
  misc_feature (448)..(448): n is a, c, g, or t
  misc_feature (494)..(494): n is a, c, g, or t
  Genomic contig location: Contig_ID=SeqID_13107; Location=19..520; Strand=-
  SCN-specific regions: Sequence locations=1-164,187-351,376-408,430-502
atgtttcctcacactttgttggccattgttcttctgtccgtttcgctcaaatgctctgttgcccaatggtcaatgatgggcaccaatccgatgattggaatgggcggttggggcggtgagttttggctttggttcagttcgacaaataactgctttaaaaaaaactgtgaattttgcattttttatcaaaattttggctcgaaaatgatcgattttcaaattggacgattcattttaaaaattttcattttcaagtttcggggaggtagtcctaatattcacccggttacgactggggttctcctattctgataaaccgaaatgctcactcaatgtacatgaaatatttagttttatcctttatttttcataaaactgcaagatttgggtataatatttattcgaggaaattttttgtaaaaatttttctctcatacattcaaattanacattttatttgtcattcgataggcataaatttgcaaaattttcanaaagctga

SEQ ID NO: 76902 - DNA, 2065 bp, Heterodera glycines
  Genomic contig location: Contig_ID=SeqID_13108; Location=254..2318; Strand=+
  SCN-specific regions: Sequence locations=1-61,83-201,255-258,290 -779,801-1614,1636-1642,1664-2065
atgtcgccgcgactttttgttttgcaacggcatccgtccgcaactgttccaatgcgagaaggagcaggaagtgttccgggacggcgagtgcaccgccgcgagttccgcttgcgacgtgtgccaaccgggggaaagcaaaaggtcgacagacaaatgcgaagaggtgggagcaaaaggcattgggtgcgaaatgatccgatttctcttactctctatcttttttcttcccccccccctccctcccctcctctctcaaattctctctctctctctctctctctctctctcttggctttgaagctgaatttttgttgtccgcttacctaatcacttggatcagtttttcttctgtgaacgggatgctagcacagggcgattccactggcggcagtacatttgcaccaatggccgagttttcaatccgcaaacgcgcgaatgcgtaccgcacggcacttaccattgcccaacacgaactttggtcctttttgtgttaattatgtaattaccatgctttaatcaccttttgttctttctctcagtgtcgagatggcgattcgtacaggtgatgactgatcagttgatggtcagaacaatttgatcactcactattcatttctcaacagtgtcgaatgtggcgactttttcgtgtgttccaatggtcgatttgtgccgggaaaatgccctgaaatgacccgctgggaaatggcccagcggcgttgtgtgtacgtcgtcattctgcgcttaaaatttcagtccgtccctttgctgctattttagcgcttcgcccgaatgtcgccgtttcaaagatttgccgtcaaaagcatttgtcggaggggccgaatgtctggacggacagacaaagccatcgatcgactgtaaaaagtttgaagagtgcgcggagggcaaatggacgacacggcactgccataactatgccagcagaaaactcaaaagtgtgccaaggatgaggacagaaaagcaaaagagagggaaacggggatatattgaccaattaacgggaaaagtgattaaatgatcagaaatgttggccagtcaaaaaagtgatcaatctcaaaatgatcagtccatccaacgctttcccttttccgttcttcgttaggtccgtgccgtttctgtccccaattgtcgtcctcaattgttggcactgaaattgaagcgaaaaagcaacagcggacggacatttacccgttggaacgccttttgcccgacaatttcaatccgttcgaaggccaaggcgttcgccaccgccgttgtgtggaaggcgaagtgtgcttttgcttcaattttcccggggaattggcattttccagaggattgtgaatcggcacgactgcgcccgcttcatggaatgcgttgacggcgattggttcagcctttcttgcccgcttggccactatttcagtttggaaaacgaaacttcaaaatttaatgaaattgaaaacccaggcccactaatccaaggctgtctgttggccagctcctcaaactcttcctcagcagcgattccaatgtgcaacgagcttctgactgtggcggagaaggccacttcgatcaccaccgaattgaaagacacaaattccaaaagcgattcagtgattatttttgattattttcagcgaatgaaaatgccaacaaaaaacaaacacaatttccctccccccacccgaaaagatgcattttttgccaattctttactcaaatggaggacaatcgccgatcggaccgggcgcggggccattgcctgagttgggggacaaggaaatacggcagaattatgtgggcgattgggaaggggccacggcatcgcaattaatccaagtcaatgacattcactcatcattccattcaggccggcgcattcagcttctgcgacgcgaacgcggccaaaagactgcccaatgcgtacgactgcacgcgtttccgcgagtgcgcgttgacaggggcggatatacgcggaaaagcaatgcgcacccggcacacaattcgacccgacatttgggcggtgcactttcaagtaacgaagtgccaaagcgaatttgaataa

SEQ ID NO: 76903 - DNA, 864 bp, Heterodera glycines
  Genomic contig location: Contig_ID=SeqID_13109; Location=36..899; Strand=+
  SCN-specific regions: Sequence locations=1-44,66-502,524-528,551 -630,652-864
atgttggcttcaaacgacatcctcgtgcatttcgaccttgaaaagcctctctttttggcaacagacgcgtcggattatggcattggagctgttttatttcataaggatgccaagactggaaaagttggagtcatcgcttatgcgtcaaaaacattaagctcatccgagcggaaatatgcgcaaattgaaaaggagggacgtggagtgattttcggcgtagaaaaattcaaccaatatttatacggccgaaagttcacactacagactgaccatgagccgctgaaacggatttttggacctaagggtcaaatgccagtcgttgctgcaaggcgtttacatcgttggagcttaattttgatgaactacgagttcgacatcgaatattgctcaacaactaactttggacacgccgatggattgtcacgactgccaacaccagaagtcgacaaaatttgcaaggagagcttcgacattggcgaaattcagaaggaatgccaaaatgctctgccaataacagcaaatggcatcgcaaaggagctcagaaaggacccaacgcttaaaatagtaaaaaatttcactgagcatgggtggccaacaaacaagcaaatcgatgccgaaattcgcccattttacgtggtgcacgacgaaattgagatccaaaacggatgtttgatgcttgggactcgaacaatcatcccagcaaaattccgtggagaaattttaaaattgatccatgagacacatccgggaatcgtgcgcatgaagtcgctggcgagacaaaaagtctggtggcccggcatcgacaaggacatcgaagcaattcgtaagaatgcaaaatttgccagaaaaatgctgcagaaatga

SEQ ID NO: 76904 - DNA, 2247 bp, Heterodera glycines
  Genomic contig location: Contig_ID=SeqID_13109; Location=1682..3928; Strand=-
  SCN-specific regions: Sequence locations=1-301,324-493,516-664,686 -738,760-1182,1205-1232,1264-1329,1352-1366,1388-1591,1614-1963,1995 -1998,2020-2147,2169-2247
atgccaaaaattgaaatggacaaattaggcgaagaatcatttgaaaatgagtttaatgaggaagctgatcagaatgtttcgtctgctgatcacaacgattctgcaaatgaaatggaatcgcaaaaaaaattaggagaaaaaagagagagaatggagaaaagtaaagaaatcaaaatggaactgatcagaaattttgataaaatgagaaaagaaaaaatttatgggtttaattatgacaaaaagaaaagaaataaaattgaaaatgaaattgctattgaaattggaattaatcgaaataaaatttataaattgaagaaggaattgggacaaaaaagagtgaaaacggaggaaagtgaagaaacaaaaatggaactgatcagaaaatttgataaaatgagaaaagaaaaaatttatgggtttaaatacgacaaaaagaaaagacaaaaaattgaaacagaaatagctaatgaattgggaattaatcgaaataaaatttataaattgaagaaggaattgggacaaaaaagagtgaaaacggaggaaagtgaagaaacaaaaatggaactgatcagaaaatttgataaaatgagaaaagaaaaaatttatgggtttaattatgacaaaaagaaaagaaataaaattgaaaatgaaattgctattgaaattggaattaaaagaaagaaaatttacaaatggaagaaggaattggaaattggtaagagatcaatggcatattcgattttttattatttattgtctcattttaaggtataaaaaagaaagtttcaacgcaacaacaaattgaaaaagtaaaagaatttgaaaaagtgaaagaagaatttgcaaaaaatttcaatttggaaccaaattggaaaattaaagaaaaaatagcggaaaaaattggtgctagaatgaacacaatttctgcttggaaaagaaaattggactctatagctagtaacattttattacaaccaatttaagtagttatgttgaaattttagagaaattttcattttcaaatcagcaaaaacagtttaaggtataaaaaagaaattttcaacgcaacaacaaattgaaaaagtaaaagaatttgaaaaagtgaaagaagaatttgcaaaaaatttcaatttggaaccaaattggaaaattaaagaaaaaattgcaataaaattgggcgttgtgttggaaacaatttgtagatggaaaagaaaattcggtttcagcattcgtaaatttttaatttataaaattttaaaaattgcttttttaggagaaaaaaaacgttactcggatgctgaaaaattggaatatgtgaaaagaagtgaggaaataagaaaaagtaatccaatgatgagtgagacgaaaattgctgaagaattggaaatccctaggcaaaacttaagccaatggacgaagaaattgggcaccaaatcgattcattagctttagctgtaatttggaaaattaatgggcttatgtagaaaaacatgtacaagaaatttaaggagtttgccaatgtcaaaaaaaatatgaaattttctcaaaaaatgggtgtcactcaagccgcctaggaatttgttccaaaatatccccggttttaagccatttttctggttctcagaccgctctgaaggagtgttctgattatcgcagcgcaactgacttttctgtttaacataaaaagttactcttacatgaattttttcagattttgtgtggtttctaggaaatttgtgagttatcaaaaaagagtaattggaacacccatttttttttggaaaaattcataatttttttttgtcatttccaatcgccgtaaattttcgtgttcacaacagccttgttttatcgatacaagtgtcgctacagatttactgttgttatattcttcttcatacaaatgaagtttatgcggttatgctttgcgattcaactgctgatattccccctgcgagaattattgtttatccgaaaaccgaataaaaaattaacagatttatacccactagataaatttgtagagccaatgacatatcattactgtatccatgtggtcaaaaaggatatcattttggatactgatgtgccacgaaatatgcatgaacatttaatgaatctaatggaccgcaatggcaattgttaataaaactggaaaacccggtctttttgttacttttacatgcaatcctaatgaccctgatacattaacacaccgtccgaaaaaacgagatgtgtaccaataaa

SEQ ID NO: 76905 - DNA, 417 bp, Heterodera glycines
  Genomic contig location: Contig_ID=SeqID_13110; Location=881..1297; Strand=-
  SCN-specific regions: Sequence locations=1-108,164-219,241-358,381-417
atgacagatgtgctgctcattggcacgcaatgtttgccagcggtgcgatttggagaaaaagcatttccaattaaaattaacaaaagtgggggaatcgcgtgtaaaagcaaaattaataataataataataaaataatttaaacatttttaaagtaattttattggcttattacgaaagaaagcattacggacggatgaattattgtaagaaagtgaaatttacaaaagaaatttaatattttaaagttcgcgtcttcttccaccccttttatattgtacaaagaatttcgtccttttgttaatcgcactttaaaatgcctaattatttaatagtgcaaattggccaatccaaccaagatttgcttttattttacattttcgagggaattattcgactcggaatgtatttacaataaa

SEQ ID NO: 76906 - DNA, 2286 bp, Heterodera glycines
  Genomic contig location: Contig_ID=SeqID_13113; Location=1085..3370; Strand=+
  SCN-specific regions: Sequence locations=1-452,474-771,793-1826,1850 -2125,2149-2265
atgacgagtcacacgccggaatggaaaaacttagcagcaggcggtagccatggaattcgttcatccgttctgactagtctaaacggcacaacgccatcgagaaacccaaactatgtgaaaggaaaggtcaacgagggcgatcgctatttatgtctcagaagtgaggagcaattggaactcgccaatcatttgttgtcctcgcgactgctcgtgagattttctttcaacaatctccagttttatttaatcacatgattaaggataatgagaacaccaacaatttgaatacgtccacttcatgtccgacgagtcccgcttccaaattggaacagcagacgaagaaacaaatgatgagggtcaaatcggacaatgcagtgaattcgttggctgattttgaccgagtttgcgcatttcgtaagggactcgctcctctagcaaaattcggtagattaactaataaagccatgaattttacatccaattcattctctgcaaggccacaaacagcaggtgaatgtgcttttttcttgtgttcagccaacttccagttgtgtgaaacggtctcgtcgttacgtcgcaaaggatcccgagagaatgttggatgcgccagatttattggacgatttttgtaaacaaaagttcacatattacatttttccaactattccagattcgaatttgattgattggagcaagactaattgtgtcgccgttggcttaggatcaaaaatttttcaatggaacgcggggaccggtgccgtggatgtcagttcttttacagttttttccaccaaatcttgtgaatttaaggagataaaagatttctctgaaacgcattcgcatccaactctcgtcaaatggtcttgcgaaggacaatatcttgccgttgggttcaatgacggacaattaaaggtgagccgaacggatagcgaagacataatgagacttcatttcgttttcagttgttggacagcgccaccaaaaaagtgctgagaacaattcacacgaccacagacatgcgattggcatgtgccacatggacacacaaagggcgcatttgctgtggctcgaagaacggtcgaatttaccaccacgatgttcgaataaaaaattcgttgatcaggttcaatatttctaaaaaattagcacacaaaccatctcattttaagcactttggatgctcatacgcacgaagtttgtggcctaaagtggagcccagatgagcattacctcaccagtggaggttctgacgcattagtaaatgtttgggagaatgtgcaattatcgtcaaataatccggttaatacaaatatttatcactttctattaccaatgcttttatgaattactcaagacaccgcttttcaaattgaatgaccacgtgtcgactgtgaaggccattgaatacgttcggtttctttgttcttttgatggctcatttgtgttttaggtgccaacgatgggtttaggcccagccaatctcgtggcaactggtggtggcactcgagaccacaccatacgcttttggaacctaacggatggcagtgctcacttcacattggacacgcacagccaagtgaagtagcattttacaaaagttttaattgcgcgaatttaggtttccgccattctcttcagcaaacctcacggcgaaatgatcaccggccatggggccccaaaggcgggcgttcgcgtttggcaccacgagcccaacaaaatcaaaaagtttgagcagacggcggagttgaaccaggcacatggcggacgcgtgttggcactttgtcaaagtccgtgcggagagtacgtaatcgccgcaaaccaagtgatttttgttgttttgtttcaacaaaccattttcttgctgtgaaattgcaggacgaagtgctcaggatttggcacgtttggaagatggacgaatcgatgcgaaaacagacgcaggaaagtgtaacggcaaatgcgaggaaacagcttcagggcgccgctggaaatatcattcgatgaaagcaccaaaattacctatttattttaaccctttcgttctctgcctcactattttttcaatattttagcatttcattaggattgttttttgtttttacgtattcaacttaacttttatactatctttcatttatttgtgtttttcatgcataaaacaaaaagtgcactgaaaattgttacagtaaaaagcattagaataatttgacaattattcgttgtcagcacttatcaaaattagcaaaacattctcttcccttatctccgttaaaaacaaagaaaaggaaa

SEQ ID NO: 76907 - DNA, 620 bp, Heterodera glycines
  Genomic contig location: Contig_ID=SeqID_13113; Location=1..620; Strand=-
  SCN-specific regions: Sequence locations=1-300,332-338,374-450,480 -578,608-620
  Gene Ontology: Mol. function=oxysterol binding; Cellular component =cytoplasm; Biological process=steroid biosynthesis
caattcgactgatgttggagtgaaagagaacagtgccaaaacaaatgacccaaataaatttgagaaggccggatggctttacaaatggacaaattatgtcaagggctatcggcagcgatggtttgtccttaatgctgaaggaattctgagctattatcggtttggttgttttttatatcaaaggaaatcaaatacttgaaggcacccatcggaagtcaatcgctcttgtagaggcagcataaatttgagcgaagcgaacattcacagcaatcagggcgagtcgagccacagcttggttggtttttaatttattttaaaatttcataaattagccaccgttttaatatgtaataataatttatattttaaaatactgtgaaaatcaaacctattgctagatcatcactactccatcagcccaaacctttcatttaaaggcatcaaatgaggtaatttaaattgtaaaattatttaatttacctaattaggtatgcagaatgatatttttagattgatcgttcacaatggcttaaagcactcgaatatgctaaacacagggcaataatacaggccgtttcacatgaggaagatgaagaggaaagccaacttttgctcaacaa

SEQ ID NO: 76908 - DNA, 183 bp, Heterodera glycines
  Genomic contig location: Contig_ID=SeqID_13114; Location=244..426; Strand=+
  SCN-specific regions: Sequence locations=1-40,62-90,113-183
cttcaaaacatccgcccaagccgacaaattgtaaaagtttttgtttacaaatttctcaaattggacggaattctcgtccttcgactgatcgactcaaacacaggacaaatccatatggctgacattgtccatcagctatggctaagtttcaacgagaaaagctattttaaagaaacaagctga

SEQ ID NO: 76909 - DNA, 1477 bp, Heterodera glycines
  Genomic contig location: Contig_ID=SeqID_1937; Location=447..1923; Strand=-
  SCN-specific regions: Sequence locations=1-66,102-112,177-408,431 -459,481-670,758-960,992-1174,1217-1290,1312-1321,1373-1477
atggaaaatgataagaagaacattttggaaagaatcagtgaaatggagaagcagacaaagaaaaaggtgaatgaatgaatggaagagaaaagtaaaataaaatatttacgggaaaaataatttttaatttatttaataaattattatataatattataaaaatatagaattatttactttcaggtgtttttaaaattccaagaaaattgttgggatgccttcgcttgtcacaaggacatccaaatcagtggtgacaaaagtctcattgtccagcataagggaaatacttttggtatttccgtcttcgcaaaatgtccgattttgctgaacaagcatttgtctgactttttttactacgaaatttcagttatgaaaaaaaagaagtaagcgaattttgtataaaaagtgaaatattttaatatatttttttctttattcagttgggtcatcttcggattcgctgttaaacagcagacaaaattggatgaatcaattcaacttgaaaagggcacttatgcatttgacaattatggctttttatggattaacggaaaaggaaaaggagcaaatgccgaatattcctacggtgttggcgataccgttggaattggcgtcaattcggccactcgacagatcattttcaccaaaaatgggcttcgtttgggttagcaaataataaataatataattttacgatttttaaattacaatttggttaattgtctatttatctaatttattttatgtttaaaataatcaaaaatcccttaactttttcacagattcctctgattttttggttgctccatcttttgctgatggttctttttatccattcgtttctttactcttttctggtgacaaaattgaggcgaattttgggcccaatttcaaattcgatttggcgactctctgaaggaaggattaattattcactaatgttttcgatcaatttgctcgtttttatcatttttatgtttttcttcttcaattaaaatttggttttctgtaataatcggaaaattttgtcgtttcccgggtatttaagactaaaagatgaaaatttgcaaaaaaatagggttttttccaattatatgctaagattcataatgatatttataaactcgaaaaaaactaagaaattttttttggcattttaatgatttttgctatgaaaatttgttaaaattttaagattttaattgatatattttaagctgacgaggaaaagcgctcacaactagaaaatgatcagaagaaactcttggaaaaaatcagcgaattggaaaagcagcaaaaagaacagtcaaaaggcgaggggaaattaaatatttaaatatttgcatttaatttacaaactatttaatttttagctgctgcggatcaattttcaaaaattttggaaaaaatcactgaactggagaaagacggaagctgaaaagaaagctaaataagggaaaaaggaaaaacgaataaa

SEQ ID NO: 76910 - DNA, 3176 bp, Heterodera glycines
  Genomic contig location: Contig_ID=SeqID_1937; Location=2480..5655; Strand=-
  SCN-specific regions: Sequence locations=1-180,219-275,311-357,380 -482,525-627,655-934,970-995,1017-1128,1150-1280,1302-1383,1405 -1408,1431-1465,1488-1709,1834-1855,1884-2158,2230-2275,2298 -2514,2536-2639,2669-2690,...
  SCN-specific regions: Sequence locations=...2731-2801,2860-3069,3091 -3176
atgaaagtggctgaactgatgtgcatcaaaacggcactgaacgaattcattgcttaccaacgattggctcaaatggtggccaacggcacacttaatggggtaattaatgtacagtaaaaaggggggaaatgccatcaaaggatgccaaatttgtttaaatttaagcacgtgcgaaaatggtaatttttaattaaaatataatttaataaattttaattgtccggatggcaaccttcgctttgtgcgctttttcaaatgtgtcaaaatgatcggtgaaaaataataaattaattgaatttaatttaaaattccaaattttttctcaggtagccaaatcgaatttttgagcgttatatgcccaaagaagaaaagtgtttttgccaagttaagttgagcatttctaaattatgcaaaaaattaaatttccgaaattttttttttgaaaattcataaatcaaaaaagttaaaattaagactcactctattttttaaaacaaaaattaataatttaaatataaaaatttcgcacattaaaagaaaacacaaataaaaatacatatttattgaattttaaaaaaccgctttattttttgaaaaaacttttaaaagccctttttaaaatgttaataaaaattttccccaaaattttcaggttgcatttcggtcctttgtttccggtatttgtaccagctttttgaccacctgtgttgccggtaaatgatgggactgccaatggcatgcaacaattcggtgccgcacggatgggacgaaaaatgcctcaatttggacacattgtgatcagcaattttaatggtggggatcggcgatgatcaaatgcggagcaacaaagtgagaacagatgaaaaggtgatcaaatttggtgaccaatcaatttgcaattggaattaaagccttgtaaatgtctaatcatcggattaatttaatataattttgattatactttaaatagagcgggattaaatgcccaataaatcaataatgttagacattttgtcagggatttaagaatccgaaatttgcacattttctcttagtttttttttgaataagaggataatgccaaaaatcggcccaaattagctaggatataattaatgacgatttttgtatataatatattttttttttcgatttaacaagaatccattaaattttcagttctatttattgacacaaatgtctcgttttttgaaacggtgtataaaatgccgaaccgtaactcggcaaaagcatttgctttaggtcaatactgtattttgattttaaaaattcacttatttggccaagaaaaatgcaggcaaacgccttgcagaaaattaatttgtgtataaattcgagaaataggtttacgaagatacaatattaaaggtcaaataatttgtgcaattttatttaacaattcaaatgactaatttcaaaaggacaaaaaataaaataaaaatacatccattggacaagtcagtggatcaaacctatcctgtctttggatcaaagttattatgaagagggaaggctcacaaatgaagacaaatcggaaaccaattacaacaaatctacccaaactccatggacacttgaggcctctcttttgttagaaaattaatgttggagccgaggggaatggtgagggtgggatccagggacggtcccaggatttcggcttccgcctgctcaggcggcgacttacctttttttctcttcctctattatgttacccttttctccctcttctctttatttctctctctgtcatattgttttttctgtcctccttctctttctctcttcttcctcttttatttcctttgtcttactgaccaaaatatgtctaaccaattctatttcatttttatttttctcttccctcccatgcatatttttagcattgagaaatcaataccgaaattttgaaaaaatggactgacatgaaacaaaacgaaggaataggtaatggtcatttatttttatttgtcttttttctttttcatttattcaatagtaacatttttattaatgaaaacttaaatttaaatctttttttagagtaccaaaactcaaaaatgtcaatttcgaccaattcaataaattgtggagatgattttacaccagcagaaaacaggggtaaaggaaatgggagaaaaatttaaattttgaatatgaattaattaaattattttaaaattaaagatttaatttatttaaattttagaagtgaatggcgatgcaattagtttggaaaatgatggacaattatttgatggaaacagtgaaacgatcactgatcaacaacaacagcttaaggtgggcggaagaaaagctaacagaagaaagaattgcagaaaaattgaattaatgtgagacaaaagcgattttgttaatttaaattcaggaatttcatgaaaagtttgccaaattggaaacggaattgaaaatggccaaattggaactggaaaatgtgagtttgcataaaaatttgagtaaattataaatgccaaaattttataattatttttagaaggcacttgaacaaaagttaatgcaccaggaattggtaggcgaacagaaggcattgaaggaaaaagtggtcaaaattgaacagaaaaacggtatggtaaatgaaaataaataaagaaaaatatatttttaacaggatcattttttacgaaaagaattataaaaatgtttaaatttagattttaaaattaaaatgtcatcattcacgacttcttcatcggccgacgaattttctcctcttcaacgtaaaaaatttcttaaaatgcataattaaaatacaataataataaacattttaaattaccaccattttacaaattttccgaattatttatcccaaattcgaacccgattcaagaatccagaattggtagaaaccataaaaaagaaataaccataaaataatttgacaactttaaaagctataaccttttataacttgacaacaattttaaaaaattaattgaaaattgcttcaaatttcagtttcgggagatcatttgaaagcaattttggagagaattggtgaattggagaagcagcaacaacagcagacaaaaggcgaggccaatttaacgaaaatgaaatttttgggcttttctttggtaactgcgcaattggacatttttcgaatcctttaa

SEQ ID NO: 76911 - DNA, 1463 bp, Heterodera glycines
  Genomic contig location: Contig_ID=SeqID_1937; Location=7412..8874; Strand=-
  SCN-specific regions: Sequence locations=1-65,87-322,346-1001,1029 -1419,1441-1463
  Gene Ontology: Mol. function=transcription factor activity; Cellular component=synaptic junction; Biological process=regulation of transcription, DNA-dependent
atgacgcctcttttccttgctgtccgccatgccaatttgccgctgtgccgtgtgctggtcgcgcgtggtgccaacattgacttgggcacggactttgccacaacgccgctgatgcacgcttgcaaaagatcgcaaacggaaattggtagagagacgaaaatttgaaaaaatgcgtaatttttcccgtcattttttcccccacagtcacatttcttgtcgagaatggtgccaacatcaatctgcagaatggtgatggggcaacagcactgatgtacgcgtgttacacgggaaatgtagggaaaaatttccattggcgaaatgttttccaacatttccatttgaattcaggtggacattgtgcgcttgttgctgtcacatggtgcaaatgtcgagcaaatagatttcgaaggtgggggattactgttacagtacccaaaaataccatgccacaaatgttgtcctaatttcaggattccatttcgcacttaagagcgctgccatgggcggcagtttggaggtgtgccgtctgctggtggaggagtgggccgcagatgtcaaccaacaaaccatccaagagcgatacactccagtgatttgcgctgccagtaaaggacatttggccatcggtgggagagaattgtggcaaagtgccaaaaatgtaatctccctaattttcagtgaatttcctcgtcgaacatggcgccgaccttcaacgtgttgacgtggacggacacaatgctttgatgtgggcagtgaagtttgggaagattgaaatggcacggcatttggtggccatcggcgcggacattaaccaacggaacattgaaggtgagcagcagcggaagtggccaaattgttgtgctagcgagcgttttattcgcccatttcaggcaaacgggcacaggatttcgcggaagagagcggaaatgccgaaatggtggacatttttcgtgcaaccgcgacggacaatgggcgggacgcggcggagggcaccgatgggtaaagaaaaatttgattgtttttgatcaataataattgttttttccattttcagacagcaaaacgatcaacagcagatgtgacagcacagagagagcgaatcaatggccaaaagcggcggatggatttcttcggaagacattaattgatcactaattgtattgtatttattatgctcatcattcccatttgatccgatttgtctgtaatatgttccaaatatctctgattgtacatataatttgtgagtcgttgtataaatgtccaatgaatttgagaaaaactcggaatttttgtaatattaaaattttgggctacaatcggttggaaaaatgaacaagaacctttcagtttattgacggtactcagtcagccctttaataatttattttaagattttctttacataagaccttttttaactcccccaattcctcccctccccacgtgcaattcacaataaa

SEQ ID NO: 76912 - DNA, 1222 bp, Heterodera glycines
  misc_feature (403)..(403): n is a, c, g, or t
  misc_feature (410)..(410): n is a, c, g, or t
  Genomic contig location: Contig_ID=SeqID_1938; Location=526..1747; Strand=+
  SCN-specific regions: Sequence locations=1-185,207-285,307-686,709 -1142,1170-1222
atggcaacatccaacaattgcgtgtgctgatcgattcgctggacgccgacgagctgaacactttgctgcggtggacggttgatccagtggagcgcgtcacccgaacaggatcagctctttggtgtgccttctttcgacgacacttcgaaattgttgctctcttggtagtgactgatcattttttctggtttaaatcactaattttgtatggcattttcagttggagaagggtgcagatccgaatgagccgatcattttcgaaacgcacgatcacagaacgagtgagtgttgttgatgaatgttttaccatggattttcgagtgtcactgtgttaacaaatccggcaccatttcgaccaatttcgaattctttttctcgaaaaatgaaatttggatattttggncgaattnttatccaggattcggaattggtcgaaatacggattccggcgatccctatgaacttttaagcgtcccattgaattttcacgcgtcccatgaacttcatcaattaggaattttctttttttagaattaaccaacttttttatctttggtttccatccgaatagcccatgcttgacatagcgtgtccagacatttgcgcctatgtccaaaatcggattcaaactttaattttttttgattctgtttcacgcatcccacgtccattgtacttttctaattgaaagaaagaaaagaaaatattcccaacattaaaaaaatccatgggacgcgtaaaagtcaatgggacgcgtattctgcactagaaccgaaaattgaatgacaaaaaaatctaccccctccccctaattttcagtgaatttcctcatcgaacatggagccgaccttcaacgtgttgacgtggacggacacaatgctttgatgtgggcagtgaagaatgggaagattgaaatggcacggcatttggtggccatcggcgcggacattaaccaacggaacatggaaggtgagcagcagcggaagtggccaaattgttgtgctagcgagcgttttattcgcccatttcaggcaaacgggcacaggattttgcggaagagagcggaaatgccgaaatggtggacatttttcgtgcaaccgcgacggacaatgggcgacacgcggcggagggcaccgatgggtaaagaaaaatttgattgtttttgatcaataataattgtttttccattttcagacagcaaaacgatcaagagcagatgtga

SEQ ID NO: 76913 - DNA, 1539 bp, Heterodera glycines
  Genomic contig location: Contig_ID=SeqID_13115; Location=1896..3434; Strand=-
  SCN-specific regions: Sequence locations=1-80,102-128,150-197,247 -456,478-607,654-684,706-835,919-1041,1062-1141,1258-1286,1308 -1373,1448-1500,1522-1539
  Gene Ontology: Mol. function=3',5'-cGMP binding; Cellular component =integral to membrane; Biological process=thermosensory behavior
atgaatagagaatttttgatctatataattattaaaacaaacttaaatttcgttgtacctgaaaaaaagttatgaaggattaatgtggaatattttatggtcatacaaaaatataagcacatttcggtgctgaattatgatttattaatcagcaaataaaatgaaaataatgttttggaactgctcattagcaaaactttaaaataaaatttattttctaaaattaatctttacttttataaaattcagtggcactttggacacattgggccgtcgttatttgtacagcttttattggtcaacactgatgctaaccgcaattggcgaagtgccatggccaataaaaagtgtcgaatttgtcattgtttgtgccgatttgttgtttggcgttttggtttttgcaacaacagtcggcaatgttggcacgtgagttttgaagagactttttttacggcattttgtgttttataataaaatttttccatattttcaaagtctgatcacaaatgctggctcggcgcgattggattttcagacaaacattgacaaagtgaaatcttttatgaagcatcggtcggtcggtaaaaaggtaaccaaatacaatttgaaaaataattaaattaataaatatttaaaattttttgtttttttttgcctatttttgagttggtccaccgaattggcaaatggtttgattatttgtgggagaataaacaggcaatgggtggtcgtgatgatcaggaagtgttgaagcttttgccgacaaaattgcaagcagaaattgcgatgcatgtgcattttgagacgctgcgcaaagtccgactttttcaggtcctaaaaaattaaaattaaaaaataatattaattttatttaaatttaattgttgatttaaattttataattaaataaattttatagtttccataaaaatatatgtccaaataaaaaagagtaattttaaaatactatatgtgtttaaggattgtgaatctggactcttgggtgaattagtgctaaaattggagttacaagtaaaaacaaattaattaattaattaatttaaaaaaagtttgttttttaggtttttagtccaaaagactatgtctgcaggaaaggcgacgttggacgagaaatggtgcgtttattaattttaatacatatatttaagtaaataattatactaataaacacattaatataaaattatatctaattgcttttttaattattcttttttcttttttaattaattttttcagtatattgtcaaaaaaggtcgtcttcaagtggttgctgatgatggagttaaaatttttcacacattagttgaaggagctgttttcggtgaactcagccttctcaatataccaggtaatattttatttaaaaaattaaaagataaattaaaaacacattaaataaattgtattaattttttaaattaatccaaaacaaatgatacttatagaactctaaatttacactttcatatagtaaatacttatataatttaaataattcctttgattaataataaa

SEQ ID NO: 76914 - DNA, 2154 bp, Heterodera glycines
  Genomic contig location: Contig_ID=SeqID_13116; Location=440..2593; Strand=+
  SCN-specific regions: Sequence locations=1-115,137-564,586-770,792 -1709,1731-2154
  Gene Ontology: Cellular component=cell wall (sensu Fungi)
atgagttttccatttccagaggaacagaactgcactctcccggtcgaaacacctccgctaacagtaaaatcgaatttatacatcccaattcgaattccacgagtttttccggcattcaaatgctggaatatcaccacaatcgcatgcacagaatcattccttcgagtcatcacactggaccaccctgataagaaaatcgaaacagaagcatctgtagaggattgtcaggcctcacttcaccatttgccgatgaatcgagtgagcgaaacgagatgggaaagtctgtcaccaattcaaagagaatacggatggtatggcgtaaactgtttcgacaacgtccaaacaatagtcgaagagggaacagcaggaatcttggaaggaaaaaggctgataacatcttggggtgattccttaaaagtcgataagagtcttggtgaagaagggagctggattcggttgccgggcgcaatggaactgcttatgtggcgaataccatctgaagaattttggcattcccacttcgctattggacccgtagtaacggaaatatggccaaataaggcggttgttgtcgatgaacttcagtatacttttccgataagcaaaaatcaggaaaggaaattcccggtgattggagtccccaatgatgctttgaagactgagaacaatgtttatgtacatgttattggtaaagtaaattcgacaaaaataactcgagccagacgggatgccaatccaaagaagtcaaatgtaccaagagccaacccgaccaaaaagccaaacataagaagaaatcaaaacgatggactcccatccaacagttccgtctcgactatggcaattccgaccaccacaattccggtcacaacaaccaaaattccgaccacggcgattccgaccaccacaattccggtcacaacaaccaaaattccgaccacggcgattccgaccaccacaattccggtcacaacaaccaaaattccgaccacggcgattccgaccaccacaattccggccacgacaaccaaaattccgaccacggcgtttccgaccaccacaattccggtcacgacagccaaaattccgaccacggcgattccgaccaccacaattccggccacgacaaccaaaattccgatcacagcgattccgaccaccacaattccggtcacgacaaccaaaattccgaccacggcgattccaaccaccaaaattccgaccaccaaaattccgaccactagaattccggtcaccacaatccgcagtagctcagcattggctacacctcaaagctccactgacaccacaaacaatattccagccactcttaaggaacttaatgagttggcacaacaaattacggatgatgatgtgctcagacacagtgcgcccacgccatttattattcaaaacgagcccagtgaagaaagtccgacaaccgtgatcacaaaaagagaggtgtccgaaagcaacgaagttgggtctgaaaaattctggaaggagaagaatctctaccacgagaattcccgacttagttatttgggatggaagacacaccgagtcaacatacaaaatgcgcgggaaaaatggatttccgattgccatgagcggaataacgctttagcaattgccaaagctcttgctcgccaaatgcctgaagatgcggctcggtcgctgtacaaaagggatgatattaccgccttttggacacagccctcaagggaacagaaatggtcaatcgcactttgcagacagatgaaagcggaagaagttttttgggatcaaaaagttgaaacaaaatgcttccgagaactgcccgtgaaagtcacaagacaaatcctctttgtgaaaccagggacgcgcgatctgacttacatcggtactgaaattagctgcgatgcacaaggaaataatccatgggcagcggagcacagcaacaataactcagaacttaataatgctaatctgggacaccgattcataacggaccaatattcaaacgcacaaaatcctctgattttttttaaccgtggctcaatttttgagtctgagcaggcacgtctggagagaaacttaaaggaattaacggaaagaatcacacgacccgaattggacttcccggaaattgggacaattgatgcaaatcaaacataa

SEQ ID NO: 76915 - DNA, 1165 bp, Heterodera glycines
  Genomic contig location: Contig_ID=SeqID_13118; Location=1978..3142; Strand=+
  SCN-specific regions: Sequence locations=1-62,119-135,160-293,315 -320,342-379,401-599,621-786,813-840,866-945,971-1000,1022-1165
atgtcatcatccatcgcttcgccagatacatttttgcgttcagaaactgatcaaagtaatggaaaaatttttaaaaaattacgaaaaaagaaaataattattaaaaataaaataaattcaaaatctaacttttatcagcaccagcagcatcagcagcagaagaagtgggcaaatacgaagtgttcagttggcacggaaatttgagtgatcaattgtcagctgaactgttcgtcactgatcagcagctgctgaaggtgggccatttttgaatggacaaatgatcaaaccgcggcgggaggggaggggaggccaaaaacagagaaagatttatggaaaatttagttcaaaatttccattcgtttttaaaggttttccaatgatataaaattaaaaggagaaagggccgacctattcctcgaacaatttgatggcattttgccaaaaccattcaattataaaatgaacacaaattacaaattatttattgggctgtaattatttgttttatttaaggaatgccgagaaaaacttgcgaagtccgaattgaaggaaacgaaattgctgtggaataacggtgaactgaatgctgaaaatgtgagcaaaataaaaattaaatttcagaggacgaagtggctaaaacagagaaaatttcacttttttaaatttagagggctctcaaagcagagttggaaaagcagaaactgatgacggaacacattgaattgaaggcaaaagtcttcaatatggagcaggaaaagcagcaatttgagaaaaaatacggtagggaaaattttaaaaataattataaatttccagtaccgtaccccgagccttactgttaaaataagcatttcaaaaagaattccttaaaaattcatattgtagtttctgtggatgtgttcaattcattggcggaacgcatcaaacgattggaaaatcagcagcaggagaagagagaggaggacagaaatggtaaaattgaaaaaacggaccgtaaatttcaaaatttcttctaaattaacattcagctgaccgtttaccaaaatgcaattaaatttcagtttctgttggccaattgttggagaaatttttggcaggagaaaagcagcaaaaacagcagaaaaaggacaacgctcagcagagattggatggaaaatgttctgtg

SEQ ID NO: 76916 - DNA, 1233 bp, Heterodera glycines
  Genomic contig location: Contig_ID=SeqID_13120; Location=619..1851; Strand=+
  SCN-specific regions: Sequence locations=1-841,863-933,962-1233
ttttccaatttgaagtcggtcccttccaattccttcgtccgacgactcgccgtttgtttaatcgagaaaatagacggaaattttgtcgatttttgtcgtttatggaccaaatttctacaaattttgcgtcatcattgggagtacaatttgaacttgccaaagtcagtctcgccgattcctcctttatttactttgcttttgagttgtcagttttgacactgatgaaaggccccaattgtcgtgctgtctcctgcaccaaaaactccaaatgattaacttttgcatttcggtgaagaaacgaaagcacaaagaaatggaagcgaacgaaacggagaatttgggcggaagtgccaaagatttgccagcaaatcgaaacactgcgggtaaattcggtgagattagtgggaaaaccgaccgaagacagaccgatttttaattgcatcttgttaaattgggagtgaatttacattatcattttggttcgttgaaattactctcttaagacgacgagtttttcgatgcgattgaatcattcgatcaatttgacgtcgccacttcgtcggagtgccctcgggggagaagccttccactcgattcgaatgaatttttaaagagcaatccaaaccaacgaatttttgttccttttactcaggtggtcattaattgtaagtaaattcgctgaatattaccgcaaaagccctttaggaggagggcccaatgacggaagaccaaattgagcagagagagtcctttctgtgcaatttggaggacgccaatttgaggacgaaggcgcagtccgagctgttgttgtccgacatgcaagcattcaaagtaagccatgtttttgtctaagtttttggttctgtttaaggccgcaaatccgggctgtgaattggtggattttttgagatggcattcgccaagggatctgacggaaggtgagggggaggggaggagaggatatttgacaatgatggatcaaaccgtttaagaaggcgaactctctgatcggatgaaaattgctgggaatttttggcaagagacttgggactcggcccgtgcgattcccgcgacgcagcagcaacgcctcttcaacgagacgcgagaagttgagcaagtacagacaaacatttgaagggtttcgcacccaatcgaattactttttagattcttcaatatttcgcgaacatttgtatcaaagaactcgttgaacttctccttccaattgtctct

SEQ ID NO: 76917 - DNA, 1384 bp, Heterodera glycines
  Genomic contig location: Contig_ID=SeqID_13121; Location=1..1384; Strand=-
  SCN-specific regions: Sequence locations=1-173,195-244,299-389,444 -459,499-545,633-694,728-931,1262-1384
  Gene Ontology: Cellular component=synaptic vesicle; Biological process=synaptic vesicle priming
aaaaaaggaccgacaaatcatcagctgttgtcagcggtgccattcggctgcacatcaaagtggacatcaatggcgaggagcggctggcaccgttccatctacagtacacctgtcttcatgagcatttgttcctggtacggtacacacacgcaacaaatgatttaccgttttagagcccccgggggcctattttccaattaattagtagcaatttgagttgaaaaaaactgatataataattctgtatttttttttatttttataaatatgttgacatttttgaaaataaataaattttggattttattttgcatcggactgtatttgaaattctaaaacaaatttaactttcaaaaatttcttcatgttttagccttcaacaaggaaggttatttaattaaatttttttaaaatatatatttattttttaattttattttaaacctaataccctcctacttttaatattttcaaaaaaattttttttttaattaaaatccattttatgatgcattttttgccggttcaacgcaaccaatgaaagctataaaaaaaattttaattttatttctaaacctaatttaaaatattttcaaaattattataataaaaaatttttttttaatttataaccatttttatgatgctttttttatgacgaaattcagtaccagtacaaagatgacgaggtgcgcctcccacagaagcagcagcagcaccaactcaaacagtatcaacagcagatggccggcacgacggatacggtagtgaacacgtacgacacggcatggacactgtattttgacgaaaacggtcaacagattgtggatgagtttgcaatgcgatacggaattgagcaaatttatcaggtggatgggaaagagagagaggggggggggggggaattggcacaatgccaagggaaaaagcgataattttaaaagttgtaaatttgtttttattaaaaatattttaatttatttattaaaaatatttttcattatttatttgaatataaataaaatatcactatttaaaaaatttaatttcttttataatttattttttataagatattttggtttatttattttgaatttaaatttaaaaaaacaaattattaaattaatttttattctcgtaaaataagtaaaaaaaaatatgatttgttttttattaaaatatttcgatattttaattttaaataaattgcttaataataaatggtattccattatttattttatttatttatttttttgtgcaggccatgacccatttcgcctgtttgtgcaccaaatacatgtgcgatggcgtgcccgccgtgttgtccatgcttttggccaatatcaacgcgcactttgcccacgcgacagcaaacgta

SEQ ID NO: 76918 - DNA, 928 bp, Heterodera glycines
  misc_feature (829)..(829): n is a, c, g, or t
  Genomic contig location: Contig_ID=SeqID_13122; Location=87..1014; Strand=-
  SCN-specific regions: Sequence locations=1-84,106-217,239-272,301 -318,344-564,586-898,920-928
  Gene Ontology: Cellular component=synaptic vesicle; Biological process=synaptic vesicle priming
aaacaactcgtctacagaaagtgccttcaagcactgatctatccgatcagtgccaccacaacaccgcacaatttttgcacaacaaattttcagcaggtgagactggcactggcttaatggtccaacttttttggcatttttttttcttttaattttggcattaaattttttatttgttggcacaatttttcagactccccccatctggtgctatgagtgtgagggccttttgtggggtttggccagacaaggtgggaaatacaattttaaaatttgtataaaatgaatttttaaaacaatgggttgaatgccgtgctgattttttttaatttaaaatttatttcctttttttttttgctttggctttggcattgtgtttttttattttctgacattattgttttttaaataattttttgtttcgaactcatttctcgggttttgttaggtaaaaatcatattcttccacatatatatttcttgaataaatattattatttgtatttggcaaataattaaattcagaaaaaaaaaatcaaaaatacgtaagccttgcacacataaattttatttgaaaaatttggatttttttttgcagtgatccgcgatcgaatgaaggcccaggagcgcaacaagccggaagtgttccgccgcatttcggacgcgttcagcgtggacgacaaaacgcagcagcaggtggggccaataggagggagagtcgatggagtcctggaaagtgtacttgaaattaatattccgaaaataacccaactctggaatctggaaaatcctggagaataagccaatgtttgcctggaaaattgaattngttcatgtgctcggtgttttgggcgaaatttccaaaatttgagggaaaattttatgagctatattaacttttaaagacctcaaaaatctctttaataaa

SEQ ID NO: 76919 - DNA, 1511 bp, Heterodera glycines
  Genomic contig location: Contig_ID=SeqID_13123; Location=63..1573; Strand=-
  SCN-specific regions: Sequence locations=1-635,657-1511
  Gene Ontology: Mol. function=enoyl-[acyl-carrier protein] reductase activity; Cellular component=mitochondrion; Biological process =aerobic respiration
attcggtgggtgcatcgttgggcatggacgtctcgccgtttgtgctcttcgaccaaaattatttatgagcaaaacgggaatcccgctgaggtgaatatattcatttatatatgcatcattttgccgtatatcttttattttgtctcaggtcctcaaacttagcaacgaaaaaatcgaccaaaatgccattggagcaaacgaagtttttgtccgatggatggccagtccgataaatccgtcagacatcaatcaaattcaggggggtccgtaacgttccgtcatgtttttcttacgttttaaaccttttttagtgtatccgattaagccacctttgcctgccgttgcgggcaacgaaggctgtgcccgagttgagaaggtttttcataataatcaggcaccaaatattcattcgtcttgccgttttcagattggttccaacgttcgagagttgaaagtgggcgacatcgttcttcctaccaatgccggccttggcacttggtgtacccacggcatttatcagtcgactcaactgttccctattgacagttctttgcaactcgactcaatcgcaacggcaatgctccaagtaaacaaatgcaaaatatttgtctgatttaattcggcctgtttccaaatctttgtttttaggtgaatccgtccaccgcctatcgaatgcttcatgactatgccaaattggtccccggtgacattgtggtacaaaacgggggaaactctgctgtcggacgcttcgttattcaggcaaattgcaattaatttcaaaaccaaaactatgaaaatttaatgcgaaacgtaaccatttgtaattttatcctttttctccttttccctcaacagatgtgtcgaaatttgggctttaaatcgatcagcgtcgtccgtgaccgaccccaaattaacgagatgaaagatgagctcaaacaattgggggcaactgaggtttttacggaggaggaggtaccgaaagaggagggaattcttccaattgcttttttgttcgtttagttcgccaaggcagtgaagtcaaaaattggagcaaaattggcgttgaattgcgtcggtgggaaaagcacgacttaccttaccagagcgttggccaatggcgggtgcatggtcacttacggaggaatgtccaaaaacccggtccaaggtatggaaattgggtctatttccacctaccccgatattaattaccacatttacaccgtttagtgcccacttcctcgttgattttcaatgatatcactttgtacggcttttggatgtcgcgatggtacaattgtggacattcggaggtaaaacagaataaaagatgatgaccgaaacgatggaatcttctcaaggaacgtgcgaatatgtacaaagtctttgacgattggtataaaagtgggaagctttcgacgccgccctttcgaaaatggaaaattgaggaatacaaagaagcggtcgagaatgccatggaaccgatgacgaagttccagcacgtctttgcgtat

SEQ ID NO: 76920 - DNA, 151 bp, Heterodera glycines
  Genomic contig location: Contig_ID=SeqID_13124; Location=122..272; Strand=-
  SCN-specific regions: Sequence locations=1-151
atggaattcctccgcggactttgtcccgcttttgtcgtcttcgccgccgctgtgttcgttttgtcggtgcatttcgaacaatgtgccgggcgacagcgctgggccgaggtgacgcaccgggtcgacttcgtcgcgaaagtctatgccctcg

SEQ ID NO: 76921 - DNA, 1613 bp, Heterodera glycines
  Genomic contig location: Contig_ID=SeqID_13124; Location=568..2180; Strand=+
  SCN-specific regions: Sequence locations=1-337,359-377,412-490,512 -931,954-1200,1226-1369,1428-1613
atgcgaaaaggaaatcagtttggattttacttttcaattgttgacacaaaatgccaaaggtcttgcgatttgtcggcccgttgctgtgacgtttctccgccacctccgccgatggaccgccgacgacggcacagcaacgaattgcggcaatccctggaaaagggagccgaaggacaaggactgcttgcgaagcggacgaacagcattcagcagctgatcagtgcactgtccgagaattcgccaccgtcgccaaaagttagttggccatccatcatttaaatgtgtattttagaatagatttgtgtgatcgatgaatggttgtgccgattgatcacctttttaaatagcaattttattaaattaagcgctgatttgtcttctcatttgactgttttttccgttcagtctttgcgtcgtttcgatgcgttgcgcacttttccctttccatcccttcgcgttccgttccgaaagtggcgaccgcccaaaaaggaattcatttatgagcactcaaaaccgatggagtgagttggggacaatgcgatgggcggggggagagaacgggcggaattgagacggactggaaaagtttttccatcgggcagtgggaacctccccaaaactcctggaccgtcgctgattaccaccccatatttgacaaatagatagagccttcttcaaagcctaatttgtagtatttgatcaactgtaaaatagtcttttggtccgccgatttctcctctcccgcctaaaatgaaaaacattttcagtttcatcacccaattggcccttcagaagcaccgctgcgcgggttgtggcctcaaattggaccacgtttatgtgaagcggacgctctattgccattacttctcgaagttgttctgccagtgctgtcaccaggggacaaaagtgcgaaacatttgacagacaattaaactgtcaaatcaacagtaaattcatttagacgcgaatccctgcgctcattttgcacgagtggaacttcaaggagtacccagtgagcgacattgctctcaaatttctgctggacaacgccgaccagcccgtgttcgatgtccgactggtcaaccccgggctgtaccgtcgtgcaaagaatttgcgcaaatttcggaaattgcgcgtcaaaatctcacatatgtggcccttcgtgcagatgtgcaaattggcagccgaactgatgacggaaaacggaatgtaagtgcactcttctattctggggaagatgaaaagacaaaaaaaaaacggtcccctaattacttctatttttgaaaaatcctcttaattaaacagtcggttcgggcagccgggaggcattatgcgtatccaatttttaaactattttttatttttcgcacttatcatactataactgtttgtgttgcttttccccttttttaaaattttatttttatgccttcaaaaatgataattcgtttagccttaggacaatgttcgcctctgtacccaaacgctttttgtcgttggagtcggtggacgtttactcgctgctcgactttgagcgaattgcgaacaaaaatctgatcgaattggttgaaccgttggctttgaagggcgccgcgcacatcgagaattgtgaa

SEQ ID NO: 76922 - DNA, 569 bp, Heterodera glycines
  Genomic contig location: Contig_ID=SeqID_13126; Location=1513..2081; Strand=+
  SCN-specific regions: Sequence locations=1-364,386-569
  Gene Ontology: Mol. function=signal transducer activity; Cellular component=actin cytoskeleton; Biological process=dorsal closure
atgggagccgccattgaagcccgtttggaagtgtgtcgtttgctggtggacgaatgggcagcggatgtcaaccaagaagcaatcgatggcaccacagctctgatacgcgcgagcgatgagggacacgtggacgttggtgagaaaaaaatttttgtgcaaaatttcagaatttttcctcattttccagtgaattttctcatcgaacgtggcgccaaccttcaccacaccgacatggacggatacaactcgttgatgtgcgcagtgagaaacggaaagactgaaatggcacggcatttggtggccatcggcgcgagaactgaccaaattggcactgatggtgagcgaaaatgctaaaagttgccccacttttatgtaacaaattttctcccatttaaggcaaaagggcgcgcgatttggcggaagaaggcgaaattgccgaaatgattgacatttttcgtcccgcggctgagcagcgggagaacgtcgatgggtaaaaaatggtgttttttgatttaaaaaaacatcaaaaattcaggcaacagaacgagcaccaacagcagcggatgtga

SEQ ID NO: 76923 - DNA, 970 bp, Heterodera glycines
  misc_feature (38)..(38): n is a, c, g, or t
  Genomic contig location: Contig_ID=SeqID_13128; Location=71..1040; Strand=+
  SCN-specific regions: Sequence locations=1-334,356-461,505-660,682 -783,805-970
gactcaaccctccagcattcaatcactgggactcaacncaccaacattccaatcactgggactcaatccaccaacattccaatcaacgggactcaatccaccaacattccaatcactgggactcaatccaccaacattccaatcaacgggactcagccctccagcatttcaatcactgggactcaacccaccaacattccaatcactgggactcaatccaccaacattccaatcaacgggactcaatccaccagcatttcaatcactgggactcaatccaccaacattccattcaacgggactcaaccctccagcatttcaatcactgggactcaatccattctcccgaattcaaatcactggactcaatctcatcaatccttcatcaacacaattaccgggactcagttctccgacatttcaatcaccggaactcaacctcagcaacggaatacagaactatttaaaaggaatccagaaattgaaatataacccataataaatcaaaacactatggtgtataattattgcccccaccccataaattcaaattaaaactgacctgtttaaaactttccacctaaatttgatcccgcaagtggcacgtcaatatcccaattgcatataaatattccactcgagcacaggcaaaacatgagatgtagcatttatattgctttttctatccatcaaaggctttttctttcattgtttattactatcataacatgctttttattcaaaacaaatatcaaaaaccaaatcagattcttttcatattataagcaaggaaaagtacaaaaaacgtttttaagtaacaaacctttttcattcaagcgaattctaatgcatttttttaaccaaacaattctccattatcgtttacataagcaaaacaaaagctttcacatcaaaatcaaatcaattaacaaaaacaaaatttagacaaaaaaataatgataaacaaaca

SEQ ID NO: 76924 - DNA, 218 bp, Heterodera glycines
  Genomic contig location: Contig_ID=SeqID_1939; Location=1091..1308; Strand=+
  SCN-specific regions: Sequence locations=1-218
atgcatcataaaatttcaaaaaaagcccggtaccgattttttaacggtatgcagtgaaaaagagcaaaaaaaaaattcaaaatattcgtaaaaacattttttactattttaaaaagaagccgaaaatttggtcacctttagaataaaaccgtaaattttcagcatcttttatttgtaattaaaaaagaaaattttttcaaaacaaaaattttttcaaa

SEQ ID NO: 76925 - DNA, 483 bp, Heterodera glycines
  Genomic contig location: Contig_ID=SeqID_1940; Location=1110..1592; Strand=-
  SCN-specific regions: Sequence locations=1-192,216-342,372-483
atgacggtttgttcgcctaatttccatgcgatgacagtgcgcggcgtcggatggacaagcattggcaaaatggcttttcactccgcttcaaaacaatttgccaaagatgttcaactgttcattgcacttgaatgatgggattttgccgtcgaatattgaaccgttcaaagcggtgctttcagttcgtatttctttaatcaattttatcaaatttcaggcttttgcaaatgcttcttcccccgtcaatttcattgtcatttgttttcagttgtctgctgattccgttgtgccatttgatctgatcaacgaattgattgttgacaaggattaacaatagccatcgttttttgcttttcctgaacactgtcaaatcactttttgttcggaatttataatgattagatgtgcatggtgtgacaaattcctttgcttcactcatttctaccaaaattatcacatgtgccaaaattaatgtcgaataaa

SEQ ID NO: 76926 - DNA, 369 bp, Heterodera glycines
  Genomic contig location: Contig_ID=SeqID_1940; Location=2191..2559; Strand=-
  SCN-specific regions: Sequence locations=1-303,326-369
atgaacgaacaagaaatccagtggaaatggataggtttgtaatcggattctctgttctggaacctcgaaaaccatttttttttaaatttcagtgtttcaagcattcgctttataaaaaatgtcaaacattccgaaataagagcaaaacatggaaaaaccatggtacacttaaaacccattgcttttttaacgaaaaagaaaccaaaaagcaaaggcttttttccgtacggttaatttcaagaaatcaaccaaaaattttcggcgccgacggaatcagaattccgttatctatgtttttgtataagatttttcattaaattttccagatctattgaattcatgtttcggattgaattagaacaaaataaa

SEQ ID NO: 76927 - DNA, 1534 bp, Heterodera glycines
  misc_feature (97)..(97): n is a, c, g, or t
  Genomic contig location: Contig_ID=SeqID_1941; Location=67..1600; Strand=+
  SCN-specific regions: Sequence locations=1-102,173-211,233-585,607 -745,767-994,1017-1463,1485-1534
  Gene Ontology: Mol. function=ATP-dependent peptidase activity; Cellular component=mitochondrial matrix; Biological process =proteolysis and peptidolysis
atgaaatgtcgaccccgtattgaggtaaattcaatttataatttgaaaaaaattccaatacaaaaaattgtttattgttgcctattctttaggcacnccttgaaaaaaattttttattttgaaaaaatttttgttttgaaaaaaattttttcttttttaattacaaataaaagatgctgaaaatttacggttttattctaaaggtgaccaaatttttggcttctttttaaaatagtaaagaatgtttttacgagtattttgaatttttttttttgctctttttcactgcataccgttaaaaaatcggtaccgggctttttttgaaattttatgatgcattagtaaattttattctaaaactcgcgaaaaattttttaagattttcatgaaaaattttttgattttttttcaaaaagattcggcgttgtttgtcccggccaaaattttgtgtagcacccgggagtgggaagctgcagtttaagaacatttttagaaaaaaaaagttagaattttctttactttacaggaggcgatacggttcgcattctcgtcagttagacgagcatatgagcgcagacaattgagcaccttttttgaacaaaacaaaattaatctgtcatttccgccactgagtaccaaacgaagtggaccatcggcatctgccgctgctgcactcgcaattctctcattggcgacgggaagaccagtgcaggcgggcgtttgtgtcactggaaaagtgacaacgattggccacatcagcaaaatcagccaaatgaaagaaaagacgatcgcagctgcagaggcaaatatggtcaaaatggcatttccaagggccaacctaagcgagttcaagaaagtgccttatcgaacccgaaagaatttaaggagaaaaactttgaataaggtggatgatttattttctctttattgatttaattttttttattgtttttccatttaatattttgatttgttatcacttttaccatttatgaaaatttacctttttgaaaaaattgcaaataattaattagggagtcaatgatcggatcaaaatttttaaggtttatgggtttgggccagtagggctgtaatggcggatgacataaagtcggaattcggctccaacaaagtccaacacttttgctgtttaagcactccgagaaaccataggggtaaaggacccttagggttggcaaaaaaaaaattttttttttgggaggtttttggggttattaatataattctgatatcagatttagcaaatctcttcagcaaaatcgaacagaatgtcaaaaatttaagttttccgggttttgatttttgttcaaaatggaattaggctttctaaataggattaaatagatgttatatctgtgattaacgccctagaaaaccccaacgacgttttcacgacgtgccaaagtcccgaaaaaatggccaagttgcgagtgtcaatgagatttggaaaattttttaaattatgattctccggaccgccacacattttcattacttcagaaagtgccgacaa

SEQ ID NO: 76928 - DNA, 1222 bp, Heterodera glycines
  Genomic contig location: Contig_ID=SeqID_1941; Location=1911..3132; Strand=-
  SCN-specific regions: Sequence locations=1-125,194-386,431-606,628 -1014,1047-1083,1123-1200
  Gene Ontology: Mol. function=ATP-dependent peptidase activity; Cellular component=mitochondrial matrix; Biological process =proteolysis and peptidolysis
atgcatcccctgctcatatatggaaatgtcgaccccgtattgaaggtaaattccaaatttataattggaaaaaaattccaagccaaaaaattgtttattgttgcctattctttaggcaccccttgaaaaaaaattttttattttgaaaaaatttttgttttgaaaaaattttcttttttaattacaaataaaagatgctgaaaatttacggttttattctaaaggtgaccaaattttcggcttctttttaaaatagtaaaaaatgtttttacgaatattttgaatttttttttttgctctttttcactgcataccgttaaaaaatcggtaccgggctttttttgaaattttatgatgcattagtaaattttattctaaaactcgcgaaaaattttttaaaattttcatgaaaaattttttgattttttttcaaaaagattcggcgttgtttgtcccggccaaaattttgtgtagcacccgggagtgggaagctgcagtttaagaacatttttagaaaaaaaaagttagaattttctttactttacaggaggcgatacggttcgcattctcgtcagttagacgagcatatgagcgcagacaattgagcaccttttttgaacaaaacaaaattaatctgtcatttccgccactgagtaccaaacgaagtggaccatcggcatctgccgctgctgcactcgcaattctctcattggcgacgggaagaccagtgcaggcgggcgtttgtgtcactggaaaagtgacaacgatgggccacatcagcaaaatcggccaaatgaaagaaaagacgatcgcagctgcagaggcaaatatggtcaaaatggcatttccaagggccaacctaagcgagttcaagaaagtgccttatcgaacccgaaagaatttaaggagaaaaactttgaataaggtggatgaattattttctctttattgatttaatttttttattgtttttccatttaatattttgatttgttatcacttttaccatttatgaaaatttacctttttgaaaaaatttgcttttaaacatgttttgttatgaattacctattcatcaaaacaaaaaatgtaaattaggtaatgcttaagaaattaatcatttgattaaagcaattggcaatttaagcgcttaataggccgttaaaatgcaaaataagcactagcgcatttcatacgcaatttaatgttttgacaaaataaa

SEQ ID NO: 76929 - DNA, 416 bp, Heterodera glycines
  Genomic contig location: Contig_ID=SeqID_1942; Location=1075..1490; Strand=-
  SCN-specific regions: Sequence locations=1-29,51-416
atgcgttcttttttcttcgccagcctcgctttggtgctcatctgtgcctccaccactgtttctaagccccacgcgacggtattgtggttatttccgataaaaggcatttaaatgtaaaacattcatattttttaagcctgcccatctgtcaagaccaatgaaaaaggttgctatcaagtgtgctttgtcgttgtgtgcatcaacatttgccctaaggccaaggttggcatttttttgtttataaaactttgggttcagaatttatgtgctaaaataattcaatttaattgccaagaacgatgaaaatggtgctgctgtgaaatggcttaacatttccgtgccaatccccgacgccatttccctgccttcctttaacatgacaaacattacccaaggcgaggagcaggaagaataaa

SEQ ID NO: 76930 - DNA, 762 bp, Heterodera glycines
  Genomic contig location: Contig_ID=SeqID_1944; Location=228..989; Strand=+
  SCN-specific regions: Sequence locations=1-125,148-541,563-632,657-741
atgagatttacggcgccgactggcactcctataattaatgctcaaaaattaaatctcgaacaccttttgttttccttatgtccaaacgaaattcttttcaaaggtaataacgaacgactgaatggaattcttagaaacttttgaattttgctgagttcataaatttttaaggctgggcagcgacgggatattgtaaggaaaagttagatggatgttaaagcaagtaaagcggtggtttttacgaggcggatttgcctcaaaacgcattggccgagttgccaaaggactgaatttccacccctggcttaacatttagcctatttgttcattaaatggaggaatgcataagataaaataaaactttttggccctgaatcattaattctgcgccgcaaatgtcattttgacttgaagcagcaaatgtcagtgccgcaaaatgtaagcgccgcaaatgtcggctaatcatcccagtcgctcgcaaatgcatttttggggttttctcatttttatgaattttagatttttgaataaagcaaaggccaaaataaaaaataaattaattgtaaatagtttcagtgttttattatttcaattttttctcacccttggccaaatttgcgtgggcacagttgactctgcttgctgctgctgctacttagcaacttgtttttcaaaaatgttgctcaaaacccatctaaaaattaccaatcaacaattattcgaactaattaattttcattctttttgcaaaaattcaaaaaa

SEQ ID NO: 76931 - DNA, 1329 bp, Heterodera glycines
  Genomic contig location: Contig_ID=SeqID_1944; Location=995..2323; Strand=-
  SCN-specific regions: Sequence locations=1-235,269-270,308-683,711 -785,812-1035,1057-1329
atgattggtgtagatgaacatgctttaactcttataacggtcagtaatgttcattaaaataaattgaaagcggatttagctaaattcatttttgcctttactattttttgttatttgatgttttttttatactttactctgtttattaaattgggcccttggggcttattcaacccatcattaaaaggtactttatcagacttatataaaggactattaagaaatatgatatgcgatttccattttcaaaaacaataataaataaatattgggaaaaattaaagtgttttaatttccagcaagaactagaaccagaaaccttacaagaggccagattttttgctgataccgtgaaaaacggtgccaacaagttgcgaaatgattgcaacaaaatgtttgagcttcaagctttaaaaaaacatgatagcagtttttcgagtgatctgaaaaccattcatgctcaggtaataaataatttttcgagctccctttaatatttataaacgaattaaggcctttaatgaatgcaacaaggttttaattgaaacccttgatgaattttgcaattaaaatggacaatctcgtcaaaaaaaccactgatcggcaaatgaatgttttgtatgaattttgtctgctggtttgtccagatacaaatgtgaattgatcctcaaaaattatgcaagttttatttaaatattatttaatttaatccaagtttataaaaaacggaaatttttggatttagaattattttgttgtttttctttaattgcatttttgcagactattaaaaaatatttaataaatttttcaaagtttgtacatgaaaaaataacaaaatttgcataaaaatctcccccttattttaagtattgattccaacaaaacaacgttgtatacgatcaagcaaaccgggtttagtggccattcatgttgtgaaactggaaattggcatgaacgacgaacttttcttggcaaaaatggaaataacaaaaaacaagctaccagcattgcagaagaggtattcgtattaatattaaaaattttgtaccaaatgtttgatttcataaattaacaaacttagtttcatatgattttttaatattaaggtgatcaaagcagcagaaaatgcaagtgcatagaactcacagaatgtgaagcaaaaaacaaagatgaaattaactttttgttaaattattggtcaccattttgctcaaagcaaatttatatatggattattatcaccatatataaaagtttcgacttagttcgacccccagacagaagaaaattattttaatacgtaattctatgaaaatttcaaataaa

SEQ ID NO: 76932 - DNA, 413 bp, Heterodera glycines
  Genomic contig location: Contig_ID=SeqID_13130; Location=819..1231; Strand=-
  SCN-specific regions: Sequence locations=1-231,273-413
atgtcggaagctgattcggaaagcaaatatggagcagttgttagcgctagtggaaatttgtttaaacattgttatctcgcgttttcgattgaccacacggcagaaaaagcgactaatgccatatgcagattttgttcggcgcttgagcagagcgagaagtgaactccgacggcttcatcgaggacagttggctgtctccgcccgctgcttcatcctccaatgcgtatcgggtaaaataattaaataattttattttaaaaatcaaaaatatacagcgcaagcaagtctcgaaggggagaaaggcgaccgaacagcaaatgccgaacaaaaacgaaatggatggacttccgaccaagaaaaagaagcccattccagcccatggtacattaaaaattctttttgaatatttttaa

SEQ ID NO: 76933 - DNA, 890 bp, Heterodera glycines
  Genomic contig location: Contig_ID=SeqID_13131; Location=549..1438; Strand=+
  SCN-specific regions: Sequence locations=1-274,296-629,812-890
atggtgatgccttctttggtgatcatcgtgtccacttccacctcggttcccttgcaggaacggcatcggccggcctcatcaaaagggaggaagcgaggggatgagagacgggggccactaattgtgataccgcttgtggtaatagtgatgtcggcttcgccgagaatttggtggagaagccctttcttgtcttgcatgtttatcgccatttgatgattgtgttgggaaagaccaaaactacagcctatttataggggcaacgcagttcgggtgtggagaaatagtgcaggtgtttgatgatagccagagaaaaagagcgaagagatatagtactggtgtagaagagggtgtcaaactaaacatctgtcaccccgcacatctagctccatgccctactcccaattaattaattagtaccaattagtcatcacgaattaccaccccacccccatctgtcggcaagttcaaagggctgcacccctcccataggcttgggtttgaccaattagcacattagcacccctaattacaccacctgtcacttctaattagcgtcaacctccaacggtcccgggggggggggggttactactaatatcaggtaatttctgcaatgaaccaaaatcaccaattttttaaaatttttcatctttttaaaaatatttttatattacttaaagttaaaaatttaggtatcaattttataaaatatttaaatgtaaaaaagtatttttttatgcattgcttttaatttctagaataaactatatttaattttgtagttatttttttaaattttttttatatttatcaatttcagcaaaaaattgtgttcacttactttatacattttttactgacgaattatcaactgcgcaaataataaatta

SEQ ID NO: 76934 - DNA, 447 bp, Heterodera glycines
  Genomic contig location: Contig_ID=SeqID_13131; Location=311..757; Strand=-
  SCN-specific regions: Sequence locations=1-286,309-363,390-447
atggcgataaacatgcaagacaagaaagggcttctccaccaaattctcggcgaagccgacatcactattaccacaagcggtatcacaattagtggcccccgtctctcatcccctcgcttcctcccttttgatgaggccggccgatgccgttcctgcaagggaaccgaggtggaagtggacacgatgatcaccaaagaaggcatcaccatttggtgtacacggttcgacaaagttcaatttgtaccgttcgacatcatctatgatctacccggacactgctttttccgcgtgaagaacaaggcgcgcgtgttcaacatcccctacggagaactgcctgccatcacattcccaaaacaccaagaacaacagcagcagcagcagcagcagcaaaagaacgacttgcgacaaaaggccaacgctgctctggacttgatggagagggactga

SEQ ID NO: 76935 - DNA, 264 bp, Heterodera glycines
  Genomic contig location: Contig_ID=SeqID_13131; Location=1547..1810; Strand=-
  SCN-specific regions: Sequence locations=1-264
atggaaggacaagtatggtccgaaggaactatttctctgtaagttttgcgatttgtaattttttcaattaatcaaccaataaaatataaaacactctaatgtcaaaaactattttttaaattctagaatcaaagttgaaaaaaatgatttaaataacaaaaaaataacaggagaaacaaggagatctattaactattcaaaagaaattacagcgacattaaattatggttaaaaaattaacagtcatacttagataagaataaa

SEQ ID NO: 76936 - DNA, 1973 bp, Heterodera glycines
  Genomic contig location: Contig_ID=SeqID_13132; Location=146..2118; Strand=-
  SCN-specific regions: Sequence locations=1-512,534-752,774-816,841 -877,899-1890,1918-1973
atgagtgacaatccagaagaaaacgacaaagaagaagtgatgagaacgttcagaaaaagcttgacattcaaagaaggaagatatgaatgtggcctaccatggaacgaaagagtaaaggatttgccgacaaattttcaacaagcgagggcaagactttgtggcacagtgaagaaattgcgagaattgaatttggtggaagaataccaaaaaattttcaatgagtgggagaggaacgggataatcgaaagagttccggatccaacacaatcaactggaccggtacattatctccaacatcggcccgtgataaaaatagacaaggccacgacaaaaataagaattgtgatggatgcatccgcgaagccagcgaaccgcaaaggagccccatcgttgaacgaatgcttgcacacagggccgttattgttaaacgaattgaccgggatccttctgagatggagaagaatgaaggatctgatcctggcggacatcgaaaaagccttcctccaattatcagtaagagaggaggacagagacgcgaccagatttctgtggctggaggatccacaaaagacagaaatttcaagcccaacatatgtgagaaccgttgtgtttcggttctgtcgggtctcatttggattgacaacttcaccatttcttttaaatgcaaccatccgcgaacatctttcattctacgacacggttctaccgcaaaccataatggagaatttgtacgtggacaacatactgatcaatgtgaagaagaatgaagacatggcgcaaatttgccacgaatcgatcgagctgttccgtcaagggggaatgaagctgcaggaatttttctgcagtaagccgatcgccatacgaagccttcctgtggaattattggccaaaaaccaaagggagataaaagttctcggaattccgtggacgaatgaggatgatgaaatttgcttccgatttaaaaaatttgccggaaagcacacgaagaggaacatcttggcacacattgcaaaaatttatgaccctttggggttagtggcgcctgcagtgctcccagcaaagcattttttgcaaaaacgttttgaagccaaaaacggctgggatgaaggattggaagaagaattgattcatgaatggaatcaaattatggagacttggcaaacgagagaggggacagaggtccaaattcgattcgcacgaagagtcgacaacgaagacgaagtggacaaggaaatgcattgcttcgcagatgcgagcggaaaaggcttaggcgttgccatttacatccgggaatcgacagaaaaaatgagcgcaaatttggtgtttgccaagagcctggtgaagccctccaacatatcagatgttgcggcaacaattccaaaaatggaattacaatcgataacgctgggagtgaagttgttaaagtacgtgctccaacatcttaaattcaaaccgtcacagacaacaatttggactgacagcttgtgttccgttgaacgaattaaggagcataagaaatgcgatcgatttgtttcaaatcgattagcaaaaatacgtggacagtttgaaatcaaacatttggtcagtgcagataatcccgcggacgtggcatcacgcggcacaacaccaagagagttgagcagaaatttgctatggaagcatggcccaaaatggttatcggaagaaaaggccctgtggccaaaaccagcaaaagtttatcacccggatgaagagaagctcaggggaagtgcagaagatgaagaaataaaaacagccgcagtcatgaatggggtgccgttccagccaactattgatatgaaccggtactccagctggaaaaaggccaaaaccgtgggtgcctatgtcttacgctggatacattcggtggcaaaaaacaaatacaatggaaatttgttgccaattctgagcaaaatgggcccaaaaaagcactggaatcaagacaagggcgtact

SEQ ID NO: 76937 - DNA, 633 bp, Heterodera glycines
  Genomic contig location: Contig_ID=SeqID_13133; Location=2799..3431; Strand=-
  SCN-specific regions: Sequence locations=1-458,480-633
  Gene Ontology: Mol. function=ribulose-phosphate 3-epimerase activity; Cellular component=cytosol; Biological process=pentose-phosphate shunt
atgatggtgtccaacccgtccaaatggctcgaccctctgcacaaagcaggcatcgatcaattcactttccattgggaggcactcggagaggacgaagcggtggacacactcatcgaccgagtcaaatccaagggaatacgatgtggactgtccatcaaaccaatgacgccggtaattcatgggatagaagacaatcaatgggacgaaagttcagctggacaaactgatgaagttttgcgaaaagatcgacacagcactcataatgtattgtaaagggagtcgaagaatgaccgtgcgaaatgaaatttgcctttaggacggtcgaaccgggattcggcggacaaaagtttatgcaggaccaaatggaaaaggtgcgccaactgcgaaaagcgtacccaaacttggacatccaagtggacggcggggtcggactggacaacatcgaacactgtgcgaacgcaggtgtcccccggagtggaatcattagtttgcacgaaaaataatgggattttaggggccaatatgatcgtttctgggactggaatcgttcggtcggctgacccgcgtcagacaatgcaaaagatgagggaaactgtcgaaattgcttcctcaaaagaaacactcggcgtttaa

SEQ ID NO: 76938 - DNA, 1020 bp, Heterodera glycines
  Genomic contig location: Contig_ID=SeqID_13134; Location=229..1248; Strand=-
  SCN-specific regions: Sequence locations=1-92,115-211,234-248,270 -309,353-375,407-548,612-627,650-749,792-919,989-999
atgtccttgaatggtaaggacgctcttggaaaatctaatatatttatggacagagggacatatttgtccttggatgccaaggacgcccttgaaattttaacaaaatatttaaggatagggctcgccttggatgccaaggacgcccttgaaatcttaacaaatcagatatgtttaaggacagggattatatttgtccattgggtgcgaataaaaattttgaaataaactgtaaacgaaaatccaacagaaaataatttgtttattattttgaaaaagtaataacctaattaatgaaaagcatttcaatcgttaattaaaaaatcaaatacaaaatttaaaattatgtttaatacattttgctaaacgatttacggcttatttttttaaaatttatttattaatttttctgaatttattcaccccatttcctgtgttattcagaattgcactgttggtgatgttcagcccataaaaagccttgtggtcaacagaagcatgaagtcgaaaaagcacttttacatcagcagaaacggcatttaaagaatcgcttaaattattaaattaattaaaaaaataatttataattatattaaacattttataaatattttcaccacctttgtgtcctactgtattcaatgcccaaaaagattggtcgtccattgctgttcaacgacacactttgtggaagaacaccatccaaaattggcacacgaaaacgctcagtttggcatactgttggaatcttgaaatttttttattttttaaaatttgacaaaaaaaaatatttaccgttgaattaccgtcgcaaatcacaaaaaatgtgcgcgtttcaaaatctccgatcagctgatgatgattacggacattgataaactgtgggcaaatgtgaatattatttacaaaatgatgattgaagaaattatataaatatttttatttaaaatcaatcaatttttatgtaaaataatcaaaaaactttaaaaatcaatttgatttgaatgaatttctttaaataaa

SEQ ID NO: 76939 - DNA, 1520 bp, Heterodera glycines
  Genomic contig location: Contig_ID=SeqID_13134; Location=504..2023; Strand=+
  SCN-specific regions: Sequence locations=1-96,119-134,198-339,371 -393,437-476,498-512,535-631,654-861,885-952,1187-1199,1221-1232,1306- 1314,1337-1520
attccaacagtatgccaaactgagcgttttcgtgtgccaattttggatggtgttcttccacaaagtgtgtcgttgaacagcaatggacgaccaatctttttgggcattgaatacagtaggacacaaaggtggtgaaaatatttataaaatgtttaatataattataaattatttttttaattaatttaataatttaagcgattctttaaatgccgtttctgctgatgtaaaagtgctttttcgacttcatgcttctgttgaccacaaggctttttatgggctgaacatcaccaacagtgcaattctgaataacacaggaaatggggtgaataaattcagaaaaattaataaataaattttaaaaaaataagccgtaaatcgtttagcaaaatgtattaaacataattttaaattttgtatttgattttttaattaacgattgaaatgcttttcattaattaggttattactttttcaaaataataaacaaattattttctgttggattttcgtttacagtttatttcaaaatttttattcgcacccaatggacaaatataatccctgtccttaaacatatctgatttgttaagatttcaagggcgtccttggcatccaaggcgagccctatccttaaatattttgttaaaatttcaagggcgtccttggcatccaaggacaaatatgtccctctgtccataaatatattagattttccaagagcgtccttaccattcaaggacatgtgagaaccactgtccttaaatatattttattgttcaaaaccaatttgcagattaaagcgtcacaaatccgtgaccgtttcgcgttgcacaatgtcagtgttgagggcaaccagggcttggctggcttactggtccaagacggtgccgccgatgtttggctcaatgacacatcattcagctggaattggggcgacggtgccaatttcatttatttaaattaataaaaaattttttattttttatttaattttctttttccaatttactgacattccttcataatattattatgcatttaattcaaaatttatttatacaataaatttattttttaaataattttttttaaattcatttataatttaataaatgcggaagcattcgaaaaataattttaatttttaaatcgtatttttttatttttaataaatattatttttctattcaatttatcatttttacaaatgcagaagcatttgataaaaattatttttattttttttgttttttattaaatctatttttactcattatttaaaatttacttttctattttaataaattactattttttcaaattaaaatacaaaaaatctaattttgcttacagttaactccgattggccttctgtgtctttgtttgctggcctgtcttcctttgccaaagtgttgatcaattgggtggaattttcggacaatatttatcatcctcatgtggaagttttcgcatgccaaagtgcaaatcagcgacttatgcatgtcgatcttagcgga

SEQ ID NO: 76940 - DNA, 462 bp, Heterodera glycines
  Genomic contig location: Contig_ID=SeqID_13137; Location=19..480; Strand=+
  SCN-specific regions: Sequence locations=1-16,39-362,399-462
atgttcaccatggacgaccttctccaactcgccaatggccgcttattggcggacatcgaagcaattgtcaggattttcactgcccatatcaccgaagagtgcgaaatatgtcggggaaatgctttcttctgcgaactgtgcacagataatcaggttaatggtgttggcttgaggaattagtacaataatttataagttccacagaaattactccgcgccacttttcagcgcatctatccgttcagcgaaaacgtggccatttgcaagagttgctgtgctgtctatcaccgcccgtgctttgaccgtgccagcaaacggtgtccgcgatgtttacgcagaaaggcgagaagaaaagcggtgatggaagagaatgagggggacgaggaggaagaagaggacggacaacaaccgtaggacagcaaacttttttatttttgcataaatcgggtcacaatagtcaaa

SEQ ID NO: 76941 - DNA, 1699 bp, Heterodera glycines
  Genomic contig location: Contig_ID=SeqID_13137; Location=1668..3366; Strand=-
  SCN-specific regions: Sequence locations=1-154,215-268,379-434,456 -645,668-1097,1119-1195,1218-1397,1419-1655,1686-1699
atgttctgctattttctcattgcttttcttttgctcgttttggcaaagggattcgaaggtaaaaaatggaagaattttgatgaattaattaacatactttcaggctacactttcagttgtttggacgggtgcgaatgtgacactgatgacgaggtaattaattaattaattaattataattattaattaattataattagttattaattatttacgtaataccccttttcttaattgattatcaaatacaaactcaatcttttttatgtcaattaattaacagttatcaccaaataattacttttttataaaatattaatcgattaaaaatcaattacttaattaccttttttctattaattaattaataatcaattacactctcaccttaattatgtcaattaattaccatccatccgttcacttccttgttttggctttccctttccaaattccgctctcccttattaggccatccattgtcacaatcgtcccgatcggcactttgtccaattgcccccgtcgcgtctccgcggtttcactgtgctcgcgctcacccgcaataacatcgatgtgctgcccagcgaagaagtactgctcgagaaactgcccgacctgaaggtctttcctttaaatttcattttattattaaatttgatgacagtttcaattttaattggtaatattccatcagaactcggcagtttttccgttaaggccgttgacgtcgaagggaatgaacatttcgactgttccacgctcgaccattaccggacattgatggtgatgagcgattgcggaaagactcccgaacaattggaggccgaccgggccaaactgccgacggacacacagccaaatgaggtaatttggaggacagatttggccacaaaaagccattcgaatttcgaaggattgcgacttcgaatgcgtggcgaaccgacgcagtcgcgagttgcgcgagtacgtcaaacacttgtgggagatggtcaaagagaaggtgagccgactggccaagaagcacggattggacaaagtggtggacgacgtgggcaatttcttcaacgacgtgggcgaacgcatctccaacatcaaactgaagaagaagaaatgagacggacggacggaaggaacaaaagagaaaaacaccaaaaaaaattggaaaggaaattgaaagattgccatttaaatcgacgagttcagaacttcctgtccattttgcttcgttatctctaaatcattaacacaaatctcccccatccaatcccatcataacgagttcatttctttttttcttgccttaactttttatataaatctcttgcattttaatttgtgatttcaatttcatatgcattcataatcctgtaaaatatgcataatgtgtcattcgagctcaaataaattctttcttttttatgcgtcggtgcctttcaaaccatacgctttttcccgttttatgcttacgttattttcttaatacctaattatttgtcagctgatcagtgtgatattttcgtttgttatgagtccgattgaccctgacaaaatggcattgctaaagcgccttttccccgtcctcggcaaacaccttcgcaagggcgactgtggcaaaatcggagtgatcggcggttcgcccgactacaccggtggcatattgcagagaaatgaatgcatttttatggcttttccccgttag

SEQ ID NO: 76942 - DNA, 658 bp, Heterodera glycines
  Genomic contig location: Contig_ID=SeqID_13138; Location=443..1100; Strand=+
  SCN-specific regions: Sequence locations=1-658
  Gene Ontology: Mol. function=biotin binding; Cellular component =mitochondrion; Biological process=biotin metabolism
cgaagattgaccgtgttttggtggcgaatcggggcgaaattgcacttcgaattatgcgcaccagcaagcagatgggaattaaggtcattaactaagtatttttgagatttaagtgtaataataaatagatttttgttaaaaaacccgttaaaattggaatgaatttttaattgagtaaaatttgagtggatttatttttaaaccaccgtttttccctcgttagacaattgcggtttactccgatgcggactccaaatcgctgcacgttcaatttgctgacgaagcgtgccgaattggggaggcgagtgcactgagaagttacctttgcgctgaccgaattgttcaggtgaatttattcgaaatttggatagtcttcgaaaatgacttaaatttgcctttgaaaggcggctctgtctgctggtgccgatgccattcaccctggctacggatttttgagcgaaaatgccaacttcgcggaacaatgcgcagctaacggactcattttcatggggccctcggcggaggcaattcgcgtaatgggaatgaaaaacacggcaaaaaatatcatgacagaggtaaaaacaatgccaattgtatcttatttgaaccataaaattaaacatcaacacggcattttttgccattttagcggaccggg

SEQ ID NO: 76943 - DNA, 2336 bp, Heterodera glycines
  misc_feature (46)..(46): n is a, c, g, or t
  Genomic contig location: Contig_ID=SeqID_13139; Location=1..2336; Strand=+
  SCN-specific regions: Sequence locations=1-1842,1864-1872,1904 -2116,2138-2336
  Gene Ontology: Mol. function=biotin binding; Cellular component =mitochondrion; Biological process=biotin metabolism
cctcgggaattggcgcaggactttgctaatttttgtctgattttcncactttctccatcccaaaggtggaacatccgatcactgaggcgatcaccggattagatttggtccaatggcaatttctggtggcccagggcgaccgtcttccgttaacgcagcagcaaatcgcactgaacggacatgccatggaggtaaaagtgcaaaagggtcggcaataattcactagtttctcggcttttgtacgtcaaattcaatttttaggcgcgaatttatgcggaggacagtgaggcgggatttatgccaaccgcgggtcattgaatggccaaaaagaaaattaaatgaattttcatgtgcgccccgtttaggccatctcgagcaccttttcttcccttcatcgatgccgcatttgcgtgtcgattcgggcgtccgcgagggcgacgagatcagtgtccattatgacccgatggtggccaaagtgatcgcgtggggcgcagaccgatcggaagccatccgacgattggacgaaggactcaggtgaaaggtgccagtgtttaggcacaaattaggacgattattggaatagcttagcccatcgtcgcttttttgctgtgccattccctctcattttgccagacaaactcgcatcggcggactgcgcaacaatgtccgcttcgtccgcgcctgtctcgcccacgagcgcttccgtcttggcgatgtgtacacggactttgtcgcagaacacatcgaccagctgttggcccactgcaaatcgccgactgcggtggcgcgtgggcgggaaagtgttggtggattgcttgttgaggccgcactcgctcaattgttgctgtccagggttcgttgtttatttggatgtttttaaaaaaattgtgtgggagcaacgaggctctattgcagtgcacccgacaaaaaaggacacgaccataaaatatgtcggcaatttttaatgcatcattattttttccagaaacatccaatcttggtatcattcgaatagctctacgaattcttcattagactgcaaaacatcgaaaattttactttgtttcaagaaagttatgaccagaaatttcaaaaattatttttctgaacctttgatcataaatctttaatcttggtgattttttttcaaccttttcgtagaattaatcgaggccccagcatggattagtaaaggattatcaaatggcatggtatttgaggggggcgggaagaaatgacaattaattcataagtgaacataataattggttaatgaaccaacccaacaattagcggttttctcatagcgtggtaattttttgagaattctcctggctatgtctgtcaacaccgccggaccccctcccctaacattttaagaattttgcccaaaaagcgagtgccgatttgcttttcaaattttatttcggcattctttcagttccgttctctctgtgccgccgccccttcgtatccgtttgcgcaccaaagtccgttctacgcctcgcccgcctttttccgcatgaatcattttgcgcgtcgtacactccgattggacgctgaacaaagtgccgaggtggaaattcaacgggacggactctaccgtatcaatttgagggtatcgtagtcagttgaaattgggtatatttcacaaatttgaagtttgctgatgataaccaacaaatgcacaatgtccgagtcggcaccgtacaatatgaaaaaacggcgaccacagggaagccaatggtccgattttcattggaaatggacgaaagaaagcgatgggaatgcaccgccgttttgctcgagagagaactggcggtaatgattatgggacgaggatttagtgcttattttttaactcttgacattttttgtaattaatcgaaaaaagtcccaaaaaagtcctttcgactttttcatactcacctgaaatctttttctttttttccccccagattttcggactggacgagcaccagtggccgaacccgttccttcagcaaactgacgatggcatttccggcgccgtgccattgttggacggagttgccgatgggaaggcacggagtccaattcccgggctggtcgagaaagtttttgtgaaggcggacgacccggtggtcaagggccaacccctcgtggcgatgagttccatgaaaatggaattcatcatccggtaatgggatgggaattgagaacttttcattaaacgactgtcaaaatgggatgcctttagggctccgttcgatggcactgccatttccgtcttttgtacgcccgggcaaaatgtggcaaaggatgtcgtgcttttgctgcttaatgtcgccaaaact

SEQ ID NO: 76944 - DNA, 2061 bp, Heterodera glycines
  Genomic contig location: Contig_ID=SeqID_13140; Location=591..2651; Strand=+
  SCN-specific regions: Sequence locations=1-133,155-172,194-814,836 -1061,1083-1137,1159-1434,1456-1498,1532-1704,1728-2061
  Gene Ontology: Mol. function=Hsp70/Hsc70 protein regulator activity; Cellular component=cytosol; Biological process=protein folding
atgaaaagcaattctaaaactgctgacattggtgatttttacgagatattgggcgttcctcgtaatgcaagtgagcaggaaatcaaaaacgcttaccgaaaattggcactaacttatcatccaggtcggttctattttaatattttctgtaaaattcagataggtatatttattcagacagaaaccctgggaatgagcaaggtattcaaaccacactaatcattttactgaaaaaatacaattaaagcgcaagaacagttcaaaaaagttagcatagcctattctgttctctccgacccaaataaaaggcggcaatacgatgtgtccggaccatcgatggcaatgaatgattttgaaggactcgacatatccgaacttggcggagttggtgagataagctcaatctcactctgttcttaaaaatttatttaggtcgcttttttggcgcaatggttcgctataagtgctaatatacccttttaattgttttcgccagtttaccaaattgggaataccaattcctacccaaattggaccgaaagtgcttgctcaagctcgtgatctctctcgtggcaatgtcacaaacggtcaacaggctaagtaccaaagagagcatttaaaaaaattctttttatgtgttaaggcctctcgagccaggtctggtgctgtccgaaacagtgaacaatcaggaggcaaatttctacgcgtttcagatgactcccgaattccaacaacacggaggtcctttcattattttacactgtagccaatgttttgttcagtgatcattcgatgcaaatcattggcaatgagcaaattcaaattggtccttttcgatcaggaaggtattccgttattttattattacccccttatgaaattgtttaattttgtttttaaggcgcagtccgtcacattcgcgagagtcagaagaaaaagaaatacacttccgctgaacttttctttgtgccgttccaacgaataaacatttccgaattcattccaattcggtaacttaaattttttaatgtgattgaaattttaaatgactactttagtttttacatggaggacaaagacactccgctgccatttcactttctggacactttagaaacccatggttacacattagcctattaaaacaacataaaatttgtctgtttttaggtgctaatgtgatggagcttcagccaggaaagcacatcctttgtgtatacggcgacaatttcttgagaatggtaaattattgggtgtctttttgtagaaatgccatcaaatcagtcaatttgttcctttcattttgcatttgttaggtcagttacgaagtcactttcctcccgctgaatcattacgccagcgcagcaattaacaaaatcaacgcattggagcccgtgttggcatcgaagaaatcggaaatgcaagaattccagaaagagtatatggacttaaagaggaagtgagccaattcggcaatgttaaagaattgtggtccctaatttcttttttattctgggctcagattcagtttcctggggttttcgagggtgctgattacgaatatgaactcggatttgcccaatttcgaaccccggacccgaattcgaacaaaaaattagaaaaaaattttttccaaaaaaaaaagttaaaaccggtcaaattttggcgcaacttgtgtattttacttaattaaacaatttaagcattattttacatcaaaataaatagtgttaaatgaattagaagcttttatccacgaaaaatgtagaccacaattctttagcattgccgccaattcggacaaagattcgtatttcaattgttcttttcttcaggtgggaagcagcgaaagaaaaactgaaaaaagaggaggaagacatcagcagttgcctgaaggcaagggaaaaggcatatgacgagtgagtcccttaaatcatccaatcagctgtaaccgacaaatcattcctactttaaaggttatatgacgcctgttcgaaaccttatcaaagccaggcattaactgcgaaacctagtggattcttatcttcattatttggctag

SEQ ID NO: 76945 - DNA, 789 bp, Heterodera glycines
  Genomic contig location: Contig_ID=SeqID_13140; Location=2861..3649; Strand=-
  SCN-specific regions: Sequence locations=1-160,182-412,434-474,496-789
  Gene Ontology: Cellular component=synaptic vesicle; Biological process=regulation of protein activity, epigenetic
atgcaagacaatttgtcacacataacggaagcaagacaggcggtgaacgcattgcgcgatgagaacgaacgtcagcgacgggaaatgctaagagcggagcacgacagaagacagagtcaattgagacacaaaatggaacacatgcgacaaatgaaacacgtgattatatcatataaaaattaagggttttgaatccaaaaactaaaatgtgttaaaaagaattaatataggaaatgttgctgaatgagcgtcagctagcaattcaacgtttccaaaataatgaacgccaaattatgcagcagcgaatgctggtacaacaaccgcaacaaattcatcagtaccaaatgccacctatggtttcgccctaccctcatcaacagcattatcagcaaattccgaattccatgccaccaaacactgctgttacaatgaatgccattccatctttgccacaaaacatcaccacgcctatgccaccaaatgtaaatgcaataacgtctcaaaatttttgtggccttatcactttaggaaatgttgacgaatgtaaatcttgtgggaattcgagcttttcaaagcaacgaacaccagattatgcaacaacaaatgatgggacagcaaccgcaaatgcatcaataccaaatgccgcatttggcgtcgccctaccctcatcaacagcaaccgcattatcagcaaattccgaattccatgccaccaaacgctatcactgctgatgagcaaaaaaatcaaatgaccggcgtacaggaggacttgttaatcaccttcgattga

SEQ ID NO: 76946 - DNA, 1160 bp, Heterodera glycines
  Genomic contig location: Contig_ID=SeqID_13141; Location=278..1437; Strand=+
  SCN-specific regions: Sequence locations=1-146,168-1160
atgccacacaaccaaaatcaacagcaatttgttgctgctgcgaatccgagatttggcaacttccgagaccgacttttccaggcgatgttggtgagtgggccgtggcgaaagtgcggaagtgtccgctcccttttcaggtccgtctttccctcccttaccatcaaaatgtgccgcgcactgtccgccgtttcttcgaatttatcactttattcaacgtaactttttcgcattggtctgatcaatctgctgaatttgtcctgttgccaggctttcgctttactcgccgtgctcatttatacgcatttccttctcaactctttccccgcccggtgtttggactccgtttacagcgattggccaaggaaaggcatcattcgcttggaggttccgcacatttgggctcatacaatttaggccaaatttttgttacatccatctaatgaatggatctgaattgtgttggttttgggggataatattaattttgtcgaaatgaatgttcgaaattgtgaggcctaactgtaaaagagtccacatttgttaaataattaaccatttttgtgcaggtgattcaaaatttggaggaataccgcgagagattatcgagaaaagaaagcggtgagtgaattccttggcccaattttcatttgccatcattttgtaatggttcattgtatttgttacatccacagaatcggcccattcgtcgcattgtcttttggacatcgccgacattttgagaaacggcggacttccggcggtcctccgcattcagctcggaagtgtgccctcgtcctcatcgcctccgccttcttccgtttcgccgtctctgaaagtgtccaatgacagcaaagccaacggcaacaacattcagcagagccgtgctaggttcggtcgacccttgccgactttgttcgacctgttcctttggttggtcgaccagttcaaccagcagcaatgggaatttgccaagggaacggacggcggagaaacggcgcaatgggcggacgacaaaggtaaaaaaagggtggacgaacgaatgtaaaagcatttcgcttaaatgacaatttttagcacaaaacgaagcggacgattcttccgacggagaagacactcaccagggacagaaactcaaatgttgtcaatttgcaaacaaatga

SEQ ID NO: 76947 - DNA, 1565 bp, Heterodera glycines
  Genomic contig location: Contig_ID=SeqID_13142; Location=29..1593; Strand=-
  SCN-specific regions: Sequence locations=1-3,26-230,253-375,397 -949,971-1343,1365-1379,1401-1421,1444-1565
atgaagaaaagcggaggaaaaagaaggtcaaacttctgttccacgacattcaaacgcttgacgtcagtacgagcgatgtgtacgtttgggtgttcgacccgactccgttgtggaagaaatgtgttggcattctgatcgtcctcggcaccatcggaggctgtctgttcccgctgtggtcattgctaacgaatgtcttttcaattgatcgctttatatgcatttttaggcctgattggttacggcttggcatttattacctttctgtgattgggattgccctctttggacttttgctcggtgtcgcatttggtaatatttccatcattctgatggttaaattctgacttttttcttacattcttccattttagctcgtacaattctttttggcctcgtttggttgttcactctgggccgtcatcgcctttggcttctcccaaatttgctggaggagtgcggctttttcgaaagtttccaaccggcgtacacttatgtaaagcggaatgaaacagtttccttctgattacaatcaattgtttttaaggaatacgtccccggtggagttttcgcgaaaaaggagccgaaaaataaaaagaaaaaaggagtcgaagcgaagaaagacggtcaaaagaaaggcgaggagggacagcaacaacagcagaaggacaacgaaagccgaggggaaaaaacgaccgaagggaagaacgaggacgaaaagacaccgttcttagagcaggaaaagagcgaagagggtgagaaactgaaccaagggctggccatgagataccatggggaaaattgcgtttagccggtccatttcatcaggtcttaagcaccgatttttctgtcacttctttcatttccattctattaatttaaaaaacccttttaagactcagaattcgtttcaccacctccgactgttcctttggctccgttgcccaaagaagaaaataaaactgatgaaacagtccaaatggcagaaaaagcacaaaatgaaggcgaacgcaactgcagcagcagaagtgaaagtcgaagctcatcgaaaaaagacgggacaagcggaagtgaaggagacgacgccgaagaagggacacaaacggggacggacgacagcaactcgtgggaaaaactgtcagaaaacagtcaccggtcgggcgacggtggcaagaagacattgtagaatattgactagggcacgtacagcgtagcggaaaattgtgatcggtgcgaaaacttggcatttataagtaattcaaatttacatattccgaaattcacaactgtcgttatccacataacaattatatctattttcttttattttcgcctgtggcttttgtgttcttccccatgtattaccactaaatgctttgtattttcttttatttcctgtgtttattctattgacctttcctattatggcgcttcaaactgttcaaaattgggtgtgaggaatgcataaattatgtgcttgggtattggaagcgatgacaactcgtacataggcctaaacttgggcttgcttgtgcctatgcaggtgttacttatggcatccgaataaa

SEQ ID NO: 76948 - DNA, 1301 bp, Heterodera glycines
  Genomic contig location: Contig_ID=SeqID_13143; Location=330..1630; Strand=+
  SCN-specific regions: Sequence locations=22-847,869-969,991-1079,1101- 1301
atgaccatctttaaagggaaattccttaacgaaaaagagcttgccatcgtgcctgaaggcggttacgagcggaacgatagggctagcgtcttcgccatcaaatatttggactggcgctccaagcgagacggtgttcgcatacaacacgctggaaatggtctcgaaaagagatggcggcagttcaaacttgatgggtggattgcggagcagaacaagtgcatagaagttctcggctgctactggcacggatgtgagagctgcttcaaacctgacgacgaactggttgacggaaaaacatgccgagaactcaacgatgctaccaaactgcgtttgctaaaactacaggagcctgttccagctgaggatgcttgcggcgaagcagatgaagagggccttgacgtggaagagatttgggagtgtcagatccgtgaacagctcaaaagagatgatgaaatgcgagattttttcgacgacttggggaccgaccgggggcccatcgacccacgtcaaacattctacggaggcagaactgggccgcttcagctgattgcagagccaaaggaggatgagaagatttctgtcttcgatatcgtcagcctctacccgtgggtcaactatgccaccgactacccgaccggaatacccgctgtcatccaccccaccattgaggagatgatcgtcgactggactcgacctgagcatttacaataccaaggaatttatcgtgtgcgggttattcctccaaaagggctcagaattccggttcttccactaaaaatcgacgaacgcctcctgttctgctgctgccatcgttgtgctgccaaatttcggaagttgaacacacgacgagtgcacaagtgcacacacacggatgagcagcgggcttttacaggaaactttacgcatattgagttggcaagagccttggaaactggctaccgagtggacagattctggagagcttggcactacgatgaatggtatgagtttgttagggaatcttaatatttttgaaatttaggagtgacggaatattcaaggactatgtacgtctattgatcaaattaaaggtctgaatatattttttaaagttaaataaagtccaaattgcaggtggaggccagcggttttcctgatggtgccaacactgtggaacaacagcagcagttcgcggacgagtacagaagaatctacagtgtaaacttggagctggaaaatgtgcggagaaatcctgggttgcgcttcatctctaaactgatgctgaacagtctttggttggtatcaaaaatttttatgaaaga

SEQ ID NO: 76949 - DNA, 785 bp, Heterodera glycines
  Genomic contig location: Contig_ID=SeqID_13144; Location=209..993; Strand=+
  SCN-specific regions: Sequence locations=1-425,451-785
cctcatcatggatcataaaattgtaagccaaatttgtaaatgaatttcaattttgtacattgtttaggaagtgtcggctgtcatccctttgtctgacaccgccgtccgtgtcatgtacaagagcaaaaagaatttcgtcagcgaacacacgtctagcaacattgtgataagtctgtggacgaccagccgtgctcgcctcaaactactcgattttatgacacaaatcgatcgaacagagggagccaaactgttatatacggtaaaatgctctaatattgtcaagtacattgacccaacctttaggacaccgacagcgttgctgtgctccataaacgtgacatcgtgcccatccagacaggagaatacttggggcagatgagcgaggagtatctcgactacgagatcaaaacctttgtctgcggaggtaaaaaatttttttttttaatttttgttctaaaagttcaggcgcaaaacaatatggctttcgaatgctgaacaaaaggacaggagaagtggaatacgtacaaaagatccgtggcattacattcgacgtcaacaacagtaaggcgctgcagtttgaacacttcctgcaaaaggtaaaaaattacggacggaacactggtgacgacaacgatgatgcacctgccgtgttttcctacgacaaaataatgccaacacgagacagccgagtcatcacacgtgaactacgcaaaaaatacatgccaatatgtcaaaaaggaataatcaacgagcaatacgaagtctacccatttggatatgaataa

SEQ ID NO: 76950 - DNA, 612 bp, Heterodera glycines
  Genomic contig location: Contig_ID=SeqID_13144; Location=1113..1724; Strand=-
  SCN-specific regions: Sequence locations=1-48,87-612
atgttatccgaagaagaagtacgagggaatagtgtggtaagttttcggaataaaaaaatattaatattttcatttgttttttttaaggagcgaacctctatatgtggaactgaaggacttgaagatttgcccgggagactcgccgctgtgtctgtcacgccattgcgaacaaccgaacagcagcagcatgaacctgatcgtggacgaactggatctgatcaattattggagcgacgacgaacgcgaaaacgagactacaacctggtgagagtgctgtgccggttcaacaactgtggcccataccgactgacgaagcaactacagaaacgacggactgagaaccttgcctatctgagccaattggacattgagactgtccatcttagaaaaaatattaagattattcccgatgctttgtgccccatcggtgcaaatcaggtgtttgcataccgtggattcctaggaatcacggttcagcaacacctttacactcgccatcgtgtcatgttaaagtacccaacccttccatgtgttgttcagtttggtggtggtcatcaccgcgatatttttcccattgaattgttacgtgtctccaaaacagaaaccctttaa

SEQ ID NO: 76951 - DNA, 2067 bp, Heterodera glycines
  Genomic contig location: Contig_ID=SeqID_187; Location=471..2537; Strand=+
  SCN-specific regions: Sequence locations=1-368,390-525,563-625,647 -1370,1394-1726,1762-2067
  Gene Ontology: Mol. function=monovalent inorganic cation transporter activity; Cellular component=late endosome; Biological process =vacuolar acidification
gctgggctcatctacgagttgaacgccatccaatgctttgcgttcggctcaatgatttcggcggttgacccactgatcactttggccatcttccaagcactcaaagtggaggtgcagctgtacatgctcgcctttggcgagtccatgctcaacggttagaattttttttcaattccgagcaactcgaaaactgcataaaaccctcatttgtattggggttttctggaggtcggagcattcaaaaaatataggtgtacgacgttccccctccctcatatcgttcgttaccttcgaaaattaaaaaaagcaaatgagaggtatttcaaaaaatagaaaaaacacttatatgaaaatttcaataataacaatttttaaaattgaataaattgttaggaaaatggggaaggggcgggaactagctattcccaaaaatataccatggaagagaaaaattccatgaccgaatttatatcataactaaaaatagcacggagaatagctgtattccaccgtcccccgctttcgaaaatttaaaaattggaatttaaaaataataaattttgagacatttctaaacacttcatagggtaatacggttgctctcttttggattaagaattcccggtatttcaccatttttaaaggtatcccatttcagacgccgtttccattgttttggccaccactgcgcaagagctgtcctcgcccgacgttgccacgatgagttcgtttgccatggttcagttcgcttttctccgcttcctggtcatgtttttcgcatccgccgccctcggcgcactgatcggactcatttcggcgttggtaatgcataatttttaagtaatatactgaaagtgccttttcccaattccaaacggcattatgtgtattttcactaaattgcttttccatgtttagctgttcaagcacatcgatttacgtcgaacacctcagttggagttggcccttctgttggtgtttgcctatttgccctatggactggcggaggcaatttcgttgtcaggttggcaactttggaatggaaaccatcgattcccagtattcaaaaatggaccacaaactcaaggtggacaagggagtgggctcaatttcgtaaatcgtacggggctccgaggcaatctcgtaaaaaaaattggcctctgagaggggagggcggtattttatctttcgtaaagacaaattccagactctccccaccccttgtccatgtatgcatgccacaaaccctgttcattgcaaaaatcatgttaaacaccatttatttttggtccattttccttataaactctccttggtaattttttttttttgcgatttcctaattcaattcctatgaaattcaacacatccccccttttttcaggcattatggccattctgttctgtgcaattgtcatgtctcagtacacccatttcaacatttcgccaatcacccaaatcacattccaacaaacatttcgcaccatttcatttgttgcaggtcagtgataagatttaaatgatttttttaaatctttgcccttttgtttgtttctatttttttatttggtattttgtattttatttgttcgaaatttggggttttcctctttttgattccgttttttgcactgttttcggaacacataacaattgaatacaataaatactgttttgaatatcctatcacatccattttctgtcctttttttcaattcccaccaaattttcgttcgattttttaaaaaggtttaataattccacaattttttattacaaacacatttggtcaacctttttccccgttctttagagacgtgcacttttgcctatttgggcctctctctgttcgccatcaaattggtgttccatccgatgttcctcattttcagcattgtatttattaccacccacaaaagatgacttttttcaaaaataatcattttctaaggttcttctctttgcaagccgtgcggccagcgttttcccactgtccgacctcgtcaatcggttcagcaagacgaaaatttcgatgaaaaatcagatcatcatttggttcagcggtga

SEQ ID NO: 76952 - DNA, 292 bp, Heterodera glycines
  Genomic contig location: Contig_ID=SeqID_188; Location=552..843; Strand=-
  SCN-specific regions: Sequence locations=1-77,101-207,229-292
atgtgctgtttgctgaagggtggcggaggtaaaatgagaattttttttgattaaaaaaaatgctgagaaatcgattgaaaattaaataatatttattaatcagcaatttatttttgggatggacgagaaattatatactaaaaatatcatatgaattttgcagcaatcgaaaaatatttgttggaaaatgataattcaaaaaatggtcaattaacgaatataaaataaagaattttggggattatgggtgaactataaaatgaaagccccgctttgaaaagggttaaataaa

SEQ ID NO: 76953 - DNA, 58 bp, Heterodera glycines
  Genomic contig location: Contig_ID=SeqID_188; Location=4746..4803; Strand=-
  SCN-specific regions: Sequence locations=1-58
tcaacctctttttgattttgtatggcttcgtaaaaatcatgtaatgtctgtaatagtt

SEQ ID NO: 76954 - DNA, 1075 bp, Heterodera glycines
  Genomic contig location: Contig_ID=SeqID_188; Location=6139..7213; Strand=-
  SCN-specific regions: Sequence locations=1-99,121-636,678-1075
atggcagttttaagaaacgcgccagcacggtttttattctgtgccgtcgtaactatgactcatcgcaggtgacaatcaacagttgagcacatgtttccttcggaaaatatgggtgaaaaatagcgtcgaaaatttatacttgacaaatccttcacccaaatgattgtcagagtatatagcaattaaattcatttaattgctttgtttaattttgagcaatttccagtcgcggcttttctttttcataatgacttataattaattttaccttgtcatattacactcataataaagttaattattgttgaatgcacatgctaattagtaatgttgaagtaaactcataaaaagtaaatttcagctgctttaataaacagcttgggcaattaattatctggttggtattttcacaaagaaataattgaatacaatttgaaaagttcgttcctcctctgagaattggttgccattttgtctctttgccatgatgaatttgacaaattatacggatgtgacggatttaatgcggacaaaatccactggaacaacggacaaacattgtgaacggatacattttgatcacactttttttcatttttgaggttttatataaccggagcatttgggatgggtatgaaataattgtttaatatttatttattattttgaaaattaaagctttgtggtttgcggaaacaagtgacgaattgttgctggcaattaacagttgcatggattgttgagatcggaacgattgtgccaacttttgccatgccatttctcgctttttgtggagcaatggcaataattcggtgtcaaacgggcaaaatgccatggcatggatggcaccaaattatgccggaaacaatgccaacatcagaaacaataacaatgtgcaacagcaatgaagaacagcaaaatgcgattatctttacatttaatgtttctcttttgaaaatggcaccacatttggggacataacgacttttggggatccgaaatttggtgaactgacttttagtaacccgacatttcgggattttaatgatacaggcactaaaaataggcaaataaa

SEQ ID NO: 76955 - DNA, 564 bp, Heterodera glycines
  Genomic contig location: Contig_ID=SeqID_188; Location=8084..8647; Strand=+
  SCN-specific regions: Sequence locations=1-103,128-449,472-536,558-564
atgcataaatcacttattctgactactgttcagaataaaagtatcgtagatgaagtgagaaaagaagtggacgaaatcacaggattagcaagataaaaatgcgaataaaataaaatcaggtttaaagtaaaactgcggtagacggcataaaataaaaatattttcacgtaattcatattttagaaaataggggtgggtgtattatttctcccgaaatccaggacaatttatcagaagctgaagctcaaaaaactcgatgtttccgaagctcgaagccgaagtttcgtccatccctgatccccctacgccctcctcgattttggcgtcttcagtgcagaatctgatcagaaagaattctttaattgctttgtttaaattttgagcaatttccagtcgcggcgttactttttctaatgacatttaacaaatattacattgccgaaggcatttaattattgtttaatgcacatttgaatgccaatgttgacgtaaacacataataattatgttttcagctgatttaataagtacccaggggaattgtttggtaggaattttgtccaa

SEQ ID NO: 76956 - DNA, 283 bp, Heterodera glycines
  Genomic contig location: Contig_ID=SeqID_188; Location=9107..9389; Strand=+
  SCN-specific regions: Sequence locations=1-99,148-283
atgaatgcgttggaaaccgggattcttggcatcattggtgccgtttattgtgattatccattgctgatttatacaaccggatcaatgggtctttgtatgtttattttttattaaacagtatttttttaaattattattttaaattttggttcagccttatggtttgctgaaacagctgccgaatttttgctggcaattaaccggtgcttggaattgctgaaaccagaactggcatacgtcattttcaatggtattttctcattgcattattaattagtgaaaa

SEQ ID NO: 76957 - DNA, 96 bp, Heterodera glycines
  Genomic contig location: Contig_ID=SeqID_188; Location=9514..9609; Strand=+
  SCN-specific regions: Sequence locations=1-96
atggccatgttcacgaagccaattctgttcagtgggctaaatttggcatggtttttcaacccatatgttggctacacggacgattttggaaaaatt

SEQ ID NO: 76958 - DNA, 91 bp, Heterodera glycines
  Genomic contig location: Contig_ID=SeqID_1945; Location=810..900; Strand=-
  SCN-specific regions: Sequence locations=1-91
aacccgtgcggaaatatacgtgcaaggaagtcttctgctcgcctttgcagcctctgtacggcactggggccaacactttatgtgtcgttaa

SEQ ID NO: 76959 - DNA, 86 bp, Heterodera glycines
  Genomic contig location: Contig_ID=SeqID_1946; Location=992..1077; Strand=-
  SCN-specific regions: Sequence locations=1-86
aacccgtgcggaaatataaaagcaaggaagtcttctgctcgcctttgcagcctctgtacggcactggggccaacactttatgtgtc

SEQ ID NO: 76960 - DNA, 211 bp, Heterodera glycines
  misc_feature (187)..(187): n is a, c, g, or t
  Genomic contig location: Contig_ID=SeqID_1947; Location=25..235; Strand=-
  SCN-specific regions: Sequence locations=1-211
aacccgtgcggaaatatacgtgcaaggaagtcttctgctcacctttgcagcctctgtacggcactggggccaacactttatgtgtcgttcattttatgctaattctggctcttttctaagaacccgtgcggaaatatacagtgcaggaagtcttctgctcgcctttgcagcctctgtaccgcactgnggccaacactttatgtgtcgttaa

SEQ ID NO: 76961 - DNA, 206 bp, Heterodera glycines
  Genomic contig location: Contig_ID=SeqID_13148; Location=330..535; Strand=-
  SCN-specific regions: Sequence locations=1-184
ggggagaaggacaaaagtagaggatgaagatgagaagagatggatgagctacagattctaaagtgcaaaattgggtaacaaatttaggcgaataaaactgatttgtgagtggctttagaggagggaggaaaggctcttttaaggggaaaaaggaacacaaaaaaaaaacagaggggagagaaacatggaaaaaagaaagagaaaag

SEQ ID NO: 76962 - DNA, 2105 bp, Heterodera glycines
  Genomic contig location: Contig_ID=SeqID_13149; Location=169..2273; Strand=+
  SCN-specific regions: Sequence locations=1-329,372-673,820-842,1032 -1050,1116-1137,1315-1320,1452-1730,1812-1817,1895-2005,2065-2105
  Gene Ontology: Mol. function=cytoskeletal protein binding; Cellular component=cell-cell adherens junction; Biological process =intercellular junction assembly and/or maintenance
atggaggaactgttggaaatgtacggagtgcggaagagtggcgaaacggtggcggaagagggagtgccatcggtgaaaaactcatgggcatcgacgtatttgcgggaacggaaggcaaatgcacaacaacagcagcaaaagacagggacaaataatgagaaaggagggaaaagccgaacagcccaaaattgggaggagggcaaagagagggaaaagcaggagacgaacacgggcaacgaggacaagcagttcagagaggtgagagggacatagacaaacccatgggacgagcagagggcatgaagaaaaggcaattgccctttttaggcccccggaattgcttttccgactttttagggctttgacttcttctggtgatgaccccaactaattagaaaaaatcccttcgatttcagcgccttctgaacgcacatcaaacggtggacgaactgctgaagaaacgcggcattggcgacttaaagaaggagagggaaatgctgctgagacagtacgaggcactgctggcagcagcggacgaagaattggagacggaatgggcacggatgagaaagaggggcggaggagcggcggggaacggacggagagactcatccgactcgggactttctgaggattattcagaacgagaaaaggcaccgacggaagggaaaatggaagaggaggaaaagatagatgaggaggaggaggaagagcaagagaaagaagaggaagaggaggaggaggaggatgagaacgagaaggaagaggaagaagtgaaggaagaagagaaagaagaggaggaaagggaagaggaagaggtgagaattgaagaaaaattgcacaaaaaagaagaaacagaaaaagtgaagagacaagtgaagtgccaccagagaataaaagaaaagtgtgagcagaagatcaaagagagtgaagagagaaaggtggaagtaacgctgaaattgagagagaaaaaagaaaaggaagcgaaagcagagaaaatagtaacagagaagagaagaatgaggaaagaacacagcataaagaatgagggaaaagaagaggcaaagataaaagatgaagagaaaaaaagagaggaagagaagaaaagagaggaagaagtgaggaaaaaggaagatgaagagaggaagaggaaggaagaagaaaagaagagaaaagaagaagaggcaaagagaaaggaagagaatagaaaggtagaagagagaaagaggaaggaagagaaagaaaagaaagaaaagaaagaagaagaaaagaagagaaaagaagaagaggcaaagagaaaggaagagaacagaagggtagaagagagaaaaagagatgaagagaagaaaagagaggaagagcacaaaagagaggaagaagtgatgaaaaaggaagatgaagagagaaagaggaaggaagagaaagaagggaaggaagaagaaaagcaaagaggcgatgaagagagaaagaggaaggaagaagaggcaaagacaaaggaagagaaaaagccaaaagaaaaagctcaatcaagcagaaaaatggcaaatgtgtcgcttcagcattgcagtttctcattaggaaaagaaagtggagaaaaagagaaaggacagaaggagggagaaaagagtgtgagagcacattttcgactgacaatgccaacggaagagaaaaaaacaactaaaaagacaatacaagtgaggaagcaaaagagtggggcagagagaacgatgaaagagaggaaaggaagagaaagggaggaaaagaaaatggaagagaataaggaagaaagagagacggacagagaagaaaagggagtcaaagaaagggaggaagagaatgaggaaggcagagagacggacagagaagaaaagcaagtcaaagagaaggtgaaggaacagctgacacggaaaaagccggccaaagaagcacaagaagttcgagagctgcttcaaagtttgcggggaaatctgcgacgaacggaaaagcctaagagacaattcccagtagagaagcagagcaagacgacgagagagaaggggaaaaggacacagagggagagagagacaatggagaagggtgtgcaagcagagaagcagaggacgaga

SEQ ID NO: 76963 - DNA, 372 bp, Heterodera glycines
  Genomic contig location: Contig_ID=SeqID_13151; Location=124..495; Strand=-
  SCN-specific regions: Sequence locations=1-372
atgactagggatggtaaaaatatggatataaaatcgcaaaatatggccataaaatatggactaaaatcgcgaaatatggacataaatggtaaaaatctcaaaatatggatataaattttcaaaagtgagtgtaacatttcttcaaatttattggttgaaattgcatttaaattttcaaaattccttctaattcgctaaaatattgtaaaacttacaaaaaaatggctaaatatggtattaaaaccattttagaagaaaaaaacatgatacaactaaaatttactcacttttagcgaaaaatcaacccaaaaagcgaaattttggcttttttgcttatttttgacataaacttaccaatttttgaaaaataaa

SEQ ID NO: 76964 - DNA, 275 bp, Heterodera glycines
  Genomic contig location: Contig_ID=SeqID_13151; Location=1481..1755; Strand=-
  SCN-specific regions: Sequence locations=1-275
atggcgacaaataacactgcaaaaatcaaaaaatttggaaaaaacgaccggattcgttgtttcaatattgctatttggcgtgatgtctgtgagaatataatgatgcgaggcctcagaaaaaaattcggacaacagggaatgctcaagcaaatgctcataaaaactggttcaaaaactttggttgaaagttccccgcatgatgtattttgggttagccgacatttgcggaccgacatttgcggaccactatttctcgatagaactgtctaaataaa

SEQ ID NO: 76965 - DNA, 532 bp, Heterodera glycines
  Genomic contig location: Contig_ID=SeqID_13152; Location=1071..1602; Strand=+
  SCN-specific regions: Sequence locations=1-182,204-451,482-532
atgaggtttgttgcttgccaaataacgtttttcaaattttaatctggctgccctgtttaaaaccctaattataatttagagaaagtttcaattacggctacaacgacttacaatctattttcggcaaaatccaacagaaaatcccaaacataattggccctcaacgctttttcaatgccatgtttatccataatcaaaacttttggaccagcgagtgtacgattcaacttggggttgcctatattccaatcggatcaatgccgccattcaatttcgtggagttttatttttccgacccacaaccctggttttttaatttccgctatcgtctgtatcttattctatgtatgctttgttttgtttaattttgttaaattttttctttagaacttggcgtcaagcaattatgaggaacgaaagtggaaaaagacgaatgctttggtcccgattttttcctatgttaaagaaaaaagatatattttggtccgtccagagtttttaattttcgtatgttaaagaaaacattcactga

SEQ ID NO: 76966 - DNA, 1846 bp, Heterodera glycines
  Genomic contig location: Contig_ID=SeqID_13153; Location=2917..4762; Strand=-
  SCN-specific regions: Sequence locations=1-269,313-335,368-604,659 -1051,1073-1122,1153-1452,1478-1551,1573-1696,1719-1821,1843-1846
atgttgcgtcccgcccatgccaacaatgagcagcaacaatcgctttgtgcccaactgcccaccaatgtttggtgcactccgtccgccatcggtcgcatggccaccattttgcgccaaatgcacgcggtggtcagcgaggaaatgggccgggaattgatgggacggcaacggttgatggaccatctgtgcctggtccatggctacttcttcatgttgcgcggcgattttgcctccgcacttgagcacatcctcttgtaagacaaggcatcaaaaaaaaaaatttaatttgaaaaaaaaaaatttttttttttaggttcacctcgaaaacattaaacaaaaatttttttttgtaaattaaaaaaattatgtaccccacaccagtgatgccaacccgaggtttttctcaacccgaaacccgaacccgaaattttttgagtgcccgacccgaaacccgaaatttttctcaacccgcggcatcactgccccacacagctataatgtgctttttcaagcaaacaaattctgtttttcaatgcctttttctttgagttatacgggtgctaaacaattttttcaccgtcaaaagcacggactctccgatggcttaatttttttttgtttgaaaaaaattttccaaattttttaaaattaattttaactgttaaaggaaatttgtttcctcgaaaaaagcaaatatcatattattgataaaattcttaaaatgttgatttgggcaacacattaatccaagatttaaaattcattttttttttgcagtatcaaaaccgccaaaacgaccgcaaccaaaaagtgtgccacgccattttcgtcgcgcaaaaatgtgtcccattcgacaaaaattgcggaaaaatgtgtgaacgacgcgttggcaatgtgctcaccgcccgcaaatgtggcgaatctgatgcacttgttgtgcggcgtcaaactgaccaaacgcgagcaaatgaagtgcaaaattttctccgaaaaattcatgctcaaaagtcgacttcgggaaggccaacgaaacggtaagtttttgaaaaacaaccttttaagttaattttctggaaaaaacgcttctatgaagccaaaagtgttttaaaaatacctaacatgaaataaaattcaaaaaaattttttttttttgttttgacaaatttaaaaacctaacgaacaatttgttttactaggaatttagggggttgagcggttttttttctttaattattatttttgccttatttcaacagaattccaagcggttgctgaatttttctccaccaatgcgctccgggcgtacaagcgcgtgttcggctttgtgtccaacctgcagttgcagcgggctcagttggactacacgggacagaatttgttacgcgttgtgcgccagcggttggccacacggagcggtgcgttttggtgcacagtccccctccccctcgaatcaaaaaaaaaatttttttttttaaatctgagattttttgaaacttttgtagaaaaacatagatagttttgtcaccatgaaattttgaaaaaatcgctaacaaattttcaatttaaatttttctaggtttttatttgaaaagtactaattgtaaatttgatttaaaaaaacttcggggggggggaggtcgtccggcgcgtagtggagaaggacaggaataaaatttttataaagcaaactggcatattttaactaaattttttatttgttacagaatatcgttcatctttctactcgatgctcatcattttgcagaaagtccgaatgtttctcaaccgattggcccattatgtgtttgaagaggtacaaacaaattcaaattaattaaacaataaa

SEQ ID NO: 76967 - DNA, 581 bp, Heterodera glycines
  Genomic contig location: Contig_ID=SeqID_13155; Location=557..1137; Strand=-
  SCN-specific regions: Sequence locations=1-3,105-449,471-560
atggaagagaaaacggcagcgaaggaaaatggagagaaaagaaaagacgaaatagaaagagaaggaaatggtggaagagaagcagagaatgtgaagagaagaaactgttgtctgttctgatgatgctcaaaggaagttggcaccggtccaagtcccctcatcagtgctttgagaaaacacacacagagagcgataaaacataaattaacgtgggtgggcgagaaggacagtgatggtgaaggggccattattggagaagccggtcataagaagacgaaaggggggctaattatttggaggggagggggcggacgaagcatggaaaagcaaagcaaagacatgcgaaaagagtgtttttcccgttttgaaggcgcaccccattttaaaaaatcattttgttaagaaatagtccaaaagtgaaaatatataatatgtatacagtcattttctgcaaaaataattatgttctctggaagaaataaaatgctctacaatatgcaaaagattacaagtctctacgacttatacccgctgaggtatgggcacttcaatttcgtgaaaatttattgaaaaatattaaa

SEQ ID NO: 76968 - DNA, 574 bp, Heterodera glycines
  Genomic contig location: Contig_ID=SeqID_13156; Location=608..1181; Strand=-
  SCN-specific regions: Sequence locations=1-18,44-106,255-384,408 -459,481-574
atgaaactgtgcatattattctttttaattgcatttttaattgctctaattgaaattggagcggaaaagaaaaagtttgagcaaaacacatttgacgaaatatttggagaaaaatgggaagaaaaagaagaaaagggaaatgatcaaaatgaaaatgatcaaaaaaagagagaaattattgaaaaattcaataaaattaaggagaaaatcaaacaaaaaggaagaaaatattcgagaaaagaatggaagagaaattatgccgaaattgtgaagaaaattagagttggccaagtagtaattaagagatggaagaaacaatttggaatgggtgaaggaatgacggagaaagaaaaaatggaaaaagtgaaaatttatttgcaaatgaaaggacaaaacccaaaaatgagtgacgagaaaattgcaaaatattgaaaattaatcaacgaaccgtttttatttggaagaaacaatttggagaagtaattaagaagaactgaaaattaaagagatattctttgatcgcctttttcttacgatatttgttgatttgctttttgtactttttgaaaataaa

SEQ ID NO: 76969 - DNA, 1935 bp, Heterodera glycines
  Genomic contig location: Contig_ID=SeqID_13158; Location=95..2029; Strand=-
  SCN-specific regions: Sequence locations=1-102,127-312,338-433,480 -1002,1039-1128,1150-1744,1784-1935
atggcttcatgcaaatcacccattagccttctcagcgtgcttctgatcatgctgctgatcgatccatgcttcaactactatttctttaatcccgcttgttcgtttttttaaattaaatttttataacggttcacaaattaattttgcacaaaatttcagcggatgattgtgttgtggccattcgtaatcgtactcagattccacctggggtcagtcagtctgtttaagtttagtgccatttcatgccctaggtttttggtgttttgtcgttactcaaagccatcaaaatgggcgttacctcataaatcaaccaaaaaaaaaaaaaaattatttattacgtggctcaaaagtaaacaaatttttttcccgagactcgatcccgagaccgaaaaacccgagactcgagacccaaaaaactcgagacccaagacttctttttaaaaattttcttattagcttaaaaaccgtttaaaatttttgacaagtgcaatttgtgcacatagcagattgattgaaggctcataaaaatttcttaatctgaaatccaaacgtctaaaaataaattttctaaaacagtatttgctcctaaacaatacacattaatagcttttgtataaacaattgagtatgcttttaccttggcaacaattcgtgccaaaaattaaaagtaaattgtcttccaacacattgtgccataacatgttgttttgaagcacttggcaaatttttcaattcagcttgattcgtacgtggatcttgctgtgcgctatgatcagcgtgaagcagcccaaaaggcgaacgttttccgcaacacttttacagctgattgtgtgcccgggggcgaattgggccatatttggggcggcttttatggttgcctgacattcacttgcactgacggtcagcaaatttgcttctctattcctatattaaagttttgtttaaatcttgagtttttttaattgaaaattacagtttttgaaaattcaatgcaaaatttggaatttatgataaaattttcaattaaattaaaaaatagctaggaggatcagaatttggtgggggtgggggtcaaaaagattatcgggtttaaatatcctgattttgccgttaaaaaattatgaccctgtcatcccattccagtacccaactcaggcatgatcctgagaaaatccgggcaatatcctgagaaatttcatttatttttccgaataaaaaatttgaatgccatattttccaattgcttggattgtgccggtgctgaaaaacaatataaaattaactttttcatcttatttacagagcatggtaaagacctttttcgcattaatggatgcgctacagaaaatgacaagcagtgcccgaaatttttcaacacattctgccgtgaatcgggtgggaattcgtcggactgtcgccattgtgacgagttggtcgacggcaaagtgtgcaacagctttgatcagttgatcaaccttgatcagtctgaggagcagatgaacagcaatttgaagtcgcacagtcatcacagtaacagctccagcaaagccgagaagcttggcccggcttccgccttcacttggatcagcagcaatttgttgctgctttttggtaatggggaaaaaatgaaatatttcgtaaacccaaattacctaaagtacgaaaataaaaaaattaaggtgttttcaatttagaaagtagtaaattaggtgtaaaaaagcgaaaaaaggaattaattgtacactaaatattaaaattataaaaataattaaatatatatattcaattgttgctgcttttggcaataataaaaaatgaaacatttcgtaaaaaaaggatagaattttcaggaattgaaattattattaccaaggcactaattaaatagtgttttcattcacttttttaaatttggactttttgcatgcgaataaa

SEQ ID NO: 76970 - DNA, 99 bp, Heterodera glycines
  Genomic contig location: Contig_ID=SeqID_13159; Location=1..99; Strand=-
  SCN-specific regions: Sequence locations=1-99
agtcaacatccaccgatattgagcttcaacatcatcgccatgtggcagtgcccgcctccaaattgacgccgtccccgtcgaccaccaccgcaacggcaa

SEQ ID NO: 76971 - DNA, 538 bp, Heterodera glycines
  Genomic contig location: Contig_ID=SeqID_13159; Location=202..739; Strand=-
  SCN-specific regions: Sequence locations=1-43,141-142,172-176,266 -266,464-493,529-538
gttcttcttcagcagtccgttcactacggggcagagacaatgcgtcacttccgcctgcttttgttgctgttggtgccaatgacaataatgttcagcgtcattctgctgataattgtgattttttaaatataaattgatttcgattttgtggggataaattttggttattatcaaacaatttttttaacttttcattttttaaaaatttatatacaaaaaaagaataataccaaaattttcaaaataataacatttttaaatttaagcttctcaaaggcaacccaaagctgacagttgtccgcccgcaattccttcttccaataacccaaatgggcggcctccgaagaaatgaatgaattaaaaatttgcctgcagcattatgttttgaaatgtaaattttttaaaattttcttttcatcgaatgtcatataacacacttacacatcatattggtattcttctcgttttgttgttttgtttttaaaaaatttttatgtacatgcccaaaaattggtgttctaaaactttcacttttttt

SEQ ID NO: 76972 - DNA, 1342 bp, Heterodera glycines
  Genomic contig location: Contig_ID=SeqID_13160; Location=204..1545; Strand=-
  SCN-specific regions: Sequence locations=1-244,266-382,404-655,677 -785,808-1342
  Gene Ontology: Mol. function=NAD-dependent histone deacetylase activity; Cellular component=cytoplasm; Biological process=histone deacetylation
caagttgccctctgtaatcggtgtgtgacgggtgtgctgaagccggacattgtgttcttcggcgaggatttgggtggcgcgtttcatgaccaaatgggcgccgaccacactcaattggacttgttggtcgtcatcggctcgtccatgcaggtaaacaaagcaaattggaaagatgttcttgtgaaattaaattaaactttaaaaaaattcggagacggtgacaccaacaaataatattttcatgaatttcaaatatttagaaaataattttaccttgctggaattgaacctggaccgaaattttctgtaaatcgaattgcgtttgctaatcaaatttaacgctcttaccatcccaaagaaaattttaaggttttcatacggtttttaaaatttacgcaaaaaagagatattctcctcgtcgattcgattttcggaatcaaaaaattgctttaggtgcgtcccgtctcactgattccgttcaacattgccggcgatgtgccacaaattttgataaatcgccaaatgttgcgcaactatactgccgacatcaaactgttgggcagctgtgacccgattttggtgcaaattgcgctggcaatgggcggacaaatgcgccaaaaaatgcttgacggtacgacgttccattggcacgttggggggagggcattttttggttacatattttgttgtttaaataatttgaaaaaaagtatattccaaaaattgagaaatagagagatggaaatttgttacattaccgggtgtatgaaaccttcgaataattaaagataattcttttatatttttggattttgaattttggcccgtaaacatttaatttgtaagaatcaacccatttggtccagtttccagaactacaattgcgacggggtgtgaagcattcgggcggagtgccgccgttgccaagcgatctgttggcacgtgctgaccaacttttgttgtctcgaaaaacgtcaactgcggcagtggcacaaataagcaattcaaacggtgccaaaatggaggaaaatggtgaagaagaaacggcggcgacggagaaggcttcatcctttccacgccaaatgacggtggaccaattcaagcagtacatcaacaccacggataacaacacgggagaccaaggggatgacatggaggagttgacggaaacggcacgaaagcggtgcaaaatgatgccgatacgggaggatgaggaggagggcacagtgcctgaaatggaaactcaaactattgttcggcaacaaagcaaacgccaacaaagcctttggcagtccaattacgcacgcgtcgacgcgcatttgccgtccactgacacactgct

SEQ ID NO: 76973 - DNA, 64 bp, Heterodera glycines
  Genomic contig location: Contig_ID=SeqID_13161; Location=644..707; Strand=+
  SCN-specific regions: Sequence locations=1-64
atgtctggacgtggaaagggtggcaaagcgaagaccggaggaaaggccaagtcgcgctcttccc

SEQ ID NO: 76974 - DNA, 572 bp, Heterodera glycines
  Genomic contig location: Contig_ID=SeqID_1948; Location=667..1238; Strand=-
  SCN-specific regions: Sequence locations=1-572
atggcgccagacccaggggtagtggaagagacccattcaaagcacgcagtgccagggcaagacatcacacgggcaacaaaagaaaggaggccgcagggactgctgcaaacgtgggtttttattctgcagctgtgctaggcgtccctcaattgttttttcgtttcactttttggcacttttccagacagagcgaaggcagaaatttcatttctccccttttcaggtgcaagctgccaacaggcgccccatttgtctgatctgcttgaagaaaatgacccaagtccgtcaggtgcgcaccatctgtgaccacgtgttccactacgtctgcctccaccgttggctcaaatatcgcctgttttgccccgtctgtctgctcaactttcgcacggaattgtatcattcgggaaacgccgtgtttgagggcgcgtacaacgatggacacgttgtgctcatacctgatggtgaacaaagcaacagtggctaagtgatcggcactaatctccaattgtgatcggaccaaaatggattatttaattgtgtcttgtacataaataggttattaggacaataaa

SEQ ID NO: 76975 - DNA, 709 bp, Heterodera glycines
  Genomic contig location: Contig_ID=SeqID_1949; Location=792..1500; Strand=+
  SCN-specific regions: Sequence locations=1-584,606-709
  Gene Ontology: Mol. function=ubiquitin conjugating enzyme activity; Cellular component=proteasome complex (sensu Eukarya); Biological process=chromosome organization and biogenesis (sensu Eukarya)
atggatgacggcaaagacttgtaccattggagggcctccatcaaaggaccgcccgagtcgccgtacgaaggaggcacctttcatttggacatcgttttgcgccgcgactacccatgcactccgccaattgtcaaattcgtcacagacatttaccatccgaacgttggagaaaggggcgacatttgtttggacattctgaagcagatgtgggctccggcgttgaccatttcgaaaggtgaaagagtggacaaaacgccgacaaaatatcgacaaaacaaaacaaccgccataaccagactttttggaaaagtgtcgatattttgtcgtgtgaaatgggatttttcaaattcggtagtgccgttttaatctttacccccccccccccccatttcagtgctgctctccatctcttcgcttctctgtgacccgaatccggactgtgcgctgcggcaggacattgcgactatgtaccgcgacaaccgagaggagtacaaccgaaatgcccgtgaatggacgaggaagtacgcgatgacatgacacgacaaacgaccgatggatgggagaggatgcagaagacaaccgccgaagaggaaggaggaggaggacacattcagcttaccctattcccattcactattatcaatgtgttgtatctctgtgttatcatttcaaacgatttgtgattaattgttgcgcctaatgtgtgtaa

SEQ ID NO: 76976 - DNA, 372 bp, Heterodera glycines
  Genomic contig location: Contig_ID=SeqID_1949; Location=2297..2668; Strand=-
  SCN-specific regions: Sequence locations=1-372
atgctgccagcggcaccgcttgacaacaacaacggcacgtcgtcccaaacgattggcgaccgcattggtcttgatgatgccatcatgcgtttggccgaagcggagaagaacgatggactcgaatggtgcgcgacaccattctgccgaccgactcccgcattgacaaagcgttcgatgcgttcgaaaatgccatcggcggacttcggcatgccgtcactgactgatgtgctgacgggcacatttgagtttgtgcagaaaacatcggaacggcacagtatcgcccttcgatgcatccagcaacagattgaggaccagcagaagcagttggacagcgaaaaagccaatgattcaattgccgtaaaaatgaattaa

SEQ ID NO: 76977 - DNA, 414 bp, Heterodera glycines
  Genomic contig location: Contig_ID=SeqID_1949; Location=2722..3135; Strand=-
  SCN-specific regions: Sequence locations=1-104,131-335,357-414
atgaacagtctctccaaaacgccattaaacaattccatttttattaaatttccacaatggcacactctgctcgctccaaccgaatgtcggctcgaagacgacgtgttagcagcagcagcaccagcagtgccgctcgtcgaacgatggcgaccagtccagtccaccgccgacctcgtgctgctccgtcgtcgcgcagttgtgccaacccgcatcgctgccccaacaccatggcccgcgccggcaggctggcggatcggaccgcgaccaacagtaacagggccaacacccgtgccggaacacgaagaacagcagaagctgcggcacacggtaaccaccctgctgatgatggtcatggtccagcaattgccaaacgagccaaaacagatgcaagaagcacatgagttgtgccactga

SEQ ID NO: 76978 - DNA, 752 bp, Heterodera glycines
  Genomic contig location: Contig_ID=SeqID_1951; Location=458..1209; Strand=-
  SCN-specific regions: Sequence locations=1-286,343-399,449-500,523 -578,619-707,735-752
atgccgagaggagtcgattggtatctattttgtcgcaattcatgcgttttcagtaattggacggttcagtcccaaaggcatatggccatttcagtcccgggtcggtaactcttcagagattggttgccgcaaaaaaattctttcggataaatcctgaattatgggggtgtattttacaaaatttttcgttcattctttgcggtaattagcacacttttcccttcttccaattgaatggtgtcactaccgggccgcccggtaaaacggactttttagaaattccttcaaaaaaatttataaaatttttattcaaagaaaatttcaagaaaaataaaataaaaagattttctgggaaaatttaaaaaataatcataagctttctaaaaaatcgatgaaagctttttaaaaatttttctagaaataaaaaaaaattgtttttttttaatttcggcgggggcgggaacaaactgttgcttccaaataaatccatcgaggagagttgaagaaacagagcccccggtgaagttaatttgaaattgatttgaaatgtttaagttttctctgattttataaaaggcattaaaaattgtttaaaaattttaattttaaaatatttttgctgcttttttcagcaaataatttgtctaatcattcgtattaagtgatcagcaacttttctgctgcgattgggacactaaaaatggaaatgagataaatattttaaaaatcaaaaatgtagtcaagtaaataaa

SEQ ID NO: 76979 - DNA, 1415 bp, Heterodera glycines
  Genomic contig location: Contig_ID=SeqID_1951; Location=2122..3536; Strand=+
  SCN-specific regions: Sequence locations=1-330,352-1095,1117 -1140,1176-1326,1348-1415
atggcattgctttcttatcgttttgatgttttggtggacaaatattttggtggaaaaagcgaattgacaatttggaatgcgatgacaattttcgactgcattggatctctggaagtatatgtacggattgatggcaaatttgtgcattttccgttgccgggccgtcccctgcccaataaaattcgttttcgttcccttcactttgggtaatttgaaagtttgtatatattagcattttcatatttcttcaggtacattgaccattccgtgatcacttttttccgttccaacaaacaaatttttgacagaattggcatcgaattggaattgtttattaattttattaaaaatgtccagccaatttgggatgtttttgtgtgtgaaatttggccaatttttgcaacaaacattcgccatttgcgccttggccgtagttataatttggacaatttgcgtcgccgcacttcgccgacaatcttcactgatcttgatcaattgaatccaatcgattccgttgatctgttacccgatgtgttcgctgatgatgggccaaatgcaactgctggccaagcgttggccaaatggttgcacactccaagcactgatggtcagtcgaagcgcttgttatgccgtaattattcattaaatttcgaatggctcaacaatttcatagaggtgatccgccatattttcgttaatttgtttttctcaattttgttcagacatttctccgtgccaccacttctgtcagttacaaaattcgaaatgatatgtcttcgtcaacaaggccaattgagccatttgaattggtgaacgaacggaccaaagagaagttgacactgacgaacgatggatttggttggctgttgaaacggtgcccaattattgtggagatggcggcgcagaaatatgaaatttttggctattggaaccgagtcatcttccgtctgtgaaaattacattgggtgagcagaaggatgcttttgtatagagcacggacagggggacagtatcccctgtacagtactttcccagaatcttggtcctcttgtacgttttggaaacgacaaggaatccagttaaaacaggacttcagtccttgtcttgtccctcctgtcctgctggtccatcggaaaccatggtcttggttccagttttttccaaaattctccaggctctatttttacaaaaagattgttcatccaattcaaattgtgcttaatttaggcctttgtctccgccaacagaccaaagcgacgaaaaagtgttctcttttcccgggcccagtgatcagcggaagaagaagtgatcatttgacaaatgaccgatcatttttgcgttatgatttggaatttggataaatattgtttatctgacgtctcaaaatttcataactaattcttaccccaattcaa

SEQ ID NO: 76980 - DNA, 491 bp, Heterodera glycines
  Genomic contig location: Contig_ID=SeqID_1951; Location=4695..5185; Strand=+
  SCN-specific regions: Sequence locations=1-491
atgtccctcttctcctctcagttatgccgaggggcactgtgccagctccgttctcagctggcccagcttggttatctgatcgatttgacaaccgaagaaatttattttttggctggagatgcagccaccgttgggccctcatcgactggtgccggtacaacactttaatcccgacatatgccgtgccaagtgcacaaaagcgtgtttttggcactatcacaaccactgacgctgaagttgcagcaatggcggcacaacaacaaaaaggcgaaaaacctccagcggcacgttgcgcattgtgccggttcctgctatacaaccagaaaaacaacagctcgttgctgctgatcaataaggccgccgtgccattggcgcaatgctccgaccactggtcaaattggtatgaaattggctgtggttggataataaatgtccaaatggatttgaatgattcccatacaaaaaatggtgcttggtcattcattccataa

SEQ ID NO: 76981 - DNA, 1290 bp, Heterodera glycines
  Genomic contig location: Contig_ID=SeqID_13162; Location=415..1704; Strand=+
  SCN-specific regions: Sequence locations=1-55,84-494,518-588,641 -695,767-863,885-925,947-1175,1198-1290
atgtcagacaaccgaaaagaaggagaagaaaaaatggcaaaagccatgtaaaagctaaaatttcaattttaaattttatttttcctttttcagcttaatctctgccgattgtttgttcaaagtgttcaatttgcttccgcctactcaacttggcctcggaattgcactgattagccaccgatttgactgtggacgaacatttcaaatcgcgcaaatgggcgctaaaatttattcgaattctaagcgaaattggacagaatggcgcaaaaaaagggaatggaaattgtcaatcgctttgacaatttcgcaagcgacgccaagacgctatctgttcgtccaggcgctacgcgcgatttccgaaaagttcgaaaaaaagttagcatatctcagcgcaaaggtgatgcaatttaagatgcaaagacaaaaagttcttaaacgagatcagttgtcgaccaaaaaaaaaaatttcctcgccatcaaacaatatatttcaaatttggtgcagttcattcttttttaaaattgtttctaaattcatttttaatttattatagtctttatagaccatatggttgaagtgtaaataaaaattaattaattaagcaataaagtaaaaaattaattacttaataattagttacatagtagttaataatttgttttttttatctttttcgcatttttaatgtgatcagtaaaattgaaattttaattaataaggaaaaatttattttatcattattttacttaataacaatattttattcatggataagatttattcacaaatgtagaatttctttgttgctataaacaaaacctagaaaataggcactaactaataggtaactcgaaaatagctcaaaaacaaccaaaaaacatgtttttcgtgcgtttcatgtcactgggagagctcggtattttgaaaaaacctggacctggatttcctggacaaaaaccaggaaaatccaagtccagctaaaacccaggtagccaaaaaatgaaatggacctggacccaggaaaaattcaatcataaatccaggtccaggccaagctctagttattaacaacggcgccgaactggacggttccccagaaggtgcccaaagagcttttttttactcaagggtcaaaaaattattttttttctctattaatatttttcaaattgcagagctggggcgaaaaagcaggaatttgtacaggtcttacgcaaaaaaataaccattttatgcataatcccccatgggggataattagagaaaacaccgctaaacacccgatgtaa

SEQ ID NO: 76982 - DNA, 785 bp, Heterodera glycines
  Genomic contig location: Contig_ID=SeqID_13163; Location=526..1310; Strand=-
  SCN-specific regions: Sequence locations=1-291,334-497,536-785
atgagctttcacttcccaatctttgtatttttttctgccattatgtggttttgttttgaatgctcaaatggtagtggaattggcgatgtgaaaatggccgaggcttcttcaaatagcaacatgaacaccacgaaacgcaaacaagcaaatcctgatgaggaaaagcataacaaaaaggccaaaactgaaattaggaaaacggtatgttattggtgggcggtcctattttgagtaattaaaaaagctattatgatgatccaaacctgagacgacccacactgacaaatactctaaaaaataacaaataaaaacaattattattactaattttttggctactgctggattacattcctgagattgaattgaacctgttcaaatacttttttaaataatttttttctttcatcgagtttattggattttcaaaaaatcccgtccaggtcttgaaaaaaccgggttctggacccggcctgatacccggacccggccaatcctaataaaactattatttaaaataaattaaattatttaaggaaaatcactgggatgccaccgcttgtgatacacgcctccgaatcattgatggtttgactgtcattcactcggcaaaacaatctggtatttaattttttctattaaataattgaatatttcatcaaaaggttctttccgcccagtcttcgctaaacattcaatttcgcccaaaaatgaatcgtccggcattttttactttgaaattacagtacaaaaaatctattggtaagcgtaatgatttaaataaa

SEQ ID NO: 76983 - DNA, 2713 bp, Heterodera glycines
  Genomic contig location: Contig_ID=SeqID_13164; Location=73..2785; Strand=+
  SCN-specific regions: Sequence locations=1-493,517-1452,1474 -2394,2417-2713
atgcatcgcgaagtccgcgaactaatgcatatgcaactgcacagatgcagtgatagttggtgtggtccacgtgaccccaactttgggcggtgtaaaaagggcttcccagccccgtactcgaaatgtacgatactacacccggacaggcccgcattgtattaccggcctagcccaaccgacggtggtgcccaaattgaggtgaacggcttaatatacgacaactcgcaagtcgtgccgtacaacccatacattttgctgcgttaccgagtacaccacaacgtgttattcgcatacggtaacaaagcgaacatcaaatatgcactcaaataccctttcaaagggcctggacattgttatgtcgagtgcaaagaggagtccggcagcaaaatcggtatcgatgagccggctcaatatgccaaaatgaacttccgtggtgctacggaagcttttgcagttgtgcattcaatgccatttgcaaaactctcgcatcacgttgttcatttgtccattcatttgccaaaccagcagcccgttgtctacagggcattccaactggtgagcaaagctgaggaaattcagcgaggcgaactcccagagacgccatgctctgcttattggaagcaatggcaaaatgaatggcagcatgttccttcgcttaaggacatgctttttgaaaaagtcccagagcaatttcgctgggcaaaggaccgatgggtcttttataaaaagaagcctatcaaaaggcccccaatcggtcgtgttgtacctgtccctccaacggaccgggaaagatttgcgctctatgcgttaatgcgtcactttcccggtgatccggaccacttaaaactggtcaatgggcagcagtacaacaccttcacagaggccgctttacagcatgggcttcttgaagatgaccaaatttggcacaaaacgctcggcgaggcagccttgcatcgctggccagaccagatgagatggctcttcgtgagcatcctcgtctttgggcagccgagcaatgccctagaactgtggaacaagtacaaagaccaaatgtataatccacagggcatcaccagtgcggctatacgccaagcacgcgagcaggaagcgctagccgacattgattggcgattgcacttctttaactcaagctgcatgcactgtggcctcccagatccaccaaattcaaaagccaaaaatatcaatttggcagttgaagaagctttctttggtgatgatgatcttaatatgccgcctggccagccaaatcctaggcagcagcaaaacgctccacctccactcaacagcgaccagcaaaaggtctttgatgctgttgtgagggctattcaatcggatccgaaggatccgactgtgcctcgccgtttctttattttcggcgatggaggtacaggaaaaacattcctgtttggccaaattatcaagcgcttgcgcaagcccccatacacctacaaagtgcttgccacggcatccactgggtgtgcggctattttgctgccttatgggaaaacagcccattccactttccgtctgggtagagaagtgtcattagacaaactcccaagcattcccttggagagcttctttgctcgacggatacgtgaggcccaactcatcatcattgatgagatcaccatgcttcacaacacggtgattgcggtaatcgaccgagtgtgcaaagaaatggcaattcgccagcacaaggacctcctcttcggaggaaaaacggtcatttttagcggtgacttcaaacagtcactgccggtcgtgcctcacgaaggcctaactgcacaagttgcggcctgcttccaaacctctccactgttttgtcaattcctgactatgaaattgacaataaaccagaggttgggccaagggcagcaagcttacttgcaaatgtgccgccaaatcgggcttggagagaccggagaacacttctggattcctccgcagttcctcgtaaagagcagggatgagttgatagactttgtctatcccgacttccagaaactccttggaaatgacaaggaactgctaaatcgtctgatcctcgcacctcacattgacacatgcgatgagatcaacgaaatcatgatggcgaatgtgcctggtcaagtgcgcgaatatttgtcctcggacaaaccgcttgacgagcggccactggatattgatgaaatcgagtccgaagtggcagcgttgaatcgacgcacagactctgggatgcctccccaccgtctgcgactcaaggtcggaagcgtcgttgttctccttatcaataaaagtgataaggaaggactgatcaacggcacgcgcatcgttcttgaagaacttggcgacgatcgtctggtcggtcgtgtcattaacagcaacgctgttggtggccaggttaagttcttcatcgaaagaacacgaaatgtctacgaggacaaaacgcctggcggcataaaatatgagcgtttgcagtttcccatcaaacctgccttcgccatgaccattctcaaaggtcaaggccaaacaatcagcacggtcggaattgacctcgaaagggatgtattttcccacggtcaattgtacactgcattttcaagagcaacggacgggaacaacgtccgagttacgctcccagaagggagaccgacgacccagacagagtcaaagtgctgaatgttgttgcaacgaaaatgctcaatttgca

SEQ ID NO: 76984 - DNA, 77 bp, Heterodera glycines
  Genomic contig location: Contig_ID=SeqID_13165; Location=139..215; Strand=-
  SCN-specific regions: Sequence locations=1-37,60-77
atgatcataattattattttcccagaatatttgggaatccacctcaatgtccagaaaaaagttaagagtcgcaagct

SEQ ID NO: 76985 - DNA, 1487 bp, Heterodera glycines
  Genomic contig location: Contig_ID=SeqID_13165; Location=921..2407; Strand=-
  SCN-specific regions: Sequence locations=1-329,359-448,470-597,627 -964,993-1006,1028-1160,1190-1304,1356-1487
cagaagccattccaatcagagctcgagaaaaagctgatggaacaaattgtgacagttcaatcgaaggttgacaaaatgggaatggcacatcaacagcaaaagggtaaaatggacaatgattaccgtataacattattaactatactgtcaaataggtattactttaccagggatgggccaaattgaaaaataaaaagcgaaatttgcgaaactgaaaaatgcgaaatgaaaaaaaagcgaaatgcgaaaagctaaaatatgcgaaaggcgaaatgcgaaatgcgaaattttttctacaactttttaatagttaaaagcataaagcaaaaatcattttttaaaattttattccaaatttaaaaatcaatagaactctttctgaggcgcgctttttccaaaaaaactttttgggaagagggggcaggcggcgccggcaggtgccgccaggaaaatttttgaaaatttgattaaaatttgttgacagattttcactaaaaaatgatcaaattttgtgatttttatcatttttctaatgagtaataagagttttggggcgccgctgagaacagtttttcatcaaattaattagccaatttataggtcaaatttttaaaaattttatgggaatttaatccaattcttagggctgtaaaagtcgcgtttcgcgccaaaaagcgaaatgcgaaacaccaaaaaatgcgaataatgcgaaaggtgaaatgcgaaacctaggcacatccctggtggtcaccgccctttgtaagcgcgccgcaaaaaaatggaatgatcgccggggcggtaccccgtccaagcctaaatcttaggaccgtcctcgactcaagccctttaaaaattgcaattaattccccaagggttggccatgccccgctattgcctcttcggtgacacggtgaacaccgcgtctcggatggaaagttcttcaagcggtcgaaaagcaaatggcattttaatttattttattatttaaatttcagccaacaaaattcacatctccaaagaaacgtgcattttgttgcacgaaaactctgaaggaggcgcttacttaacggaaagcagaggcgaagtgatcattaaggtgaacacaaattagacaaagtcttcaaaatcagagagagcactaatcaatagaattaagaggaatatttgttattttttaaagctttatctcttggcaaaaatttgcctaattttgtccaaaaaaagcacaaggttcttagtgctgctgattatcattataaataatcgaattgcttctaaattggctttttcttgactaactcaaattcattttttgcttttaaaatgcatattttaaaaattattttagggcaaaggcgtaatggaaaccttttggctgttgggaaacgcaaaaattagcggtggcacaattggcacaaatcattcgcaagcagcggaaagacaaatggcaatggaaagtgacaaatcggagaaggaaatgtacaaaa

SEQ ID NO: 76986 - DNA, 106 bp, Heterodera glycines
  Genomic contig location: Contig_ID=SeqID_13166; Location=3716..3821; Strand=-
  SCN-specific regions: Sequence locations=1-106
actttgtgctttcgaatgatgccaaaaaatatagggtttgttcaaacatgaacaaagttattgtataaaaaccaggcattgtcaattgattggactcataaagtgc

SEQ ID NO: 76987 - DNA, 2295 bp, Heterodera glycines
  Genomic contig location: Contig_ID=SeqID_13166; Location=1378..3672; Strand=+
  SCN-specific regions: Sequence locations=1-405,427-551,573-629,651 -753,784-947,969-1245,1267-1825,1853-2295
atgaaattttgtggttcagtgctgctcaagctgttcaagtcggctcaggtcgtcgaattgggtttctgtgccgattttggttattgtcaggtgactcgtttgtctgtctattcggttgtttgaatgtgtttttagggtatgaaaaatggtggcgaaaaatgcacaaatgcagtgaacacctccctctgctcgttttgccctttccacacccaacaacgcgcccgccaactctcaatggcccgcggcgctttgaaccgatcgtacaatttaccgccaaagaaaatgcgctctttggaagagcattcgaattcctttgacacaccaactcaaattggcgtaaaaaccatcgcaaggactcaaatatcagacggaaagatgtacgctttaacaagggaatttgtgggtaaaattactcttaaaaatattcagtttcacaaagccattgtccgtcgttcagcaaaggctcgaaagtaaaacggcggaaatgaaggaaaaacgaatggacgaattgaaaaagctcgtcacggaaaaggtaaatgaaaatgaaggaatattttcattaattattatgggaaaggaaaacattctgttggttttagccgtttggctttggtgcgaagaatttgttgctgaagcagcagagggacaaagagaaccaaagcccgcgggcggaagcgtcggcaccgttgcagtcgcccagtcaaaagtcgcttcagtccatgcgcgaattcatccgctcgcgagtattacaacaattttttttttaaattcaataatttaatagaatttgtgcggctcccggtaaattggacaccagaaaattggacactgttgtaaataaaaatgaaaataaacaaaataaattactaaacaaaaattttggtttggcctaaaagatctttatcttaatctgccatatgttgtttataagcgtaaataatatggaaatgaatttgttattatttttgtaacttcaggagaagaaaaacatcatatcattcataaagaaataagttttattactcatttctggtggattttttggcccattgatcaatcatccctcatttaacccatttattctactcaaatttattttcacctagttcttgattttttttaaaaaggaaatcttagtgtccaattttcctttagtgtccaaaattccggcggtgtccatttttccgcttggtgtccaattttccggtccccatttaggctccctatatttacactgtatataccattattatttttgcctcaaaatgcgtcgtcgcctctcacgcaaatggaatcaatggaaaacacccaagcgcaaaatgttgaccaactcacagcgaaagaacgagcgaaaatcgtaaatgaatttagcaaaacaacaattcaaacaagtacggccattttccttttgcagaaacgcgccgcagaaattttgaaaaatgctcccgccaaacggcacaaacgtaaatttaaatttatatgacctttctggcaatgttccatttttgagccaatgacagtaaagcacaaaaagaaaatggaagtaaaagcgacgacggagaaacaaattttgggggaagttttagcgacgaacaaattcgaacacttttggagaaaacgtctaaccacgacaaagaggcgaaaagggtaagaaaagggcaaaggaatggacagcgaaacaatgcaattttcaggcggaattgaaccaacaaaacgtttatttcgaccggcgccaaatcgaagaacaaattgaaacgaatgcaacttcactaatggaattgaagaactgcaaagtcgttacctgctcaattgtgagtacagaaattgaaataatttctttaaaaaagtttgcttagatcgcaaaagccattgaaaaatagtattttttttgctgaaaatttcggttttctccgtcagacccctcttgttcctaaaattttctttaaattgtctgacgtacgtttgttcacagtgcgcttgcacgagtcgccatcaaagtgtttattgtaagacgtcgggacacgaagtgaagcggcattttgcggacaaacgcttcttcaagtgcaaaaagtgtcagcagcggacattttgctacgaccgaatgcccacgagggcgtgcattgtgagaatgaatgcttttgaccacttttggcattgaatgattttgtttttaagtcgtgcggagcaaaggaattttgccgagtggcgatgaaagacgagagaaaagtgctgacggagagggaaagactgaagctcaaggaggaggagaagaacttttcatcactcaaagcgtag

SEQ ID NO: 76988 - DNA, 62 bp, Heterodera glycines
  Genomic contig location: Contig_ID=SeqID_13166; Location=3894..3955; Strand=+
  SCN-specific regions: Sequence locations=1-62
gctgattattttggtttgtaactttcttgaaatgttaaaattatcttgttttctcgtatatt

SEQ ID NO: 76989 - DNA, 592 bp, Heterodera glycines
  Genomic contig location: Contig_ID=SeqID_13167; Location=624..1215; Strand=+
  SCN-specific regions: Sequence locations=1-95,117-277,337-462,484-592
atggttttgagtgatttgtcgaatgccgtcaacaatggggcaacactgagtttgcaagaactgcggcggcgccgtaggacggccattgtgtttctggcgcccgacttggcggcccgacagcgacagttatggcgagaacgccaccgcagctcgaatgcagttgaacagcaagatgttattgtattggattagaagatgacggcggaaaaaggccaatttggatgctttttttgttaattttttgttcgaattaatggtaattaattgtgcttgaatctttataataaaaagttgaattttttattttttgtaaaattaaaattcatttaattatttgcaatttttgcatttctttttaattctttggcattttgttttttaagcaagcaattttatccactttttttgccgtccatgacagaatttcacacatttatccgtaaacaattgaatagtttttttatggatcaaaacaggaaatgcattgaaatccgtttgctgacttacagacattttttggtcggagtttgctctttcttggtggagcaaaaagatgggatttgaactgattgacggaggagcagttgaatga

SEQ ID NO: 76990 - DNA, 920 bp, Heterodera glycines
  Genomic contig location: Contig_ID=SeqID_13168; Location=573..1492; Strand=-
  SCN-specific regions: Sequence locations=1-170,192-314,352-425,447 -484,520-811,891-920
atgggtgggtcttcaaatgaagttgggaaagtgctcattgtttaatcgaaattctccttttagtttttactcaaaaatttttctacttattaagcaatagaaattttgcatcggaattaaatataaatctctataaaaatggctacaataacatttcactatgattttgaaaactgctgcaaatgctgcaaagttaattcaattgattgcccaaattgttgggtaaaactgagaacattaatttgtgacttttatagcttttctacaacaacaaactattaacaggaactcatttaaactgaactttttgtatcaaaatttaaagaaaattaaaaaattatttattaattacaaatgtctttattttgttttttcctttactatttcccattttgtcatatttggtatttgttaaaccctacaatgggatttaaattttccattttgacgggatgatttaaggggtttagaatttgttccaaacatcaatttaaaacaaaatataaaaaggagcattttaaaagactttcacttcctttaagttatttctttacttatcctataagtattgtttacggttttgtaaaaatttgtctacaacacatttttttaaattaataacatgtcccgttggactactttttcattttacagacattttgctcaacattttgatggttgacgttggcacaacttttgtcaaattttctgactgcaccaactcggcattaaacacaaattgcggacgaattccatccacaatttgacggcagaaagtgttcaacaacggcgacaccagcaatggtcattcattttttatataatttttaatttacataatttaatcgcactgaaataactaaaaataattaaatataattaaataattactgcatcatatgattcaattaactaataaa

SEQ ID NO: 76991 - DNA, 512 bp, Heterodera glycines
  Genomic contig location: Contig_ID=SeqID_13169; Location=649..1160; Strand=+
  SCN-specific regions: Sequence locations=1-228,250-460,482-512
atggctgttcgccgaagagtagcacaccacgaagccgggcacattatggcaaatcacctaaataaggatggggctgagtgcttagcagtaaaattttgaattgaaaaattaaaaattcattaattttagtcagatatagtggaagatcagtttatgtgcgaacagttcaaaaaaagagaagtcaaggaagcaataaagcaggtatctcttttagagcaattcaaaaattcaagaattaagcttgccaacgcgttgcttcaacgaaatgtattgcagtgcaacgacataaaacggttagagatattttccaatgacaaataatcatttttatagaattattgggcacattaaacgatcgtaacgttcattctactgacagggatggagctcgtctgaaaaaggaaacataattatattagcaaagcattagtgtgattaatttctttggaaaaaaaaatgcttatttcattattttttataaagaggaattccactccgattttgtattttaa

SEQ ID NO: 76992 - DNA, 752 bp, Heterodera glycines
  Genomic contig location: Contig_ID=SeqID_13170; Location=4..755; Strand=-
  SCN-specific regions: Sequence locations=1-121,145-488,510-519,541 -562,596-752
atgggtggcaaagatttagattttggcaatggcattggtgaagaatggcacagtacgaataccatttttaatgaaaacccggtaatttttggtgaaagcccggaaataagctcaatgaataatgacgatgataacaacaacaactatcatccttattactactacaataattatggttatggtaacgacagtaattttcctggaaataataattggtataacgcaaacgcatacactgataactggtatagcgtaaatgatggtgatgatgacacgagtggttacggtagtactacaagtggaaactacggttttgagacgaacagttacagtagcagtacactgggtggcaattacgattacggtaacagtagtgagtcatcatcagcaccagcgttgacaaaaaagaaaaaagaattgcagcaaatattcagaggaaacattcaaatccgagaaactgacagtgatggtttagtgagttatcggccggccaaaaagaacgaagtggtaatcaaattgaataaataaaataatgcaaaatataaaaggtttcaaattcagcttaaattatactaatattttattttaaaaaattcaaaaatgcatataattttttcttttagtgttttgaagtttattgcggcactagtaatctaactgacggcatttttactgatcactatggcaattttgaagaaactttgcataaggaacaagaagaagcgctgaaaaaaatgcaaatttggaattaa

SEQ ID NO: 76993 - DNA, 1053 bp, Heterodera glycines
  Genomic contig location: Contig_ID=SeqID_13170; Location=1001..2053; Strand=-
  SCN-specific regions: Sequence locations=1-3,25-46,228-268,448 -661,697-701,742-855,889-919,990-1053
  Gene Ontology: Mol. function=DNA binding; Cellular component=nucleus; Biological process=regulation of transcription, DNA-dependent
atggacagagagagaaaacgggagaaagaaaagagacagaaggagcgagagagatggagagagagagaaaacgggagaaagaaaagagacagaaggagcgagagagatggagagagagagaaaacgggagaaagaaaagagacagaaggagcgagagagatggagagagagagaaaacgggagaaagaaaagagacagaaggagcgagagagatggagagagagagaaaacgggagaaagaaaagagacagaaggagcgagagagatggagagagagagaaaacgggagaaagaaaagagacagaaggagcgagagagatggagagagagagaaaacgggagaaagaaaagagacagaaggagcgagagagatggagagagagagaaaacgggagaaagaaaagagacagaaggagcgagagagatggagagagagggtgagagagaagaaagtgcaaatgacaagttgtgatctgaagaaatgacagagcaaaacgtactgattagagacaggatttttagttgctaaaatgccgaaaggttactaaaataggtgctaaaaagtgcaataatgtttccaaaaatgcccaaaacgccaccaaaataattgcaaaaataggtgctaaaaattggaaaaatccttcaactttatacataaaaattccaaaatgacttatttatttttatcaatttggcccgcacaattgcaaattgtcaagaaaataaataaataaatttggagtcgaaatttttgggaaagttttcatttcttaacgaattgccaaaatcttaaggagtgaatttaatcggttttctcatataataatgccaaattaagtgcggttttaaaattgaattttctttttataaaattaatcactaaattaaccatgattctcgagcggcacgaaattggatcaaataaaaattaaaattatattaaaaataattttttaaattaacagaatttttaaatgttattatttaaaccaacaatgtgctattccaccacacattcagcggttgctcaacaaaacgcatagtctcacataa

SEQ ID NO: 76994 - DNA, 1177 bp, Heterodera glycines
  Genomic contig location: Contig_ID=SeqID_13172; Location=1276..2452; Strand=+
  SCN-specific regions: Sequence locations=1-745,843-1102,1124-1177
atgagcgatcataaaggccctaccgcatttgtaaaaattgccaaaataaatttccaattttggaaactcgtcgacgaccatttgcggaataaaaaatggcttcttgattatttggagattgatgaagaagaacaaatggatggaacgacagaaatggttatttatgacggaaccggaaaaatattgccaattccgcaaaatccattgcccaccaaaattagcggcttccaaacgatttggatcacgtaaattaaccgattatagtaaatattatattttttgttaactttctagttacctggatgcaaatgtgatcgcttttctccacctttttcaacatcttttcacttcgtgtgaaattactttgaccattgaaatgaccaatggtcaatttttgttcagtttggcccaaaatatttggccactgatcaaaaacaacgttaaacgcttttcaatgccgaccaactttgaacattttcggcatcacttcccttcaattctcagcagcgaccaatggccatctcttcaattcttttattgtgaaaatgttttgccagatttcccagccgatgattgtgccaacgcgtcggatggacaagtgctgtccaagtggctgttttcggcacattttggtgatttgccaccgaaagtggctcaatgtgaatgttcaacggacctgcaagggatcacgtcaaaaatggcattggtcaaatcggtagtccaattttaacttatttaattgcagaaattaataaataaatttaattattaaaggaaaaagaatatttttgtatattaatattttatcttatatataaagaaaagatataaatattttaattcttatgtacgtttttatttatttttttacatttaggcatttgtcaatgcgtcttctcgtgccaattttatcgtgtacatttggtttaatgcctcttcttcggatcatgtgacagacattccgacttttaaattgtccaacaattcaactggcgagcacatgacattgaaacggattcgtgataagtatgctaatattacagttgggttggtgggactgcggcaggtcaaagaaatttaaatttgaactgttataattctctaaaactaatttgttttgtttttctatcaaaattgattttggattatcatttagcaatattgcttggttttaaaa

SEQ ID NO: 76995 - DNA, 790 bp, Heterodera glycines
  Genomic contig location: Contig_ID=SeqID_13173; Location=297..1086; Strand=+
  SCN-specific regions: Sequence locations=1-87,109-140,163-198,220 -337,361-507,530-546,573-759,781-790
atgccaatcacaaaatgcgccattcattcgggtggaaacataatggcctatgcgatcggttatgattggagcaaggtaataattgaaggggcgcagagagcggacaaattgaaagagaattgccaagccaaaaagacaccataaaatgagaaatttggtttttagggcttcgaatacagcacggcgaataatgtgacgaaaatctttctgcacgggtgtgacgaggagatgaaaccaaagccgaagaagtgatctccgtgagtgaccgttttttaatgttctctcaattgtttttttataaattttttacacttcgttttgcattgctttaaaacggcctctcctccccttctcccctccgttattcactctcaaattcatttttacaaaattccctggccaacttaacaaaaaaagaaccctttgccgttcccaggctctttatttttattacatttctcactataattctcttcaatagcccggaaattggcttcggcggatggcagacaaaaattgagaaaggaaaagccgtgcccattggacagaggcaaagaaaagggggagggaatgttccgggaagggaagggaagccaattcaatgtttattcacttctccttttatgtccttagaaaatttggatgctttgacaaaaaaaggaaaagccttcgcacaaattctatttgccggaaattttacacgggaaggaaaaagtagaaaatgctttaattttaatattgatcaaaaatggagaataatcaaaaggaacataaaacaaaatacaaatca

SEQ ID NO: 76996 - DNA, 65 bp, Heterodera glycines
  Genomic contig location: Contig_ID=SeqID_13173; Location=277..341; Strand=-
  SCN-specific regions: Sequence locations=1-65
cattatgtttccacccgaatgaatggcgcattttgtgattggcattggcaaggcatcggaaccct

SEQ ID NO: 76997 - DNA, 794 bp, Heterodera glycines
  Genomic contig location: Contig_ID=SeqID_13173; Location=1591..2384; Strand=-
  SCN-specific regions: Sequence locations=1-45,67-190,212-624,646 -653,675-751,773-794
atgggcttgaaaggctccaagccgaaactgtccaaggaggacctggagttcctgaagaagaacaccaacttcacggaggaacagatcaaagagtggtacaaaggcttcgtggtcagtccgtacactttgcgaggcctccgtccgttcaccgctttttgtccccgtttagcaagactgtcccaagggccatctgaccaaagagcagttcatcaaagtgtacaaggtcagtgccatgccgatttaatcggtcggggactgactttagccctactcatgccccgcttcttttcaggactttttcccctccggctccgcggaaggcttctgcgaacacgtgttccggaccttcgacacggacaacagcgggttcatcgacttcaaggagttcttgctggccatcaacgtcacttcctccggcacacccgagcagaaactcgaatgggcattccgggtttttgaatttcgaattcaaaacgatgccattgcctttgtcccgttcagatgtacgacatcgacgggaatgggacgatagacgagaaggagatgatcaaaatcatcgaagtacacacaaatgggggcttgacatttccaacattttgccgtttttaggcaatttacgaaatgttgggccccgaagtgaccaaatcggcggacgattcgccaagaaaacgggcgaaaatgattttcgagaaaatggacgtaaataatgacaaagagctgacactgaaggaatttgttgacgggtgccttgcggacaaggagcttttccaggcaaattttgtctcagaaataaa

SEQ ID NO: 76998 - DNA, 791 bp, Heterodera glycines
  Genomic contig location: Contig_ID=SeqID_13175; Location=133..923; Strand=-
  SCN-specific regions: Sequence locations=1-271,294-433,455-791
atgtcaaggtgagtacagtcgattcgattcaaagtcaggaagccgagcttgtccttgtcatcacgactcgctccgcggctggacgatcattggaagctgacactggcaaggaattctgggcggattgcgcgagaacaaccgtggctctctcccgtcccaaatttggattggtcatcatcggagatttgtcgttgatttggcacaaagggactgtgtggagacgtttcattgacgaaacattaaaaatgacggttgcggtaaccccggagtatttaaaccttatttccaatccgtttccgtcccgggtgggaaaatttattgcaaaaagggatggcacaattccgatggcatttgaattttatgccgaaagggacagtactttaagacacgatagtttggcgtatcagccaccaataaataatttcgtaaataatttttccccttccccatttttcacaggtggtttcaggccattcacagctcaggcaaatgtgtttccaccgatcagttcgggtcatgctcaaccgccggctttctcacacggaatgatgatcattgacacctctgtgcgccctcctccaattaacatgatcgccggtcacacaatgccaatgccttcaaattgccctggtccaagtacgcgaatggcgccgtatccgccacaatatttgccgtcatacgccgaagccgcccaacaagccccgtcaaactcgaacagcaaccgaagaatcgatgtgaagtgctatagatgcggaaaaatcggacacttttcaaaacgatgtcgcacctga

SEQ ID NO: 76999 - DNA, 1652 bp, Heterodera glycines
  Genomic contig location: Contig_ID=SeqID_13175; Location=1839..3490; Strand=-
  SCN-specific regions: Sequence locations=1-278,304-307,331-941,968 -1189,1211-1557,1579-1652
atgaggcgaaatgtggacaatgatagtggtgcaaacaatggcgcgaacatcagcagcgacccgaaaattgctcatgctgtggacactggaaatggcgcaaatgacgcgcttggcgacggaatggacattgggcactgcccaaactgctcgtggcattgcaatgtgtgcagtaagcgaatttttctgttctgcattcaatttcgttcaaacatttctttgattcagtctgtcattaccgcctaatttgtttaatttactatcaaaaccacaaaacggtcaaatttttatttttttattttttttccctgttatcaatttaatcaatgtttttgggctgattttccactaactaattcaatttgctaccaaacaacaaaataatggtcaattttttttctcttctctattttttttcgtcaaaaaaaaacattgccgccaaaagttcaattccctattgaaactaatacagtacaacaatgcgcgatgcggagaacattgcactttgaacgctaatatcatacttatcttttactgtaatcgccgatgagcctggacaattccatttttcgatttccacgatagggatgggctcttaaatgttacaacagctaatgggaaaagcgtcgctattaacaatctccacttttcactaaaaagcatttcccactcattcatcaattcattcttcatccaaagcacatagtgctctcatctcaatcgacaaacactctgcaattcacagccttaagcttaagcaagcaaccgcgcgaaccctaccgcctattccctcatttgtttccaaatttaattgttacatctaattattctaattttgtttccccgtttcattttgcttattatttgcgctcatatttgaattgttttaactcgcgctctcatttcaatcaatagaatagtcgtaagactaagagcagaccaaatttttttttttttttttttctcttttcaaattgtccaccccaattttcaattgaactatcctttggatagaaagaaacgaaacaatggaagaccaacaagttacaataacgagtgtagacaggacattatttcaaaatctcagtcaccctcctaattccggtgctcccttttcattggtagaaaaagtataccaaggcactgtacgtcttgaggatgccgctaatcggagtctaagagtgattaatcgcagagctgtacaaaatacagacgccattaaccaagtatctgttactgttaatgctaacatggacactctctccacaagacttgaccaagtggtagataaagttgaaactttggaaagccaagtggagaattgggataatcctaacactgataacttatcacaaaacggggatgccactgtagtactaaggagccgagtgggtttacttgaggaagaggacgatgaagacgaatttttaaacgttttgacaactgtggacccatttgctagtcaacttccggcatgcaaggatgaaaatcttacctctttcgataactgggcccaaaaatttagagaccttttggattatgctggcacaacatggtcagaaaaagaaaaattaggccgactcaaattttctcttgaagggcaaatcagaatggggtcttcccaaattcaatggatgctcctctattgcagttaa

SEQ ID NO: 77000 - DNA, 435 bp, Heterodera glycines
  Genomic contig location: Contig_ID=SeqID_1952; Location=110..544; Strand=+
  SCN-specific regions: Sequence locations=1-293,318-374,399-435
atgccggcgggaccggaaggggcggaggccagcgccaaaccgacaggacagagcgcagcacctggtggaacttcagcagctggtggaacttccgcggtgggacagcagccagccgacgcctccaagaaatcattggctccagcggggaccgcatcggccggtgagaggagagggacgggcgggcggggaagcgtttttggttcactctaatactttcattcccatttttagcagttccttcgacgtacgcggcgcccggcacggggacgactttgagcaccgcatcgcagaagtcagcagcgcctgctggaggagcctcggcactgagcaccgcgtcgcagaagtcagccgctggaggagccatgtcgcagaagtcagcagcgcctgctggaggagcctcggcactgagcaccgcgtcgcagaagtcagccgccg

SEQ ID NO: 77001 - DNA, 250 bp, Heterodera glycines
  Genomic contig location: Contig_ID=SeqID_1953; Location=1..250; Strand=-
  SCN-specific regions: Sequence locations=1-198,223-250
aaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcaccgccctccgtctcatacgcaagcgcttttgtgaggcataaaatttctccaaaaaagagatagccatttttctgggatagagtataaat

SEQ ID NO: 77002 - DNA, 233 bp, Heterodera glycines
  Genomic contig location: Contig_ID=SeqID_1954; Location=480..712; Strand=-
  SCN-specific regions: Sequence locations=1-51,73-233
atgaaggggttatcgaataatatgaagaattaaaatttaattgcttttgaacaattttttgttgaaaattttcagaccggaaggatcggaactccctcgggaattttacgggattggtgatcccactctgggaaaatttcggattcccgatcccgcttcctacaattttctcaccatatgcgggagtaaaatatactggtaagaattcgatttttcggcaaaatattaataaa

SEQ ID NO: 77003 - DNA, 2060 bp, Heterodera glycines
  Genomic contig location: Contig_ID=SeqID_1954; Location=2008..4067; Strand=+
  SCN-specific regions: Sequence locations=1-84,106-252,279-369,402 -683,722-1355,1377-1484,1506-1520,1543-1613,1635-1682,1711-1753,1775 -2060
atgttttactcaattgctattccattaattcaaataatttttgtaaatttatgctttggcaacgacgaaagcccaaatgatggccaaaaaactcaaataaatttattaaaagaagctggaaaaaagccgggaaatgagttgaatttgaatgaagaaggcaattcaaatggcaatcaatcagctgataatgaagaaaatgaattgatggtattaagcagacaaattcaaaacaaagtaaaagtttaaattggcaaaattattattattaaaatttttaactaactttagggcaaagaaaaggaaaaagattcacttgaaaaggagagtcatttaataacaaaaacgaaagagcaacaaaatatatttggtaaaatcattttaaataaaaaattttgaccaaaagcgatgctattatgctggccgcaaaaaatgtttaaatattcgttattttctaacaaatttttgtccaaaaataaaaaatattcgaggaatttagtatatttaaaaaaagagtatttttacgaataaattggcgccgctgaaaatttccaaaaaatataacaaattaaaaagaaaaaacccaatttttctctcatgcaaaatttaaaattgctaaccattgaactataaggaaaattatgatgaaacttaaacatttgaaatctctaagacttaaagattttgatttaaacactttattacagcttttagaaataattttcactcttgaactctgtttaatgacaattttcttttgcttttctttttcaaattaattttagaattgccaacggaactgaacgaatttgaacaagatttattaccattaccatgggcattcgacaacgatttgttgcttttaagtgaacaaatccaaaaacaaagtgaaatgctgcaattagcgaaaagtaatgaaaaagtacaaaaaacaccggcggtggaaaagcgacaggaaaatgggaaagcaaaggcggcatgggtggattacggtaggataatacaacaataaacggctttacaggttttagtacagtataccataagccttgtcggtttttgtcagattaagtcaaataatttacaaatgacaaccaaaaaataagtgaaggattgatgaattttttaaaattatcatctgatagagtcaatttctgctgcactattttacgtttttaaatgaattgcctcattaagaaacggttgcccaaaagcgatcacgcctttcccttgctcaaacttctggcacttctaagcccaattggccgaataaaattgcttcattggtagatatttttttggaaaaaagtaacaaacgatggcaaagcgtgaattgcaagtgtttaaaatgttatacgaagaatgcaatgcaaaacaaaaattgctgatccaaatgagcggatttggagtgggaaaaacactttttacttttttaaaatcaaaaaagcgaaaaattaaagtgactgtgactgcaatgggactgtaaaatgtaaataatgaaatgcaatgtgtaaaattttgcatgaatgaatggtatgtgtggaaaatagggagagatgacgacgacaaaagataaaacatcgatttcattggatgcgttgtaatttatttaatgcttttttaatgtgcatttttaagagaatgcgacgtattcattcatattcacatgaaaatcggggaattcgtggcaatgaaaagagagagaaagagagccacggtcttagctcctttatttaagttttcaccagtttcaaagtgtaattttaggctttgaatttaggcattaaataggcacaaaaataggcaaaaaaaattttaggtagcaaaatactagagaccggattttccaaaagtgccggaccggaccggtctgatattttcagaagcaaccgatttccgggcccggcctctcaaaaaccggtcaaaccggaaaaccggattttcaaattgccgggcccggaaccggtttggtaaaaatttaaattttcacatgtatttcacccaaaattgaccataaatcgtgccagatgtaaaatttcggatctatttcacttcaggcgtca

SEQ ID NO: 77004 - DNA, 1199 bp, Heterodera glycines
  Genomic contig location: Contig_ID=SeqID_1954; Location=4792..5990; Strand=-
  SCN-specific regions: Sequence locations=1-972,1009-1052,1088-1199
  Gene Ontology: Cellular component=extracellular; Biological process =pronuclear envelope synthesis
atgccggcgggaccggaaggggcggaggccagcgccaaaccgacaggacagagcgcagcacctggtggaacttcagcagctggtggaacttccgcggtgggacagcagccagccgacgcctccaagaaatcattggctccagcggggaccgcatcggccggtgagaggagagggacgggcgggcggggaagcgtttttggttcactctaatactttcattcccatttttagcagttccttcgacgtacgcggcgcccggcacggggacgactttgtgcaccgcatcgcagaagacggcaccggctggaggaacatcgacactgggcaccgcatcgcagaagacggcaccggctggaggaacatcgacactgggcaccgcatcgcagacaccggctggaggaacatcgacactgggcaccgcatcgcagaagacggcaccggctggaggaacatcgacactgggcaccgcatcgcagaagacggcaccggctggaggaacatcggcactgggcaccgcatcgcagaagaccgcagcggcaccggctggaggaacatcggcactgggcaccgcatcgcagaagtcggcagcagcaccggctggaggaacatcggcactgggcaccgcatcgcagaagaccgcagcggcaccagctggaggaacatcggcactgggcaccgcatcgcagaagtcggccgccggaggaaccaccctgaagtcggcaccggttggaggagcgtcggcactgggcactgcatcgcagaagtcggcagctggaggagccgcgtcgcagaaggcctgaacaaccaccggacagcacaagaacaagatgctctacaacccgcttcaatgatgttcatcgacagtgatcagaaatgattttaaatgatcccatattgttcccccatatgtgcctaatgtgctctattgtctgtgatcacttgtcattgtaaaaccgttgtgtgatcattatttgtgtatatgtatatatatatattgtatgtatgtataattggctaatcaccggatatcgataaacgtgataattcaagtgtaaatttctaaaaattaatttttgaaaaaacatctaactttgccaattttggactttttgtgcttaatgcctatttttatgcctatttcgccttttttgcgcctttttctgaattttcggaaaaatccttaagaaaaatgcaataaa

SEQ ID NO: 77005 - DNA, 595 bp, Heterodera glycines
  Genomic contig location: Contig_ID=SeqID_13176; Location=454..1048; Strand=+
  SCN-specific regions: Sequence locations=1-130,155-162,207-319,395 -451,473-595
atgaatcccttttaacacaatatcaaaatgacaattctttgcttcaatttgttgaggaagaaattcgaaaagaattttttggagcagaaattgagggatttgcagaagatttgcaagaaataaaattcataggaaatgaaatgaaagaaaaaataatggtaaaatttatttattttattaatttaatttaatttttaaatttagttgtcatatttgaaaaagaataaatttacagaaaacaatgacaattttaataaagcactgaacgaattgcaacaaataattgaagaatgggtaaggcacaagaaaaaatgttttcaaaaaaagttaatttatttattattctaaattaaaaataaaaaaatattaataataattaactaaaaaataaaatgccgtaaaatatttgcagtcagatgaagctcgacttcaagtaacgggcgcgctcatgataaaatatgaaaatgaaagcttcagcccaatttgccttttgcctggcgaatttaatcgggcaaaaatttttggcaatttaatttgtgactttaaaaagagaacattgtgccaagatgaatcactttattgcattttttgtaag

SEQ ID NO: 77006 - DNA, 2337 bp, Heterodera glycines
  Genomic contig location: Contig_ID=SeqID_13177; Location=250..2586; Strand=+
  SCN-specific regions: Sequence locations=1-177,213-292,351-678,743 -756,778-787,810-879,903-1003,1028-1052,1081-1190,1213-1254,1276 -1318,1340-1420,1461-1788,1814-1830,1864-1905,1934-1941,2008 -2076,2098-2337
  Gene Ontology: Mol. function=RNA binding; Cellular component =cytoplasm; Biological process=reproduction
atgtttcattggtgcaaaagtttgagagagatccgcttttatctgtgccaacactgaaaataaatttaatgagtgtgcaaattaacatacaatttgttgccgtgccaaatttaaaacatttgccaattggaaatttcaatggcacacaatttagaagaatttcaaaaatatttgttgaaaatataaaaaatttattgaaaaatgataattttgatgagtgtcaacataattttgagctaaaaaagctaaacgaagaaaagtataaactgacgaaacaattgtcgaaagcatgtaatattttaaattttaaatcatttcaaacaaaaaaataataataatttatattttaagcggaagaaaaagcggacgaaattagggaaaaaattaaaaacacaaaaaaattagaagatttgttgacaaaattctgccaaaatgctttaaaggaccgagaaaaagtgaacgaaatgaaaacaatgcttgcaattttaatgggtaattaatagggctgacaattttatgtaaatacatattttttcctggcttctccatgctctaaatagtaggaaaaacactttttttgtttgtgttttcgaataaaagttgggacttttatttacatatttttacataatttagaggtttttatatatttttttttgttattttggactttttagcattttttctaatttttttttgagaatttttgaaatttataaaatttcttgatttaaatttttttgaaagtgtacccctaaaaaaccgggttttttcttaaaaggagataccaaaaattaattttaaatatacaaaaatgtgcttctaagactatataagttatttttatggtattttgtagagcccggaattttgaaagtaccgggaccgggcccgggaccgggcttagccatttgaccgggaccgggccgcccgttcaaaaaaagcccgttttaccgggcgtcccgggcccggtccaaaattttgaccgggcgcccgtacgggaccgggcttttttcaaaatttttggaattttgaattaaagacatttcgccaaaaataattattaaattttcaaattttgagcagtttcgctggtgaaatttaagcccgttttagcccggtcaaattgaccgggtccgggaacgggaccgggcttagccatttgaccgggaccgggccgcccggtaaaagcccgccgggcccccgggcccgtccgggctctagtattttgtgcctttcaccatttacgaagaattttttccaaaattagaatttggaaatgacattaaagtgttggaaaacatttggccatcaaatgaagaaatttataaagaaaaagttgtcgaaattaaaaaaagaagcgatttgaaagtgtttgtccaatcattggcttatttggaaaagtgggcaatcggtagggatttattatattttatgttttaaaataaatatttaaatttgcttttatttagacaactatattttcaattccgaattgggctatttggactcgaacattctgaaaataatgctatcaaaaataattgcaatttatccgaactcatcggcaccttttataatccacaaattctttttgactttctcactttggtatgtgaataggtgcagattgtgagccgttataaaagccatcaaatgaaaattatcaaaaaaaaaaactttaactataaaaacctggtccctggagtacttttggccataactttgttcaaacttgacgaaattcctttgaattttccaggttaatagagaattgttagggttatcggatgatattaagaattaaaaatttccgttgggcttgagcaaagttatagtcagttttttgttgagaattttcatttgatggttttttatagaacgatatagcaccagcgaaaacggaataaatttaaaactaaaattaatttatgcagcaacaataaaatattctttataaatattttatatattataaataatttttaaatttaattatgtttttttccaaattttaggcattggcctttgcccgtacagctcgaacagctcacttatgagcaaagtggcgaactgctgctgatgtggtcaccggggagagaatgggtgctcaaaaagcaaaatgtgaagtcgaaaagtctgagaaaacggcaccagcgaattctgacaatgccaatcattgggccaatgtttccgcaacaaaatttgggccacaaaatcaattcattgactgcaaaagtcattcagcgcaaaatgcaggaaggttaaatttgcattgtctgaaaaatttgtaaataatcattagaaggattacaataattacagtaaatttgatta

SEQ ID NO: 77007 - DNA, 1675 bp, Heterodera glycines
  Genomic contig location: Contig_ID=SeqID_13181; Location=685..2359; Strand=-
  SCN-specific regions: Sequence locations=1-422,444-584,606-1675
atggaccgtgtcaaccctctgaatgttgtcctacccgatgccctgcttatgaaggatggcgaaaacacattgttgtatgacagccgagtgcgtcgccaaggagaatcggatgtggtcttggtctttgcacacccacagttaagttcattaatttctatgttcaatttttcgcttttattttcagctgttggacgttttgaagcgggcgaggaaaatttcggttgatggaacattcaaagtggcaccagccgcatggacgcagtgtttcgtgatcggcgcttttgtcaaccggcggctcgcattatgtgtgcatgctttgttgcctggaaagcaacgaaaatactacgaagaggcactcaatgcggtcaaagcggtgattgcacccaacaccccagcacatagtaagtgatcatttcttctaactttatttcatcccaaaatttaagtcatcagtgactttgaaacagcaacgattcgggccatgcgagaaacgtttccggcggcccaattgacgggatgtctattccacatgagccaggcagttttcagaaaatggcgtgaaatgggcttggcggaattgtatgccaacgacgaagaacaaggagaagtcgcgcggaacagtttcaggtgagtgttggagtgagtgaaaaaggcaaaaaaaagttcactcctaggaagctgcttgctctagcattgatccccggacaacatgttcgtcgtggttttgccgtcatagtaaaccatgcacccgaaggtttggctgcatttttcggttacttcgcgagggtatatgttggactgaccgcacacgaacaagaagccggcgccgtggcgtttgttccgggcactgatcaaagccgacgcagttcaatcagcaccaatgccactgaggatgccgaatacagtcgccggaattcatttggtagtggtgagtatttttgttttttgaattcgttcttattttctttattttagtgaatttggaccatgtttatggtaacaatttcatccaatttggcatcccttcacctgttccatcaacgccaacaacccaatcgtcaacaattgtttccgtcgtgccgcgctgggagctgccaattgtgcgtccaccactgtaccctgtgcacttctggaatgtccacgaccgtgcgaagtcagcagtggagaaaacgaacaatgctatggaggcatcacacctccaattttcggttgtgcgatttttagtgcgagtttaatttggtttttaaaacttaagcgtggtctagtccatcacccatctttgtcagactttctagcagctattctggatgatgttgacaagcaggtggacatcgcaagatctgcccgagtgttcccgcacaaacgccgcatcaaatacattttgaaggagcaattgatcggagatgcattggacgaggcggagtacaacaccgacgaagacgtcatgaacatcctttcactgctgagtctgcagatgcaaggatatgtgggtggcctgcgtgcacgaggggctcaacacgaacatgaggaccgtgaatgattgatcgctttataccattggcaaaaacccttgtcttattccgcacaagtgattggatttttaaacctcaatttccgtgattttcaacattttcatttgatttgaactattatttttgatgtttattataataaa

SEQ ID NO: 77008 - DNA, 953 bp, Heterodera glycines
  Genomic contig location: Contig_ID=SeqID_13184; Location=1050..2002; Strand=+
  SCN-specific regions: Sequence locations=1-171,196-424,446-953
atggacggaacggaggcacgcagcattttggagttggaccgaatggcacgaccgctggatctccaaaagtgccacccggtcggaatgtcgcgcttcatcctcggcatggactcaaacgcaattttggcccgaatttacgacggcgaagtgaatccggaggtgaattaatgcaaaaaagagaaaacaaaatgaacacagcttcaatcacttaaattcaaaaagaataatagtcatagttttaagccgtcagtcaaaatgatcggctgtggtcagtgagtggctctgttcagagtgatgagcagcgagtatttgatcagattgactagcaagaatattaattagagtgaccaacattgattatttgatcagagtgatcaacaataaatattgatcatgattagcagtaagctttatgatcccaatgatcagtacttagtattttgatcagagtaattggcagtgactgatcaatgtaaccaaaagcgagtgttttgacccgagtaatcagcagagtgattaatatcagtgtggtcagcagtgagtgactctgatcagagtaatgagctgagtcaatgtgatcagcagtgagttgataaatgatcagcaattttattagtaattagtgccggatgatcgttcataattgtctttctctttagagcaactacaaatcggtgctgatttctcggcgaacgtgctgtgccgaagtgctccaaatgctgtgccaaatgagtcgtccgtcgtttgtctccgccgactgccgccttcggcccgcgcgtgacgccccctcaaaagcgcagtactgccagcagcttggcctggatgccatctccgaactgcgactgttcgtggacagtcctcgcggcgccgagtcggcactgatccccgcgaaatgcccattggccggggtatacacggcactgatgccggggcaacgaattgcactccgccga

SEQ ID NO: 77009 - DNA, 836 bp, Heterodera glycines
  Genomic contig location: Contig_ID=SeqID_13185; Location=433..1268; Strand=-
  SCN-specific regions: Sequence locations=1-257,290-328,350-661,683 -770,792-836
  Gene Ontology: Mol. function=DNA binding; Cellular component =nucleosome; Biological process=establishment and/or maintenance of chromatin architecture
atgaaaaaaaaaatcaacaaaaaggaagaagaacggcgaaagcggtaccgaccaggggagaagtaatttgtttttcttttttatttatggtaaattaaataatgtttgggtttcatgtaccttaactttttttttcctaaaccacaaatggagagctcttttcatttggattgacaaaaatcacaaatagccaaaatcatcggccctttagacatttttaaaaaataaaaaagaaataacaatcaaaatgacttggcttattttttaaatttaaatctttaaaaaaaatgagaggacaaacacgacatcaatcaaacttaatcttttagggcacttaaagagattcggaggtaccaaaaatccacagacaatttgatgccccggcagccgttccgtcgcttgatccgggaagtgataagcgaaataacatggaactctcaccggttggagacccaagcggccactgctcttcaggaggtgggttatttattggtcaatttacaagacatcctttttggtctttagaacccgaacatgaatttaacaaaaattttcgcattttttcgtctaaaaatagcttaaatgaaactattaccgaagtttcttgaatttacaggccgctgaaacttttctcacaaccttttttgaagccgctaacagatgtgccgtacacgcaaatcgagtcactattatgccgtccgattttgtccttattcgctggatccttcacacttttggcaataatattgtttgactaaaaactcacatttcttttttcattccatttgctgtataaaattgcgactttttgagcctattttttctatttgaataaa

SEQ ID NO: 77010 - DNA, 1393 bp, Heterodera glycines
  Genomic contig location: Contig_ID=SeqID_13187; Location=850..2242; Strand=-
  SCN-specific regions: Sequence locations=1-7,30-507,529-573,596 -945,980-985,1008-1140,1163-1303,1345-1393
atgaaaatgctgccaaaggagcagaagcaaacgccccaaacggacaccagcagtgccaaactattccttctccatttgttcacaattagcacaattattttacacattttgccaacaacggaatgccgtccatcttttgccaaagaaaatggcgacgacgacggacaaaatgccattctgatcaacgacgaaacgacaaaaacatcagcggcacttccgacagactttgagaaggtaaggaaaagtgtacaagtcagggtggacagagctttttatatttcataagttgtctttcttttctatatgccaagtttgccaaacccaataaatatttttggcatttggccaattcgactagcgaattcggtcttttgtctctcattaatattttttaaatttgaccagtccatccgtccgaccgtcgtttttggcattttgccaaatcccagcggctatttgttttctgtttccccctgaatattttggccctttggtattatactcaagcatctttcagttgttccaacttgacgcagacggtacaacagaacagcggcaaagtccgcagcacgtccaccaccaccggcaccaccaccgtcgtcatcgttctcactacgaccattttgtgctcggacattcggcccaacgacgtcggcatcaccggcgcagtttgaaaaacgccgacggtgtcatcgacggagcgaccgcgcatgaaaaacgcgtgcccaccggcgccgtccgcaaattgaccagcggcggcacaagcggccgaaagcaccgccgcagcggcggtggcagtcgattaatgctgaccaagccgtattggccttggccctgaaagcgatgaacgaggaatggcatggccattaggctagaatggtgccagaaatgatctcagcaattagccttccggttaatttttcatttcgtttcactattttttgacaattacttttcctctcaaaatgctttttgttttcccagcaaattctcacccattaaaaataatgatctgcaatatcgaacatatcattttcattgtgtaaataaaacagcgtttattaaacgtgagaatgaatcggtctcaactttttgaaacaaaatttaaaagtgaatatcgtcataattggggccaaaatcaaaacatttggcatttttaaaaggctctctgaaaaaatcggagttaagtaaagtttaaattttgctttaagaataaatgggacaataaaaagaaaagaacaaagaaaactattgaaataaaaacatgggatttttgataaattatccgtctcaactcggccatcacaaaagtcaaattaaaaattttaaaaaggcaagaaataacatataatatttaaagacacaaatcattcgtcaaaatgttcctgcttaa

SEQ ID NO: 77011 - DNA, 375 bp, Heterodera glycines
  Genomic contig location: Contig_ID=SeqID_13189; Location=445..819; Strand=-
  SCN-specific regions: Sequence locations=1-375
atgaagcgtgttatggctgatcaaaataaaaaatacaaaaaaggcatttaccagtgtaagtgcatatactttgtttttgcgtgtgttggcgttttgttttacgccaattattttttggcaatttttttcgttttttaccgtccatggaattaaagtagagtgattatgatttaatgcaccaaaaacgacgttatatatttcatgactatcgccagacaaattttaccattcaaatccggaagagaatttacaattccgtcgattgggttggccggcggcagcgaattggtcgaaatttgaacgtgggattcgtgatgatgggcatggttatggttacggccatccatctgacagaaaatcaaaaaaataaataaa

SEQ ID NO: 77012 - DNA, 782 bp, Heterodera glycines
  Genomic contig location: Contig_ID=SeqID_13189; Location=1601..2382; Strand=-
  SCN-specific regions: Sequence locations=1-755,779-782
atgggactcaacccaccaacattccaatcaacaggactcaaccctccagcattcaatcactgggactcaacccaccaacattccaatcaacaggactcaatccaccatcatttaatcaatgggactcaacccaccaacattccaatcaacgggattcaatccaccagcatttcaatcagtgggactcaattcttctgcatttcaatcactgggactctattctcctgcattcttggcattttcatcatctcttcttgtttcttgtggcatttccttatggcacaacattcttggcattttcatcatctccttgttttttggcatttccttatggcacaacatgacacaaattagtgtctcacacgaaagtcacagaacaaaccactaatgtttttcaaaagcatgacacacattagtgtctcacacgaaagtcacagaacaaaccactaatgtttttcaaaagcatgacacacattagtgtctcacacgaaagtcacagaacaaaccactaatgtttttcaaaagcatgacacacattagtgtctcacactaaagtcacagaacaaaccactaatgtttttcaaaagcatgacacacattagtgtctcacactaaagtcacagaacaaaccactaatgcttttcaaaagcatgacacacattagtgtctcacactaaagtcacagaacaaaccaaagatatgcatttatatttcattaaagttcaaataacattaagcataagcataattatttcacgtaaagaacacaaaaacaaaataaa

SEQ ID NO: 77013 - DNA, 658 bp, Heterodera glycines
  Genomic contig location: Contig_ID=SeqID_13190; Location=272..929; Strand=-
  SCN-specific regions: Sequence locations=1-343,382-424,480-513,535 -575,597-658
atgatgatttggatcattgtcgtagtgggaatcatcgctttagctttgctcagctgcgtcttgagccgagcttgtcaccgctcttcgaccagttcggcttcggctggtgccaatgacatcgaaatggcgccaacttcaagtgccagcacgagcaacagattgccaggctttaactacagtagtgatgtgaggagtgttcaccactatttaccacgagttcatgatcggcggtgagaaagatcgctggaaaaagaacacaagcagcaggaagagcaattccaaattctgtctttaccatatcgctacagtaaccaactggggctcctctctttttcttctttacaaaattattaaaaaaatcatttaaatattcttttaaatcgtaaaatgtagcattttatgtatcttcattttagtattctcatttttcctttaaattgtgagaataaattctttcttattttatttgttatttctttttgtaaaatattctaacggtaatacaataattagagttcaaaattttgaaaaaagcgtgtgcctggaccagggttccttgttggatcttgatctgcatttccaggacaaaaatcaggaaaattcaggcccaggaaaaaccaggcttgtcgagacttgcatttttgaaatttaaaataaa

SEQ ID NO: 77014 - DNA, 511 bp, Heterodera glycines
  Genomic contig location: Contig_ID=SeqID_13191; Location=249..759; Strand=-
  SCN-specific regions: Sequence locations=1-23,45-64,86-302,429 -435,457-511
atgttgctggcaattgtcttttttgtgtgttccattgcttttccccaaccaattttttccgtgataaaatcaaagccccaaaatttggtattgatcgaccgccaaatttatgagcaaaaattggcagaaaatgatggcactggggaattgcgcgagtttatccaaaaattggaggaccaaaacgaaacgatggccaaagtgatagaaaaatgtgaagcaatcgaagaacgggaagacgcgaaattggcccaaatttacttaagtttaagaacaaaactcggagaaataaaaggaggagaaggtaattgggtaattaaattaattaaggatgatttaaatgggcaattaaattaattaccgaggtaaataagtaattaatgagaagaatggtaattgggtaattaatttaaaaatttaattataattaaagtattagaatctgtgtgtgatgaagcagcagttgagagactaagaaaaaatgcggtcgaagcagtgtttctgttagccaaac

SEQ ID NO: 77015 - DNA, 247 bp, Heterodera glycines
  Genomic contig location: Contig_ID=SeqID_13193; Location=129..375; Strand=-
  SCN-specific regions: Sequence locations=1-47,69-247
atgcacagtgtatttgcgaaacttggatggacaagtaaccgaaaagctgctggaggaactcttcgtccaggtgctcatcgttctattgcacttaaggcattaattgcatacaaaaaggtccttggtttcaattagcaacctgtgctataaaagtgcctaattatttaaataatttgtcccatatgaatattaagattataggtgctgacgtaatagataaaaaatctgtttgtaattgcttattaaa

SEQ ID NO: 77016 - DNA, 611 bp, Heterodera glycines
  Genomic contig location: Contig_ID=SeqID_13194; Location=438..1048; Strand=-
  SCN-specific regions: Sequence locations=1-398,428-611
atggagctccatcaacagggagaacccggcacggaaaaaggaacggaaaagttggagcaagccaaactcacttttagtccaccgcccgctgctgcgaatgaagaagcattgtcgatcagtgaaagtgatgcaaacgacgaaaaggaggacaaaagcaatagaaaagaggcaaaaagtaaaagtgaaaaagtggaggaaaaagcgaatgaaagcaatgggaaaacggagaatggaacgacggaggaagaaattgggcaaaatgtggcagaaaaggcagagcagcagagagaagaagcgaagggccgcacaattgcagcgattcgaaaaggagggaatggcgcgcgatctctcccaccgatcattgacgtcggtggcatagcagcggaggaagcaaacgaagaggaggaacagaaaaaagagacagatgagaaagggaagacagagctgacatggtgggacaaaattgtgcttggattgaggtgtgcacgccacgactgccgaggtgagaaaatttgaatttgcgtaagaattttggtgtttttttggaaatagaacgacagtttcagaaacattaattgtgaagaatgaacagcttccgaggatgatcaacg

SEQ ID NO: 77017 - DNA, 405 bp, Heterodera glycines
  Genomic contig location: Contig_ID=SeqID_1955; Location=78..482; Strand=-
  SCN-specific regions: Sequence locations=1-44,75-130,152-295,322-405
atgctcaataaattttatctcgatcggctcatcgaaaatggtcaaacaggtaagaaaaacatattttgaaacttctataacgtttttccatgtggatcatatttcagcatatttcgagaatttatatgcatattttatgtgtataatttttaatataaaacgcccatttgagtaccatgtgccaacgccatgcgtatgtgccggcgatgatcagtgagtgcatcgctgatacgcactgacggcacccccacaaagtgtccaagccacgaaatgtccaaaagagtaaaaacccacgaaatgtccaaaatttttcaaaatttataaaaacaaaatgagtaatttaggatttttattcgagacttggacatttcgtgggctggacattttgtgggtcagcggcactga

SEQ ID NO: 77018 - DNA, 1282 bp, Heterodera glycines
  Genomic contig location: Contig_ID=SeqID_1957; Location=891..2172; Strand=-
  SCN-specific regions: Sequence locations=1-1,23-298,323-403,425 -426,475-723,745-977,999-1114,1136-1218,1240-1282
atgtccaaaaagttggaggccaaaaagtattccttgaccctttcaaagtcaacgtcgaagaattggcgttcccaatcggtgaatttgaaccaaatgcgcttaaagtggcctcttttcacagtttgctttgaagagcactcacttcctgcgtcaccgggtcctccttgacaattggctcggcaaggtctgaaaaggagccgaatttttgtgtcaccaaaatttcagaaactcagttggcccccgacgatgtacaaacaggagacgggacataatttagcagccgaaatttcgcagagacaaaattaaaaaaaaaaaaatttttcagcgattttccatgaaatatatggtgattagtaaattgtttcgaaaatttttccaaaagtcgataaaaaaaaaatttacaaacattttccccttggaattttcatataaaaaattttaatatttttttcttgaaaattttttaaaaaatttcttcggcgaaatttgggcagcgaaattttttgcatccgtaaaaacactaacattcactaatatttacttatcctatggaggtggaatagtgtgctcgactgtttatttacccgttgggaaattaaaggattatgaatttatcaattttagagggggtaaaacgattctggtaattattatgtttaattgtaagtgccaacggactgtgatgttcgcgcatccaagcaagaatctgttgaaaacagtcgctggtgatgtcattgagcggaaaaacgaagtccgcaaaattctcttccgttttttcttccatgccgagactttccctaaattgaaatacgaattggtcattaacttttatattgtttttttaattgggcccattccatcaaataaagccgcctgaaaatgatcatagactcgacgaccatgcaaaattcggttggggtcgttttagtctgaacacatgttttttgggtataacctttttctttgccaaccaaatcaaaacatttttggtatcactcgatagccctaaatgtcttctattagcctgcaaaattgctaaacatttcgttttgtttaaaaaaaaagttatgaccaaaaatgttaagaaaaccatgttttttgaaattttctggccataacttttttaaagcataaagaaattttcaaaaatttgcaggctaatagaggacatttagggctatcgaatgataccaacaatgttgaaattggttggcaaataaaaaagttatagccaaaaaacaaagggataataatcaaatattgccagatttcgtcaattaaa

SEQ ID NO: 77019 - DNA, 804 bp, Heterodera glycines
  Genomic contig location: Contig_ID=SeqID_1957; Location=1389..2192; Strand=+
  SCN-specific regions: Sequence locations=1-40,62-310,359-360,382 -462,487-762,784-804
atggaagaaaaaacggaagagaattttgcggacttcgtttttccgctcaatgacatcaccagcgactgttttcaacagattcttgcttggatgcgcgaacatcacagtccgttggcacttacaattaaacataataattaccagaatcgttttaccccctctaaaattgataaattcataatcctttaatttcccaacgggtaaataaacagtcgagcacactattccacctccataggataagtaaatattagtgaatgttagtgtttttacggatgcaaaaaatttcgctgcccaaatttcgccgaagaaattttttaaaaaattttcaagaaaaaaatattaaaattttttatatgaaaattccaaggggaaaatgtttgtaaattttttttttatcgacttttggaaaaattttcgaaacaatttactaatcaccatatatttcatggaaaatcgctgaaaaatttttttttttttaattttgtctctgcgaaatttcggctgctaaattatgtcccgtctcctgtttgtacatcgtcgggggccaactgagtttctgaaattttggtgacacaaaaattcggctccttttcagaccttgccgagccaattgtcaaggaggacccggtgacgcaggaagtgagtgctcttcaaagcaaactgtgaaaagaggccactttaagcgcatttggttcaaattcaccgattgggaacgccaattcttcgacgttgactttgaaagggtcaaggaatactttttggcctccaactttttggacattcgttcattgtacctctact

SEQ ID NO: 77020 - DNA, 1242 bp, Heterodera glycines
  Genomic contig location: Contig_ID=SeqID_1958; Location=783..2024; Strand=+
  SCN-specific regions: Sequence locations=1-281,310-379,402-410,433 -543,565-1242
atggcattttcgtgggagaaaatgcaaaaaagttagacgaaatttgaatttttttaaccatttgccaaatttttattaaataaagaagatttgctcaatttggaggtgctgtaacatttcgacagtggctgatttcgacagtgacagatttcgacagtgactgatttcgacagtgacagatttcgacagtggatttcgacaatggctgatttcgacagtgacagatttcgacagtggatttcgacaatggctgatttcgacagtgacagatttcgacagagaattaaattattattttattattattatgtattcacatgaaccatccggaatccacggtttgcccgaagcaaactgcctcagggtcaaactgacccaaaaagtcatttttatttaaaaaatcactatgcttaatgaaaattgatatatgtgtgtagtaaaaataacgcatctttctcttattttcaatgtggtaaaattcagtggtactttggccgttggatagtgataaggccggtcgttcagtttatctcgggtggtcaattttcttgggaggtcattttgataagagaatttggagaggaattgttttggcattcccgaatgctgatggtcattctcgagttgtaattgctggtgttcatcatttgctgtttttccctctattccttttccaaattcattggctcatggctcttctccgattcgcagaaactaaaacaaatcgcgggaaaattcttctatctcgtggtggatatgagtacacttttgaggttaaaaagctaatttaatttggtgaaaatgttaaacggcaagttctaaaggcggtttcaaaaactgaagacggaatggagtattggcgttgccctaaccgtccaccttattgcccagggcgtgcttgtgtacaatgccgcagggaagtcgatgacgatgggtcgcaatataaaattggacgaattaccgggcagcataatcatccacccgttttgggtggtcatatggtagaaatttaaaatgtaaagtgcgttaagtagctaattaggtgagagaagcatctgaacgtctccgacaagaggcgaaaagcgaatttccgacaacaagccgtaacatcatcagagaagttcggtcgaaccttagtgatgaggttcgggcaatcagtgcaccatctgcagccgacatgaggcgaacatataattatcagaaacggaagcatcaggaagaggcaaaatgataatttaaaaa

SEQ ID NO: 77021 - DNA, 179 bp, Heterodera glycines
  Genomic contig location: Contig_ID=SeqID_1959; Location=31..209; Strand=-
  SCN-specific regions: Sequence locations=1-179
atgactatgcattttctcggaccgggtcagtttagtacgtgccaggaaatttcgacagtggctgatttcgacagtgaccgatttcgacagtggatttcgacagtggctgatttcgacagtgaccgatttcgacagtggatttcgacaatggctgatttcgacagtgaccgatttcgaca

SEQ ID NO: 77022 - DNA, 938 bp, Heterodera glycines
  Genomic contig location: Contig_ID=SeqID_1959; Location=745..1682; Strand=+
  SCN-specific regions: Sequence locations=1-110,132-295,358-548,570 -585,617-938
atgaaggaaagatggccccataacaacagtcatccctccagtgttggatgtggtctagtggctaagacaacggatccacgtaaggggccacgagcggcggttcaaatccggccttacaccccaatttttcgcctaaataatagttaccatcgctgaaaactttaagcattccttttaacaaatttattgatgaatgcatgatccctggttttttgtcggagttgaatcgaattggtcattttatgaaaataaaacggaaactcaagtccacaatttgcgagaaagcctatggaagtatataaaaataaataaaacaaagaattttcaataattaactaatatttttaaaaattatttctcagtgacgaaatgatcggccaccgttttaattgggatttaaaaatttataaatttgataccacaaatggttgaaatagcgaagacgaattcggacaatattacaattttagcactgtccggcacagaattagggtcaggtgactaaaaataaaacattttaccggaaaatggattgttctgttttaaactcaatttaatttaaaaattacagcgaaaatgaaaaactaaattatataaaatttcaataattttttatgcatatttagctaaatacaacatcaaaataaatttaggcttcaatgcctttgttcatttatgtgtcagttttatttctgatagcacttcaaaggcaatgccagtcaatggcactggatcaatcattacaatgtttgtgccctctgcattgaacccaattttctcaatttgcatgataaaaagctatcgaagtgcttttgcaaaggaagcgctgaaaattggtaaatttcaggaaatatcgtatttccttcattataagcctcctctcgattagaagccaccctcccctcgaatataagcaccttcttgagggaggttgaaca

SEQ ID NO: 77023 - DNA, 1396 bp, Heterodera glycines
  Genomic contig location: Contig_ID=SeqID_13195; Location=888..2283; Strand=+
  SCN-specific regions: Sequence locations=1-154,177-276,298-656,680 -781,803-805,846-1038,1062-1249,1314-1323,1350-1396
atgcagtcattgtcgaaacgcaattccaaacagcgaaagttcataacgattttcacccagatttggttcttttttcaaccatatgcatttgtcactaaatacttctgcctattattgccgaaaacaccattattagtgatgggtgggacaggatatggtggaataaataacatgcagcagcagtacaaccatcgttttgtaaatcaccaattatacttcgtagacccagcttactctcaaatacacacccagggaattgaagcgacctgaagggctctaaatcaaagcttaaaacaaacaccttcataggactaaccctgaattgttgcgaacctatttgtaccagaacgcatttcgtggttaccacataagcataaaaatattttagagaaaatacgtacaactatactgtttaaaatattttttcctattttttaatgtttatttgaaataaaccaatttggatgggaaaattgggtgggacgcgtaaaatgtcaggggacgcgtaaaatgtcatgggacgcgtaaaatgtcatgggacgcgtaaagtatcatgggaccgtaaaaccgactagaaccggctttttttgcttcacttataatacccatttattttttatttctgatatcgtttcttatttcagttttttaattcgttttttaattacataattcttgaatttatttccatgaggcaaattctgtatcaaaaaaaaaaaaaaaattgaccaaaaaaagtgaaaaagttttcaaaatcgaccacttttacagtagcgccaacattttcattgtaaaaataatcagattcttttgcatttggtttaaattttaaaaatgaatttaaaggtttgacatcaatcgacagctcaaaatttttgaaacaaataagctattgctaagcgctgtaacaatttttaaatctttgccgccatatttaaaccgcgaaaatttttttatgaatttatctttttcacattttaattttcttcaattttttaataatctaagagcttgtttcgatattttgggttgattttctaattaaaaaatatataaattttcagttttcacaaatttccatttacccgggcagcacagtgattgtctgcaaaaatatgacggctgaacatagggtcaacatttgccaaacatggagcacaagcggcggatgctgctcaaaaagcagttggaccgaaaaactgacgggcccaatcattgaggacaaaagaattggccaaaaagtgcactgaattaaattttttgaaattattgaattaaatttaaaaaatattttttaattaaataattattatcagaaagttaatttcttttaattgaattttctaaaaaggttaattaaattctgtgcaatattttaaaattaaatggaaaaaga

SEQ ID NO: 77024 - DNA, 550 bp, Heterodera glycines
  Genomic contig location: Contig_ID=SeqID_13195; Location=2950..3499; Strand=+
  SCN-specific regions: Sequence locations=1-180,227-284,309-495,548-550
atgttcaacggaatgtggaccaattgttggccaattgtgcgtactgttgtccacaaaagcatgttggtcagcaataagcacacagcagttgccggttggagaacattgagcagagcggacagtaccgataaggtaattaaagcggagttaagatggggaataacctgtaaaaaataagcgaaattaaatttaaaaaacaaatgtaaataaaaaataatataaataagaaaagggatctattaatattaacctaatttaaaaaagggacccaactttaattagccaattaaatttaattaatatattaagaaaatagacttattaacacaacttaaaaaggagaaaaaattagccaattagtataatcacaaatggacttattaacgtaactaaaaagggacaaaaaattaattagccaattaaattaatgtaattaagaaaagggacgtaaaaatttgtttaaaaaattaatcttaaatgtaagcaacaaagaggtatataatagatttatttaattaaaaatttatcataaataatgtatttatatgta

SEQ ID NO: 77025 - DNA, 583 bp, Heterodera glycines
  Genomic contig location: Contig_ID=SeqID_13197; Location=492..1074; Strand=+
  SCN-specific regions: Sequence locations=1-362,385-583
atgccgggggcacaaaatgacggaagggattatatgtttgccatttttaagcatgtttcctcgtccgccaaggtcgacattggcactgtgccatcgtcggaaaccacggcggcagtgtctgccaatggtacggtggccactaccggtgccaacggcacatcggcggacaatgcgacggcggaaagttgggtcggcaagggatgtgtgagttaacaaaacgctaattgattgatccgagtttcgcactttggcacagccaacagaagagtcgcttctccaattgtacattaatgcaattagggagataattaactaattgcctccttggcttgtgattagttattgattgccatttccgactgtaatcaattaattaattaatttcctgcccattttcagggcgcatttgacgtcgctgtgccgccattggtgcccattgtggcggccacttttggttagctttttccactaattagccgattataatgattattctaattgtaattaattttaaaggttgttttgcggcgcttcagcaacttttgctgctgtaagaagtgcgacttggggacgaaaaggagca

SEQ ID NO: 77026 - DNA, 2590 bp, Heterodera glycines
  misc_feature (2506)..(2506): n is a, c, g, or t
  Genomic contig location: Contig_ID=SeqID_13198; Location=125..2714; Strand=+
  SCN-specific regions: Sequence locations=1-54,76-983,1006-1457,1482 -1594,1625-1678,1700-1851,1874-1959,2190-2409,2431-2590
atggccatttgcgcacacttttgggacacgtcggcccaaagtgcggagtgtgtcgggctcagtttgggccctgtcggttactccaacgacgacattgcggacgcggtcagggaaaggctggcggagatggaactgacgatggaacgcggaaaattcatacgattcactgtggacaagtcgagtagcttctccagctacaacgcgagaccatcatttttgtaaggcacagctcacaccaataagaaaaattcagtcggaaattgctttgtcactctttttaatcagcaacgatccctctgatcagccttccctttccttctgatcagcccttcctttcgctctgatcagccctttcccttccctctgatcagtccctcccttccctctgatcagtcctttccctctgatcagtccttcctatacctctttttgttcagcaatcctttcccattcgtcggtggcggttcatttgcctctgccatggctttgccattcgattggcaattggtcgactgttcgccggaagtgttggaagcgttttttaataacgacgccgaagaggacgacgccggcggagaagaggctgaaattggacttggcgaaggcatcgaagtgaccgtttgcgcagcacggcgattggagacggtgctgaggacagtgctggagagggaccagcaaatggtacagctgcgtaaggtaatgccgacactttgtctcactttggcttcattttccccaattccgcgcgcagcgtttgttccttctgttcggccaattcgccttctcccactccgcttgcaccgctctctctgcgcgcaatggcggcgtttcccttctctttcccgccaatgtccgttggcattcgcttgagcccgcttacgcgcgactgttcactctttgcgacacaattggcgccgtttgcgacgaattcaaaatcgaacgaatttgtgaaagggattggcgaactgtcgaaacggctttggaagtaaatgaaaaagcaattggcactcattcattcatcccatcccttcatcacagatatccgacacttttcacaaatttgtggccaaattggagcagcacggacagccgaccatttctctgctgtttcccggtctcaaccttttgctcagcacttttcaggtgattggtcacttctcattagacttttaaacattttgaaagtccgtttttcttcattttatcataagttcgtcaatttatctttcccccaccccccaattcagcaaaacttttccgcccaaatgccctcactaatcgatgtcttttctgatcaaattcgccgctctttctccgatgttttgagtttcgatcgcaattcgctgtttctttgcgcttcgatgttggacccaaaagtggcttatttgttggtgcaggaacagaagcaggagggcgtaagggcaattcggaaaatggtaagtcaaaaaagtaaaagcaaaaataataataataaataaaatggcatcgagcaacccatcaaaatcaaaacaatgccatcatcactcccctaaataatgccagttccatcttctaccgtggcagtgccgatgacttcccatgacaattattccatctttttccatggcagtgccatcgcccttttccgtgccattcctttccaacttttccaaaatccttttcgcttcttccaattttattcttttaccatttttccgtttaggtagaacataaaatctccgacccatcaacacttctccgcgttcgttcaaacatcgaaaggtttttggacgtcgtcgagtcgccctttggcttcggcactattcgccgggtgcgtgcgccgataattggcacggcaaaagagcaaaacgcaatgggcgaagaaagggatcaaattgacatggaaatcatggagtatttggacattgtacagttggattcgtccgaaagttgcgcacaattttggacaaagcatggacaagtgagaaaggaaagggaaagagagacgataaaggatggagagagaggagagaaatggggagagataaagaaagaagtgagagatgcagaaatggggagagtgaaaagaggagagctgaggaaagagggagaaagattaagggaagagaaagagagagtgaaaagaaaggggaagagagagggggagagaaatagggaagaggagaacgaaagagggtgagaaagagagaatggtgggaggaagtgagaaagggaaaaagaaagaaactgaaagtgaaggaaaagcttggaaaagcatcttttaaacattttgctggccttggtttttcattcgctttgcttccctttcagcgctttcctttgctctccgaaacggcaaagtccgttttggccgttccggcgaccgctgcgacggcgaagcgattgctaaggcaaatttgggaaggcgttgagagggacgcggaggtgggcgtgcggaaagcgcttctccgcttcaatcgccgcttcgtcgacctcgcggaatgaatccctatttgaagcacctccntccattgatatttttgactcattctctcccactttgtttttgttttttcttacaaaccattacaatccatttaaaattgctaga

SEQ ID NO: 77027 - DNA, 445 bp, Heterodera glycines
  Genomic contig location: Contig_ID=SeqID_13199; Location=10..454; Strand=-
  SCN-specific regions: Sequence locations=1-151,174-445
  Gene Ontology: Mol. function=signal transducer activity; Cellular component=cytoplasm; Biological process=signal transduction
atgaacaatgcaaacagtggaggaccaccgcaaatgcgcgggggtggcattgcgcagcagcaacaaacggctggcaatcatccacagcagcaaatgctaggctgcgccggacagccacaggacccgaagacgcgcaagttgatccaacaacagttggtgctgctgctgcacgcacgcacgtgtcagcagatcgaacgggtcggtggttcaatttccatgggatttcatttttacaattggttattatttccccgtaaatctctttttttagtctgaaccgctacaaaaccgtgcgccctgcacattgccctactgctcggtgatgaagggcgttttggagcatatggtcggctgttcggccggccggcagtgtcagtacgcgcactgcgcctcctcccggcaaatcattgcgcattggaagaactgtaacaaggacgactgtccg

SEQ ID NO: 77028 - DNA, 662 bp, Heterodera glycines
  Genomic contig location: Contig_ID=SeqID_13202; Location=407..1068; Strand=+
  SCN-specific regions: Sequence locations=1-74,110-243,279-366,409-662
atgaccagattggtgaataatttcaaaaaaggagcaaagtgccaaaaggtaattaatggtgccattgagtgacctaaaataataaaaataattaattaaaattatatttgactactttgtcttgatggtgacataaatgactgaaaaattaagggcaattcccaatgtggcgatgatacccaatatggcagcacagctgatcaatttccatttggagtttcatttgcgaattccaaaaagaacttaaattcatttaaaaatagtaattatataaattagtttgttaattaccgttaaattgtttatatcagacattatttcaacagttttagtaataacaaacaattaacagaaaattaatatttggttgggttacaacttttcttccctttatttccaaaattttctcaatgggcttggggcttcgttttccaatttggggtgtgatttaagagtgccaaagtgaagagtgggcgaatggcaccatactttataattttttgttttgttttgtttaaagtgttgtgaacaattgagcccatgacaactatggcgtgataaactcataaacttgttgaattgttcacacgaaatattttcagacattttctcgttatatgttgaaccggattttagaattttggtcgagttcgtgttaggga

SEQ ID NO: 77029 - DNA, 947 bp, Heterodera glycines
  Genomic contig location: Contig_ID=SeqID_13202; Location=1625..2571; Strand=+
  SCN-specific regions: Sequence locations=1-77,99-145,175-357,380 -584,624-765,806-917
atggcaattaaaattttattttcttttgtgatatttttcattttgtctgaacaaatttgtggcgtaaatccgcgtcagtcaaaaggaaaaagcaaatccttgaataaagttgaccaaacagaagaagaaggtaatgttattcggcatttaaaaaatttttaaaatttaatatttcactcatggataaaaaaaaatctaataatgctaaatatttttgaaaaaaatgaaattcatccgggatttagaggttgctgatcacacgaatctgacatctaattcgaggtcatggaccccaaaaaacccagggaataaattttcatgactatatattaaaaaattttgcaaaccaaaagggtcccccttattgtttttaatttttgataaaattcaaaaatggtgactttgcatatagcgcctaaaaatattataatgtattcctcagatcaaagcaatgtgcctgatgactgtatgaaatgcccgatttgtattgagaatgtaaactatgatcagctctgtttctgtgatcagataatggcggaaagaatttttggaagcaattcaaataatcaacaaaaaggcacgacaaataaaattattaattcaattttaaatataaatttaaagagtcccacgccttctgcattgaatgcctccggaaatacacagaagcggcacatgaagaaatgccattcgcacgcggtggtttaggactgaagtgtatggcactgaattgcggaaaccctctctcttggcgtttcgtctatctatttttaaatatattttgaataaaattaatttaatttaagaagaaataaagtaccggctcccggatcagctcaactcaattcaagcattggaaaatcattgtgcagaattctgtgtgttgtcagtggaaggtctatgcttggttaagtaagaaattttatttttaattaattatataatta

SEQ ID NO: 77030 - DNA, 208 bp, Heterodera glycines
  Genomic contig location: Contig_ID=SeqID_13204; Location=692..899; Strand=+
  SCN-specific regions: Sequence locations=1-124,149-208
attttctaaaaaaataggagttttgggggcgcggcggtgccgataggcgccgccgggaaaaaaaattggaaattttgatcatttataaacaggttttcactgaaaattagccaatttataggtaaaattttgaaaaattttatgggaatttaatccaattcttaggggtgtaaaagtcgcgtttcgcgccaaaaagcgaaatgcgaaa

SEQ ID NO: 77031 - DNA, 966 bp, Heterodera glycines
  Genomic contig location: Contig_ID=SeqID_13205; Location=85..1050; Strand=+
  SCN-specific regions: Sequence locations=1-321,343-757,789-792,825-966
atgtgcaaatttgcccccggctcattttgtaaaaaagcactaatcaacaacaattttcttttttaccgcttattacacaaaacaaagcgtgcggatttttggagacgaattgttagtaaataaaataaatgatcaattaattaactgtcataaattaatccctattgataatttgatgtttgttcagaatgaagccgagcgagaagaacatgccttttacacgtatcaagagcgaaattaccatgcacttttaccaagaattccaacccaccggtgcctgggcacaatgttttgtcggctcgacccactggcttaccttgtgcacgaagcagatgatgaacaaatggccgaacggaccatgtacatttcgcttcgtgtcggaacagttgcgcaagtattatattattaatgtgtttggtgccgagggcctttaccgggccgcctgggcattggctctgtaaactctaaaaaaaaccgatgccacgatgtttagcgaaactgattttatcgggcggcctgggccaggcaaatttgtctaaatccgctcgagccggttaaccaaaaataatacctaatttaatacaaaattaccaacaattaatgattaatataagcatctaattttgccctgatctgtttgttacagagattggtcttacaaaatcactttcaaaaccaagaagaccaaatacaggaggcgttaaatctggtagcatttacttttatggaactcccagctcaggaaggagttgtaagaaatttaatttaatttacattttaatttaattaatcaaattatgtaaaattttttaatatttaaaatagttttgaatttattgtttggtttaaatacaaggtatgggaccttgctgaggtcaactttaatgaggatttaatggcttaattttggacgccgttgatgaattatttgcatgaaacccttgttgaggtgtgttttaaatataa

SEQ ID NO: 77032 - DNA, 706 bp, Heterodera glycines
  Genomic contig location: Contig_ID=SeqID_13208; Location=1080..1785; Strand=-
  SCN-specific regions: Sequence locations=1-706
ctttgctcaacgccatcaaaaatgggcagaacaattacacattggaggtggctaacaaagtttacgtgaaggacggcttcgaagtgctggacacgttcaaagcgcaaattgcggagcattacgggggacagttcgaggcggttgattttgcggacagtgtgggggcagcgaaggtggcggggcggaggagaaattgttggcatatgccaatttggaaattgtcgggaagaaaaagtgccatccacactaataattcaaccccaaactaaaattctaacattggctcggtgaaaaggatactctcgctttctttggcacttaaatcttgttcaaattttgctaaatgtgaatgggaataattaaattgtttttttttgctacattttgcatcctcatcagaaaatcaacacatttgtggaagaagcgacccacgagaagatccatgatctgatctcgtccgactctctgggcgaactgacgcggttccattcaaaataaacaatggataatttaaccgaatttgattatcagaaattaaattgataaataaatgtttccgaatttcttcagtttggtgctgatcaacgctgtctatttcaagggcaattgggcggacaaattcgactcgaaattcaccaaaaagagaacattttatgtggacgaaaagaacagcaaagaggtgaatgaatcacaaacatttatttaa

SEQ ID NO: 77033 - DNA, 4784 bp, Heterodera glycines
  Genomic contig location: Contig_ID=SeqID_13211; Location=18..4801; Strand=+
  SCN-specific regions: Sequence locations=1-1027,1051-1257,1279 -1518,1540-2784,2809-3329,3351-3904,3926-4293,4316-4368,4390 -4572,4594-4645,4667-4784
atggcatttattgacccaagaacaatgattttgagctctgatgcgagactggcaccatgctcagaataccgcaaacagctcatttttttgcgtggttctcttcatgaagttgatcaaattgatgctcaggtcaagcaggtgaatgccaatcgcattgacggtttcagcctaaatctatcattggcaccgacttatgctcgccattcttttcttcatcttgcccttgtgaatgtgtctgactttattggccagttttacgacgccaatttcgcaagagaaagtgaactcacattccaacttaaaagtgaggacacggttataacaaagactctgtctgaacaatgggagcaggtgagtgagtccattcgcagcaaaatgtttgggaattgggaacaaattggcaaaatcgtcctgtctataatgataattattgtttttacagactttttgatccggtttggattaatgattagagatgaatacgttggcagaggaacaacacgacgcatgacttttggtggaaataaaacgcagaaaattgtgaaatctccagcacacctcaacatgatgaatctgaatgcatctgtagaatttggtaacgaaattgagctcagtcccgttaagctcattgaacccgcccaaacccaggcatacaaatttgcaggaaaacgaaagagaccagtaaaaaggactcgcttcagttttcgggcgccaaaagtactcattggacttttagtaatttttcttcccaatgcttttgcaaatcccgatgtgaataatcaaatctcaattcaattcacttctccttcaatgatttatctgcttatcattccatttctgatttttatcactatttcagtactgcttcgctcaaaacggaattcagaccttccaatgctcccaaatctgaatgcaatttctccgcatcacgccgtggtgcagacattgattaactccacacccgtccgctgtttaatggacactggcgcaagtttgactgttgcaccacgatcaattgcggatgaactcaattgtcgaacattttcatctgatctggaggcaatgagtgcctcaggccatgtcattcgcctcaaggaatatgctcaggtgaatttgaacattgctgggtacacagtccgttcattaatttattttgtggatgattccgaatttactgtggcccgggattacagtgtaattgtcggttgggatgtctttgaaaaattgcccccaataaaattcgatcatttaaacgggaaattttttgttgggaacaacgaatccaaattgtgctatcgttcaattcttttactgaacgatttgcgcgtgtcggcagagaaaaacacactcattccggccgactcccaaatattggtcgatgcttcaatcgaatcatccccaaacccaaaaaattcattttgcattgatcgacctgacataagtcttattaagaagggactgtcagtcattaatagtgtctcgcctgcgggccagaaacaaattaaagtggcagtggtcaacccaaccatggaaccaaaatggatttggaaaggaacacatttggcatttgccaatgaattgttatgtgaccgaaatggacttttgaaggaaaatagcacaaaagaaattcttacgttaaattctgaacgaaagaaaatggaaattgacccaacatttgtagttgacttttctaaggcaatggttgaaggcaaagatttggaaaagctgaaggcattaattgaagaattttcagacgtttttagtaagtttaggtatgatcttgggcttttcacagctgctgaacatcacattacaaccacaactgaggaaccaatcgcatctgcgccaagacgaatgccgtacaaatacaaagaggaattgaagaagcacattaatcagcttttagaagccggagtcatggttgagtccgataccccatgggtaaccccaattgtcattgtgcaaaagaaggacggtggaattcgtccctgtttagactttcgcaaacttaacgaagttacagtgcccgacaagtaccctctcccacgccttgacagcatcatggaaagggtcggaaactgtcaattttacagctctctcgacttggccagtggctattttcaaattaaattgagtgaagagacgtcaaggaaatgtggcattataactgaagacaaagtgtaccaaatgattacgatgccatttgggctgaaaaatgcaactgcagcattttcaagggccatggctatcgttttgtctggattggaggatacttccttggcctacgttgatgatgtgcttattttcacgaaaagcccaaacttttcagaacacctgacggcggttaggaaagttttggagcgttttcggctttacaatctgaagcttagcccgaaaaagtgcatttttgcctcaaatgagatgaattttcttggatttgttttaacagctgaaggttttaagccaagcttaagtagaatcgaaattctcaaagaaatgcccgtgcctttaaatgttaaggaagtaaagagagtgctaggacaggcaggcttttacagacggcacattgagaactttgcaatggtcgtagagccattgctgaagcttacgaggcaaggcaataaattcgaatggggcagggaacagcaaaacgctttcgacaaaataaaagaattacttactcaagccccgagtctaatttttccagattacgacaaagcatttcacattttcactgatgcatcatcgactggacaaggaggagttttgatgcaaaaggatgacgtgactggcacattttctgccatttcctattgcagcagaaccctctctgctgctgagaggaaatggccggctgttcaaattgaaatgagtgctataatttatgctttaagagaatttagaacgttcattttcatgtcggacattgaacttcacacagatcacaaacccctagcgtttttgctgaagaaatccgaaaccaatcagcatttggcaaggtggctcattgaattgcaaaactatcaagttaagattgtccacgtggcaggaaaagccaacacattggctgatgcactttctcgtgccgctgaggacaagcccttgtcggaaatatacaatgtggatgaactcgaggacattatcgaatttccggtctgtctcgctttggcagcacattccagggtggtcgcgtacccatttttgcacactttgaccatccgacacgaggatggaaacacttacgaagttaatttgttggaagagcaggcaggagatcctgaagctgcagcctacattgcgtttgtcagagatggggaatttccagctgatttggatgagaaagaaaaagagttatttgctgtaggcactgccaattacaaattaatttcgggaattctttattttgaggacaaggtactccctccgaggatatatgtcccaatttcgttacgtggactcatttttgaatcatttcactcgtctcttttgggtggtggtcatttgaattacaggaaaacaattgccaagtgcaaaaaatatttttggcccaaaatgtactctgacgttttaacttgggtcaaattgtgtgtcacctgccaattgagacacaatccaacacccgcgtaccgggaagagatactcatggtgccagccaacacactttttgccaaagttgggctggacttggccggcccctttccagtcactcaaaaagggaataaacacatttatatatcgtttgttggttcaccaaatacgcgatttctgtcccggtccccgacacaaaagcacaaacaattgcccacacttttcttaccaattgttacttaaaatacgatggttgtgttgaattaatcaccgataatgcttctgcctttacttccgaatttttcagggaattttgctccatgctttacattgacaaaaagtatgcctgtccacattggagtcaaggcaatgcgtcaacttaacgcacctttcggacatttcacaatatcctggccaagtacatttcgaagactcagcctgaattcgatgaatttttggatgcggctaatttctgttataatacgtcagtccatgcttcaacgggtgagactccattttttctaatgttcggacgtgacccaattttttgtgttgatcagatcattgatccgaaagttcgtgatccgatagccatttcggatcgtaatgaatttaaacagaagctggtcgttgccataagacacgcgtggcacgctgcagctgatgaatatgcaaaagctcagcgaaaaatgaaggaacaatatgacagaaaggcaaggccacagcaaatcacaattggtgaccgagtgctgatcagaaactacgacggacgggtaggaacatccaaaaaatttcaattaccatggcgcagaatttttcgtgttatcaaaattgagggcatttatgttactgtgatcagttgcacttcgccaaattcaaacccaaaaagacttcacttaaatcaaattaaaaagtgtttcgaaattttgggccctccctgcactatgccaacacaaccagttgaagagaaaaagtgccttgaaaagacacaaaatgtggaagaagtcagttcggaaaggtccggaatccgaaatgaaatggaccccgaatcccgggaaggcgaaaatttagaggaaatccacgcccgagggccggaaacaagaccagaaattgaagcagatgaggagaaaaatgagcagaaaaaaatagatacggaaccaagaaagtatgaccttaggaaaaggacgagaacttga

SEQ ID NO: 77034 - DNA, 317 bp, Heterodera glycines
  misc_feature (229)..(229): n is a, c, g, or t
  Genomic contig location: Contig_ID=SeqID_1961; Location=2181..2497; Strand=+
  SCN-specific regions: Sequence locations=1-159,190-317
atggaacaacgcaatcaggaaataaagacaaagagaaacaagcaaaagctggaacatgaaggtgcactttatgttcttcaccaaatcagtgacgatggacttcggaagtattggcgctgcgagtttttcggacctaacaacaaatgcaaaggtgtatgcaaaaataaaatatagattattttttaaattcagggcgaattcacactgacattaatggtaatgtcctcanaataattggaagccacacatgcgacatgagtgccgcacaagtggagtgtcagcgacgcgtgaccccagctcaagcggcgtgcagttga

SEQ ID NO: 77035 - DNA, 1983 bp, Heterodera glycines
  Genomic contig location: Contig_ID=SeqID_1961; Location=3080..5062; Strand=+
  SCN-specific regions: Sequence locations=1-521,543-622,650-739,764 -792,814-838,863-1051,1116-1179,1202-1983
atggacaattacaccggaaggccgtggttcaatggtggtttgacagtgccacggttcgcaaaatatcgtgccgccgatgcgagaattcttcgactcttgcagagctacaatgccatcaacaataaccaggctcaccaaaatgatcacaattaccatgcccttatcaatgttaacccctataacatcatcaatttctccttggtatttctcggaattatgagatgcgcccgtaatattttcaatgttttgttatttttttgttgttaacacattgacaaatctgttatggtgttaattttaaagaatttttgagaaacaaatcagaattggatcaatgtaggacaaaaacagcttgccagactagaacgaccctctgactaaaccggccagactaaatcgaccctctgactaaaccggccagactaaatcgaccctctgactaaaccggccatactaaactgacccccaccgcaattccggcactttttcggcttgaaaaagggcaagcgcgcctctaattctatttttccaacccattttgaacggggggcggaagtttgggcaccgggaagtttgggcaccagaaatttgggcaccgggaagtttgggcactaaatttaggatttaaaaaataaaattatttttaattgtctataaattgcaaccatctaatttaaaagcatagtaaatttaatcaagttacgaatagaaagtttttttaacgaatattcactcgattaagcatgcttattttgctaaactgattaccattcattctataaaatgccttacatatatatgtattatttgtatcattacaaggctcagtatgttcaagatttaaaatttataaatttaaatagtattagacgggtctcttgtcatttcgggcccaactaagacggtattcagggtctaagtccataaccagtacatgtttaattctacgtttaaacaaccgtaagaattgactaaataataagaatgccaggtttccatataaaaactttttaattttcaagaacatagaaatttttgagcacaagggttgttaaatttactaaactttaatgatttatataacattttatatatttatattgttttatttttttgaaaggtgctgtaacatttcgacagtggctgatttcgacagtgaccgatttcgacagtgaactattttcatttattttactgttttccgacatttccgacagtggctgattacgacagtgaccgatttcgacaatgaacaaaattttaactttgccaattctaacatttgaaaacttcaaattgatatcgaaaataacgacaaaattgtgtaaaacgacaatgctaaaatcctataaatgtttaaaagtgcagatgataagcgcaagcgcgaagaaattggatcggatcacgattgaaaaaatcctgcacaagtgcttccaagttttggtcttgacgaatgtatttggcctttctcgtttcatgaggccctttaatgccgtcagccggtgcaagcatcgacttcccaacggcactgtacacaagcacgccctgggcaataaggtggacggtttgggcaacgccaatactccattccgtcttcagttttcgaaacagccttagaatttttcgtttaacattttcacgaaattaaattagccttttaacctcgaaagtgtagtcatatccgctacgagatagaagaattttcccacgatttgttttggtctctgcgaatcggagtagagccattggtcaatgaattcggaaaaaaacgaatagagggaacagcaaatgatgaacaccagcaatgacaagtcgagaatgaccatcagcattcgggaacaccaaaacaattcctctcaaaattctcttatcaaattgacctccaagaaaattgacctcccaatataaagtgaacgaccggcccttccactatcaacggcctacggccaaagtacagtacaactgagttttacctcattgaaa

SEQ ID NO: 77036 - DNA, 716 bp, Heterodera glycines
  Genomic contig location: Contig_ID=SeqID_1961; Location=5078..5793; Strand=-
  SCN-specific regions: Sequence locations=1-15,37-556,579-716
atgaattttcttaatagtgttaaatttttggattgcgaaaggtggtgaaaattttttaattttcccttaaatattttctattttttgttgtcaatgttttgtactgctctcctatttttacatttttatttcttcctcaggtggaagaagtgtccagctgggtcaattttgtcaccggatcagacacttacggccaccgttttgttgaagaggaggtgaacggcgcttcattgcttcgccttcagtttgagcagttgaaaaccgacctgaagctcaaactgggcccactcacaatgatttggagcagtttggaagaacttaaagaaaagcgatgagcaacagctgacagagtggaatttatggatcgatctctttgttgactatataattaatctgttgtccgttggctaatggtcacacaattctcctgtctttctatcacattaaaattggtgccaggaaatttcgacagtggctgatttcgacagtgaccgatttcgacagtggatttcgacagtggctgatttcgacagtgaccgatttcgacagtgaactattttcatttattttactgttttccgacatttccgacagtggctgattacgacagtgaccgatttcgacaatgaacaaaattatatttgtgtattagtcatttttatttaaaaaagtcactatttaatgggtgaaatttatatatgatgtagtaaaataaa

SEQ ID NO: 77037 - DNA, 293 bp, Heterodera glycines
  Genomic contig location: Contig_ID=SeqID_1962; Location=113..405; Strand=-
  SCN-specific regions: Sequence locations=1-7,29-47,70-257,281-293
atgagtaagtatttcatcctcatttgggttctcaatcgcatcaaagccttcagacaattaagaaaaagacttaattttcagcttcaaaccattatgaggagcttttgcaaaactttttcaccttgaacttcgtgttggacaattacgaatttaatattgccgcgaaggactatacgcccgagtatttttttaacaaaatatcaaagcaaatggggcgacgagttgacgaaatttgtcttactagtatgtttcctttatatttacaaaaagtaaatactgttataaactattaa

SEQ ID NO: 77038 - DNA, 123 bp, Heterodera glycines
  Genomic contig location: Contig_ID=SeqID_1963; Location=1..123; Strand=-
  SCN-specific regions: Sequence locations=1-123
tgggtcgcccctacaaggaattcctcgttcacggacaataattgcaatgtccgatcccaatcacggcaaattttcaccggtttaccaacccctttcggggaaagacaagcacgctgattttgc

SEQ ID NO: 77039 - DNA, 1126 bp, Heterodera glycines
  Genomic contig location: Contig_ID=SeqID_1963; Location=245..1370; Strand=-
  SCN-specific regions: Sequence locations=1-50,73-207,229-360,382 -396,418-551,573-913,935-1126
agcccagtcgcctgttggactgtctgcactatgtgtgcgaagagtgtgtgcctgaacaatgcctgctgctggacaatttggagcccgacgaaatccgatgcccaaattgcagccaagtacgggcccatcattagtgttaaataggggaaagcagcgcgtggcaatcttgggaaatgccaccggctttaacgctcggagtgttgtggggcattgcaatatgtttctttttaaaagttagattattaattatgaattttttgggcaacccgcgcatctgttggggagcaaatcaaaatgtgtaggcaaaagatcttaatgaatggcttcaagctggtcatgacatgtacagttttttcggacaaaaagtgacagaaaagaattcaagcatttttttgcaaattataactggctcaaaaatattcatttgcttagactttttcctccgccctccgtctcgccccacctactggccgccgtagtcgagtgtgcggcggttttgtagcgtaatattattaaactttggtctacctatgatccaatgtcttataatgaaaaaagttaaaattaattgccaaattttacttttttcaaaaaaattgttttcagcatgaaataccaagttttatagcaaaaaaatgatgatatctattaattatgtgccattttagaaccattaaacgtgtttttcatttaccccttaaacggaagtcttacctaaaaaataattgtattatgtcaaaagtaaaaactgataaggaaataaatcactccgggctgtgctgtatttttcatacataatacatgtgtatgactcagttccttggcaaatcctgtacataatcgatcatttactctcttgtccaccgacctctactaccaccaattaattgattgtttctgttgctcactcactcaatgtttaacaattatccgttttaaggttgaaatgtcttcaatttcgggtcaatccactgaaagttcgcgtgtggaaatctgtatcaaacacgagaaatttacgcgtttttgtctgtcatgtgcgcgtctcctttgtgtgaattgcgagcagcagctgtccttgcccaccgcgcaagtcaacaatgtcactaacgttgttgctgttccgcaa

SEQ ID NO: 77040 - DNA, 1148 bp, Heterodera glycines
  Genomic contig location: Contig_ID=SeqID_13213; Location=1130..2277; Strand=-
  SCN-specific regions: Sequence locations=1-83,105-275,320-426,448 -688,719-973,995-1148
atggcaacggcatttgatagatatgtgagaaattggggagaagaaggtcaaatgcatgcggaaaacgccgcttcaccaggtcaaaacattttttataaattctaaaaataccattttatcctttaagtgaagcccgagtttcaactttcggttggtaacggttatcggcaaattcggttgagctcagcaatggaagtaatcaaattgttattcctggaaatgtttgttgattttgaagacaacgaagacagcgacataagttatattgaggcaagttttaaaaaataatacataaaattttcaaaaattaattattttagttcaattttgtgaacgaaaacaaatgtgaaacggtacaggagaatgagacttcattgaacaccggtaaattaatagcaaaatattcataaaactcttaaaaatggtaaaaattgttatttgtttttgggattctcgaggttttacgacccttcgtttctccatactgagaagaatacgcgccattttatccaaaggccatttgtagcaaattttgtgctctttctaatctttaaaatcgtcttccacgaaaattttttccagccatttaggaatttattagcatggtttctttcacattttatcaagtgcaaaaaatatatgtcatcaaaatttgtgagtttatcattttgaaatccaaatttgaagcatttttagtataaaaatatttattttatttcggactcgctcagttgggcccaccacatttttggacataagtcacccaaatccaacattgttattataattcgatagccctaacaaataagagtcctctattagccagaaaaattttaaaaaccgtcaattttgaaaaaacttatggccgaaaaagactgaaaacctggttttctgatatacttttggccataaatttgtccgaaattgatggaattttttgaaaattttgcaggctaacagatgactctatagcttttgaatgataccatctatactggatttggttgacaagaaaaaagttatagtccaaaaacttgctgggcccaaacgtgcccgggcccaactgagataaaccgattttgttctctactcattccgattttttgtatgcttcatggacggtaaaaaagaaaaaaagcgacaataaa

SEQ ID NO: 77041 - DNA, 855 bp, Heterodera glycines
  Genomic contig location: Contig_ID=SeqID_13214; Location=629..1483; Strand=-
  SCN-specific regions: Sequence locations=1-447,470-664,688-855
atggacccaaagctgatcactgacccgggctctgtcgagcgtacagccgaatgtgctgatcggtcagcaaattgtggtgtattgaagaagaatgggttctgctgggaaattcgctatgtacgactgatcagaatccaatgccaacacacatgtggcttttgtgaaaatgagcatgggaatggcgccacaaaaaagcagggcaaaaacggaattggaaaccaaaatcaaggacagaatatgggcaaggacaatggccaagacctaaaaattaatgtcggattggacaacgctgatggccaagatgggaatgaggagtatgatatgcaaaatggtggccaagagtgggagcatggcatcgacttgccaactggggaagaccgaactatgaatggcaaccgaggccaagagttgagcatgtttggcctggacaagacggaaggccaagctgaggaaaaccatggcaaaatgggtgtccatgatttggactatggcaatggcattgatgaagaatggcacagcaataacaacaacattgccgatggtaatgatagtggaacaaggcatggaaatgatggcattggcacaacaaatagccaaaatgggaatgctaatggtcaaataaatggccaagaggaacagaaacaggcggaaagcaattttatggacaaaaagaagcagaagaaaaagcttttgctattgactacaagcgatgaagcggatttaaacaatccgaaactgttgaacaaagtggacgaacactacacaaaatggacattcccaaaaaggagaaagccaatcggaaatggagatgaaactgatcaagcggtggagaagaagacctggcatgagacatga

SEQ ID NO: 77042 - DNA, 171 bp, Heterodera glycines
  Genomic contig location: Contig_ID=SeqID_13216; Location=2465..2635; Strand=+
  SCN-specific regions: Sequence locations=1-171
atggatttgacccccgtcggcccttctgtcgctccgttggctttttcttcgtcttcaaccgatgcttcagccgttgaattgccatatgccgtcccaaactttggcacacccactgaaaaattgttgctgggcggggagctgattgccgtgccaagcgctctgttggccgat

SEQ ID NO: 77043 - DNA, 1912 bp, Heterodera glycines
  Genomic contig location: Contig_ID=SeqID_13216; Location=163..2074; Strand=+
  SCN-specific regions: Sequence locations=1-517,539-1057,1079 -1326,1361-1539,1561-1912
  Gene Ontology: Mol. function=transcription factor activity; Cellular component=nucleus; Biological process=central nervous system development
ttccagatttttttggggttccctccccggacgacttgcccaccagccgagtctaattgcttggcacattgtgtggaaaattcgaagaattttcaggcctcgaagtgggagggaggggggggggagagagcagggctggacgcaatccaaaatttttttttccaaaaattcatttgtttagattaattgtgattgttgtgattagtcgttcaaaatgggcgccacagaaagcgttgaacacagcaaaagcgatctgcagcagctgaagggcgatatattcgtcaatgggaggtgacggaccacgtcatcgttctattggcttaattttacaattaaatatggaaaaattgacccaatttggcatacaaattaatctatcgatgcaatgtgccattaaaaacaaatacaccgagccattttggccccaaaaatggttcccttggccgattgggcacaaaaataaatgcatcaaccaaatttggcataaaaatggataatttgccccaattagcattgaaaatgccccctttttcctcctcctagacctttccccgaccaaatttgccaacgaattgtcgctttggccatgggcggcatgcccccgcgggacattttgcgcaatttgcttgtaagttattgttgaggaggtcaacaaaatattcagacgtgtcagcaggaaatgttccggaataaatattgctttgctgtcatgagaatataacattccgtagcctccttcctcctaataccgtcccagtagaatactgtatctgtgtcatgacaactcgtacaaaagtcgactcatacatattgtacgagttgccattgccgcatttttcggtcacgcccccccccccccccccgatttttattatttttactcatcctgggaatttaattttaatgaaataaattttggatgagttaaggtgtcgagcggatgtgtttctaaaattcttgcaagttgtggcaccatcgatggccggtactgtttacaaggcacaccaatttgtctgatatattgtaaaaatgtcaaacttttttttaaagttccggaccccaaatgctgagtcaagaaatcgtcgagaaaataacggtaccgtttgttgtttgcgcgaaagtgcgcgcttcatcagtgatactgtaaaaacagatattattttaaaaagcatttgaaatgtatggtaagctcacgacagtatgccacttttttatacagtatcactgacgaattttttcggttgcgcaattttgcacaaatttttgccatcgcttatcatttttggttaagattacttttagctgtataaaactgaatacccgtccatttttgcttgggagatcagggaccggctgaagcaggacagtttgtgcacggcggagactttgccaagcgtgggttgccacaacccctcgggggaggacggtagcgccggaccggccattcatttatcgtcattaaaattgttttgttaccgattgtaaaggtgttcaatatttttgtaagcatgaattggtactggaacatacatgtaatccatttacagtatgtttgcatttcttggatttcgtgacttcctgttgtttttgaacgttcaaaaaaacagaattattgaattcaaacaaatttccttaaatttgggtcctttatactacaataagtaatgatacagtatcaaaaaataaatggacaataaaaaaatacttttggtagtgaaaggccggttcttcgcgaaagtaccgtataccctcgtccaactatgctactgtattggttataccattataatgtttaaagatctcgtcaatcaacactgtgcttcgttcccatgcaatattgtgaaagcagcagatgaaaagcaaatttgacgaaatcatgaaagaaaggagagggatgaatcggcaaacaaat

SEQ ID NO: 77044 - DNA, 1141 bp, Heterodera glycines
  misc_feature (726)..(726): n is a, c, g, or t
  Genomic contig location: Contig_ID=SeqID_13217; Location=1044..2184; Strand=+
  SCN-specific regions: Sequence locations=1-377,400-575,597-1141
atgtcaaactttagaatggatttgatcatctgtgccatttcgttccgtgtctcgtgccacatcgtcgcacagacatacagtgtaaggattctgtccatttcgccattaaatattcttgaaatgctttcacggtagttgtaatcggagtcacaatcagtttccttgataattaaaattaaaattgcattttgtgatttcagagaacctttttagcgattgagcaacggaaaacaaccagagattggcaaatgtcaagcccactcatcatcggtgacatcgacacaattcttgatcaattaggtaaataaaaagtacagaacgtggaacaaacatttcgtccatctgatcgaagttctcaccacttataaaacgatagctccatttcatatatgagaaaagccaaatcaatgttatgtagaaatcggagaaaacgccttgccgttgcattcctacaaaaatttcattttaaacgcatcgatgacatcaacaaggaccttttacgcaataaatgctcaagtcaaaatgttgaaaaagagcattgattcgacaaataggaacgtaatgacaaaatgtatagaagaagaagaaaagcattggagtcgtgagaaagacggggtgtccaagcggaatgagttcaagtcgcatcgcagccaaaaagcggaagcaaaagcggagataaaagttgagagaaatgacaacaagcgcaagcagaaagataagtcttanagcgaataagcgaccaaaaagacaattttgagtacttagggccttggagcgttcccccgttgagcaacagagaagtcagcgtaccaaatgggatgttgtgattgcaaagggaaaaccccaaaaatcagcgcggcacacaaaaaacggaccacacaagcgcacacgcgcgtctccgcgttcagttttctcagtccatatttgagctgtggttggctaataagctgatgatacgctcgtccttctcacctcgtacaattcctgcaatacgccgcttgtgtgtttcgtgtccacccaactttcccagtgtccaactgcacacatcagaaaggataacggaagcaaaacgccgaaacggaactccaaatgcgcttgagtaagataccacaggtaggcaccagtgaaaagaacagcgaaa

SEQ ID NO: 77045 - DNA, 1787 bp, Heterodera glycines
  misc_feature (451)..(451): n is a, c, g, or t
  Genomic contig location: Contig_ID=SeqID_13217; Location=433..2219; Strand=-
  SCN-specific regions: Sequence locations=1-580,602-777,800-1172,1201 -1359,1381-1787
  Gene Ontology: Biological process=reproduction
atgcgcatcatcgctagcattccttcagcgtttattttcgctgttcttttcactggtgcctacctgtggtatcttactcaagcgcatttggagttccgtttcggcgttttgcttccgttatcctttctgatgtgtgcagttggacactgggaaagttgggtggacacgaaacacacaagcggcgtattgcaggaattgtacgaggtgagaaggacgagcgtatcatcagcttattagccaaccacagctcaaatatggactgagaaaactgaacgcggagacgcgcgtgtgcgcttgtgtggtccgttttttgtgtgccgcgctgatttttggggttttccctttgcaatcacaacatcccatttggtacgctgacttctctgttgctcaacgggggaacgctccaaggccctaagtactcaaaattgtctttttggtcgcttattcgctntaagacttatctttctgcttgcgcttgttgtcatttctctcaacttttatctccgcttttgcttccgctttttggctgcgatgcgacttgaactcattccgcttggacaccccgtctttctcacgactccaatgcttttcttcttcttctatacattttgtcattacgttcctatttgtcgaatcaatgctctttttcaacattttgacttgagcatttattgcgtaaaaggtccttgttgatgtcatcgatgcgtttaaaatgaaatttttgtaggaatgcaacggcaaggcgttttctccgatttctacataacattgatttggcttttctcatatatgaaatggagctatcgttttataagtggtgagaacttcgatcagatggacgaaatgtttgttccacgttctgtactttttatttacctaattgatcaagaattgtgtcgatgtcaccgatgatgagtgggcttgacatttgccaatctctggttgttttccgttgctcaatcgctaaaaaggttctctgaaatcacaaaatgcaattttaattttaattatcaaggaaactgattgtgactccgattacaactaccgtgaaagcatttcaagaatatttaatggcgaaatggacagaatccttacactgtatgtctgtgcgacgatgtggcacgagacacggaacgaaatggcacagatgatcaaatccattctaaagtttgacattttttcgtcaaattttcgccattttttagacttgatgaggaacatgccattcgtttgtcggagaaaaatacccttgaaggaaccaaattccgcttggaaggtctttattaaaattgacaagctcgccccaattgcatttttctcaccttttttttgacctaagatttatattttccagttaatttctacaaaaattgaaactttccgtgatttgttcagttcatattttcttcgatgactcgtggactgatgacaaagaatgtggtcgcattccgaatgagtacttcaagctgttgttcgaagttctgatggaattgactcggttttatttaattagtcaattggttccgtggtatttttgctttgtcttgtcaagttccgacaacgctgaagcggacatgtacagccgtattcttctgaacactccgtacggaggtcgacttgtgctggcgttgaatgggggctcacttctttttgtgcatctcaaagacaaacgtttgatccgacacaaaaagcgttggtcgcaagtgatgtacatgtactttttgctcgggcatcgaattatggactcacatttgagcgtagaagacaaacaattgcaggtcttttga

SEQ ID NO: 77046 - DNA, 443 bp, Heterodera glycines
  Genomic contig location: Contig_ID=SeqID_13218; Location=993..1435; Strand=+
  SCN-specific regions: Sequence locations=1-443
atgccaattgggcacaacgccaaatcggtcatccgacgatttttgcgtttgcccttcgccgtggaaatacgcgcaatcggaggaaaaagaaagtgagttaatgaagacaatatgaaaacaaacggacaccctgtcaatgattcagcaaatggatatttgttcattttgcactcaaattgggcactgcaaaaggaacgaatggaaaatcgacgggcaaatggcgacggtgccattctctgcgcggaagggtaagcgaaagggcggcctctcacaacgaagcgacgcatcgcaggaacacccaggcgcatttgctgtcgctggtcgccccgtggggcaaaagggtggtgaacgtcggccgaagcaccggtgacgagacggtcagaagcggtgactgccaccgactgttctcacacaacccgaacaatctgaacccatacgaatga

SEQ ID NO: 77047 - DNA, 924 bp, Heterodera glycines
  misc_feature (762)..(762): n is a, c, g, or t
  misc_feature (845)..(845): n is a, c, g, or t
  Genomic contig location: Contig_ID=SeqID_13219; Location=899..1822; Strand=+
  SCN-specific regions: Sequence locations=1-153,175-356,378-417,439 -466,497-721,746-872,896-924
atggcaccgccgggtcaataccaccacgaggtgttgacggtgggcgagccccagctgatggcctgttcgtacggggagcatgacgaacggcatatcacgcgggtggagaacacggcttttgctgccgcagcggcgggtggcggtgccatgggaccgccgccgatgccaccgccccagggcataatggtcagcagtgcgccgggaacttcagcgctgggcatgccaccgatgccggtgccgacgacagcgatgggcggcgacaacggtggtaagcgcatatttccgggggttaggcaccgttggaccccattgtgccatttttgaaaatcattttttggcacaaaaccgctacatattttttaaatttattcttctttgcttgggttgaaatgcgaacaaaaattcgctcaatttacagctcctccacaccatttgcttggtgccaacaacgacttcgagcagcacatccaacagcagcagcaacaacaacagcaaatgcccccgggcggcttgtggaatccgctgccgccagcaacaagcgcgggccccggcggcaacggcggagaccaggcgatgggcggaaatggcggctgatgactatttattgtgattggactgcttgctgccgtgcgttgaccgggctgctggtgatgatcattcttcgcgccaccgccgtctctttcctgtaccgtatcgcccaccgtattcctccgctgctgctcacttcgtctctctcctcccttcactctcccactctaactnatttctgttgttgccccgtgttgcgtgcgtgtgtgatcgacccatttgaactttgattgacctccttcctcatccccccccgntctcgttccttcgttccattgccctcgtcaccctcttcttctgtcactctttctttgctcattggcactttgtctcgga

SEQ ID NO: 77048 - DNA, 1476 bp, Heterodera glycines
  Genomic contig location: Contig_ID=SeqID_13221; Location=675..2150; Strand=+
  SCN-specific regions: Sequence locations=1-387,414-495,524-1066,1089 -1182,1206-1449,1471-1476
atggacgaaaatgcaaatgcggacgacgcgggcgagggaagggaaaaacgccaaccgaaggctaaccaagtgggtcaaagggaacgaaggtttagtggcgccgcttggtaatttagttggatttatcccgccccctggttttctatgtaattgccttgctatcattgtcagatcaattacgcttccctgggccatttgctcgatcgtctcattgtcagccagcgtcggacttcgcttcttcccgtcgttccaatcgctttttttccactcactgacttcgagaaacgaaatgtgtcgctttgcacgcgcacaaatccaaccgaagtgttcggtaagatggaggacttcaagctcaattcgtgccacgtctatggggtgatttattctaatgttttttaaaaattattatcttcagtcaattgctctgctcgatttcaaaaacattgccatcgtcaacaaattttcgcaattagtgtgggaatttaatctttcctttttgcattaatttttgttttagcattaactcccaaaaaaacgatgcaaattttgtcggtttggagccattgatggagcaaactgaggatgattttaatggtaatattaactccattagattatgaatgcttttcagatgctttgagttgcgcttccaagtcaagcacagaaacaatgcatcgccaaaccgaccaacaggagatcgaacggcgcggcacggacacattggcaccaacccaacttcgacctaattccaatatcgaaaatgaaatgtgtgccatcgaaatgaattcggagttggcactgcaacgacatgacggtttggttgacgaggaaatgaacgagaacggaccaacaccggccctgacgcagcagcctcaaattgactttgaaaatgagatgttcgacaacgactccaccctcgtcccgccctcgccgcgtgattttttagaagtgagtgagcacgaaacgacgccggaaccaacgacagacaatgaggaaggggaagcaccgccgccggacatttcttctttggtgctgtgtttggcaatctttcggttcattggtcccgaattttttttttaattaaaattctgaaaacacatttctaaggctaatttgagccgctgagtacgaatctgaccaccttttcggcctttttcgaatcccgaacctaaagtcgaacaattttttaaaaaattcaaaaatttcaatttcatcaaatatgtacgcctagatgtccgggacaacgctccaattgttgttatttggacgaatatatgtgtcgataattcaacggaaaaaagttgtcaataattatttttagacgtatttatgtaaatatttgaaggaattcaaaattttgaattttttaaaaaaatgtttgaattcaggttcgggattcgaaattggccaaaatggtggtcagattcgaactcagcggctcaaattagccttagaaatgtgtttccagaatttata

SEQ ID NO: 77049 - DNA, 882 bp, Heterodera glycines
  Genomic contig location: Contig_ID=SeqID_13222; Location=280..1161; Strand=-
  SCN-specific regions: Sequence locations=1-28,52-56,79-339,361 -779,808-882
atgggacgaagcgacgctccgcgcatcgatggaagaaaaataatggaaaataaacgttttttattatttttaatttttgtgttgttgtatttactgtgtacaataaaaaacgcatttactattaaattcaaatgccttaaatttattttaaaaagttctcatacagtattgtgtacattaatccgaaagtgtttcgtttaattggctcattttctctttagtttacttatccaatttttggtgaaatggttgatgaacgtgtgaaaattttcgaattgttcagggacattgacgaagctgcggacagagggtgggccgaggccgagcgattgggcaattctttcccgtcttttagcaatcagttggtagagatgctaatccaagagggacaaaaggaccaattggagcagttcggcacggttttggacaaattgtcggaattggacaaaaatttggacatggaccttagggtcggaggagggaataaatgccacggaaaggacgcaaatcacccttttattttcagacaatcgacgaaactttccgacagttggaaaatgccgaaacggagaagaaagtgctagagaagcatttcaacgaaaggtccgcgaaaaaaggaaaaaacaaaaaagtgaaatcgaatttagccgcaaaaacattcaaatgccatcaaatgccggccgtactcaggcgaatatcgcagcaattcggaaaaagttggacacagcactcgcagagggaacgagcggaacggcacaaaacgaaggcgaaacggaacagaggggggaggaggaagaggaggacatgctaatgtcggagaatgtgttgtcagcaaaggacccaataacgaaaagggacataaaggagccggtgaaaaattcg

SEQ ID NO: 77050 - DNA, 547 bp, Heterodera glycines
  Genomic contig location: Contig_ID=SeqID_13223; Location=252..798; Strand=-
  SCN-specific regions: Sequence locations=1-235,259-547
atgagacactgtttctcgaccaactcaggacaaatggtacggagtctctttggtttttgccttacttttttgttttgtttttgactgtccgttttcagttggcttcgtccctttcactttttcttccgccatttgtgccgcgtgcactgtcatggctcattttgacctcgtcgctctgttcctttgctgctttgaacttgtccattccgatgtcttcggtcccttcgctttgttttgcttttgttccttcgcttcttccgccactcttttggctcattttgcgcttctccgatcgtcggatctgttccaaatttcgtcttccgattttgttgaatattgccgaacttttgtcacaattctcgcgtttggttacgcttttactccggtgataaggtgagaaagggggataaatgaccaataattgtttgtttaattgcaattttaggacattgaccacttcaattagcactgacaccatttacgcctgtgccattctgctctttttcgccagtctttttgtccacgactacggcataaatgtgccggt

SEQ ID NO: 77051 - DNA, 1820 bp, Heterodera glycines
  Genomic contig location: Contig_ID=SeqID_13224; Location=107..1926; Strand=-
  SCN-specific regions: Sequence locations=1-931,953-1017,1039 -1155,1179-1820
atgagcgggccaatccgctcaaaaatcgggccttgtgccgcccgtaccaaggcctacatcgaggcggccacggtcaatctcggaaaggacacgacagacgagagcattcaagcagacctcacagcggagcgccgtggactccgccgagcgattcggcttttggaggattgcaatgacaaatggcaatccctcctgctcaaattcaatggagccgaccgccaacaagaggagcaacgctacgatgactttaagccatcgggaaagcacttcatggaatggtcggacaaagcccgaggtgcagtggacacgatcgatggagtgatcggtccagaggatgacgacgaaataactgggagcattatctctcagcccgccaatcctccacaaattcaacatgttcagcctcccccacctcgccatgaggtgaatctccctcccatttctctcccaaaatttgcgggagagccaagggagtggccgatgttttggaggctcttccgttcctcagtggacaaccttccaatcgacgacttcaagaaacacatctatttgttggggtgccttccccacaactcgccagctaggcgggcagtcgacttgtacccaccctcggacgaaaattatccgagggttgtcgacatcttgaagaagcggttcggtgatagtaaaactatcactgagtccttgcaggcagagctactgcacctccccaagccgggagagtcagtgctctcgctccgcaacttcgcagagtccgtggaacgaatctgtttccaactaatggacttcggcgaatctgaggacaacatgttcatggcttcgacgatcaagtcgaagcttcctttctccatcctcacccacgtggtggagaaagagctttcctcaggaaagacattttcgtgccttgacatcagaaaggcacttcaaacaatagtggaagtaaaggaggaagtgcagagatgtgcacatgtcctccgaggcgatgaacgaccacgttcatccgccttcaattccccacctcaacagaggggtgcctgggatcaaaggggtgaccaccgtcactccaacaaccgacagagccaaccaccaaggccatttaatcgcggaggaacgcctcagccagaatatagggcgttctccgctattaacaaaaatccggaaagggccaaaaccccagcaaggaaatggggtcggtcctgctcgctctgctcgggaactgatcatctcccgagcgagtgcccggcgttcccaacaccgggagctcgccgaaaacggctgacagaacagcagcgctgcctcaactgccttgtgcaaggtcacaacactgaggagtgcacctcaccataccgttgccgaaactgtggcaacaaacaccacttcctcatatgcttcaagagggaggagtcccattcacggtcaaatgggaatcgttccgcttcctcccccaagtcgggaagagagccaggagggcgaaagttccatcagcggcaggtggaaagccaaacccacctgatcacggctgggtttcaacagaacgatcagtcaaaccctccgccaagagagggggagatcgttcaatccatggggatgtccaccgtggacaccagcaaagggagagccaacaaggttcccaagtgcaaaaatccgcacgcgtatctgatgatgcgacggctgctggctaagtcaagtcgcgacagccggaatataatcaaagttgcagtgctctttgacccgggaagccaaacaacgtacggagcggatccgcttatcgataagctccgcccgcacaaactcacctccgaagagatggaggtccacgg

SEQ ID NO: 77052 - DNA, 89 bp, Heterodera glycines
  Genomic contig location: Contig_ID=SeqID_13224; Location=2844..2932; Strand=-
  SCN-specific regions: Sequence locations=1-67
cccgccctcacattttcggcctataaaaagggcacccttttcattaaatgctcacttccacatttccattcattcatttctgctgctgc

SEQ ID NO: 77053 - DNA, 1251 bp, Heterodera glycines
  Genomic contig location: Contig_ID=SeqID_13225; Location=190..1440; Strand=-
  SCN-specific regions: Sequence locations=1-92,114-403,425-626,649 -675,697-1098,1120-1251
  Gene Ontology: Cellular component=mitochondrion; Biological process =polar body extrusion after meiotic divisions
atgtcgacttcatcgcccccgtcttccgagtcggacccccccgaacttcttcaaacgccccattcgccgtcctcgcggcccttttggcgtgatcaggaagagttggtgatcagtgggatcagtggacgattcccgcgcagtgacaacgtcaaacaattcggagatttgctgttggctggggaggacctggtcacagaggacgaactcagatggcctccaggtccgattggccttatttccgcagaattccaccaatgacagacaattaaatgccccatttatttaaggcttttatgatctgccgaaaaggcacggaaaactgaaggaattgcgcaaattcgacgcgcaatttttcagcgtgacgccgaaacaagtgggaatagggaattgtgcaaagtaaaaagcaaattgcaggccaattacatggacccgcaagtgcgaatactgctcgaagtggcctacgaagcaatgattgactcgggtgagtgtctttctttagccatcggttgagcaaaacggcgagggatttcgtcgacaaataatgtattcacaggagtaaacccaatggaattccgaggcaccaaaaccggcgtttttgtgggctgttccgcttccgaaacgggcggagcactcactcaggatccggagatggtcaccggctacactttgaccggctgtgtgcgttcgatgttctccaaccgcctctcctacgccttcgacctgcgcggtccgtccttctccgtggacaccgcctgttcttcctcactgctcgccttgcaattggcaatcgacgccattcgccaggagcaatgcgaagcagcaatagtggcaggtgggtgaggggggcgagcgagtggggggggggaatagtagggggacagtaagataattaggggggggggggggattttaagacattgagcattttttaaatgctttaaccttcgcccgccctttgctcaggtgcccaccttacgctgactccgactgcggctcttcagtttctcaagttgggcatgctttcccccgccggctcgtgccgctccttcgaccaatccggggatgggtatgtcattttttccttccgatgacatactgtatcgtttccctgctcttttgaggtattgtcgtactgagggtgtttctgccataattatccagcggcgttccgtcgcgcgtcgtatttatgcgactgttgtgcacgcgaagagcaacacggacggctacaaagagcagggcatcacctttccg

SEQ ID NO: 77054 - DNA, 306 bp, Heterodera glycines
  Genomic contig location: Contig_ID=SeqID_13226; Location=131..436; Strand=+
  SCN-specific regions: Sequence locations=1-75,97-108,218-306
atggtcgctgctgactcctcctcctgtctcctccatctgattgttatcaactgtggcgatctccgttgtcgggatgaggtgaacaaaggggaggagcaaagagaacggagaggaagaggagcaagaagaataggaggagcaaaaggaggaggaggaaagggaggaagaagaagaagaggaggaggaaagggaggaagaagaagaagaagaagaagaaaggagacggacggaagagtcgacggaagaaaagagtcgacggaagagaagagtcgctgttcagaatttgtgctctgccggcggcgctga

SEQ ID NO: 77055 - DNA, 93 bp, Heterodera glycines
  Genomic contig location: Contig_ID=SeqID_13226; Location=368..460; Strand=-
  SCN-specific regions: Sequence locations=1-93
attacgctcactttcaaacggatctcagcgccgccggcagagcacaaattctgaacagcgactcttctcttccgtcgactcttttcttccgtc

SEQ ID NO: 77056 - DNA, 69 bp, Heterodera glycines
  Genomic contig location: Contig_ID=SeqID_13226; Location=882..950; Strand=+
  SCN-specific regions: Sequence locations=1-3,59-69
atgggaggaagtaaaggagaaagagagaagaaattggaggaagtgaaggagaaagagagagcagcaagg

SEQ ID NO: 77057 - DNA, 57 bp, Heterodera glycines
  Genomic contig location: Contig_ID=SeqID_13227; Location=322..378; Strand=+
  SCN-specific regions: Sequence locations=1-57
atatatgttatataggttttgagtttcgtttcaaaaaacaaaatctcccggccgaag

SEQ ID NO: 77058 - DNA, 476 bp, Heterodera glycines
  Genomic contig location: Contig_ID=SeqID_13228; Location=12..487; Strand=+
  SCN-specific regions: Sequence locations=1-50,121-276,298-344,371-476
atgaccttatttttgttcaccgccaacttctttcttgcatataaagtgccaaaaaaatatatatataaataaaaatgattttttaataaaattacacttaaaattaattgaataattttaggtgcttccgtctgatcccgaaaatcctccaagttctgataaagtccctgccttaactgttggtgcacacgaattcacgtgccatgtgatgccttatttggacattcagtgatttgacttaatgagattaattaatttttgatttgtcgagaacaatatttttattacaatttaatttgaaattgagttaaaaaattgagagatatttttgaaagaatgctgaatgccaaaaatttaaaaaattttccaataggcaaagtgccaagtataaagtgcaaccacaactttgaaatcaagtacatttgaaaaaaggcaaaaaagcaaaaacaaagtatgtacttggaaatcaattacaa

SEQ ID NO: 77059 - DNA, 769 bp, Heterodera glycines
  Genomic contig location: Contig_ID=SeqID_13230; Location=1693..2461; Strand=-
  SCN-specific regions: Sequence locations=1-230,255-331,353-386,430 -516,563-675,698-701,731-769
gaaacattgcgtttgacaaatttggttgtgttcaacaaccctcatatgactcttgatgaaataaaagttggcaattttacggtggaaagtggcacaccgattgtgccacaggtggacaaaaaatccggcgaaatattttttagttttatttttcagatcagcagtgtcctcttcagtgaaaaggtaggaaaatttggtaaaattcagcaaaaaactgcgtaacaaattgcaaaaaaaaaatttttttttaatttccgaacattttttttagtactttgccgaaccccaccaattttggccagagcgctttttggacgatgagggaaaattgaaaaaatgtgacaaattaattccatttggagttgggaagaggtgaattaacttccttttttattaaaaataattttaatttattttaaaaataattttgcttcttagacaatgccctggtgaagcattgacccgaatgaccttatttttgttcaccgccaacttctttctcgcatataaagtgccaaaatatttataattaaattacatttaaaattaataaataattttaggtgcttccgtctgatctcaaaaatcctccaagttctgataaagtccctgccttaactgttggtgcacacgaattcacgtgccatgtgatgccctatttgcacattcagtgatttaacagaattaatttgtgaaatttgttattattaaaaaatcttttttataatttgttttttggtggcctttgagtttatcatatttaaataaa

SEQ ID NO: 77060 - DNA, 5275 bp, Heterodera glycines
  Genomic contig location: Contig_ID=SeqID_1965; Location=2134..7408; Strand=-
  SCN-specific regions: Sequence locations=1-594,617-694,716-2024,2046 -2075,2097-2361,2383-2411,2433-3421,3443-3740,3783-4284,4307 -4689,4820-5140,5168-5211,5244-5275
cagaagaaacaattgagaaagggaagacatgggattgatctcctcgaattggcataataaaatacgtcaaatggattgggttttctattttaatcgtcttaattgccgtcggctcatgttttatcttcggaaaaattaaaatttacggcactattctgacgattccgctccacatgattggcaccctgacccaaatgttaatggattgtttcacatccggaagaaatgtcgtcgaacgtgttcgacacccggtcgttatggaggtggaactccagcccttttcgaaaccttccgcgccgccggaggagccagcgctcgaacagactgcctacattttgaattatttgccgaaaatttgtcaaattcatcattatcaacgccgaaagaagagatgctacgtgaatgtcctaataaacgggaaggacataaaagcattgttcgacaccggagcagatgtcacgtacattgagctctcaactgccaagaaatacgggctgagcatacttcgaggagacttcccacaagctcgtgctgccaattcaacgtctataaattttattggatctgctctgacgaacgtgaaattcggagaatttgagggaaaattcccaattcttataagcgaggacggaggctgtccatgtgccgccattattgggactgattttatggactttatcagcgagcaaggaggggaagaggaaattggtctcaacttcaaacagggaattgtccgagtggggcacgtccaattgcccatggttggagccgttaatattgagtgccgaccgatcgaagtacgacttttgcaaacacacactcttccaccgctctcggattcctttgtgtggggacggataaacagaaatttgagtccagaagacacattcatcaccgctgagagagaacacgactattttccaatgcgtgtggggaagtgtctaacgagccccggggcgactcgaatcgtaccactccgcttgttaaactttggaaattgtgacataaaagtgcacgggggatcccgcttggctgtacttgaaccgctttcagctgacacgcatattaattcgttgcgaaagtgtacagaaaccgaagaaaacatgctgatgaacgacgaggaatggcataaattcaaagcagaaagtgatcaaataccaccggaagccgattggacagatgaaactctggcgttcccaaaaaatggcgaggccaccaagccaattttggaaagaatctcgctgaaggaatcaattttgagtccgggaggaatgataaaattgaggcaaatcatcgaaacaaacgaaaatgcatttgtgaagccgggcgaagtcggtctctttaaggggaagacaattcatcgaattgatctgactgagggagccagaccatgtcaacaaaggccgtatcgttatcccgtggcactccaaccagaaataaagaggcaagtaaaagaattactgcgacagaatgtaatccgcccctcttcctccgcttgggcttctcctattgtgcttgtacgaaaaccggacgggtcctaccgcttttgtgtcgattatcgaaaattaaatcaattgacaaagcgatcaacatattatttgccgagaatccaatcgattcttgacgaagtgacgggaaagaagtatttttcggttgctgactgctccagtggattcttccacataaaattggctaaaggacatgaggaaaggagtgcctttatctgtcacatggggctgtttgagtggctacgctgtccatttggcctagcgggagcaccaacaacttttcaaagagcaatggaggaagtccgccaaatgtgctcggccacttttcttgtctacttggacgactgtattgttggatcaatgactgaggatgaacacttgagggacattgacatttttctaaagacaatggcagaggtgggcttccgtttgaaaccggagaagtgccgctttgcgcttggtgaaattcgttatttgggacatttgatttcggagaagggagttcgaattgacccgaaagatttggaaccaatccaacgactaaagaaaccggcaaatatcaccgaactgcggtcactgatcggaatgctgtcgtatttccggaaatttatttttggcttcgccgaaattctacaaccgatttacgaactgacgaaaaatgaaaatacaacggaatggggtcaaatccatgaaaatgctctggaggaacttaaacagcgattaatgacggcaccagtgttggctccaccgaaattcggaaagccgttcgttgttgagacagatgccagtacaaaggccatcgcaggctgccttcttcaggaaaaccgtgacggagaagtgcacccaatcagctatttcagcagagttctcaccaaacatgaaaaaagatattccgtcgttgaacttgaggcgttggccatttgtgcctctcttaaaaattttcgcccatacttggaaggggccggaaaatcgactgttatcacagataactcggcgttaacatctctattccggcgaaaagacttagagggaagattgagtcgctaccaattagccattatggcattcgacgttgacataattcataggcctggaaagagaaatcaattttgtgaccatttgtctcggtatttggaagagagtgctgaaccccaaataaattggctgaatgtcgaagcgaagacatcacaaagtgagatggtcgaggctcagaagagagatgccgaaatacaaaaaataatgatcagattgaaaacaaccgtagacggggaagagtcaaacgaaaatgaaaagaagagatggaaactttttgaggaattgctatgtattatggacaaaggcgaatggaaaatatgtgtgccgaaaagtctacggtcgaaaatcatgggcgaataccattctgacccattccaaggcgctcatttgggagagaaacggacgagagagaagataaggagaagcttattttgggaaggactggacggagatgtccagcgctttgttaaaacatgtgatgcctgccaacggagaaaaattattggaattcaaatgagcgcagaaccaatttgtccaatcgaacccgcatcacggccctgcgagagattacatttggatttaatgggtccattaaaaacggcaaaaggaggattccagtacattctaatgattgtcgactccttttctaaatatatgatggccattccattgcgggaacaatcagcaaccaccgtcacagctgtatttgtcgacaaattcttgtgcttattcggtttaccaaaaatagtcgtcactgattgtgggactcaatttctgagcacaacatttgaatctctcgccaaaagcggatgacagaaatttctctgacatggccatttttataagcgatttgacagtgcgaatgacggaaatccgacaaaaagttaatgagaagttgaaaaaatgtgcggtccaaatgaaaaagcagcaaaaacgcattaatgaaataccgtggacagaaggaatgctagttttgttgcgaaaagtcgacaaaaaacataagctggaagcgaactacgaagggccgtatcgcgtgattggaattgagaagccaaatttgttgctgaagaagttaaatcccgacggcacagaatttgaggctcatatggacagatgcaagccatatttccagcgtgaggtagaagagagaaatgaacctggcgatgaaataaaaacgagagcgttgggcgacccaaatctggaggaatcagatgacgaaaatgaagacgaaaaaacaactatagcctttttgagaacatcagacaccgacgaagagtccacaaatgatgctttggaagatccattatttctaatggaaattcaaatcgacggaaacacaatattggcttatattaacttctccgaaaattatgagccctcaataatcccaagaaaccgtgtccaagcccattgggaaatatattcgggaggacaaaagccttacatcacggcatggctattcgaagaagagttacaaatttttgtagaggaaggggcggatcgaccgtacatcggtagcgaaatgaaaagacttttgaggcaaaatggtataattacggccgaaaatgatatggcaatgttttggaactcgattggcaagaggggacaaatttgggaagaaatgattatgccgattgttgaagtcactcatcgggactcttgggattttgatttggaaaatgcccaaataaactgtctcaagttaaatgaaaatgaaaaatttacaaaaaatgaggaagaaatattttctactaataattttcacccatgttcgcataatccgcacctattttcaaatttcgaccgttcatttccttatacaacatataatttggacaaaattaccgccattttacagcaaaaatatttactttcacaccaaatatcgcggcacgaagcttttattcccgaaaaagtgcgccagtctcgcgaccaatcgtcaccaactccacccccgattttggtgtcaatttcgtcggacgaatcagacaaagaaacggcaactgaggcgggaactcaactgaaaaaacaacgtccggcctggccacagaacaaggaaacggatcgtgagaaggagattcaggagcttaagcaaaaactcctgcttttggaggccgaaaaggcaagtgatgctcggaaggcggctaaagctaagaaagaggcggaaaagagagcaaaaaaagaggcagaagcgagagcgcagagagaggtggaagaaaaagccaaaaaagaggcagaagcaaaagcgcagagagaagcggaagaaaaagcaaaaaaagcggcagaagcgagagccaagcgagagatggaagcgaaagcccgtagagaggcggaagcaaaaacgcagagagaggcggaagaaaaagccaaaaaagaggcagaagcgagagcgcagagagaggcggaagaaagagccaaaagagaagcggaggaaagagcgaaacgagagagcgaagagaaagtgcaaaaagaggtggaagcgaaggccaaaaacaatctgagggctccatccgagattagtctttgtgaggatgagttggattgggaagaagcggaaaagaaggtgcaaaatatattgaggaaaagcagtgagatagctaagaaaaaagaggaaagaaagaaagtaggggagagaattgccagaggagtaataagaaggaagattacggagaaagagaaagaggaaaaagccaagaaagacagtagcgaggcagcaaaaaaagcggaagata

SEQ ID NO: 77061 - DNA, 1161 bp, Heterodera glycines
  Genomic contig location: Contig_ID=SeqID_1966; Location=48..1208; Strand=+
  SCN-specific regions: Sequence locations=1-491,513-643,665-1079,1101 -1101,1123-1161
atggtggtggtcggaatcgccgtggttggaattttggctgtcctgaccggaattgtggtggtcggaaacgccgtggtcggaattttggttgtcgtgaccggaattgtggtggtcggaatcgctgtgatcggaattttggttgtcgtgaccggaattgtggtggtcggaatcgctgtgatcggaattttggttgtcgtggccggaattgtggtggtcggaatcgccgtggtcggaattttggttgttgtgaccggaattgtggtggtcggaatcgccgtggtcggaattttggttgttgtgaccggaattgtggtggtcgaaatcgccgtggtcggaattttggttgttgtgaccggaattgtggtggtcggaattgccatagtcgagacggaactgttggatgggagtccatcattttgatttcttcttatgtttggtgtcctctttatttgctgagtggaaaaccaagccaagcgaaacaaagttgaacaattaacagaatgaatgaacgaacgggccaggggaattgagggtggcagaaaggggaggggcagttggtcaattgaggggacaaaaagtgatgagaggggctgacaccaaggaagggggaggaactccaagcccaagccaaaggggaaccccggtcaatgaccatcttttcatcacaacctcaattagctattatcaaactaatgaaatatataatttttgagggatccactggtgctatgacgttagtcaaaaaccatcaactgaaaatttggtttgatataactttgcccaaaatgaatgaactcattaattcttgatatccttcgatagctctaagtgttttctattatcctgcaaaaatttgaaaaaatttcgataaatttcaagatgactaaaaatgttcaaaaaaactttgttttttgagtttctcaggtcattatttatttgaaaattaatgatttttttttgtaatttttcaggataatagaaacacttaggactatcgaaagatatcaagattttaaaatttggtatattttatgcgaagttatgaaaaatttttatgtcaaaaattttgcattttggtctttattttatagtcattttcttcgagaacatttctgactctgggcaattaccttaaaggcacaattagctattataaaaata

SEQ ID NO: 77062 - DNA, 417 bp, Heterodera glycines
  Genomic contig location: Contig_ID=SeqID_1966; Location=1..417; Strand=-
  SCN-specific regions: Sequence locations=1-417
  Gene Ontology: Cellular component=secretory vesicle; Biological process=cellular morphogenesis
cgaccaccacaattccggtcacaacaaccaaaattccgaccacggcgatttcgaccaccacaattccggtcacaacaaccaaaattccgaccacggcgattccgaccaccacaattccggtcacaacaaccaaaattccgaccacggcgattccgaccaccacaattccggccacgacaaccaaaattccgatcacagcgattccgaccaccacaattccggtcacgacaaccaaaattccgatcacagcgattccgaccaccacaattccggtcacgacaaccaaaattccgaccacggcgtttccgaccaccacaattccggtcaggacagccaaaattccaaccacggcgattccgaccaccaccattccggccacgacaaccaaaattccgatcacagcgattccgaccacca

SEQ ID NO: 77063 - DNA, 569 bp, Heterodera glycines
  Genomic contig location: Contig_ID=SeqID_13231; Location=182..750; Strand=+
  SCN-specific regions: Sequence locations=1-153,179-331,374-432,522-569
atgccaggttatttggcttattgtccccagcccacggacttcgaacagtacacttactgttgtctgtactaccatttgggtgttgaccgaccttcgtgctgtcgcttcccatttcataccggtagtgggcaaggcattttgccagctttgaagttttaagtaaaaattttaaaaattatcccccccccccttgtgaaatgccctcaggcaaaaagacataagagaattcagcatcaattagcgatgcattaattgtaattcattcaggtgtgatcattgcactgtttgtttcgagtgttgtcgcctttttgggtaattatggtcaatttacattttatctaatttcattttagttaattaattattatttttagttctattgtttctaatgtgttggttttgcccaatttgtccgttggccaaaaaattgagggaaagaaaagaagaggaggctgaaaatagtggagaaatggacgaataaatgaagagaaaagagggaatagagaaaaaaagggaagtgatcgaaaaatgaccaattgacgatcagaagaagaacagaaaatgagaaa

SEQ ID NO: 77064 - DNA, 659 bp, Heterodera glycines
  Genomic contig location: Contig_ID=SeqID_13232; Location=1..659; Strand=+
  SCN-specific regions: Sequence locations=1-155,185-659
  Gene Ontology: Cellular component=integral to membrane
tgaaatatatgaacgagcggtgaagcctttgagggaaaaactatgggacggtcctctcggggaagcttcttcttctctatctcagtatcaattggccccaacttcagaaattgcaaatgctgatcaattacgactgggtgcccgtccctctgggcaagtccctccctttcccttccctttgcctttggccaaatgccgtgccctcccctcccccttcagcttattctcaggtcgttttcttggccactcgcgtttacttccttttgtgtttgtttgggcgccaatttcgcatttgggagcaaagggattccatggcttacttcgaatattactttccgctgatgacttttctgcaactgatgtgttacatgggctggctgaaaatggccgaatctttgctcaaccctttgggggaggacgacgaggactttgagagttcgtttcgcaatacgtacgctgaaaaacgacgaaaaacaattcgacgctttttcaggcggttatataatcgaccgaaatttggccgttgggatgacaatggtggacgaattctatggccaactgcccacccaaaagccggacaaattcggcaaggagggcgaagtgccgtcagcgtacacagagttagcgggggtcagtcattggcactttgccaactcaat

SEQ ID NO: 77065 - DNA, 300 bp, Heterodera glycines
  Genomic contig location: Contig_ID=SeqID_13233; Location=798..1097; Strand=+
  SCN-specific regions: Sequence locations=1-90,142-234,256-300
atgaaaattcattgcatttttttcattcttcttatcaacgaacttttcgttgttcctcttatttttggacaaccaattaaagaaaaaaggtatttttaatatttgcttaaattaaaaaaaacataattttaaaaataaatagtcaatatggattaacactgtcaaatcaagctgaaattttaatggaaatgtgcatccttggaattcgctaggtttttttgagttgaccaaatttgtttttccaaaaattttccgattttcagtgtattagagggtgtcccggtcactctaaacgaatga

SEQ ID NO: 77066 - DNA, 2983 bp, Heterodera glycines
  Genomic contig location: Contig_ID=SeqID_13234; Location=498..3480; Strand=-
  SCN-specific regions: Sequence locations=1-10,42-93,116-352,374 -1525,1547-1917,1939-2243,2323-2385,2414-2442,2464-2820,2843 -2902,2937-2983
atggagcggaatttgcaacagcagcagcagcaacaacagttggagatgggaaacaaccaatttcggaaatcgtctcctgacaatttggatgggatggcactgaaaaggtaaaagggagagactggcggctacagtaagaaagtaatgatattttaagcttgtaatttacaattgtaattcatcatggaaaataagcattttgcggttgtaatttacagttgtaatcaaaatgagcatttacggatgtattttataattgtaaccaaaaataaacattttacggttgtattttacaattgtagtgatatattgaaaggcgtattttgcctttttacaattgtaattaatcatggaaaataagcattttacggttctattttacaattgtaacgacacgaccaaatgcgtattgtaattaatcatggaaaataagcattttaggattgtattttacaattgtaacgatttaacaaaaatacacattttatggttgtattttacaattgtaatttattcattggaatatgcgcattttatggttgtatgtattttagaacacataatatgtttttccatgcctaaaaaatagaaaaactctatcattttattcccttcatgacacaggtaaaatgaaatttgaattttacagtgtgatcaaaaagcgtgaccggctaagctttgcacttgtggacgaacgggagaggcaacaaacgccgtcatgctgccctccgtcatcgccgggaaaagtgcgacgacggaggacggcacattcagtcacgccgttgcttgatgctcgcttgttcctcaacgggctcgatgaggtagaaactgcgagccatcacagtcaaattcgacaaattctatcctgctccatgaaaattcataggcttcatcatcggcattaatattacaaaaaaattgcagagtgccgtcgagagaactgctgatggcgctgctgaaatgaaaaaagacggcataatcattgagcaaagtcttgaagcagtggtggaccaggcactgatgagaaaggaaatagttagtgccagagaaacaaagtgcacaaaaatagatgaggaaaagaaggggcagcaacaggaggaaaagcatatggaaatggtggcacaacaaatggctaattcgacgcttcagcatgagaaattggtactggcatcgcagacgatgccgacggaagaagccaaattttcggcacggcaacaacaccgggaacagcaaaatatgccaccaaaagaggaaaatttgttacaaaatgaagcagtgccaccatcaccggcacttgtgacgatgagcaccaaagcgaagaagcatttgttaaccgatcggaacagtacggcggagacgcaacaacaaaaacggcaacgagtaaaggcaaatgctcaacgaactcatggccaaacagtgtcagaacgagttggaggacaacagcaacagtttgggacgaataacaacagaacagctgctgcatcaacaataaatgtaaagccgaatgctttacgagtgctaccaccagcagctgctggtgttctacgaacggcacaaaagcggactaacaacaatttggcaccggcaccaaagtgcactgccaacataaccgccgacccatcgtcggcaccaaaatgcgcaccagcggtgtgtcggattcgaattgttgccaaaccgaacagcaacaacaacaatgtccatggaataacgacgacgacgattgaggctgatcagcaccagcagaagcgagccccacatcagcaacagatgtgttcctcatcatcctctatgccggatcggccgttgaagccatcacaggtgaaagcgtgccaaccaaaggtgcagaagccagcagcagcacatggcggggtcggcactttgggccaaaaggcaacagttacggcatccgccggtccatttaaaacggacaaaaatgtcacgacaattggtggcggatgtgcaacagcgacagcaactgcagcagtagttgcggtacttatattttcgaaaattctcgggtttgaacataggcttcagatagtaagccaagcttttcggcccagcccaaatgcgagtcaaggatgcatgaaattttgtttttcatttggtccccctttttcggtatttttggtttcatgtttcgtttttggtccataaaaatatttttgggaatttgatttttttatgatcaaaaattattacttaaaaaaacgacggaaatttcgactttcagaaaatgaaaccatcatcagcaacaccgaccagcaacaacagcaatggtagcagtaccggcagcagaaggagcgtaacaactgctgcaaccaatacaactgttggcagttgtcaaatgatgatgatgatctgcagagggcaaacaccacaatgccaagaaaagcagcaacagcagaaggatggcaaagcaatggcaccggcacaaccgacgcaaccgcaacaacaacaacatttgagagcaacaaaaccgacactgacgagacgggtaagttcagaacaaaatttggtgtcggctttcaaaacaagaaatttttttgttactttttactcacagtaattcgaaatgtgtgacgtgataggctttttcaaattgaaacaacagggggtgcaattccaaggcccaaaaaaaattcggaaatcgaaattccaatccaaaaattcgaaaaacggaatcccatgatggcatcactgaacataattgaaaaattgagtcgtataatttctgatttcaatttttcgactatgcatacaggtcatagtttggaatgccagggtcaaaaaaatttgccaattttagcgaaaaaatgcaaattaaaaaaaaaaaataaatccagctgagcacttcctcccgcccaactttggtgcattcaaccggtcgaagctgtacaacgacagcaggaagcagagaaagggaaaagccaaaatggatttaacaacaaaaaaaaggcacaaacatatattttacaataaa

SEQ ID NO: 77067 - DNA, 2070 bp, Heterodera glycines
  Genomic contig location: Contig_ID=SeqID_13235; Location=1751..3820; Strand=+
  SCN-specific regions: Sequence locations=1-177,199-1229,1252 -1373,1399-2070
atggcaacgccgatcacacggcgttgctctgcatttcacaaggggtggcaatgcgctgcagcagcagccaaacatttcccggaatattgtgactccgggaaactcggtgacaaaaaatgcgccgattgcggtgcacatctcttctcacatgaagacagtaacatttgctgccggaagggaagagttgtgctgccaatgcttaacccgcatcctgatgagctcaaagagctgattgtggggaataagcaatcccgtgaagggaaagaatttgtgcgacacatgtcgcgttataacaacctgttccaatttgcgagcgtttccgctggcaacaaaccaagccctgctggcggtccgatggccgttattcttaacggagaattccatcgccgcataagcagcatgcaggctggtacaactcagattcctggctttggccagttgtacattctggacccagtcgaggctatggaacagcgtcgaaacaaccccaggtttactggggagaaaatcacaaacgaagatgagtttgtgcagggtcaccagctaaatgagcagactcttgagatcttagaaaaaatgatccaagtgcatcatcctgctgtgcaggcatataagcaggcgcgtgagcagctcactgagcttctccaacaacaaaatcaggaagagcttcgtttcttccgcatgactttgttggatagccgcagggctccagctggtcttaaagacccaaaattgcacccacaccaaataatcaccccttctacgggtgaagggatgttcgctattcatgcggaccccactggtgctcctccgcccaaaggaatttgggtagagaacaaacaagggcaattaaatgaaattgctcctttcagtccgtggactgatagtcttacgtatccattaatcaagccaatgggcgatgatggatacacaactggcattaaatatgctaagccaccatcgcgtaagcgaaaaggtgttcagaatgcatctggcctatttgactcggaagccgagtcagataatgagtcgtgcgagactcagtcaattgcatcatctgatgcggggtcagtcgcagattcagatgctgaatctgtagcatctgtttcatcgcagcaccggcggattgacaaatccaaacaatttatctccctgcgagattattgcaagtattatctcgcaataagggatgaaaatgtggagttgcaataccaccacattctttcatgtggtggaggacttggtcagcgctggatccttgaccaggctgcaaaaattgattggcaaatagcaacatttttgcgtagacctgacatggatctgcggatcagcactccaaaaaatctgctgcagtatttggtcaaccaatacaacaggcagcaagcacggcaaaaccccaatgcccaacagaaaactgttgatgacattggcagtgttgttcggctttccgaacacaacgtaaattctctccaatattggaagaaaatgtatgaagattgcaacaccgtttttgcacggtgccatgacgcgaagaaagcgcgtctcttcattactttcacgaacaacagggaatggcctgagttcaaagagaatttacacaaaaacggtcaagtatttactgaccgttttgacatgtggatgcgtgtctggagcagcaaaatcgctgagttccgagaagaactttatgacaaaaagttcttcggaacaatccttggttacggtgaatcaatggagttccaaggccgaggaggcccacatgcccacattgtggcgcaaacagacctggacgcagttccatatgtcattcaggaatacatatgggcgcacattccatctttgcctgataaagatgacgacacgcccattgcaaaaatgcatcgcgaaatccgcgaaacaatgcatatgcaactgcacagatgcagtgacagttggtgtggtcctagcgacccaatttacgggcggtgcaagaaggggttcccagccccttactcaaaatgtacgattttgcgcccggacaggcccgcgatgtatttccggccttcaccaactgatggtggtgcccaattagag

SEQ ID NO: 77068 - DNA, 821 bp, Heterodera glycines
  Genomic contig location: Contig_ID=SeqID_13237; Location=1367..2187; Strand=-
  SCN-specific regions: Sequence locations=1-176,201-280,303-494,529 -572,594-654,677-821
atggcaccaccatcaatgtccaacacggtgctcatgccggacattggcgattgcgcggcggctgaggcgggcggcgcatcgtttacggcaccgtcgcataaaggtgtgtgctttttatgatatctgattattttgattagcattgtaattaattattaaacggaaggtgattaaaattctttatgattttttaaaaattttctctgatcattgccggtcaaaaagtgatcagaattttgtttaatgatcagaatttcctttgatatataatgtttttggattaatttgaattattttcaattagtgcaaaataatttttcatttgtttagttttgccattttattaaaattattatctgcctgttaaacttatttgtttgattgcgttgccccatcaaattcttcaatttaaggttctttgttgtatcgaagtgaaggcgttaaatggaactcttctcgcgtttcgtggagagctttcacattacgtaaataccaattataattaataaattattttttcattaaattgtatgaattcgaaattcagaatcaaccgacataatgcgcaagtaatacaaattttcctttttaaatcaaccaattttattaataattacatgaaatggaatagggcattttataatttgcagaagccccaaaaatatttttggcatttttcttggcatttctcagggaattgcgcatgctttgcttccaacgggacaccgccaaatcgccagcatttccgcctgtgtcacttggtgaattcccactgttctactcggtactgtttgacatggcatgtgggaggcgcaaataaa

SEQ ID NO: 77069 - DNA, 1173 bp, Heterodera glycines
  Genomic contig location: Contig_ID=SeqID_13240; Location=480..1652; Strand=-
  SCN-specific regions: Sequence locations=1-130,170-527,549-618,655 -722,744-1173
atgcgaatatacctatgcttgttgtccttattaatttccgtacattatgctacagtaaacgaaccgcagaacaaaaccaatgacgacgatagtaatctgactctaccatcagtaaagttggcggtgggtgataattaaataattttaataattaataaaaaataataaacattgtttggtaataggtagttggttaagttcatttaaatgtgatttgagtgccagtcaaaccaataattagtattgaaagtcaagaccaagaatatctcgaaaaccaagatagagaattgatatctaaatcgatagaattgaacttgagaatcatatacctatgaattgttctcgaaatcgagaattggtccagcagaaaccgataagtgctccctagaccgagaaatgatttcaagatttcgaaaattaatcccgaaaatcaagatcgagaatttatcttgagaccgagaaatatctcgagatcgagaattgattccgagactcaacaccaaaaattgactggtagcggaaaatcgtgaagaaattctctgaagctataatgctctaaaatgtctggcactcaaatgtactgtggtactgaaccgaccggctcatttcggcattaagaaaaatatataaatacaataataatactaaattattgtagaacaatgtaaaattagctgacgaaaatgatcagcagaaaaataacgggccaccaaagaacggagttgcttttgtggttgaaggcattgagaggagcgattttggccaaagcctacgaacttcgaactttcaacgaagccgagcagctttaggtattattaaattgcaaaaattaaagcttctcacctaatgagtttgttcaaggcttccaaaattgtgaggacgaaagtttggccgttggcgcaaaaagttcgctgataaaagtgttttacgagagtcagcgggggccaagcaattacgagcccgaggcgagtgtgattaatgccactaattggctataattattagccagggggcaattccgtggcatcgaaatgaaaaattaaaaaatttatgagaaaaagttagcatattttttttatttgaagcaattatcaataataatttgtttttgaaaatttaccttaaaattaagagaaaaacatatgaatttttgaaataatttggaacaataaa

SEQ ID NO: 77070 - DNA, 324 bp, Heterodera glycines
  Genomic contig location: Contig_ID=SeqID_13241; Location=1158..1481; Strand=+
  SCN-specific regions: Sequence locations=1-64,87-324
atgagtgaaatggccgaactcaaagctattattaatcgcctatctgcaattgagaaactaatttcaacaaacaacaacaacacattggcgaccgaaatgactgcgcagttcagcgccatcgcggaccgcctcggcgaaattgagcgcaaattaaacaacaacaacaatggaattggcagtgcggaggataaggagcgaaaaaggagcctcgtgctcattggtcttccggaatcagaggaggaagtgccatcgcttcgagcgaaggatgacgcgaaaacggtggaggaagtgttggaccggctggacgtggaagtgtgcccgtaa

SEQ ID NO: 77071 - DNA, 1438 bp, Heterodera glycines
  Genomic contig location: Contig_ID=SeqID_13242; Location=588..2025; Strand=-
  SCN-specific regions: Sequence locations=1-216,252-894,933-952,991 -1108,1131-1181,1203-1321,1343-1438
atggttacaatccaatctaactcccaaactctatttttaagtagctcaagaggtgtttggagcgaaaacaaagcgttgagcgttcagctgccagcgctggcggagggtgaggcgttggccagcccattggtcagtgacgtggactcggacggccaattggacattttgatgccggtgagttaaattatggatgcacttcattccccctaactcctgataaatttttttaaacaaaaattgaaaaattttttctcgtttttttaaatacttgcatattttaatggcaaaatatagatatgtgctattttcaggtctgtgccagtgctgcatgtacaattgttgctcgactgtggtgctacagtcggcagacagtgcgaactgtccaaattgatttcagggtttgtaggcctgggaagactgaggaatgggtccccaaggttgggaaattgtccggaatattcaacgcaaaaaatttgtattgtgagcgaaagtcctggattttaagaatttcttggatgtacgtaccccgcgtatcccccccccccatggggtggggaaacaatgtctgtctgtctgttcattactatagactggaattgatttgtctagtttagcaagtcactcttgtgccagagattgacggacaaaccattgtgccatttcgaattggtgatttctcgcagaacggctttccggatttgctcgctaccgtgacgccgccgggtggcagcaaaacgccaatgatttttgaaaatatacccgacgacggcagctacccgaggttggtcttggctaaataatgcggatggatttgtttcccctcaaaaaaaagaataaaaagttttttattccctacaattcaaattttttcttgtataacatttttttataacgaaaatttgtaatttgtaaaaataaaatttaaaaaaaaaccttaaaaaagcacaaattgcatcattttttacttaaaaaactattctaaattttaggaagtttgaattgaccaagaagcctgaacgtattttacccccgttgaatgacaaattgtccgggcttacaatgtctgcgttttttgacttgaaggaagacggaaatttggacatgatggtaaatatattattattattatacatcatccttaatttgtaaaaaggtctttcttagttggctcattttgtatcataattaattttaaaaattttcttaccaggttgaataccttgacgaagtgaaggggtccagcgtgaatttcatccgttgtgatgacaagggggacacaacctttctgaaggtgcaagtgttcaccagcaccgaatgcaccggtccatgctgtgagcagcagtatttgccgtcgtcacacagcacaaatggcgttcgtcaaatcaaaattggtcagtcagtggtcagagtcggtgacttttaccgacaacaattgtaa

SEQ ID NO: 77072 - DNA, 1751 bp, Heterodera glycines
  Genomic contig location: Contig_ID=SeqID_13242; Location=2217..3967; Strand=-
  SCN-specific regions: Sequence locations=1-976,998-1196,1219-1751
atgccgaaatcgttggtcatgtccctgttggctagtgtgaccgctgcttccatagtcagcattggtgacaagccaatgcaacccattcctggacgggtttgtgccattgccgacatggacaaggacggcaacacggacttggtggtgcagcaaaacgatgtgttggtagtttacctgcaagcaaacgacggcagcgaatttaagcgagttttttaaggagtttgacatgctaatatttaaaattgttggttcaacaaagtgtccgaatccgaaccaattcgatattattggataggctaatggctcaaaattggaaaaaaaaatttaatttgaaaaaaaagatccaaaaatcttcattgtcagctattggtccaatttaggaggtccaaaacggagctgacattgccggccggcgttggccaagtttcctgtgccgtgggtgatttcaacggagacacgtgtcccgacctgcttgtcatccaggtatgcaataaatggacaatgtttcgcattagtcatttgttattttctatctagccttttttgtttcgtttcgtattttgagatatatttttgcttttgcataactttaaagttttcccgaatttggtctcgacgaaaattaaagttaacgaatttttcatttcggaccacaaaagactttttgctaaaaccagtggtaatacaaattacaaaaacatttttataattatttgtctttatttgtttgtttttggctttgtccttgtcgcttttgtgcccgtgcacagtgtttgtcttttgtcgttcttttagacgttccaagccgacctgaacatcatcgacaaagttaaggcattgttcaccactacagccgaatcgcagtacgctgccattttgtacctgaatgacggcaacgacacattcactgagcaccaagtttgcgatgaaaacagttacgtttttctttttggtatttaataaatttcagaaaaaattattagaaaatttttccttattgttcaacttattaaaatctagaaaatcctataaaaacaacgtttaatgattaattgggggttttcaaattttattcaaaatttttggttaaaagagattgaaaaaagttttctatttttctgaaaaaaattttaattttggtatagaattgagattttaagaaaaaactagcttggtttaatgatgtgtcgaatttcatttttaaaattattataaattcgaacttgggtactattttttaaatttttgcttattcttaggtttggaaggcaccacccccgtttctcctgaccctggtccgccgaccccaccgctgcattgtccaaccaaatttttggaccatccaactcttgtggacatcaatggcgacggtgtcaccgatttgctcggatttgtgcagcgaaagagtggtgggtaaaaaaaaaaatcaaaattttaccaattttcgcatttttttgcctgattttacgtgacaaaatttagcggacaacgccaaggaatttacggagctgttctgccttgagggcgttcggcatcaatcttcggcatcggtgccaaaatttcgtcactgtgagcaccaatttccaccggtgcccagtggtggtgtcttccccggctttacaccaattttcgccgatttggacaaggatttgagtgccgaatttgtgtttctggcagcggacaaacgttcattggtcgtgtggagccagtccaggttcatctcgttttgctccttcctcgttactctatga

SEQ ID NO: 77073 - DNA, 2045 bp, Heterodera glycines
  misc_feature (49)..(49): n is a, c, g, or t
  misc_feature (57)..(57): n is a, c, g, or t
  misc_feature (101)..(101): n is a, c, g, or t
  Genomic contig location: Contig_ID=SeqID_13244; Location=1..2045; Strand=+
  SCN-specific regions: Sequence locations=1-22,45-250,272-638,660 -990,1016-1047,1070-1191,1214-1257,1280-1480,1502-1529,1551-1764,1786- 2045
atacaattgtgaaaatttcaatgaaagagacgttatttttatgagccgnaaaatacnagagaaaatggtggaaaaatcagagaagaattggaaattgtttnggacagaaataaaagtgtttttgctaggcatgaatatgaccttggcacatgtgcctattgcgctccgcctattctaacaacctccgaccttccggagagggttcggccttaccccgtacctgaaaagtatgaggaggaattgaaggcacaaattgaaaaaatgttaaaatccgaggtgatcagagaaagttgcaccccgtgggctcacaacattgtccttgtcaaaaagtctaatgggcagttaagaccgtgtgtggatttccggccgttaaataaagtcacggtcccagacccttatccaattccccgaatggataaaacaattttacgggcagctggcaaaaagtggtacagtaccttggatttggcctcagggttttggcaaatcccattggaccacggacgcatccgcagtcgcatatgcaggcgcactaatgcaatcagctgatgagaatcaaatgcacgctgtcggtttttggtctaggactctaaactcgacagaagctaaatttcctccaacacatgtagagttggctgccatcgtccatgcagtccaaaatttcaaacccataatttatggagcagaactgattattttaactgatcacagaccgctcactttcctattttccaagtcaagctcaaaccccaagctgaatcggtggttaatgtcattacaggaatttgaacccaaggttgtatatttggaagggaaagcaaatcgggtggcggatgccttgtccagagtcccgattaaatgggaccaaattgaatcaaaatgtaaagaagacattccctttttgctggtgacagatgaagaaaatggttttgaaattaaccgggagaaaattgagaaagaaaccagtttagacccaattttgtcacaaattgtctcaaaaataaaggaaaattgggccgaaccaattcaggaggagcttaatgtgtattataagcaaagagatcaattatatttggagggaaatttgatcagaaaaaagccactgagacaaattgtaatcccggagaaaatgcgaaattcggtactaaaattggtgcacagggcacattttggaattgtacgaaataaggcaagggcaagaaaccagatttggtggcccgaaattggagatgatgtcgaaaattttgtaaaaagttgttggatttgtcaaaagaatggatctatctaatccacccaaaacggatgctgcttataaatggcctgattccaagttcccattcgaacgggtccatgccgacttagccgggccaatttggggaacgaatttttttattttggttgatgcgtattcaaaatttccattcgtttaccaaatgaattcgactcattcatcggcacttattaattcgctccgtgaattatttggaatttttggatcaccaaaaacgttggtgaccgacaacggcactcagtttgtgtcaaatgagatggagacgttccttcagggggaagggatacgccatttgacatctccgacataccatccttcatcaaacggcgaagccgagcggtttgttcgcaccttcaaagaaggaatgggcaaaatgttggaagatggaaagagcatcaaaattgcgcaatttattttcctgcaggagtacagagcgaccccttgctctgcggcagaaggacaaagcccttctcaaaaatttttgggaagagaattgcgtacggagttggacaaaataaaaatgtcagcaagtgccattgaacgaaaaaggcgtctgttgcccgaggcaaatcgtgaaaagaatttggttacgaaaaactttaagcccggagacttggtttgggtaaaagagccaaatggcaaatggacgcctggtgttttattgcgcccaattggtgaaagaatttggaaggtggagcctgagggatgcaccattagcaaaagtgcccatttggaccagttaaaagcgcgacgc

SEQ ID NO: 77074 - DNA, 1120 bp, Heterodera glycines
  Genomic contig location: Contig_ID=SeqID_13245; Location=429..1548; Strand=-
  SCN-specific regions: Sequence locations=1-106,128-483,506-724,781 -1120
atgcccggtgagtgccggacgacagacaaacacaattttggtggcatgggggcatttctcttctcccagaaatggcatttcaaactttgaataccaaaatatgttgaattggaaaaggatagcacaataaaaatgaatgtattttttaaaattttaatgaaaaatctgagttttctaaattttaacaaaaaagtaaaaaaaaaatctgtgaactctttttggaaaatttaaaaaaatactttcattggatttttatttatttatttttcgttttttttgccatgattttttacccctcaggcgcaccagtgactgttgcaagtgtgaacattgacacggacactttgctgcgcacgcggcacaccgacgccaaacattcaaacgacgacgaaaaccgggagaacgacggcaaatttgatgatgctaatgatgatggagaggacggggaggatcaacagaagggcggcgaagaaacagtggcaaaagagggggaggaagaagaggacaatgggatgggaattgaacgacggggacggcacaatgccaaagctgaaacaattggtggtgctcagctggcaccgatggtttcggttcggcgcggcacggtggtggcggagacgcggggcggcaactacaaagtgtccatcccgttccgggcactcatctacacagggtccgacccgaaattattttaaatgacgcattttgttaatgggttttagacataaatttttaaaatctaacaaaaaatttaaaattcgaattgaatttttcccatttttcagcgatttggagcacgagacggaggccaccgcctttcaccacgcgttggagcccattgtccgccgggaagtgaccgtcaccaattcgttgcccttcggcctggccgtttggggcgtcgaactggccgagaacgcgacaacggcgtttcaggcacgttgcccattttcggaatttgctcaaacaaatcttttcgagactttaaattgtgtttctcgggaatttacaaatttttcgtaatattctaagaattaagaaatttaaaattttccaattcccattttttcaaaattatttttaaaattcaattttgacccaactttacctcatagcgaataaa

SEQ ID NO: 77075 - DNA, 990 bp, Heterodera glycines
  Genomic contig location: Contig_ID=SeqID_13246; Location=155..1144; Strand=-
  SCN-specific regions: Sequence locations=1-567,589-865,887-922,944-990
atggtcgtctccgagctgtttgtcagcgactgcaacgtgcgcattgaactgaacgatggcacaacggtggcaatgcaaaagcgacgatgggacggcggggacaaaagtggcggcagaagagaagcgatggattgggtagaaacttaacttgttggacaatttaccatgggggatttaaccatttaaccgagtaaaacatggggactatttaccatgcggatttacgatttacagagtataaattcggagcaagtcgtccctctcccccacctggagtttttttttgtttttcaaaaaacttttattggaaaaatttctgtttgaaattttaaaaaacttccagaggttactgagcaagaaacgtggcgtattttatcattgagaatttgacatgaattcccaaaatgctggactctttttttaccagggcatgttaagttggaagtttgctaattaaaatgccattctttgtgcaaggaattggttaacacaaattcaatttggtaccaaacccgggaaacgaattccttcgtttcgttaaataacttttttttacatatttttaccatggcttttatgaatgcatttggttggaattttgtcatccttttgcctaattttcagcgctttcgtccctttgaaacacgcgaaattggacacgccaaagtgttgggcaacttggaacggaacagcaccgcgtttattgtggcaaaactgcgcagaatgggcagcggcgatggttggaggacaacacattccccgtcctcgccatcggcaccaaacgatgccacggcacaacgccagcaaaaaaacgatgggtccgacgacagaaaaatgggcggcgatgatagcgatgccaaaaaggcggtgccaaaagagcagcaaggtcaactttggcacaaccatcgcaagaaacaaccgaacgccggggaggagggggaaggggacgacccatttgcccaattgttggttgtcgcaatcggagtgcag

SEQ ID NO: 77076 - DNA, 972 bp, Heterodera glycines
  Genomic contig location: Contig_ID=SeqID_1967; Location=655..1626; Strand=+
  SCN-specific regions: Sequence locations=1-972
atgcccatttcgtgcggctccaccacctcccaatcggcggaactggcggaagaaacaaatggcaatcaatatgacgacaacatcaaagaggtaagtcaaggcgagcaagaggcgttcaattccattggacgagaccgctggtacaacaatagctgatctgctatttctacgatcgccgtcttcaccccgcttttcggcgcctgcttcaaataagaggaagttgaagcgaatgtcgcttgagttggtcagaaactggagctgtgacgaaggatcgttgaaatagtgtccaatgcggaacttgtacacctgccttcgccaaatcaggtacacatggtcagctgcaatgaaataatccgttttttgttccggcaaaaagccaacaaaattgcttctcagaacatgtgccgtcctgttcagtgcattgtcagtgttattcagagtccaccatcgctccaaatcgccaatgagcaattcgttgattcggcgttcgctattgtccacaatgtacaatcgggcggcgatatgatcatacaaaatgcgaccatgtgcactcaattgccctgctattttttgctggtgtccacgaagaacggtcacctcacccacggcattttgaaggttgaaaattacaaaactatggccgccatgcccaaaacatgcccatggtaaggcggttgacggtatctcaattgttgtccgtcccaggctcattaaattatccacatctgtcagggcaatgttccacgtatccgggttggtgtacagccgattgatgttcctttccaactcaacatggcatgctgtgtcccggttatagccgaaccaatgttgcgccggtgaagtcttggaaattgtgcgaaatgaacggtcaaaaaagtttggtgggtcaacactcagctcaacattaatccattcgccagcagatagacggagaacatggaaaaaaattacgatgaaggcgatcagcaagaa

SEQ ID NO: 77077 - DNA, 3239 bp, Heterodera glycines
  Genomic contig location: Contig_ID=SeqID_1967; Location=3691..6929; Strand=-
  SCN-specific regions: Sequence locations=1-313,335-945,985-1424,1446 -1526,1549-1622,1645-1727,1749-2071,2096-2615,2637-3239
  Gene Ontology: Mol. function=myosin light chain kinase activity
atggacgaattttacattgtacttccgtccaacacaccaggctcaacgaatacggcatcaaattttacggttcggcttccacacacgttggagttggactcaaattggaccgtcgctctagcatctataatctacccttattcatttccatcagtcggaattgatgaggatgatatcattagcattaaacttgttaacccgaactatagattcctagacgacaaaaaatttttacatatagaactaaaggttccaagcatgcaattttcgagtgtagaacatttgcggctcaccctgaacagcctcatacgtgaggtgtatcagcagcagcaattttcttctggccatgatggagctagccggacgaaacggcaggtcacagacctattttttcatgaaaatccagtggattattgggaaaagattggcgaattacgcaccaaacaagagcagttcgaaaaggaggtaaaacaggaggagagtgaactttcggcagacactacggatgtggagaggaaaaaactgatacaaagcgagcttccactcaaacggattcgtatgcagaggaaaaaggaagagctggaagagttggaacgcgctgctgaacgtcgtgatcaggaaagtccggagaatgagcaaagaaagattagcgattttttccaacatcatcccgaagattataacaaaaaattgaacgagtcaagacttatattcacacaacatctctcggggctgcaagaggtgatgagcaagtacattggtgaaaaagatataaataaaattcgtcagcttaacaccgaggttggcaaaatacgcacaaaaataaaacacatgcagcacaatttgaccatctttgaaaatgctgcgcttcagcgtgaccaccaaaaatctttgtcggaatatgaggagctcagccaccagcagaatagtgcatttgttgaggaattttttcaaaaacatcccaaaaattattggcaaattattcacaacaattataggggtcttacagaacattttcagaagatagaagaactgcaagcaaaggcagtagggttaaaggataatgcctctttcgaaaagcaaatagagcgagcaaaacagatgattgagtacagacgaaagagattcgctgcgctggaatttgaggcaaaaaagcgtgatgagcaacaacagtttgttgcagcagcagcaaatacaattactgcaccgactgcgtcggcattgatcggaagggaggcgttaaaaaaacgtacaggcatctctgccagaacggatggtgaagtaggtgataaagcagatgtcggtccacaaacagctaccacaacaacacatggggaggtattaaaagagaaaatactggagcagcaaaaacacacggacaacgatgataaagcagatgtcggtccacaaacagctaccacaacaatacatggggaggtattaaaagagaaaatactggagcagcaaaaacacacggacaacgatgatacagcagatgccggtccgcaagcagctaccacaacgcatggggaggcagtacgtgagaaaatattggatcaacaaaaacacacggacaacgatgatacagcagatgccggtccacaagcagctaccacaacgcatggggaggcagtacgtgagaaaatattggatcaacaaaagcgcacggacgatgatgataaagcagctgtcggtcagcaaacaatcccaacagcaacaaaaacacgtggtgagacgttaaaagaaaaaatatcgcaagagcagaagcacctagttgacgataagtcaaattctgccaatgcaaaacaagatgatggtagcggtactgatgagaaaatcgcgcatggtcaaacgctaattgcccgacttaaacagagcgaggagcagaaaaaagaatggggggacccaccccaagataatgatgatgatgggcgagcgccgaagcatggagaaatgctgtggaaactgttgcgatcaacggtgccgactaaccaacagcaaatgggcgatgtcatccaccaccaatttgctgatgctgaacaaacccgtggacaggtactgatggagctgttgaaaaacatattagaagaaaaaactgacactgcggatgcacagcaaaattatcaccatctacagaaatcagcctatctttcttcaacactgcgaagaggtgaagcgttgaaggaactgattaaaaaaacacaaaatgaacctttgcataaatcctctgcaaaaacgcgaggagaaattttaaagttgatgttggaacatatgaagttttccagggaggaagaggtaagctttgaaaaacttgtcgccaagcagcaaaaagagtcaaccgctgccgagtttgtgttcaacgatcttgcacaacggttcgttctgataaccggtgcgggcgttctgcatgtggatgtaagtaagcatcttgcatatgtgctaggctttgacaacactcgtctgtttcatggggaacaggcacgctatatgccagatctgtctggtggtgttaaacaattgtatgtttatgctccaaagcttattgaggagtgtatcataggtgaccgaatggctcctctgcttagagttgtcaatgtttcggccgcacctgtcagtgggggagggacggacgtgcctgaggttatatataccaatgaaatatttcattcacttcaaaacaaacgcatttccgaaattcgcatagaaattcagaacgcatttggacgatacgtcaaatttaattggggaacctgcattgtcactctgcattttagacggaaattattttaaaaaatatcagcaacaaaatgactcacgtcacatttaacccggatagcattaattggggacctcttcttgctttagaacaagtgggagggggagaaatgcaatattttgttggtacacggcatcagcgtggtgctggtctattgagaaatgttgcccgcttcctgatgccggtcgcttccaatatgctgaaggcggtgtcacgcgaaggggtgactgccggaagccggattatggaggatctttcgcagggaaaggccctcaaggaatccattcaggcacacgcaaaacatggtatggaaaacctggctgaaaaattgaagcaatgtgggaagggagcccccacaaggaagaggaagagaccggtgaaaaaagtgaaggtgccattgccaatgcattcgttgagaggcaacaagagacaggcaatagaccaactcacatttgcgccttaa

SEQ ID NO: 77078 - DNA, 1925 bp, Heterodera glycines
  Genomic contig location: Contig_ID=SeqID_13247; Location=80..2004; Strand=-
  SCN-specific regions: Sequence locations=1-364,399-805,831-891,917 -1170,1206-1729,1751-1826,1848-1925
atgcgctgctccttcgctttgtcccttctgttcgccgtcggtgttcagctgctgattttgagaatggccaattccgaaaaggtaaagccaagggaacggagaatggcattccctggagaatgacacttttgaattggcaattcatcaaaatgaattaattccctgcgaaattctttggcccatggccatcttctgctaagaagagcatttttcaggaatttgtaatggccaaaagagagatgcgcgatggcaccgtcccactgagcttcaaaatggacagaaatgcctttcggatgagtttcggcaagcgcaacgcggtaaggccaacaaatgccttaataagccaataaattgccgcttttcctcccaggctttgcttttgccattccctgcggttcgttcttccgtcccgcgtccgttggacatcgatcggaatgcttttcggatgagttttggcaagcgaatgccgatcagtgacggcagtggcgagcgaatggtaagggaattcgaagaacgctaattgaactcccctccccccccccgcctcaacagaatgccaacttcggtgccaaccaccaattccgcgcgttgtgggctccggccagcggtggatgggaggcggccggcatttccccgaagcgattggacagaaatttgtttaatgtcggatttggccgacgataaagcgaaaggcggggagaagcagccattaattgatctcattttgaccacaaatttctgtttttaagaaagaattcgaaaagacataaaagtttagatttttaataaactcagaaaaaatgccaaataaaaaaataaaaataatttttcacaaaaccattaaatgttttttttttggttttttggctgggctttccttaacattttgccgtttctttctcttttttctttgtcccgagaatatgaaatttgccgagaaaaaaagaaatgccaaaaataaatttcgaaattaaaatcagtgaatcgaatgaatgaaaagcgaaaaacaatgccaaaagaaagggacaaattttcggccaaatgccaaacaatcagtggagaattgagcagaaaatcatgatgaatattgttaattttatttgtttttgtttttgcctaaaaataagggaaaaaattggcgaacatttgcaaatccaacggagaatttacgagcataaatattattaaataaatcactaaaatccctctttctatcccaaatttttaaatatttcaacaatttggtcgctacagtatgttacttggattatcgtattcatttggcgttattcggtcgattgaatttccacttttttctgatccttcgcattccgtcggtgcaagaaatgacgtcgacaaaatccaatgcttttgcgatttgcattttgtattaaccgtcatgggatttcgacgacattaattattaatcccccaaaattcgaagtgaatctatcaaaatccgcggctgattatctcgacaaaatgaaataattcaaataattttattcaattttttttctctcttcaaaatttgtctgtgccttccattaacggattacctctttgacaaaaaatcacaaataattcatcaatttatccgttttgataatatgtttcattttttgattcattttgaaaattgtccattttttggaatgaaaattaaactaaaaatccctttttattttttaagttccattattaaaaatgtctgttattttttttggtaaatttacattttttgtgccattcaaaagacttatataaattgaccgtcgtcttgtgatgctggcgtaaaatgcagctttcccttcctaattaggtgctttttcttatttttgcctttgtactgaaaataaaaaataaaaatccaaaaaaattccaattttcaggaaaatgtaattttgattattttccgtttttaa

SEQ ID NO: 77079 - DNA, 58 bp, Heterodera glycines
  Genomic contig location: Contig_ID=SeqID_13248; Location=802..859; Strand=-
  SCN-specific regions: Sequence locations=23-58
atggcaaattggcaatgcttttttgtttctgatcattggccaacattaattgcttatg

SEQ ID NO: 77080 - DNA, 122 bp, Heterodera glycines
  Genomic contig location: Contig_ID=SeqID_13249; Location=611..732; Strand=+
  SCN-specific regions: Sequence locations=1-122
atggacaaaggcggagaagtgaccggcggacggacggtaatgtgcgacggagcggcggttgaataccgcgggacattgtttatccgacgggacgcatatcgcgaagagaaactgccatatcc

SEQ ID NO: 77081 - DNA, 682 bp, Heterodera glycines
  Genomic contig location: Contig_ID=SeqID_13250; Location=15..696; Strand=+
  SCN-specific regions: Sequence locations=1-332,354-682
atgctcggaaaaaacattcatggcattgaattgcccgtcggaatttttcatcgtttgcgtcaattcaccccgtcacttctcaatgaatgtccatcacttcgcatttccaatgcatattacttttgtttcttccccgaattcccatgcaatgacaatgccgcggcatcggatggacaagcggtggccaaatggcttttcactccacttcaagacaatgtgccaaaggtgttcaactgttggttgcaaaatgatgaagcgaatttgacgtccaaagttgaagttttgattgatttggcacttttatgggcgttgggattttctgacaaaaacattaataactacataattaaaaattgtgcggacaaaaatggtcttttcctaagagaaaagtgccacattttaccatttcatttctttatcaatttgctccatattttaggcttttgcctcggcttcatctccgtccaatttcatcatttccatttcgtttcctttgccttttgcttcctccgttgtaccatttgctctaaccaacgaattgactcgggagcaattggtgttgaaaagaactgacaataaccgccgttttctgctgattcgggctctactccagtttatgcgtccaatcgacttttatgcgtccaatcgctttttatgtatcaaattatgtttttttgccaaa

SEQ ID NO: 77082 - DNA, 282 bp, Heterodera glycines
  Genomic contig location: Contig_ID=SeqID_13250; Location=2784..3065; Strand=-
  SCN-specific regions: Sequence locations=1-107,172-199,221-249,275-282
atggttttccactcaatcacagagaagattttggacaggtaaaagctaaaattatattaataaaagatggtaggatttttaattaagcagctgacaaatgagtcgattttgaagttttaaaataaaaataggtaaatgttttacttttttgattttatgagtaattacaaaaatattttctaattgataagtgatattgttttaattattcaaaatacaaatttaattttagcgtgaatcattcacaccaaatgacaaagaaaaagtaaaagaggtaataaa

SEQ ID NO: 77083 - DNA, 142 bp, Heterodera glycines
  Genomic contig location: Contig_ID=SeqID_13251; Location=1362..1503; Strand=-
  SCN-specific regions: Sequence locations=1-142
gcgcgaagcgcccgtctgaggccgcgaagctgccttaatagcccaacaaatttagaaacgggcgcgaagcgcacgtataagcccaacaaaatttaaaaaacgggcgcaaagcgcccgttcgaggccgcgaagcggcctaaaa

SEQ ID NO: 77084 - DNA, 1217 bp, Heterodera glycines
  Genomic contig location: Contig_ID=SeqID_13252; Location=1..1217; Strand=-
  SCN-specific regions: Sequence locations=1-394,416-874,909-918,941 -1132,1154-1167,1189-1217
  Gene Ontology: Mol. function=potassium:chloride symporter activity; Cellular component=mitochondrion; Biological process=embryogenesis and morphogenesis
ttaagacaaattgttggctggcgcggtcaatggaatggcacttttggtggcgaagggaataaccgaatttccgagcaacgttaaattgagtggctatttggacgtttattggattgtccgagatggcggactgtgtgtgctgatcacttttctgctgaaacagagcaaagtttggcgcagttgcaaaactcgaatcgttgcagtcgctcgtccgcaagaaaacagcgcaaaactgaagaaacagctccaacactacgtttaccaattgcgaatcgatgccgaaattttggtgggggcgcgggaaagcgatcggacggttcattttgtgcgttcattgtcaggtgacagaactcaatgacccagaactgtcgactactgcttacgaacggactttgcttatggaggaaaggaccaaaatgctgaagcaaatgcaacgacgaggaatgccctcgctccaatcgacccaactgaacgacgaagcgaacattggagtgactgaccgacccatttggagcaaatggactccctttatctgttgcatttcagcctaacacgcaaagtcaggaagaggagacgcaagaggaacagacaaaggcatcgactgatgaagacgcatcggaagagcaaacggagacgaaaggacggaaggaagggcaagggacgacggagggagtccaagtggcagagacaatgtccacccaacgaagtgacggcacagccaattgaccgttctttttccaggaaagaaagtgcacaagcggagacatgcgttgacactgagaggagacagcgaatattaaaggcattggaccgaagaaaggtcaacgaatggacgaactttgacaataagtggggggggggcggggaaattatcgaagccaaaagagaaaagtcatcaaaactggaaaccgaaatgcgaaatatattagaaatataaaaatgggatggtccgtcaccgcatttttctctaaaggtccataaaatgcacggggcaatccgactcaatgagcttattttggaacactcgcgctgcagtcaattggtgcttttttctcttccgaagccgcctttctttgaggacgaagtggacgactacattcagtatttggaggtgtactttgacattttaaacgcaacaaaatgaaagtgtttaggtgatttcggacaatttgcaaaaagtgctttttgtccgggggacgggcgcagaagtaatcaca

SEQ ID NO: 77085 - DNA, 705 bp, Heterodera glycines
  Genomic contig location: Contig_ID=SeqID_13256; Location=125..829; Strand=-
  SCN-specific regions: Sequence locations=1-96,210-340,362-420,447 -497,541-705
atgcatggaagcattggcgttggtgatttcataattggcccggactcatccgattcagatggaaaagaaaactcagggcagggaagtgcaagttggaaatttacaatttatttataataaaaattttttaattaataatttaattacgtaataaatgttagaagaaaaaatttaaataaaattttaaaatttgattgatttaaaattatcaaaaacgaatgggggcggatcttttgatatcaagagatttttctagccatgttattaatgtcagggaacttgtaggttttgtcaccatcccgccttgaaaattttttccagcgagttacctgaaaattcacttgaagtgaaaatttgtgagactttttgttcaagtttttttacacgtttttttatttacaaaaaattctaggcttcaagaaaatttaattttttaaaatttattaggcacttcatttgttgcgggacaaagcactgattcttatataagcagtttaaaagccaaaattattgaacttgaaaaggtgaagactgagcttgaagtagagaaaaagcgtcaagaagaagcaaatcagcaattttacacttattggtgtaatgaaaatgccaaatttgaaaaagttcaaaatgagtttcaaaaatttcaattgtaccattgtgtcagaaaggcaattttggacaaaattgttggtacaaatgggggcg

SEQ ID NO: 77086 - DNA, 2121 bp, Heterodera glycines
  Genomic contig location: Contig_ID=SeqID_13257; Location=1..2121; Strand=-
  SCN-specific regions: Sequence locations=1-212,234-461,489-686,708 -895,920-1238,1260-1855,1877-2121
  Gene Ontology: Mol. function=theta DNA polymerase activity; Cellular component=snRNP U6; Biological process=DNA repair
cttggcaacgtgaatgtttggaggatgagcgactggtcgaagggagggaaaatttcgttttatggctgccgacgggggccgggaaaacggtggtcgcggaactgatgatgctcagggaatgtgtgcggtggcgacgcaactgtttgctcattttgccatatgtggcaattgtgcaggaaaaggtgtgcaattaattccttataatttccgtatgtaaaatccgttttcccttccgattattccatcttaccctttaggttatttccctgtcttctttcgaagaaaaattgggaataattgtggaggaatacgccgcggcgaaagggcgtttcccacccatccgacgacggacggccaaatccatttacatttgcaccatcgaaaaagctaatgggctggtcaattcgttgattgagaacggaagggcacacgaattgggcctggtcattgtggacgaggtgaaaatgtaaaaacaaaacaaataaatgattgtttggcacccaatttgtcataaatggaaatgccctaatgaccttacgagtcattatgtcctccttagattcacatgttgggtgagcagggcggaaggggcgctttgctggagcagtgtctgtgcaaattgctcttccgtcccaccaatgaacagcaacaggaacgagttcagctcattggaatgtccgcaacacttggcaatgcttctgaactgtgccgttttcttggtgccaatctcttccgaactcattttcgacccgttgcgctgattgaaaggataaaattgcacgacaaactgttcagggtggacgagcagggcgagtggaggatggagaaggaattggagaagggcaacaaagtcggacaattgcggggggaggggggtcacaaaaaacgaattcatttggaggaactcgagaggagagacccggacggactgttcaaattgttgggcaatttgctcaagggatctgtgctcattttctgtccgaccaaacaaagctgcgaaaacgtgtgccaaatgctgtccaatttcagtccgaagttggcatttacattattatttgttttttttttgtaatttcccattttcagacaattgcgtgaccatagagccgatgagagaaatgcactgatcggtcgacttatggacgaacacgagggcctcatctgtccggtgctcagtgcgtgcattcgcaacggcgtggcttaccaccactcgggactgtccagcgacgaacgccaattggtggagggggcgtacaaagttggccaccacttctttatgtctgtccattttatattctccatttccttgtcagagtggcattatttccgtcatttgctgcacttcaacgctcgccgccggcgtcaatttgcccgcgagacgagtgatcattcgaagtcctcatgttggaagagagcagctgaagaaggcacaatatttgcaaatgattggccgggcgggcagggcggggttggacgacaaaggggacagcattgtgatattgcaccacgggacagaggcacaaacggtgggcaattggcaattaaaatatcatgagaaatcttttagttcaagaaaatgcacgagggacccattgagccgtgtctaagcggactcagtgaccaagtccaattggaaggcttcttcttggatttgattgtgctcaaagtgtgtgggtcattcgtcttccattgtccaattgctcctccttttctcagctttgctcctcactcgacgatctcttccgatttctacgccattctctgttcggtgttcagcacactgacgacacggaattgttgtcctttgtggaacggactgtccaatcgttgctcgacaaaaagatgattgttcgacaagaaattgttccgttcttccatttcaaatggaaaccctaattcatccattttaggacatgttcgaagccacacaaatcggctcggccactttcaacgcgaattttaacccccaaatggcacttgacatgtgcaacgacctcggcgccaatttgggcaaaggcatcgtgctaatttcgcacttccatttgctttacaattgtgtgccgttggacgtcgccgttcaagtggactggaatttgttctacaacgaagtcagtcagtctt

SEQ ID NO: 77087 - DNA, 2340 bp, Heterodera glycines
  Genomic contig location: Contig_ID=SeqID_13258; Location=1..2340; Strand=+
  SCN-specific regions: Sequence locations=1-556,579-585,607-657,681 -873,895-1129,1151-1204,1226-2132,2155-2276,2298-2340
aggtcgccgatgggttcaccgggtgaaaccgatgcgagtggaggcgctgtttgtgttcccgggcgaacgttacgacattctaatcaggtacatgggccaaacgaacacttattagccggattgatcagcataaaacgaattccccccaattcagaggactcatttcccctcgtcggcgtttataccgaataattgtcgagacgatggaatacattaattgggattggactcatacgaaagcaccgaccgtagggcttgccaatttgtactatgaagactttgttggcacagaaaaggcagtagatgttgacataggttggcaattagcgttattttccaatttaatttcaaattatctaaaagtggattggacacatcgccaatgcacgcccgaggcaaaatgcaatgtgctgaattgtccctttgagcagtttccgccatctttgaatttgacttgtgtgtccgcccatctgttggagagtgcggaaccaatcgaagacaccgaacttttggaacaaaaagtgttccccaaggactcgtttcacgtaaacatgcgtaattaattaattaattaattaccctcatagtattcatcaattaaaccgtcattaatccgaaagagtcgtccaacggaccactcccccctcgtcactaattgttaaattattatttaaaatgatttcctcacggcacaccggtggtatttgagcagtctttgtgccttctcttttcaggaagtgttcgccaatatgcacgcggacaatcacttcgacggttggctgtttgagcatccgtttggaattgtgcgagtttggcacaaaattcgcacagaattgcgcacgggcagcggcaagggctgaaaacttacggcccggaaggcaaaagacacgaaaattttccagaatttagatttttctttttactaattatcctgagttgtggtttccttaaaaatttttgtgtccggacgggtagaaatttcgggtcggggtcacttcagcgcggaccatttcggctccgccaattttgaactgccataacttttttgtttgacagttaactgtagccaattaggcattttgaaagctttatttgttctcgacatttacatgtcaaatttgaaaggaattttcaaaagtaaataagttatggcacgcggtgccgaaaagccaagtttttttggccataactcttttgtaaaccgacaaaaaatttttaaattttgcatgctaataaagaaccttaagagctatcgaatgataccaaaaatatttaatttgatgataatgagaaaagttattagcaacggcgccgaagtgggcggtccttgaagtttttgggttcattgcgctgcatttccataagtttaaaattatgaatgtcctccccccccccaaatttaagccgtatttcaaccgtgacaatttgagtcgtattgcacggctttgcgacacgagcgaaagctgcagcccaaaaacgaacgcacattgggtgttttaactgacaatttcggcactttttatcactttttttgtcaaggaccgttcctgcgattgttttgttcacttcaacttcacattgggctccgtcgttcagatcaccatttacaacatgggcgacatgggcaacccccacgggccggtacgatttcttagggccaaaatgcccccaccccgaaatttgttgcagggctattcgcacccactccatttgcatgggactcatttctacctggtcaaagttggcttcggcggataccacgcgaacaatggcagcatttggacaatgaacaaagacatcccatgcatcgacgataaagtacataataatctgagataactcgtatcaatgccttcaatttgtatcaggagcgttgcgtgggactgaaatgggccaactcgacttggctgggtggtaatgtgccggccatgcgccaaaggccgtcctcgcgggacacggtcaacatcccggtcggcggatatataactatacggtaagcgcgcgcgtccctttctttgactgaatgccaaatttatttccgatttcgcgctttaaatgccggctggtggttttcccactgtcatctgatgctgcacaatatggtcagttgattttctaattgtaagagacccattttaattttaaattaataaagggcggcaccgcttttgcttttcgtgtcggcaccgacgaacaaatgccgaaaccgccggacgcatacccacactcatgcggaatataaagacgaaaagtcaaattggggacgccatttttggcattctctgggtgtcaattccaaatgtttttttaatgaatttaatgaccatcaatatgtttaat

SEQ ID NO: 77088 - DNA, 1725 bp, Heterodera glycines
  misc_feature (1035)..(1035): n is a, c, g, or t
  Genomic contig location: Contig_ID=SeqID_13259; Location=166..1890; Strand=+
  SCN-specific regions: Sequence locations=1-188,210-375,397-912,935 -1300,1323-1439,1470-1685,1710-1725
  Gene Ontology: Mol. function=Rab interactor activity
atgtatgaagtgccattcccgtcgccggctcgtcctcgcgtgttggttgagcttggcagcgacatgatcgcttttgaaagcagcgatgacagtcaaacgccattgacgggtgctaattttgtggagacgttgaagtgccttggcacggaaaatttgctctacgccatgctgctgacactgcttgaacaaaaggtgtttttgttttccttcacagcgaatagagcaaacatcttacaattaacaatacattttgtcgaatccgtggcattcccaagatttaaagtttcctaggccttttttttgaaaaattctttgtttttgtaaattttcacaatttttcggtaactaacgacgggggatgccatatttgaaaacaaatatttatataaatttataccactttcttttgctcattgtcagcttcttgtccattctcttcgtccttggctgctcacctgtgtggcggagacactctgtgccctgatgttcccattctcatggaatttgccctacatacctcagtgcccgttgccgttgggcttcgttttcaacgcaccactttcattcatggccggcgtcgattcacggtcaaaatttgtaacttctcctttttattccgtaaaaattctatttcctagacccatttttagtaaaatttaaaaaaaaagaaggatgccttaacattcatttcattaacacaatgtttgctgaacattttaagctattttgatctctacgaggagcctccgtcggatgtgacctgtttcgacttggacactgcaacaatcagccaatcagcggttcgcaaattgtaccaactgtccatgttgccgaaaaagccgctgaagcgtctgcgtgccgcgttggacgaaattggcacaaaaattagtgaaaaacagcccaagaaaggcagcggcgctggcggcggtgccatggactacgagcaaacacatgcccgacgaatgcactccgaactggcaattcgggatgcttttttgaggtaggaaaatttgtgataggtctctttggagaggnggggggggggggggtttggaaattttttaataattttgtacagatttatgtgttgcttgatggacggctacacggattttctctgtccaatcatggattcgccgtggaaaaagggtgccaccgacgtgtgcaaactgtttgattgggaacactttatgcaatcgcgggacaaaaattccatggaattttatgcaaaatttcgcgagaccacctgcttcaatcggttcatcgaggaacggtcgggcgcaattggcggcgcggaaccaaatgaacaaaatagtgagtggcacagtagttggttatgtacatgtataggaacaactatgatcaaaaactatgaaaattttttttgagcgatgagcaaaaaaagtagggatgaaaatttcgggaaaattactgtaatcttacccaaaaataaaggctattttttaatactggtattattctgaaattcaaaaggcgaggacgcacacaatgagaacggcagtagcaaggaagcaccaacggtggaggacaaaagtgttttctatgtgttctttgacgattgcatcgcaaaactgcgagcaggtaagagggaaatgattttgaaaaaggtgctaactataaaaataaaatttggtgaagattgacaacatttttgagcgaattcgatttttttttttaataaataatttgcttaaacaaacagag

SEQ ID NO: 77089 - DNA, 1072 bp, Heterodera glycines
  Genomic contig location: Contig_ID=SeqID_13260; Location=814..1885; Strand=+
  SCN-specific regions: Sequence locations=1-219,241-254,279-446,468 -501,526-656,733-849,871-872,934-1072
atggagcaaattggagtgcctttccatgaccaagtgtgctaccgtttgttgatgcatctgtgcggcgcctatggacgccctgaaatggcgatcattgtcctgaaaagaatgctcaacatggggatcatcccaaatgcaatcacatacaaagtgtaccacaaagcactgatccaagtgggtgttttattttgtgcgtgttcagtgcccttggttagggttagaaagaaaattcagaaaaatctctagaaaaaggaaatttttctttttacaaaattttcaacgtttaaatattggccttttcgccgcctttcagagcgaatggccctccgaactgagtttgtcggcaattgctgcttggcgtcgtgtgcagtttaggctggacgtttgtgcccgctttcgtgcaatgttgcccaattcagcgaacattttgccaccaccggcaacgcatgaacaaaagctgaacgacatgacaacattgtcaaccacgaataccacggcattggaggaggaagaagaggacgatgataacagcaaggactgctcaaacattgtgcaagaaatcggtaataatttttaaaagaatccttaaaaatttaaaaaaacagacttttaaatacgtatgcaccttttaacatcaaaataaaaaaattcaaaggaattatttagaaaaatttattgttaatatttatactaaaacaaaattaagagaaaaaaaaaatttttttttttaatgaattctggtgaaactttaaggaaatttgacattacaaaatgtgcacaccctaacaaattcagtaccaatgaaaattgttgaaattgacgagcccatttgtgagcagcagcagcaactcctcaccaatcatcacttctgtaataacaacaacaacaacaataataataaaatcacaaaagggaaatcgacaacgatggcaaatgccaatttgtttgatccattgggtgcctctgttgaattggagaccgccctcaacaatgtttctattgttggcaatggcacgccagtatccaggccgccacaacaccaacacaatccaccgccaaaaccaccgagggc

SEQ ID NO: 77090 - DNA, 670 bp, Heterodera glycines
  Genomic contig location: Contig_ID=SeqID_13261; Location=186..855; Strand=+
  SCN-specific regions: Sequence locations=1-201,223-575,598-670
aaaatttggacactgtgagtcgggatgatagccttgtttcggatgcacgatcagcgtcaacatcatcagcagcagttggctcaccaagcatcctttcgttggcaaacaaaatgcgtaaacgagcaatgagaagtgagttgaatttgctgaagcagtttaacccctcgcccacaaaataagaattttttgcaatttatctatttaaatgttagttttaaaaatcatcaagaaaagcttttaactttaaaattctagcatacaacgaagtggttggtcaaggtgtcatcaacgatctgctggaacggtccggactgaacagtccggcgcaaattttcaaggaagccaagctgaacctgagccgatcatatcgcgctgctgatcagtccggtctgtcaacaatgtcctcatcggacgacaatttgttcgccagtgatcaaaccggagcaatggacttattttttgtaggcacatatttatttgtacgccttatttttgattaatattcgccataactgttttgcttgttgttagatttgtgctcaacggacacgagatccagtgtcaattcactattggatgaatgacattttgccagatgatgacgctgaactcagggatgtttggttgcggtacagtgctgggccagtcagttcacctgaagaatatttgg

SEQ ID NO: 77091 - DNA, 548 bp, Heterodera glycines
  Genomic contig location: Contig_ID=SeqID_13262; Location=138..685; Strand=+
  SCN-specific regions: Sequence locations=1-15,50-285,309-395,428-548
atgccggaagaatctaacaacaacaacaacaacaccagcaacaataacagcgtcaatgctaatgctcaattatggaaacttttacgaaaaaagtatattctaacttttaatctttgtcattgctgctcacaaaaattgttcaattcgacaaaaaacaataacaacagcggcggtaattaagcttttgaaactgatcagtttggaggcgttaaggtgcaatttgttatgtgcagtgggtgtgtttcgcttaatatgaggttgagcgacatgaattgtgcaaataaaaacaacgattacaacaacaacaatcgctttagaagcagcttcactaataataactcaacatttggcaatttcgaaaacaatcgcacgcactttgacactgggaataatcaaagcaacgcatacaacaacaacaacagcaatgaaagtggacaaatggtacataacaacaatgccggatggatgaattgattacctattttataacagactaataattttgctaaatagttcattgcatttaatcaccatttcatattgttcta

SEQ ID NO: 77092 - DNA, 1304 bp, Heterodera glycines
  Genomic contig location: Contig_ID=SeqID_13262; Location=969..2272; Strand=+
  SCN-specific regions: Sequence locations=1-134,174-372,423-426,448 -1304
atgaattcccagcagcgccaggcagaacgtgcccaactccgtgcaaggttaaacttgcttgtcgacgaggtcgactttgtggtccaagggctcatcaacaattatcaggccgatggattgatcaacgcggtaagttttcttttcatttcttttgctgtctttttgttttttttgaattttaattctcgattgaacaggcgccggctgatgtacagctaatggagatggataatgggcatgagcaacagcagcagccgtgggaactggacccgccaatgcctgcacagcaattggaaattgggccacagctcccggatgcgtgggaactggttccctatcagccaccacaatgggaccaagttgtgcatgtggaacaacaacaacaacaacaacaccaccagcaacaacaacagcatcagcaaggcgcgtgggacgagggatgggaggagcagctttcgccaaatgcgttagcgcagatccaggacgaggcggatgggttgcgccaggatttgagtaagaatttcgggtcggggtccctcccataaaacgaaaattaagtggttgagagatttgttcgtgtggggcagccgcagcctacgtggcccggttaccatagatgttcggaaaatttttttttattatgcactaattaataattaatttagcattttggctcgacgagggcacggcaggcattcctgaccaacaacaacaacaacagcatccgatgcagggatgggaaactccgcgcacccactttgagcggcccgtgccgcagagaacgcccagcccttcgggagatgcgccggcggcactgatcagagaattaaatttctccgatcagtgcctcctgtgcatgggtgagcacgggttggactgcgaagtgaccgttcgcggcaacaactgcgggtgtgtcacaatttgtgacacgtgctgcgaaaatggctggtgggcgaggtatgcggatgctgcgcgcgagcagtccgcgcggcagctcgaggacagcctcgacccgtggactgggctagtccgcttagatgaggacagtcagaggcgttgggtaaacacacaaaacattgattttctgataaaatttaatttggttcatgttttcaggtcgaggggcacgatgtgcgccccaagtgtctcggctgccagacgagccgaatcgactacttgatcggggtaacgcggccgcgccgctcgcaacgcacgcgcaaggccacccactgcgccttttgctgttgatggatagtgatgcattttgtaggatcacacaattgatagtatttggtgatttaaaa

SEQ ID NO: 77093 - DNA, 543 bp, Heterodera glycines
  Genomic contig location: Contig_ID=SeqID_1968; Location=1787..2329; Strand=-
  SCN-specific regions: Sequence locations=1-69,92-543
atggaatggcttgaaatgcttccaataaaaattattcttctaattttcttgatttgcacaccaaattctgctgaaaacattactgaaaatgccaaatctcgaaatgaacgagacctgatcagtgttgggctcataattggggcagtgactgccgtgttgacaccaataatcatcggcagcgtggttgcaggatatgttattggaagcaatactgcacacgcaaacaatgatcgttggtcatcaattttaacttttctatgttttttttagaaagcaagctggtaaaagtgtttttccaggtccaagtgaccgtccacgatcagcttctctcaatttcgctcgaaaattttacaaatgagtttctttttgagcaaattgaacgcataaccaaaaatccaagcatacagagcatttgcctgcacggtgttgttttactatttgcgtataattaattaaaaatgatcagaattcgatcggttttccgtttacaaaaaaagaacattccttgaccgaatactcaaatagagataagaaaaaaataaa

SEQ ID NO: 77094 - DNA, 97 bp, Heterodera glycines
  Genomic contig location: Contig_ID=SeqID_1968; Location=1423..1519; Strand=+
  SCN-specific regions: Sequence locations=1-97
tgtgggcgatccacaaaaaactcagtgtgggcgatccacaaaaaatctcagtgtgggcaatccacaaaaaatctcagtgtgggcgatccacaaaaaa

SEQ ID NO: 77095 - DNA, 446 bp, Heterodera glycines
  Genomic contig location: Contig_ID=SeqID_1968; Location=2461..2906; Strand=-
  SCN-specific regions: Sequence locations=1-44,67-341,372-384,408-446
atgacgcggtgcttggtttaccgtttcaccagagtaagctttgggcattattaaatgaaagaatttattatcattttataaagaatggaacaagctagcacaggcagggtaaaatgtttaacgctccattgtttctgcctttcttgcatctgagagcctaaacgcgagtaaatctaatcggtgctaggtcgatccacaaaaaaactcagtgtgggcgatccacaaaaaaactcagtgtgggcgatccacaaaaaatctcagtgtgggcgatccacaaaaaatctcagtgtgggcgatccacaaaaaatctcagtgtgggcgatccacaaaaaatctcagtgaataattaaataattaattttaattatatagaacgtgtcactgaattaattataattaaatttataccattatatttcaagataaatttaaaaagaacaaataaa

SEQ ID NO: 77096 - DNA, 623 bp, Heterodera glycines
  Genomic contig location: Contig_ID=SeqID_1969; Location=1293..1915; Strand=+
  SCN-specific regions: Sequence locations=1-343,367-474,496-535,582-601
atgggctaccaaatggtgccaagaatgtaaaatttgattgcccttaagcaaagttaggctcaagtacagtttatgcgtccaatggactttcaacatgtgggatgccacggcttaatcattgacaaaatgggatatgtaagatcgaaaccttggcatttttgcggatgttctaacagatatgaaaaggaaaacattttacgtgaatataactagtaattctgagaaaatattcataattttgggaaattctagcaaatctttgtgtcatattgtcaatgtgatacaattcgaagtattgattggacacataaaaatttgattggacgcataaactgtacttgagcccaaagttatgccatgtttggtcgaaaatcactaaaaattgcgcattttatggaacgacccagcacagtatgttcctatcccattgtgagtgtcaattgcattatggatcgaaatgaaattttaattagtaaattctttaattagatttttcatattttccacatttatttgggttgtgtgtagttaaaagattaattacatttttagataatcattaattaaaaaaaatattatttcgtcggaaaacatctttgtatcttaattatttaatttaatta

SEQ ID NO: 77097 - DNA, 232 bp, Heterodera glycines
  Genomic contig location: Contig_ID=SeqID_1970; Location=1069..1300; Strand=-
  SCN-specific regions: Sequence locations=1-84,106-232
atgtggtccatgccaaatttggatgagatttgtttttttggtatgaaagaactgataaaaaaccacataaatcagccttcctttcagatttaaaaggaacaaaaagacgccacactcgatcgggacaaattgaaatatttttattttatctgtcaaaaatggaattgcctgtttcactgaatgcttgttgattgctattttttctcgttagcccttgagaaaggcgaataaa

SEQ ID NO: 77098 - DNA, 1168 bp, Heterodera glycines
  misc_feature (19)..(19): n is a, c, g, or t
  misc_feature (77)..(77): n is a, c, g, or t
  Genomic contig location: Contig_ID=SeqID_1970; Location=1469..2636; Strand=-
  SCN-specific regions: Sequence locations=1-238,263-351,373-528,550 -648,670-675,699-793,815-891,972-1139
atgacttacttcaaaaaanttaataatgaatcatctcaaaacctaagtaaatctacactggaaagatatctttctanaatcaaaacaagcgttggaaaatattctacgaaagcagatgaaacaaaatacatcgcaagacaatgtataacaaaaaacgatcaagaaaaattgtttctaataggaaaagaacaggaagacaattggagaaaatttggtgtcactttaatttacaataacaaattttatatttcttgtattaaatgtcaaattatacagcaaaaattatttcatccggaaattaaccaactcgaagagtatattagaaaccataaaatgccagcaatagatgcaacagaaatgtttaaatgggcatcaaatattgactttttagctgcagcaaagctttttcagctcaatgttatagtgtgtagtccgaatattcaaacatcccaaagtaatataaagtatacatgggctgtttattctccagattcaaataattcggtaaatatttctttcgaattttatttcatttttcttaaattttagttatcaatttctttaaaaagtgatataaattctatttttgtttattatgattgtcatgggcattttgaagctataatcaatcctcaagaaattaattaaaaattgagcaaattttccaaaaaattattgatcaaatgctttctctttaaattgttcgtttaatgggtttcgctgataaactgatcaaattttgcaaaatttgctgcagcaaaattttttaaggtttctttgataatgtgaattctttaaattgttcttaatgggttttggcgataaagtgatcaatttttctaattttgtgctttcatgtgattgtgcattggcttgacaattataaaagggttaatttttcttaaaaattatatttttataaaatggctaaattaaaaatttttttttttgcatttttgattttgtcacaaaatttgacaatttcaaaaccaattcgtcgcaaagaaagataactggggactcttgcggctattgcaattatttcggcaattgttctaactccaataatacttggttcggttgcaaccggcattgtatttggttatactttaaaagatggaagtggtcgtgaatgtatgaatataaatttaaatttaaaaataataaa

SEQ ID NO: 77099 - DNA, 1840 bp, Heterodera glycines
  Genomic contig location: Contig_ID=SeqID_1971; Location=471..2310; Strand=-
  SCN-specific regions: Sequence locations=1-361,383-599,641-713,742 -774,812-826,848-874,905-1142,1181-1226,1248-1324,1365-1633,1655-1817
atgccgaactggtgccatttaaatggaaagataaatttcttagcattaatttattgctttaatcaacagatccaattgttacggacaattgaaggggaggacgggaagccgatccagacaaatgttcgaccagtgcagcctttcaacaaaactgcataaaaagtgcctgtctaacctcgttaaatacgattgatcaatttttacgtttcacattgtaatttcaatctgtaattcaagaattctatcattaggaaaaacttatgacagggttccaagttttgatggtgctgagtcgttatataaaaaccctcaaaaagggcgttatataaaaaaccctcaaatggtttttttttgtgtttttattgatttttccttgtgttttgggcgttatataaaaaaccgtcaaaaagggcgttatataaaaaaccctcaaatcaatcaaattgtaagacatttcatcaaaattgggcgttatataaaaaaccctcaaaatgggcgttatataaaaaaccatcaaatcttattgttaccgtattaatttagaaaaaacaatcgtgccaataaaattaaaaaaacaatcgtgccaataaaataaaacctatataaaataataaatcattttaaataaatattttttatacaatattgacattaaatgtaatcaattattggatttatgtaaatgttacgtcatcaaaaaaaatattcgatagatttatattttttattattcatattaatggaaatgcatggaccatcaaaagccgtatattgtatattatttattttattcatatttctttttaaaaatcggatttacgattacattactggtggaagccgtgcttcttcctttgactcttttatcaatgacaatataattaaaaatcttttaaataaatatgaaaaaagagaaatccgaacaataaatgaattacttcaaaaaattaataatgaatcatctcaaaacctaagcaaatctacactggaaagatatctttctaaaatcaaaacaagcgttggaacaaaatacatcgcaagacaatgtacaacaaaaaacgatcaagaaaaattctttctaataggaaaagaacaggaagacaattggagaaaatttggtgtcacattaatttacaataacaaattttatatttcttgtattaaataattaatgaaaataccgagataatttcttcacgtccaacaatacatcatcacgactgcttgggagaaaaaattgaaaaatttagcgcagaacagatagacagacaacaacgaaataaaataataaattgcactgctaacattaaaagtttatggcgtgaaataaattaaaatatattttaacttgtaattttatttaactaggggtttcaaaaagctgagtcttttgatgtagcaacagataccgaaacattatcagaacaatcattatcatttcattacccaacttataattccgtcagacgttcatataatagacgtagacagcaagcacacggaatttcaactgactcatataatttgccagaatctttattaataacacgttttggttctataaagctggcattaaataaagaactttcaagtcaagataagtaagttctgcttaaaattctcggaataaaattttgaaattatttgattttatagctgggttatataccgaaatagagaagatggtataatcatttttgcaacaaaaactgcaagccaagctatgcaaaaatgtccaattatcgcactagacgggacttttgaagtagcaccaaaaccttttatgcaattatatattgtgcacggattggtattagattttatatttatttaaaataaa

SEQ ID NO: 77100 - DNA, 1595 bp, Heterodera glycines
  Genomic contig location: Contig_ID=SeqID_13265; Location=156..1750; Strand=-
  SCN-specific regions: Sequence locations=1-174,196-861,883-1264,1286 -1389,1411-1595
atgaatgagtcggttcttgatctgatgaagcggggaattgagacgtacaacggtttgccagaccaagcgttgatccagagccaaccgaaaccactgctcctcgtgcttgatgatttaatgttgaatgtaggaagcgattttctggatctgctgttcacacgtggttcacataactggaatgtcagcgttatttttgtcacccaaagcctatacgggcgtaacattagaacagcgcgagctaacagccattatttggtgctgacaaggaacccgtctggtcaactccaggtcagaacggttgggtcacaacttttcccaaaacgactcaattactttatggaggcgtacaatgaagcgactagtcaaccgttcagttacttggttataaacatgcacccaaatgctccggaaaatgagcggttgacaagcaaaatattccccggggagagtcgtgaggtatatttacctgtagaataagtgtaatgaacgaaacaagtgcgctaaaaaactatttaaggaagggaaatttttttggttcgcaaaatgtacgagttcagtccatacattcgcgcaaattcggattttttcaaaaaattagcctcaacaaaatcggataaaaggaaaaacgatttgctgaaaggcgcatccgtagaacaaattctcggattggttgagatttgtgcaaatattttaaaatttaactttcgcctcaaccggcgacagaggagacgattggccgtgtacgcagactattaccgagcaattgcacgttcacgtagtgagcgcacagccaggcagaggctacaacagggcagcggaatagctttaggagctattttggcgccaattttgagcgttttagctgaacatctggtccagaaaattgttgcaactccatcggcacaacaataaaatgaagcacactaaaaagatgctacttgtaccggagagtgaatatttggcgcttatcaacctgctgaaagggggcgcaggtggaacggactcacttcaagccgaaaaagcagcgatcgatgccagcatccaaaaaaatctaaatgacaataaaacgggtgcggacgtgaaaatgaaacgccactcgtggttgtacaaacagaggcatcagatcaaggacatgattgagaacaaaccacaaaaggtgattgtggaaaacgctacaggcacagcgccacaaaacattgccccgtatatgggcatacagaaaccaaacctcaacaagcttgaagaattgaacgggcaggatggcaaaaaaataaataaataaataggacgaaaatcggtccaggctttcagatttcaaactcccaatggtgccagctttggtgaagaaacggatacgtctgcgcctgagaccgatttgcggctaaccaaaaagagacaacaaaaatttttggagcttaaaacaggcccagagcattatgataagctgcacgaaatgattgaacgaaaccccgaaaagtacggagtcgataagtcgtccggcgaaattctaacaaacttcaaaaagccggtgattaggtccaactacattgactcactgatgtacttgacaggacagagagcagatgtgccgaaag

SEQ ID NO: 77101 - DNA, 568 bp, Heterodera glycines
  Genomic contig location: Contig_ID=SeqID_13265; Location=2026..2593; Strand=+
  SCN-specific regions: Sequence locations=1-103,126-542
atgtcccaccaaccatttgctaatttcgaaattgtacggcttgaagcgatgatcattgggttagaaatcgacaaggaacaactccaacgagatgtttatcatcttaaaaataggaaaacacaaatccataataaaaaatttgaattgctacaacaaaaggaacaattaataagagaaataaatgtgctgagagagacgaaggcaactctggtcaacgagacgaaagatctgagagaagaaatattggaattacgagatacggatggttccactgatgacccactttgcgccgtttgttataccagaaaagtcgtcagcgtttaatgcaaaactaattttggatattttagcgaaattatgcatgcatcccatgtggccatcgtgccctctgcaaccgatgcgccgaaactgtttcaattgatgggcgttgcccgttttgtcgtgaagaacttattggggtgtttaaaatattcagtccctaatttttcgtgaccgaacacacacacacccacacacattgttaattgatgaatttctagacttaataattacaaaatgtttttaatga

SEQ ID NO: 77102 - DNA, 300 bp, Heterodera glycines
  Genomic contig location: Contig_ID=SeqID_13267; Location=403..702; Strand=-
  SCN-specific regions: Sequence locations=1-66,88-278
atggcatccatttgggttccaattcgaatcccgaacccggatcgaaaagaaagtcaaaattaattgtttaaacaaaattcacatttttccccgaccctaaaaaagtttatcaaaaaaaaaagctttttttttaatctccttacagattatacgcaaagtacgggaactttacgtagcctcacatgtaaatttaatccaatttttttatttgcagcaaaagtcttcatcgagataattcaaaaattaatcgccaaagaaacacgagcaatgaacaggcttagaagggatcaaaaagaaaag

SEQ ID NO: 77103 - DNA, 745 bp, Heterodera glycines
  Genomic contig location: Contig_ID=SeqID_13268; Location=360..1104; Strand=+
  SCN-specific regions: Sequence locations=1-103,127-183,210-532,555 -628,650-745
atgggggcggccggataccaaggcacgccgggaaacgagggcgaggaggggcgcgagggcgcccagggacggacggggcccgatgccgcatactggtaagcctattttggctggcacatggcttttcgtgccatcttttgggtcaaattcgaatttgcagcccctgcccaaaccggtacggccacggcggtggtggtggcggcggcgttcatggtcgctcaggtaaaacgcccgaagaatccgatgaaaaattatcccgccgatcagagatcagcatgggttaggatattatctcatcagatcaagttgactagaacacagcttaaacgcggattagcgtcgttcttttatggtttgatcagttgttatcccgatcatttgggaagttaataatgccctgatcagatgcccacacttaaatgattaaatgtgggctgcgattattttctgggttatcagttgaaaaatcaattgggcattatcagatgttttggaaagtgtcccgagaatcggctaattcgcattttaattgttttaattttaattcgtttttaaagctggcggcaacgctggcgatcgcttccaccaaaggcgccgaaagtgacgttgaatttcacttcgacggtggaagaaggcgaagaaaataacggagagacggggaatgtgacgacgaaaatgacgacattagcaaatgatcaaacgaaacgaaaagtcggaccgaaaaagttgtgattaaaagagaaaa

SEQ ID NO: 77104 - DNA, 1152 bp, Heterodera glycines
  Genomic contig location: Contig_ID=SeqID_13269; Location=2168..3319; Strand=-
  SCN-specific regions: Sequence locations=1-70,92-288,310-355,377 -380,402-1152
  Gene Ontology: Cellular component=actin filament; Biological process =nerve ensheathment
ttgcggcgccgacacttgcggcggccagtaaaaacgacttttgcggcgcagaattaaattaccccaaaacaaataaatttttttattttatgtatttccttcgtttaataaaaaaaaattgggcgaaatgttaagccttgggcgaaatccaatcttttgacttggccattgcgttccgaggcaaatccgcctcttatcaaccgccgctttacttgctttagcgtatagcttgacttcttcattacaatatcccgtcgcggccctgccttaaaaatttatgaattcggcaaaattcaaaagatttcttaaagaccaggctgaaaaaaatattttaaaaatgaacattctgtggttcgttattacacttgaaaataatttcttatgacattaggaaaacaaaagggtgttcgagatttaattttgagcattaattatggaggcgccgcaaatgtcattttgactgggcgccgcaagtgtctgcgccgcaagtgtcatccgcaagtgtctgcgccgcaaatgtcggcgccgcaagtgtcgctttggctgggcgccgcaaatgtctgcgccgcaaatgtcagcgccgcaagtgtcatcgaagcaagtgtctgcgccgcaaatgtcggcgccgcaagtgtcgctttggctgggcgccgcaaatgtctgcgccgcaaatgtcagcgccgcaagtgtcatcgccgcaagtgtctgcgccgcaaatgtcggcgccgcaagtgtcgctttggctgggcgccgcaaatctcagctccgtaaatgtcagcgccgcaagtgtcatcgccgcaagtgtctgcgccgcaaatgtcgctttggctgggcgccgcaaatgtctgcgccgcaaatgtcagcgccgcaagtgtcatcgaagcaagtgtctgcgccgcaaatgtcggcgccgcaagtgtcgctttggctgggcgccgcaaatgtctgcgccgcaaatgtcagcgccgcaagtgtcatcgccgcaagtgtctgcgccgcaaatgtcggcgccgcaagtgtcgctttggctgggcgccgcaaatctcagctccgtaaatgtcagcgccgcaagtgtcatcgccgcaagtgtctgcgccgcaaatgtcggcgccgcaagtgtcgctttggctgggcgccgcaaatctcagctcc

SEQ ID NO: 77105 - DNA, 1430 bp, Heterodera glycines
  Genomic contig location: Contig_ID=SeqID_13271; Location=365..1794; Strand=-
  SCN-specific regions: Sequence locations=1-128,151-162,224-363,385 -515,537-640,716-1430
atggacaatcccgaacaatttgtcgacgaaaaggaagccaaacaaatcatcaacaaacaatgctatcacaattttgggaaaatggacgtgccaatgtcaaatgcacatattacggtcccaattccgggtaaattaatattatttatttttctgttttgtgccattaaaaaaaattaatcaaaaaattaatattattatttttgatttaaatgtaaaataatttccgaattcatttgcagtccaattgtgcaagaaagcgtacctttccaagttgctcacttattatgaaagctccgacagttcatgcagtcaatttcagcgctattgttatatgcttaattgttctacaagtaatcaattaacaatgctttagatttatttttttgcaaaaaaagaaaaagattttaattgattatcaaataaggaactgtactttttttatttgaaaccaacaattttcagtgaacaataacaaccaaattgaactgatcactgagtggggctgcactgatgccaattatgacactgatgacctcattcatggcacgggacgagcattggcccaggcttacatcggcccaatcccggacaattccttgtgcgtttccgctgttgtaagcggctcaaacaatggccttgtgcttccaactccaagtctttcattttttaatttaaatttgctttcattttttaacataatttaatttttttaaatgtcctcaggcattgcaaacaaatgcaaaattggtcatgaaactctgggcaacaaaacctcagttggccaatgttcttcagacgctgatttatgctatgcaatcaaatgcgatgacagttaatctgccaattaataatttgtttcattcagaattcggtccaaatccctttttttgtctaaaggtaatcagccaaacaaatttgtccaagagtggggctgtacttcgagcttttcaaatgtttccaagttttgcatggataaagctgctcaacttggcttcggatctgaccagcgtttgtgcaaatgtcatttaaaaccaccaaacaaatcgcacaaaatcagtgcttctggtaatgcataggatttttagtggttaaaaatagtttttcttaagtaattttagggatgtaattttttaaatagctgttttttaatttgcaaataattttaaacttaagcaaacaattttattcactgattccagttactttttaggttttttattccattttttgggaaattttctaaaaaataccaaaatagtggagaaacgccaaaatagtggcaaaaaactattttagtggccaacatccaaaataatttttttttaatggcaaagctccaaaatagtgattcctagtgatgaatagtggcgttaaaacgaagaatttccgagctaaaattatgtttttcttgcatttctcgtcgaaataaa

SEQ ID NO: 77106 - DNA, 364 bp, Heterodera glycines
  Genomic contig location: Contig_ID=SeqID_13272; Location=52..415; Strand=-
  SCN-specific regions: Sequence locations=1-22,44-269,291-364
atggccaaaaaagttggagttcggggttggggaggggtcggggcccaacttaggactacacgtgactcgaaaattcttttttcacctaggttaaaacaaattgtcaaaaaattataattttccagcaattattttctgtttctttgttggcaatgcgtcccggacattggcacaaaatcggaaatctgaacaccccagcgaaaatcagacaatttcgccctcaagaaaacaatcaactaaatttcaaaaaaatttattgtaatacctatgaagtgagaaatcactggagttcaaattttttacaaagtggggatgtacgacaaaaattctgataaatttcatttttggtgcatgtactaataaa

SEQ ID NO: 77107 - DNA, 1175 bp, Heterodera glycines
  Genomic contig location: Contig_ID=SeqID_13274; Location=243..1417; Strand=+
  SCN-specific regions: Sequence locations=1-316,338-505,527-645,677 -677,725-858,880-1022,1044-1175
atggctttcccttacgtcgtcaatttgtgtgccaacgaagtatgttcaaatctaattttaactaaatcaggcaatttaaatatcacatcataacctttgacccaaatttatttcagaagcctaattggtcctttttattaacacttggcccaaaactaatgaaattcatcaaaattaacaccaaacttccccctgaactgaacaacgaactgctccattttgttcccgagttttactatcgaagggttttaatcagctctaattttttagtttattacttttttaataacggaaaacgaggcaaacgattgaaatgcaaagtatgccaaaatcgaaagttaacaaaaaatcagttattgttaaatctaattttctatccaatttaatttaaatgttatgctttttaaggatgtagcagagagagaggccgggacgacttacacatttggcgcaggcacacccattcgctcttttctgccactggatgaacgtcatcgcgttgcaaactttttggcaactatgaatatctaccagttttttcatcctgcggaaggcggcggacattacgctctcgtttcattgcgaatgagcggaccggacgaggtgaaacaccattattttgatactttcagcttttttttggacgagaaaaatgaaaggaaatttggaaatagcacaaataatttgctttccaaaaaatatgaaattattaaattgatttctaatccctaactcaaacgcgaataaaaagtcgtaacgaaaaacttgaattttcgactttttccgagtttgggtacgcgactgatcaaagttagtgtcgcatccatgatcagcaactacgaaaaccccctataaaagaaaagttccatctggtttctgttcttccatgaccaaaatttgcctaaaatccatttttataattttaaacacagcgacagcagataagaagctactttcaacgagagggcattgcaatgaatttcgacaaccgtttttgcaccagtggaattcgtctgtttctgatgaacaatttggtaattatacaatatacataaaaagggaaagaagacgagctaaaggttttacatccagtggcaacccccctggctgctaacggagaatagaaagaggaaaactagaaaaaaattatgctcgcatattgaagagtacaacaa

SEQ ID NO: 77108 - DNA, 1050 bp, Heterodera glycines
  Genomic contig location: Contig_ID=SeqID_13275; Location=64..1113; Strand=-
  SCN-specific regions: Sequence locations=1-165,187-319,343-375,436 -560,582-678,710-758,783-819,842-1050
ttctccgccgtacgttatgaacgaaagattcagcctaaagaggaggcgtcattcgattacgcctttattccctccgacgcattcgttggccgtcccctcggtttggtcgtcaatttgcactatgtggacacggtgggtcgatctttcttggccaaaatgggataaatgattattcagttggttaaaaatgcatgcttttttaccttccttcaatttaggatggcaattattttgtgagtgccgttttcaatgaaaccgttacaatccaagaagacgaaagtggcttcaacacggaaacgtacgtttcttcatgtttttaccaagatagaaatgatattttatcgggttctcctgatataatttttaaaagacagcatttttaacataataaaaaaagtattttattcttttaaaaaaatctattttcaataatatgcaatttaactgcatttttcgcattttcatttagctatttcatgtacatcgttctgctcggatttatcgttgtgcttttgcttattgcccagcattttttctcaaaagttcgaatagcatttttcaattaatatattttttaatttctcagctgaccaaaggcaccggcaaaagttccgcccaatcgtaccaaacgaagaccaaagcgtatgaaatgggcaccaacaaaaacgacgtcgactttgaatggattccgcggaatcatttgggtaaaatgaactgggaaaattcaaaaaatattcggatgttcgtaaatttcagaaaagaaatcccccaaattgggctctcctcgcaatcggaaacagccgtcggcggtcgccagctgaaaaaggaaagacaaagggagggacaatgacaaagcgcaaagtgtgcgaattcgctaaacaatccgttattctcatgtaattttcaccacatttcgttgttgctttttcttctatttctttgttaacatattttggtaaaaaaaaatgacgatttttaattataattcaacctatttattggtgcacttttattgattcgttcaattattgccctattgtcccaaataaa

SEQ ID NO: 77109 - DNA, 679 bp, Heterodera glycines
  Genomic contig location: Contig_ID=SeqID_13277; Location=1602..2280; Strand=-
  SCN-specific regions: Sequence locations=1-341,364-633,656-679
atgtcgacaaatgcggcttcgccaactccgaaggcaacgaccgcgccttctgtccagaggaagtcgtcaagtaaacgaccgaaatttgccctgagtcgattaatcgcacaattttcagctggtgaagcgcagcagccgccaccgcaaaagcgaccaaaaagagtggtggacgaggcggaattgagcgagggcgaaatccttagcgatgaagaagattaatcttgtaaaattgatcacaatttcaatgggtttacacagcatcaatttgtgcacgacgcaccaccccccattttaacactcatttggaccacttcaattttccgaaactttctcataaattataaatgtattaatataaatcttgaatttatcttgacaaatatattaaagggctcatatccagggacctatttcaattcggaccaggtcctcgacttgatttttgcgaaatggactgcaaaaatcctgtttcaattaaatcgaaaaaatcgagtgtcgcacttgattttggcatcaagtcctatttttttgttgcaattaatcaagtcgaggacttgatcaccaagtcaaatgtaaaatcgactgccacattcgattttttaatttttgtttcaattcaaaaaacagtcatggtgaatgaaaaaagttttcaaatttatcaagagaaaagttaaataaa

SEQ ID NO: 77110 - DNA, 1458 bp, Heterodera glycines
  Genomic contig location: Contig_ID=SeqID_13277; Location=105..1562; Strand=+
  SCN-specific regions: Sequence locations=1-469,491-813,835-1223,1245 -1458
  Gene Ontology: Mol. function=electron transporter activity; Cellular component=nucleus; Biological process=electron transport
atggaaggtggcgcaatggttttggcggacggcggagtcgtgtgcattgacgaattgacaacaatgagagaggacgaccgagttgccatccatgaggcgatggagcagcagacaatttccattgccaaggtgcggtcggactgtccccccccctggtcaaatgatggctaattttttgagttttcgcccattaggcaggaattacgaccacgctgaactcgcgctgttcagtccttgcggccgctaattccgtttttgggcgttgggacgacagccgaggggacgaaaacatcgattttatgttcgaattcccttcggtgaaatgacagtcaaaatactgcttttaggccaactattctgtcgcggtttgattgtatttttgtggtcaaagaccaacacgatcgggccaaggattcggtgcgttgtcatacttttttcattttttgttcatttccgtttagcaattggccagacacgttgtttctgtgcatgtccgtgccatggacccccaggcgcaagtcctcacttctgaaaacgacgcaaccgcttcccaaacgcccctttcgcagccaatcgcagctaatggggtgaagaacttacaaacacaacctaagctaatgttgtgaaaaaggaactttcattggacttcctaaaacgtttcatcgcttacgctcgcgccaattgcgcgccgcgcatttccgagtcggcgagtcagaagctgatcaatcagtacgtgcaaatgcgaaacataccgaaggatcaccagcagaaacagcaaatgcgatccaaaagtaaggagaccgaccgactttctaattacaatgcatttagttttatgggtgatcaatttttccgtaatttttttgcagagcatccgcaatcggccattccgatcactgtgcgtcaactcgaggcggtggtccgcctcagcgaggcgcttgccaaaatggaattggctccgtttgcggaagaacgccacgtggacgaagcactccgactgttcaaagtgtcgaccattgctgcggcgcagagcggcaatctgtcgggtacggaagcacaacaaaatattcttgcaataataaatattcaacaatttcctcaaccttttttcattttccaacactgaccggaataaggaatatttctaattttgtatttatgaggcctttttccgtaggagtcgaagggtttacttctgccgaggaccaggaatcattcacccgagtggagaagcagctgaagaagcgcttccaagtgggcacttacgcatcggaacagctgatcattgaggaatttgctcgccagggataccccgagggattggtcagaaaggtgttttgttcgcaccaaatgagaagaaacggattaattattcgtttttaggctatcgatttttatgtgagaaggggcgatttgcaataccggatgcaacgcaaattgctctaccgatttaaataa

SEQ ID NO: 77111 - DNA, 615 bp, Heterodera glycines
  Genomic contig location: Contig_ID=SeqID_13278; Location=148..762; Strand=-
  SCN-specific regions: Sequence locations=1-615
atgccgtccaaacagcaaatggtgagtagcgcaatgcaaatgataaatttgcattttaatatatgaaatttggtgtcttaattgcctccttctttcgctgccacaattatctaaaatgccgttttctgattctctttgattttgccgcccaaaagggccgccccacattttgttgatcctcttaaattttgtctctccacccccatggtcaaatcttatgaagataaggctttcgtctgtatatataattctcttaaaatgattttgccattcaaattctttctgggctctctctccgctttcgaaaatgccaaaaagattacttcccaatgagctcatcttggaattggtctgctttatcccatttaatttgaaatggacaaattgccgagtatcaattgtttttgaccaatttttgctggaaaatatcggcgattgcttaattctgatgaaaaacacagtgctgtgaaataaataaatttaaatccgtttttattgaaattttctgttttcagattaccaagtgccgttcgaacatttacgaattgaacgacgccattatggcgaaagaaaatgaccatgaaatgcggaccagtgccagatgtgtgtaccgcg

SEQ ID NO: 77112 - DNA, 792 bp, Heterodera glycines
  Genomic contig location: Contig_ID=SeqID_13279; Location=398..1189; Strand=-
  SCN-specific regions: Sequence locations=1-190,212-361,392-536,571 -603,634-696,718-792
atgataccaagtatgcttaatttggatgcttctggaaaaagttatggcgttgatcaaaaattgatcttttatggtgatcaattattcaaccaagtataactttctatatacaaatcgtagaaccactattccaataacaattcggtagcaaattttgtgctcttgccagtgggcttgcccattttctctagaaaaaatttcccaaccccctagggattttgaaaatttccccgattttcagtgtattttaggtgtccccgttcactacaaaggagtgatctgatcaagttgatgtaagagacttttttgatcagcaccaaaagttgtgcaagcatgaattatttcaagtttttaaatgaactataatattattaattaattaaattaatttcttcgtactgaaatgaccccacccctctgaaagtctctcactgatatttttgtcacttcgccacactgatatttttgtcacttcgtcctagcaccgtaaaatcgagtaaatcgtggtccggcggtgccgataggtgccgccgggcaaattttttttttaaattttaatgattttattaagaaaaatcgacaaaaaaaatttaaaagtcccaatttttcctgtaaaaatttttaatttttcattttgggcgggggaggggggggggggataatataaaatttaggcaaaaatttttgttccttcctctttggaaatggtcttaaattttgcttgtaaatattcagataacaagttttttttactgaaaattttttacacactacaggatgaaacgcaataaa

SEQ ID NO: 77113 - DNA, 1799 bp, Heterodera glycines
  Genomic contig location: Contig_ID=SeqID_13280; Location=1228..3026; Strand=-
  SCN-specific regions: Sequence locations=1-358,380-576,655-712,794 -1040,1062-1188,1235-1311,1344-1446,1468-1718,1741-1799
atgttctcttggaaaagtcccggtcctcccggttgaaaaacttggtcccggtcccgacttttctggtaacggcaagtcccggtcccggtttttgtcaaaattgccggtcccgtgcaactctacatccaacacattctgagtcaggagattcattgttgttactttttctctagtaattttatgaaatttttaccatttataaaagcttcactaaaaaattcctattgtgattttagaaaaatttagcgaaatttttagaaatttgactaagttaggtcttgtaaggataacaataacaacagaatatcaccaaaaaaactactaacgcaaaaagaacgtattaattaataattaacccattttaacagacaaaatcagcaacaatggaagttttcctaccatcagcgattcagtgaaagtgataacaaatgcctttgaaatcaatttggaaaaagcacctaacaaggtgtatcagtatgaacttcgttttagtgccagatatttgaatacaaaagtggacatagaattatctcgagggccacacaacgagtgagcattaaataaacttaaattgagataaatttaaataataaaattgtaattcatgcttttttaaatgaataattattttatctaaattttaatcttaaaattgcttatggatgagtcatctcgatttctttggctttcccatggttcatttcccatgtagtaattaaatatattttatttttcttttaattttattgatttgttatgtaggttacaaattttttaatttaattaattatttgcaaatttctcggctttcatttcaagcatattttaatatatgaacccacacaatttactttttttttaatttaaataacccaaaaagggatgtttttaatacaaaatcttgttggcaaagattacaaaattgtcgttttcttctccttttttaacctatattttaacccttggaagaaaaacgtttaaaaattaagcctagtttttcaaaaacctctccagcggacgcctatcggcacagctggaccaaaaatggattttcttctggcggtgcctgtaggcactgcctcctccaactacatagggttttgaaaaatactgtaaatttctgagttgtcgagaaaagattgacgaattgtccattactgacggatagtcagtccttcatttttcaagaatttttaaatttctaaatctaaaatataaaaaaatgaaatatataccaaaaataccatttttagcgaaagcaacgagactcgtcgggaattgaatttatcgctttggcaaatattattggacgaaaataaagaattttttggcaaaaacaaaaatatgttttgttacgattgtgaacgacaactatattcaaccaaatatttgacggctcgtgtctttcaaattaaggaggagaataaggtaagttaaattcagttacctcttgcaaaaattggaataatcatttttttgatataatgttgaatatctgtccagattagggaacggatttttaagtttatccttattttttctgcggcttaactcgacgagaaatgcacgaaaaacacattttttgttcgaaaattttgcgttttaacgcccttatgaccttagaaatccttattttagatgttcgcccttaaaataagtttttgtccatatttaggcatttcgcccttatttcgcgattttttaatttttaatgtgaaattcaaaattctttttaaaaatacagtgaaaaaaatattctttacattttttggcgaattgtttgcaactgtaagaataaa

SEQ ID NO: 77114 - DNA, 1253 bp, Heterodera glycines
  Genomic contig location: Contig_ID=SeqID_13281; Location=3024..4276; Strand=+
  SCN-specific regions: Sequence locations=1-96,177-220,337-418,444 -464,551-612,651-657,722-730,752-786,834-927,952-1007,1045-1096,1149 -1157,1179-1253
atggaaattagtttcaatcaaaaaatcaaacgtgtatttagtcacaaaacacataattcgcattgagttcattataatttcttgaacatttttgtgtttataaattatttagtaattattttaatttgtctatgtttttttgattatatttttaaaattaatattttatttaaaaagtttgattagactctttgggcggaaaatgcaatgcatttggaagatattttttaattaacaatatttgattttggtttatttaattcaattttgattttttattaatttttatcttttgattttgaaataattacgatttatttttatcttttttaattagaatttgtaattcgcaattcgtattttgattacaatatcattgtgctcataattgaattctcatttaatgagctgggctaatggtgttattgttattaattattttagtaaagtactaaagtttttccttttaattgtttattaaatatttaatttttttataaaattcactttaaaatgtgttcaaatattaatctattaaattttatttaatcaagtgccaccaatgctaaaagacgtaccattttattatgccgtttaaaattagttgtttattaagatagaaaagagaaattttgaattaatttttcatactatgtcatttaatattattttaaattatattttcaaaataaaattatttaataatttatgaaaaattaatgcacacaaatttttcaagcaaaaaagaaaggtgtttttttttatattgccaagaaaaatttttggtttttatcaattaaatatttttattatcattaatttatatatataatgatacattttgtgtgctactaagcgaaataaattgaaatcaacattgatctgaagagtaccttttgattaactggtccggatgattactattccttttttaaattattattattatttcgttttgtttttgggtttgtaagtattttttataatacattaattaaaccagtgccaaaaattcaaaattattttaaatatataaaatattttcagtcatctcgtttataaatagaaaagggattgggatgaaaattcttcattgtttaatagattattaaatatttaaagaaaactttgaattattaatatttataccaaatcatttcatttatttttgagaatgggatacaatatattaataacatgttgtattgctcatctgaagttatattggttaagccccagaattaaattagtga

SEQ ID NO: 77115 - DNA, 624 bp, Heterodera glycines
  Genomic contig location: Contig_ID=SeqID_1974; Location=95..718; Strand=+
  SCN-specific regions: Sequence locations=1-29,54-71,93-133,155 -222,260-269,292-624
atggccatccccatcgatggtttgtgtagtaaaaaagttttataaaattaaaacacatcaaaaaacaatttattctaaataggtgtttttagcttcttttcgatggtcggcatgctctacacctttttgttctattttggaatgtaaggcgttgaaagtgatggagcacgcgtaacacgacctgacactgtcgcatggcaactttggcttgaaaaagagaagaataataaatatttaaaatgattttcatttaatttttgttcatcggtttattttgaaatttgtcatcctcaacccaattacacgttgagaccacgaaaatataccccctaatcggcaccgcatcgaaaatttcaaattttcgccgatttttcatattctttaaaaaggcatattttttcagaacgtttcctattttatggtaaatggatgtgccgaaagaaatacgtgttcatcaaggttggagaaactaagcaaaaagaatgatgagtttgcatcgtgtgttatttaccacgagccagtgcccgtgtgcaaaaacgataaaattgaattgaaggagccatcctccctccaataatgcccgcgcccaccgaaggtttgtgcagcaaaaatttttttataaaa

SEQ ID NO: 77116 - DNA, 484 bp, Heterodera glycines
  Genomic contig location: Contig_ID=SeqID_1974; Location=1040..1523; Strand=-
  SCN-specific regions: Sequence locations=1-63,85-484
atggaatatcgaagagaaaaacacagaaatattggcgaaggagttaaagcgtttggcatttggcaaaatgctggggctggcctcgaaatgggctttcactttctatgcaaaatgccgtcacaaaaatgcataacacaatccaagttgaatgtaaataattccaaaattcaattagaatccataactgctcagcaaatcattcacttctgcagatcaattggatcaagggtttcgtcgagaagcataaaaacacgaagactttaaatttttgactaagcatttgctgaaccgtcccctatgccatctcatttaattccaaaattggatattttggaaaaaatcaaatcatatgaaattctcttccacccttgtgcctgatcagagtgcagggccaatgtttgacacttttccctgcttggatatgttgccaaaaaaagaattgtgcgaaaactgtgttttttcaataatatcctgttgaaataaa

SEQ ID NO: 77117 - DNA, 703 bp, Heterodera glycines
  Genomic contig location: Contig_ID=SeqID_1974; Location=1778..2480; Strand=+
  SCN-specific regions: Sequence locations=1-552,574-594,616-703
atgaatggcggcgtttgcatttggtcaatgatagaacgaattatgactaaagaagaattacgcaggcgcttgttggtggtcagcattgaacgcagccaaccgaaggtttgcgaaacgcaattagataaaatgatggacgaccgaattttggagtaaacggtcaaacatttgtacagcaaaggagaccacatgacactttcttatcaaacttgatgaataatgggataggaaatttttctcaaaatttggtccacgtaccgcgcacttcaacccgaacccgaaatgctgaatttcaacagcaaataggaccattcccgtttgttgttgaccacaacaacagagcaccagccccacctttaaacatacggcaacaaattttccaccccgtaccactgatgcacaccgcattaaccaagtgtcggttaacgcgcaacgcaacattgactttcagtatttaccaaataatggcgttaatgcaccgacaaacttacaatgtcatggcgacattcagtacgccgctgttaaccctgtcactgcgccatcaaacgcgcaaaaatttttagctcaaaaccaacaaaaattcactcgccaggctttccaaatgccagaaatgaatcaagagcctagacatttccctacctacctatacccaccagggctggccgtgattgaatttccaatcacggatatccgtgagccgtga

SEQ ID NO: 77118 - DNA, 1350 bp, Heterodera glycines
  Genomic contig location: Contig_ID=SeqID_1974; Location=2597..3946; Strand=-
  SCN-specific regions: Sequence locations=1-67,104-279,316-329,352 -822,858-1273,1296-1350
atgaaaagagtttcaaaagatttgggatttgaatcaatcgattgcgctgcccatgtacttcaattggtaattaaaatttaaaaaatttcaatttcttttttaagtgtattaaggaaggacttaaaaaaattgatgaagaagaaagattgaaggaacttattgaaaatgtcaaaaaatttgttcgaaaagtacgaaagtcaagagttttgacagaaaaattagctgaattccaatccaatgaagaaatactacaaacggttttgctaaaaaacacagaggtaattatattattttttaaaattaattacaaaaaatcatttgaaggttcgttggaacagttcttacaaaatgttagaacgttttttgattaatcgttcggctgtgaatttgttggcaattgaacacgcggaactgccaaaattaaatgccgacgattggacacttttatcttctgttaagaatgtactcgctccgatttacgaagcgactctgcttttacagaaccgaaacgcttcaagttccattatcattccactctttaaagttaattatttaacaatatatcttaatctaaatagcatttaggctattacgtttgcattacgtaaagagggggataatcgattttcaaatatcaaaaatacaattgcatcggccattgaaaagagactaaaccaattcgagaaccaaaaatatttggtgatttcgacccttcttgatccacggtttaaggctgtttatttggattgcaatcgcgtagatggctacaaaaattggctaatcagtgaaatcgagagttttcacaatgaaaattacgtaatgaaatattttattttgagtttatattttaatttttagtataccgatgatttgttagttgaaaataatgcaagcgggtcaagttcaaccgacattttttctcaatttgaaaaagatgctgaattcgaccaattaattaatacagtaaagctttctttttaaacaatcgcattattgttcatttcacaggcaccatcacccagcccatcagcgttagaaataaaacaaaaggctgaagttgaagtgaacgaatattggagagatgcgaaaattaaggcaaaatccgatccttatgcttactgggaaatcaattcacaaaaatggccgatgatcggaagaattgtgcccaaatttctttctccacccgctacgagttcagaaagtgaacgacttttctcgaccgcgggccttatctctaatgatctccgaaaaagtttggcacccgaaaatctcgcaaaacttctgttcctccatcataatttgatattgacaggattttcaagcgaataaattttcgtttttgctaataaa

SEQ ID NO: 77119 - DNA, 912 bp, Heterodera glycines
  Genomic contig location: Contig_ID=SeqID_1974; Location=6309..7220; Strand=+
  SCN-specific regions: Sequence locations=1-187,217-528,550-565,588-879
atggaacaaccagcgggaaatgaaagcaaagtgccgcgtaagtgaatgtgaaaaattgaaaatttggcaatttcagggtcctttaaataacagtcagctatatcgattaagaaaaggccaaaagcttaaccaaaattccaacaaataaaaaatatggacaaagatttgggtttcatatgaaaaaccgataaattttatatttaaatttgtataaatgctcggtcaaaccaaaatgtgccacccacggcgttaattggttattagcgcactaattacacctggtatttccagcccatgaaattcgtggtattgcgccggtcggagtgctgctcaacgcatttgagctgaatttgagtgcggtgccagacaaagtgttccggcacgagcttcgcttcgtagccgagtacccaaatacgaaatggggtcaagcggacattcaggaattgacccgtgagcttcgcaatgagtgagtcactcattagcggagtgccaatctcaaacagcaaaaatttgcttaggctgatttttatggcgattttaaaattcgatttaaattcataatacctaataaaaaataaataaaatttcggctctttttttgggggggggagagcgtgcaaaatccggtgattcaattcatcaatcgcatttttaagcggtggtcagcgtgtgccgttggacaagcaaacgctgcaagccgaggcgcagcagttgttcccgctggcactcgccttcgccgcatccaatgagcaaattgagaaaattgagccgaccaaccgtggcagtcagcatatttataattaattaacgcatcattagcttttttgtttctaagctcttgttttttcttgtcctgaattttctgagaatttcatgaaaaaatatctgaaaaagatattttcttttttaaaa

SEQ ID NO: 77120 - DNA, 241 bp, Heterodera glycines
  Genomic contig location: Contig_ID=SeqID_1975; Location=1816..2056; Strand=-
  SCN-specific regions: Sequence locations=1-241
atggcacttctgctgctcaccttcttctccttccgcttcgcctccccccgccaccgatggtggtgggcccccgcagattgtgaatgtgttaagcatccatttgcgtcggctcagatgaatgtccaccaacacgtcgaaccggtcgcagaccaacgccatgcagaagccgagttcgtcgatgtacatgcatttgaaggtgtcgaacaggacgtcgtcgcatagagaactgtttagaaataaa

SEQ ID NO: 77121 - DNA, 1175 bp, Heterodera glycines
  Genomic contig location: Contig_ID=SeqID_1975; Location=2955..4129; Strand=+
  SCN-specific regions: Sequence locations=1-281,304-520,662-786,808 -830,857-1066,1102-1135,1157-1175
atggtggcacaaattgtcgtctacaaatggcgcactgtttggcgccaaatgccggcggcaactttggtggatggaggagaacaacgacaacttcaacaagttagcaagagaacggaccgaacactgcctattccgcaggggccgctgcccgaccaagtggtcggctttaagggcatttgcattcagtgagtgtgcatggcgccggcatgccatcatgtcgactggccctttgtactcgggccggggccagcctttggcattttgaccgggcatgcttaacggcacacacacaaaaaagaagccgttttccggcaattattaaactagaaaccaaataccaatgagcattttcgtgccaaattagcaaattttttatggctctaattagtagggcgtgtaattaaaagtagagttgagcgggaccgggaattttgggcaaaaccgggaccgggacttgccgggacctgagaagccgggacctcgatttttttcgggaccgggaaccgggaccaatcgggactttttaaaaattcaaaaaaattcaaaaaatttttaaaattcaaattttaattcatttcaattgaaaataatacaaaaataaatttttattttgttttttatttataaaatccaaattaaaagctaaataaattaataaaaactttcaaatcaaattttcagtcttattttgtactgattttcttaaaaaaatgataaaaatgtgtcaattaaacaaaactatgaggaattatattttgtcgataagaaacccatgagtagacaataagcaaattcaaaatattttaatttctgtagagggattgaaccaggggaaagaagaagggaaagtcaagggactagcactaggccatttgcaaatttaatttttttttcctttcactctaatttttatcactaatttttcactcagacccccattcttaccagtgcttgtttttcccggttcccggtcccgctcaactctaattttgacaaatgaatgacttaaaaaacttcttatttttcttagaaagaccaaaaatcgtaaaatttaacaaacttttacaattaaattagttaaatttttgaatttttaataatcctttgcattcaaaactataatttttaattcatcaggaattttcataatgcaaatgtttcagacgcagcgaaaa

SEQ ID NO: 77122 - DNA, 909 bp, Heterodera glycines
  Genomic contig location: Contig_ID=SeqID_13282; Location=511..1419; Strand=+
  SCN-specific regions: Sequence locations=1-133,155-279,301-679,701-909
  Gene Ontology: Mol. function=translation elongation factor activity; Cellular component=nucleolus; Biological process=ribosome biogenesis
atggtcgacgtcgaacgtttgaaagttgccttcgaaacggtttttgtttattttcattatgagaattcttgggtttgaaccggttgactttttcagtgtcccccttcgtcggttcgcaatgtttgcattatcgctcacgttgatcatggaaaaacgactttggctgattttttggtgtcgtccaacggagttatttcgggtaactgcaaaatgttgtagtgattttatttatttatggcatgtttgttattttccttttgtctttcatttgcgttttcagctcggttggcgggcaaattgcgttacatggactgtcgggaggacgagcaaatgcgcggaataacaatgaagtccagctccatatcacttttttatgaaccccttctgctgaatttgatcgacaggtttgagaggacggcagatgaggaatcagaagactgcgttatttttcggacttttgttttgttttcacttttggaaccctcatttattattttcagtccaggccatgttgactttgtggccgaagtcagttcggccgtcaatttggccgacattgccatcctcgtcgtggatgcggtcggtttgactaacaatactatgaaaaaccaactcattattgctaatccatggcatctttcgaggtggaaggcgtctgttcccaaaccgagtcgctcatccgccaggcgctgtcctgcaaattggacattttattggtgctgaataaattagaccgactggtggtggagctgaagatgcgcgagcaggaggcccatcgccacttacagcgactgctcgaatctgtgaactcgtgcctttctcaggcgatccacggccaattgctggaggaagactggcacactttcgagcaggtcgagcggacaattaaggagaatcaatttatagcac

SEQ ID NO: 77123 - DNA, 1082 bp, Heterodera glycines
  Genomic contig location: Contig_ID=SeqID_13283; Location=251..1332; Strand=-
  SCN-specific regions: Sequence locations=1-609,631-939,962-1009,1031 -1082
atgcgcacctgtgcaattcccacaacggctccagcacaaattgctctgaaaagggtggaaatagcaaaggtaaataataagcaatataaaacccaagagtggcttttttccgcgctgttctgcgcccggtaaaatttgtttagaatttgtggcaaaaaagtgatcggaagaaaagagattggcgttaagctgtgccttgacaatttctcggtggtcattcggcgatttatccccaattttttgctgtccaaagattcgtttggtccaaaggtcggcaaagtcttccgacgcaaaagcgtatccgtacaatgccgaagcaaacagaacattgcctttggaagggtcgaaatggagcagactttccatctgaaaccttcagaatgactggtcaaactacgtgcttataaattgaattctccttaaattgtccgctcgacctgctcgaaagtgtgccagtcttcctccagcaattggccgtggatcgcctgagaaaggcacgagttcacagattcgagcagtcgctgtaagtggcgatgggcctcctgctcgcgcatcttcagctccaccaccagtcggtctaatttattcagcaccaataaaatgtccaatttgcaggacagcgcctggcggatgagcgactcggtttgggaacagacgccttccacctcgaaagatgccatggattagcaataatgagttggtttttcatagtattgttagtcaaaccgaccgcatccactacgaggatggcaatgtcggccaaattgacggccgaactgacttcggccacaaagtcaacatggcctggactgaaaatagtaaatgagggttccaaaagtgaaaacaaaacaaaagtccgaaaaataacgcagtcttctgattcctcatctgccgccctcccaaacctgtcgatcaaattcagcagaaggggttcataaaggagtgatatggagctggacttcattgttattccgcgcatttgctcgtcctcccgacagtccatgtaacgcaatttgcccgccaaccgagctgaaaacgcaaatgaaagacaaaaggaaaataacaaacatgccataaataaa

SEQ ID NO: 77124 - DNA, 1779 bp, Heterodera glycines
  Genomic contig location: Contig_ID=SeqID_13283; Location=120..1898; Strand=+
  SCN-specific regions: Sequence locations=1-37,59-183,205-252,275 -583,605-1257,1279-1349,1389-1491,1513-1779
  Gene Ontology: Mol. function=translation elongation factor activity; Cellular component=cytoplasm; Biological process=ribosome biogenesis
tgtcccccttcgtcggttcgcaatgtttgcattatcgctcacgttgatcatggaaaaacgactttggctgattttttggtgtcgtccaacggagttatttcgggtaactgcaaaatgttgtagtgattttatttatttatggcatgtttgttattttccttttgtctttcatttgcgttttcagctcggttggcgggcaaattgcgttacatggactgtcgggaggacgagcaaatgcgcggaataacaatgaagtccagctccatatcactcctttatgaaccccttctgctgaatttgatcgacaggtttgggagggcggcagatgaggaatcagaagactgcgttatttttcggacttttgttttgttttcacttttggaaccctcatttactattttcagtccaggccatgttgactttgtggccgaagtcagttcggccgtcaatttggccgacattgccatcctcgtagtggatgcggtcggtttgactaacaatactatgaaaaaccaactcattattgctaatccatggcatctttcgaggtggaaggcgtctgttcccaaaccgagtcgctcatccgccaggcgctgtcctgcaaattggacattttattggtgctgaataaattagaccgactggtggtggagctgaagatgcgcgagcaggaggcccatcgccacttacagcgactgctcgaatctgtgaactcgtgcctttctcaggcgatccacggccaattgctggaggaagactggcacactttcgagcaggtcgagcggacaatttaaggagaattcaatttataagcacgtagtttgaccagtcattctgaaggtttcagatggaaagtctgctccatttcgacccttccaaaggcaatgttctgtttgcttcggcattgtacggatacgcttttgcgtcggaagactttgccgacctttggaccaaacgaatctttggacagcaaaaaattggggataaatcgccgaatgaccaccgagaaattgtcaaggcacagcttaacgccaatctcttttcttccgatcacttttttgccacaaattctaaacaaattttaccgggcgcagaacagcgcggaaaaaagccactcttgggttttatattgcttattatttacctttgctatttccacccttttcagagcaatttgtgctggagccgttgtgggaattgcacaggtgcgcattggttgaaggagacatggacaaattgcgacaaatggctgcgaaattgtctcttcctttgctgaaagggaggagagccgaagaggtggcaaagggagggcgggtgggtttaggaaagaatgaccgatgtgagaattgatattaagtatttaaataaaaattttaatttataaaaaaccaaaataacccctaaaagtcgaatttctgaattagcctcccccaaagccaagagtttggctacgcccttaatggagactgtcattgcttggactccgctttgttttcctttactcaattttccatgcctttttttttaaaggcttttaccgaaatgatgcgtcaatggcttccgcttagttcggccgtcgtccgcgcctgcgcccgaatgcgttcggctcagaaggctttccaaacaaacaaccgacttgagcagctgttgcccatcggatgcgaagttggcccggcccgtctttgcttttgccattcattctatgccctttcctcttttcgttctcttcgtcccctgtcatcgatgccttacgcaactgcgaccccatggacgaattga

SEQ ID NO: 77125 - DNA, 1521 bp, Heterodera glycines
  Genomic contig location: Contig_ID=SeqID_13284; Location=766..2286; Strand=-
  SCN-specific regions: Sequence locations=1-196,218-311,334-602,624 -665,687-925,957-1108,1133-1180,1205-1396,1418-1521
atgtttgatttcgttgacaaagaaaaaagttatagtccaaaaactgggctggcgccgaaacgcgcggcgccgaaacgcgtgtgtccccaaattcaccggtccccataccattttttcctaagttttcaaaatttactgcatatgtacgatgatttatttatatacgcacaggtcgttcgccattgattgttgcgtgtatggttgggcaattgcaaattggtaatttaatgcaataattattatacatagcaggattttgtgctttttgaaatggtccaatgtgaatttttgtttcatttcttgaaaattcgatattttcatttaaaaattttgagtttctgattcaaacaaacatcaaagcaatcttaatgaattgcgttaaattcccgaaatttttgtgattttctccgcatttaattgctaaattaaaaatatttgttttttagtcaaatttcttgtggaaaacggcggggcggacatcgcaattgtcgcttctgatgggcttactgcgctgaaggccgcaatactaacgaacaaagttgagattctctaatatttgctcgagaaaggcgcgcgcattgaccgctgaacgagcttttgttggttcgatccagaaacagaaaaacagctttgataatgatctgatcagaaattatttatttttaagctggggataaaaatgagaatttattatttaatctccaggcccataactagaaaaactcgtgaaatctgaaatttttttacacttcgccttaaatctattcctggttatcatcgaaattgtgtggaataagacaaaaacaaaacaaaaaagttttagcccatttattaattaattttttgccaaaaagactacctaatttgggagacttctgtgattcattttggaattttgccttggctatgggcctgattttgtctgttatatttattattatttaattattttttttcaaatacatatatgccagggatgggccgaggtttcgcttttcgcatttcgcctttcgcattattcgcattttttggcgtttcgcatttcgcttttcgcatttcgctttttggcgcgaaatgcgacttttacacccctaagaattggattaaattcccataaaatttttcaaaattttacctataaattggctaattttcagtgaaaaactgtttataaatgatcaaaatttccaattttttcccccggcggcgcctatcggcaccgccgcgcccccaaaactcctattttttcttagaaaatggcccaaaatcgcaaaatttggtaatttgatgaaaaactgttctcagcggcgcgccaaaactcttatttctcattaaaaaatgatacaaaaatcacaaaatttgaagattttttggtgaaaatctgtcaacaaattttaatcaaattttcaaaaattttcccggcggcgcctgccggcgctgcctgccccctcttcccaaaatgttttttggaaaagcgcgcctcaaaaaagctttgtattgattttttaaatttggaataaa

SEQ ID NO: 77126 - DNA, 289 bp, Heterodera glycines
  Genomic contig location: Contig_ID=SeqID_13284; Location=1029..1317; Strand=+
  SCN-specific regions: Sequence locations=1-54,79-126,151-289
attttctaagaaaaaataggagttttgggggcgcggcggtgccgataggcgccgccgggggaaaaaattggaaattttgatcatttataaacagtttttcactgaaaattagccaatttataggtaaaattttgaaaaattttatgggaatttaatccaattcttaggggtgtaaaagtcgcatttcgcgccaaaaagcgaaatgcgaaaagcgaaatgcgaaacgccaaaaaatgcgaataatgcgaaaggcgaaatgcgaaaagcgaaacctcggcccatccctggc

SEQ ID NO: 77127 - DNA, 509 bp, Heterodera glycines
  Genomic contig location: Contig_ID=SeqID_13286; Location=123..631; Strand=+
  SCN-specific regions: Sequence locations=1-261,286-318,358-361,383-509
atggccggctgggacgtgcgaaaaccaaaaaaaaaatttttgaaaacgtaagaaaaaataatttctcataaaaccaaaaaagaaaattttaaatccgaaaacaaaaacgaaacgaaaaataattcctcacaaaaccgaaaaacttttttttaagttttaaaacgaaaacgaaacgaaaatattgtattatacaaataattttattgctatatattcttttattgatttcttatgattagagctccctaagaaatgacccgaaaattttttagaaaatacacccttaaaatctaaaaattttctcaaaaattaatcaccaaaatttattttattttttttcttgtaaaaaaaattttaggcttaaaaattttccttattcgaaaaacattaaagtatttcataatcatttaaatattcgaaaaagtcggagcattggagaaagaacaggagaaaggaaaggtgaattcagttaaatgacaaaaatcaattaaaatttattattccgaaaa

SEQ ID NO: 77128 - DNA, 445 bp, Heterodera glycines
  Genomic contig location: Contig_ID=SeqID_13286; Location=1230..1674; Strand=+
  SCN-specific regions: Sequence locations=1-164,196-445
atggacaacgtttgggtaaaaattatttatatagctggttaaatacagtcatggttaagtataaagtttttcagagtttttggctcataaaatatttgattctatttgcaattaaacaactgtccgtacacttgatcactaaaaatttggggcatatcacctaactttaatgcatttttatttttaattggttttcaacactaaattttatatactgagtgtccgtacacttatgaccatgactgtatttgaaaaactattcttttttgtgcatttgagaagaaaaaaaaaatttttttttctttttttcatagattcttccgattttattgttgctccatcgtttggaggccaattgtttccattcgtttctttggttcactccggtgccgaaattgaggcgaactttgggcctaattttcaattcgatttgaccactctttaa

SEQ ID NO: 77129 - DNA, 671 bp, Heterodera glycines
  Genomic contig location: Contig_ID=SeqID_13290; Location=103..773; Strand=-
  SCN-specific regions: Sequence locations=1-10,55-65,152-343,440-642
atgcatttctcattgggtttatttttatttttctttccattattaatatttggacaagatttaggtatatttaaaaaagtatattttaaatatttttaaaattattatataccttttttattttaaattatttttattttatagattttatgcccgtccccgtgagaccaatttcggccgtcaattcgtccgctggtggcggcggggaacacctgcagttgaggcaggaaccgcgttgtttggaaagtgttgaggctggaaccgggacggacacaggtgggttgggcaaataattattcaataattgcatttacgcctaattagggtgaggaatttttgggggaaaaataattattgtaaaaacaataaaattatttctataaaattttgttattatatacagtataaaaaaacaaaaaaatttaaattaaattaatttgattacttttgacaatagaacggtttactttagtaggggcttcgcggttgggccccagcaagtttttggactacaactttttttctttgtccaccaaatccaacattgttggtatcatcgaaagcttttcatgtttagaagctatttttatggtattgcttgtcggttagataattatcaaaaaagttatagcatgaaattgctaaaaatttttaaattttttcttaataaa

SEQ ID NO: 77130 - DNA, 62 bp, Heterodera glycines
  Genomic contig location: Contig_ID=SeqID_13290; Location=1903..1964; Strand=-
  SCN-specific regions: Sequence locations=1-25,52-62
gcaatttgacgaaatatccataaagataatgataaatatataaataaaaactgtcacggaag

SEQ ID NO: 77131 - DNA, 2253 bp, Heterodera glycines
  Genomic contig location: Contig_ID=SeqID_13291; Location=69..2321; Strand=-
  SCN-specific regions: Sequence locations=1-98,123-143,170-297,346 -464,486-515,813-1025,1067-1158,1337-1361,1384-1551,1573-1613,1637 -1644,1689-1720,1742-2253
gaacatttgaagcccgggcctccaaaagctgcagctcatcaacccatttattgttacatttgtggccgtcaatttggctcaaaaagcattggtaaaagaatttataaaaaatatttaattaagaaagccatttttgctaatcgttttaaattaaaaaattatttataaaccaattaataggaatacatcagccacagtgtttgaagaagtggaaaatacaaaatgatcaattgccaaaagaagtacgccgtactgagccggagcccccaaaaattgttagaaaaggtttgaaaaatgaaaattaaattacagttaaaataattataattaaatatttttttaaatctagcggacaattcaattgatgtgaatgccaccaatatggcggcatatgaagcatcgttagctcagcttatccgctgcgaaaactgtggtcggaaatttgcgcccgaacgccttcaggtaaaaattaaaccattaaataaatgaaaaatatttttgtgccattgtttgacttttataaattttattaaaaacaattaaatctttatagttttttaaaattttcttaatatttttaatgaatttaaagaaaaaattaattattagctaaaaaattatgttaactataaacaattaattaaagaaaaattaaattcttttttaaatatgctttaaaaatttaaaatatttaaatacatatatgaatattgataatttaatgaaaaaacaatttaattcattttaatttcactatgaaagtttaaatgaaagtaattatttttttctttgttaattatttaaattattttctttttgctttaccattacaatttattataatattttgtttttgcatttttcttggcctcaaatcggcaaattttcccatcaggcacatcaacgtgcctgcactaaagagaacccgggcgtgccgatcattgtgcatccgggccagcaccatcgtcagccacacttggccacaagtttagcggcaaaaaaaggcaaaaagtgaaatttgtcggaatttaaattaatttttttttttgatttttttatataaatagccaattaaaaattgtgatttagccaatgttctaatatgatgtaattacatgcatttcatatttatgtgtaaatttctcatggtaaataaaattattttctttaatttttaattctatttattttaatctgtgtttttttttctgtattattaaaataaaattttagcttttttttaaattttctttgtttatattatgttttatttaaataaattttatttttattttccttttattgtttattaaattaatgtatttatttttaattttgattactgtaaaattacagttttatattttattttattttattttaattaattatggaatgttccgtttaaattatttttttgttttccgttttctcaaattcttttttcacattgttcttgcgagttaaagcgtcaaaaaacaatttcttaatcaccaacaaaaaaccactcacgttttagcagggatcacaggatcaaccacaattgttttattttttcatcaaatgattttttgttctatgctccttccaaatgtgaaaaattgaatatttaaggaaaaaatttttcacaataaaatcacttagaataataatttcaaattaaattaaaaattattttcataaattaagatccattttcataaaaatgcataacttttattttcctcttctttcctttgtcatctttgtgtatttagcccatttctcagacgcaaccaaagtacaataattaaaggatttaaataaaaaaatttcacaaaaaacatttagcaaaaatttcttggcggcgcctatggtaacgatgtggacaatttggatgcaccaaagcaacacattctcggcggagttggtggtgaaaaacagctcaaaccggaagatgcccagccaagaagaatgcgtggagcatggccatggattccacctcggaacgacaccaatggccaagaacagcgaaaatttctcggaggagcgaaggttgaaacagtggtgatcaaaccggaggatgcccagccaagaagaatgcgtggagcatggccatggattccacctcggaacgacaccaatggccaagaacagcgaaaatttctcggaggagcgaaggttgaaacagtgatgatcaaaccgccggaggcggatgatcagaaacagcagcaaaccattcttggcggagttcatggaaacgatgctaattga

SEQ ID NO: 77132 - DNA, 941 bp, Heterodera glycines
  Genomic contig location: Contig_ID=SeqID_13292; Location=1325..2265; Strand=-
  SCN-specific regions: Sequence locations=1-214,257-457,479-643,671-941
atggctcaaattgtaaaagtaacccacgacttggccaccgatctgtgggattggcctttgcaagtgattattttccaattgctttattttcaaagcattttttttatttcggcacgaagacggcgttgtgcaagtgcacaatgggagggatggttgggaggtcaatttggacgtcgcctttttcaagccgaacgaaattgaggcaaattcgaacatatttaattataaattaataatattaatttagaataatttagaagtatttttttccaaattcacaaagttcagataaatctgtcggccgaccatttgttcatctactgccatcacgaggaacgagtggacgagcacagctgggtgaagcgggagctgcaccgaagttacaaagtgccggaggacgtggacgccggcacaatccgatcgcacttcacgcgcaatggcattttgcagctgaaggcacagaaaaagaacacaatcaggtgaacccatttgagcgaatttaaaaataaaaaaagcaattaacaattaattaagacgaccgagtataaatgtggaagtgatagcggaagaaacaccaaagaaaggacaaaaagcgcaaaggaaatacggcgcagcggcagaagcagcgcaaaaaagtggcaaaaaggtggtggtggaggtggagaaggagaaaatgcccgtcggtgagaagaaaggggcgattaatggcactaatgggactgtctattacttaaaaaattgtaccaatttaagctcgaccaaaaagcccccgagaaaatcttttcacttcggccgacgatttctgctcctcgcaaatgccattgggcccatttggatggtcagcgaatctttttgatttaaccgacaatttaaaagaaattttgttaaggagtgccaataatagcagttcaagtattaatgcgttggttgggaagagctaa

SEQ ID NO: 77133 - DNA, 735 bp, Heterodera glycines
  Genomic contig location: Contig_ID=SeqID_13292; Location=3248..3982; Strand=-
  SCN-specific regions: Sequence locations=1-294,329-735
atgcgtctttcgcctgtccttctgctgaccatcgttgtgattgttgtgctcgccaaaaatgccaaagatagcaaaacggacgaagccaaaagggcgaaggaaccgcgcaatcggccggcaatgagccgcaggcgtcgctcggcgtacagcgcaatttggagcgaactcaaattggccaaggaagcgaccagcatcggctgcaaagtaaggaccggagcaacaaattgcttggcacattctttaaatccttgttttggttgttgactcatttgtcagtgcttaaccatcggacgcatttttaaaattttaaattttatttctaaattaactttgcatggcccaagtcagacgcactaatttaaatgatttggccgttgattcgtttaatttgcttcttctcatcaatgctttttgaaggtgttgcacaccaaaacatgcgatgcgattgcgcgcagtgagcgcggcactccgacgacgcttgaggacattgtgccgagcgatgtggacgcattagtggaaaaagcgacggtggcgctgaaaaaggcgacggagacggacggatttaacgaattgagcgaagcggaacagagacgcgtactgctagaaacagcggaaaagcagggcgaaattgtgaaggtaaagcagcaggacggcacaaaaatgtcaacggagcaaagcggaaaaagctgcggaaatcggctttttgttagtagtacaaccaacaaaatgttctaa

SEQ ID NO: 77134 - DNA, 240 bp, Heterodera glycines
  Genomic contig location: Contig_ID=SeqID_13293; Location=75..314; Strand=+
  SCN-specific regions: Sequence locations=1-27,53-128,151-211,233-240
atgatcaaagttgcccagcccgtgcttaaatggctcaaggaggcggaagaagggtcggacgagtcggaggacgacgatttggacgttgcatttgacgatcgaagccgcaacattgggatgacagtggaggtggaaaagggagcaaaggatggggtcacccgtgtacagaacggccaaattgcaaccaatggcaaaatggacgatgggaatgcagacgacattgacattgacaatatctga

SEQ ID NO: 77135 - DNA, 368 bp, Heterodera glycines
  Genomic contig location: Contig_ID=SeqID_13293; Location=495..862; Strand=-
  SCN-specific regions: Sequence locations=1-315,337-368
  Gene Ontology: Cellular component=mitochondrion
atggaaatgctctgtcttttctcgaccgatgatttggcaaatgtcttcgcaacttattgctatgccaaaggtttcatttggtcacaggaagagccgaggaatgccggctgttgggcatttgttgggccgaggttccaaagtgcatttggacttacggtaagtagatgcaaaagcggtcgtgattgttttttgagggggggggggaatctgatcttgaatggttccaagatattatatactttcattactttttaatcttttagttaaaatatgcaggacgaacagaaatggaatggttcgcaacttcaatcatcgaaacacacaaagaagaagaaatgcatgtgatggattcgacatttgctcaatga

SEQ ID NO: 77136 - DNA, 2154 bp, Heterodera glycines
  Genomic contig location: Contig_ID=SeqID_13294; Location=1..2154; Strand=-
  SCN-specific regions: Sequence locations=1-116,138-555,578-630,693 -1359,1381-1503,1526-2154
  Gene Ontology: Mol. function=oxoglutarate dehydrogenase (lipoamide) activity; Cellular component=mitochondrion; Biological process=TCA intermediate metabolism
ttgcttgagctgtgtcctcggcatggcatctccgaagttcgtttttgcactattcccttcatcctcccgctctaccccccccccttccgagcagttcatttttgatggtgctcatcggggtttgtttttgtgttttggcactgtgttcattgccctcccccccccccccccctttctcatctcttcccaccaaaggtcgtctcgccctccaaacggtccttttccgtttccctcccggccaattgttccgaaaggttcccaaatccgccgcttttctttcgtaaagtccgttttctcagatgcgcggacttgccgaatttcccggagatgtgaaaggaattggcgatgtgatgaaaaaataataattgaagacgaatttgaatccaaaagtgccaaaatggcgtaatgctttaattgtcgaaggtgctcacccaccaacactcccattttgactacgaatcccccgccggtggtcgtgtgcatgtcagcacattgcccaacccatcccatctcgaagttttccttttttggacgagtgaattgtgtgtcctcccctttttcccccaaaggtttccctcgcggtttgctccggcaaagctcgggcccgggctcagacactcaggtcgaacagagggggggggggggggggagaaggcatggaaggggagggttggacggatggaggaaggggacagacagttcgtcggtcggacaaattcgaattcagagtgggcgattacggtcgagggactgttggcgacgtgagttgttcactcatcactgagcactctccccaatttccctcttcagcgggtccttcccgtccaccaccatggcgacggagcattcactgggcagggcatcgtttgggaggtcggtagggaccaattgtgccattggtcctcatccatcccctagatttccttatcttttaaggtgttggcattgtctcaggtcccgtgagtgtattactgcttccgttctcggcatttccctttgcctctcagtcattttcgggtcggcggtgccattcatttgattgtgaacaaccaaatcgcttttactgccgaaagtgccgttggccgttcttcgctccattgttccgacgttgccaaggccattgactctccggtcattcacgtcaatgccgaatcggtcgaagtcggtccacaaaatcggaacggaatgaatgtccgccggctaactttcccttaaggatgtgattttcgctgctcaattggcattggatttccggcagaaattccgcaaagatgtttttgtcaatttgatttgttggcggcggtacggacacaacgaattggacaacccgcggttcactcagccggtgaatcgaccatttccttcttttttggcaaagtgtttagctcatgtaccattcggttgatgccaaacgttgtttggtcgattcgttcgtcgatcgacttgccaacaaaggccttttttccaccgatcagtccgagtcgattgtttccggtcattctgaaatgctgagtgaacagttggaattggtcgactctggtagaacaccgccaattgccgagcatttgggcggcttatggaaggggtgcctgatcacacttcgcaccctttgacgacatgacacccttttcaatttgtgtccgtttgctcaggttttgccaagcgccagccgctgtcaccaaatgggacaccggcatggacatggacttgctccgtcaaattggggtcgcttccgttacaattccggagggatttgtgagtgaaaagctttggcaagaagtccaaatcaaaacccgagacagattgtacacccgcacctcaaaaagacacatatcgaagccaggcgaaggaaaattgagcagggccaagtggggaaattggggggagggggagaatggcaaaatgggagggtgactcaaacacggacagatcgattggagcacagccgaagcattggcaatcggaacggcacttttgcataggaaatgtgcgaattggggactctgcagaaggaagccaatcccaaaaatgttttaaggatgctctactaaacgctcaagacggaccgtgcgaataatgcacacaaaatgccaatgtcttgacaggtgggcgagcgactttcacccaccgccacgcgatgctcgtcgaccaacg

SEQ ID NO: 77137 - DNA, 954 bp, Heterodera glycines
  misc_feature (33)..(33): n is a, c, g, or t
  misc_feature (49)..(49): n is a, c, g, or t
  Genomic contig location: Contig_ID=SeqID_13295; Location=953..1906; Strand=-
  SCN-specific regions: Sequence locations=1-723,745-954
atgctttcgctttacccccagttgactgaagcncaaaagttgagtcgtntacgcatcctcctgacaggacaagcacgtgccgaattggattcgattgacccgcacccaacaacattaggtgacgcacttaatcatttgaaagggaaatttgaaaatgaaaatacgaggtccattgcacgccaagcattatccatttgcagacaagcgcccggtgaaaaagtatatgaatttgcaaatcgtttaaatgaagcgattagaactgcattagctggagagaatgagggatcaattcgcaaacggctgttagaagaatttttagaacggttaaatcccgatctccaatttgaggtaaaagcaggccgtcctgccaattattcgggggcatatgagcttgcgcagcattttgagttattgttggcctctaagcgggaaactcagatctcggtcgccgattcaatggccgaactctcaactcgtgtggtgacattagccctaacccagcaaagggacggagacttcaaaggccaggacaggcgccgctgctattattgccgccgacaagggcatgttgtaagggattgtcggataaagaaaaaagatgaaaatgatagccgccgctggggatcaaataatgatggccgccgctggggatcaaataattggcatcctagagaaaactgggacaggggtagagatgacagaggcaaaattttacggcaaattgcagaggacaagggaaccaaagaaacgatcggcaaatggcgaaccgatttacaagagaaaggcaatactttaatgggtcagaaaatcaaagaaaccgccgaaccccgactccctttggtcggcaggaaaatgaaggatatgagcaagcaaattcaccatcaggccgagtacactttaggggacggagatttgccgccgcaagattggcgagtcctattttcatggccctaa

SEQ ID NO: 77138 - DNA, 348 bp, Heterodera glycines
  Genomic contig location: Contig_ID=SeqID_13296; Location=27..374; Strand=-
  SCN-specific regions: Sequence locations=1-310,338-348
atgaccgagcaaaatatgaataattcgcagagcggctcaaacatacaaatgcccgcatgctcaatgggttctgattttgatgcaatatatttttcgcaagaggaaaaccaaacgatggctaatttattaaatcggatgagaatatttgagtcatccgtttaccatcaattccgcgctgtgcaacaagaaatatcaaattttacagcggaaatacctaagcaaaaagctattggtcgattggaagagttggaaagatcgatgaatgatttggaaaatatggaagaaatggataattttgaaaacacagagaaatgggcaaaaatggaaacaaaggtggaaaatttgacg

SEQ ID NO: 77139 - DNA, 1090 bp, Heterodera glycines
  Genomic contig location: Contig_ID=SeqID_13296; Location=1082..2171; Strand=-
  SCN-specific regions: Sequence locations=1-208,234-764,787-1090
atggccataaaatatggacaacaaattgcgaaatatagacataaaattgcgaaaatctcaaaatatggacataaaatgacaaaatatggacataaatttttcaaattgagggtgtaatttctcaaaatttctttaaattcgctaaatgtaaagtaaacaaaaagcgaaattttcgctttttttgcttatttttgacaaaaaaattaccaatttaaaaaaaaattaaatatattcaatattctcgagaaaattttgcaaaaaaaaaaagatttttcggtaatttttccgatctttagggggtaaaaaaaggctaatttagctggtggggccgttctgatagaggtttttttaaaatgccaaaatatggacataaaaaatatggaaatatgttcataaatcgcgaaatatggaaaaatagggaaaatatggatatagaaattcactctagatgcttctaataaagctaaaaaacaagattttcttgcgtttcaagcctcccacactccaggaaaaaatatggatttccatataattctacgcctaataattattatttggatgttttaagctccgaaaaaataaaaatttcgaaaaaccaaattggataatctggattacaaaaaaaaaaaaattcaaaaagtgagtcataagaacaggttcgtaaataaaaagtcacgatttgctaaatcctataagtattctcaattttttgccctgccgaatccattttgatctgcgcatttcaggacccggttcaacccgataccggacccggttaaaaaacttggactcggaccaggacccggcttttctatacccggcaatacccactcggacccggtttttggccaaatactcggaccaggcgtaccctacataaaagcaataaacgaaaaatacacccctaagaattgaccacaaaaaaaatttcgttaaggttcaaatagttatggccagaagatttcaaaaaacttgagtttccaacctttttagccatgaacttgttcaaaattgaagggattttttggaattttgcaggttataggctggccgaacgtttcgtcactgaacctttcgtcactgaaataaa

SEQ ID NO: 77140 - DNA, 783 bp, Heterodera glycines
  Genomic contig location: Contig_ID=SeqID_1977; Location=2043..2825; Strand=+
  SCN-specific regions: Sequence locations=1-257,279-350,437-494,522-783
atgccaaatccgttgctgttgctgatcatcgttgtccaactgtttcaagcaattcatgcacaaccagcccgactccgtgtgccaagtgccgatttcttcggcggcattggccaccgcctttcaggcgatgagaacgttgcgatggtgttcatgctgttgatgatcaccattttggcaacgaatacggccattctgatcatgcaaattgtcatgttttggacagttatctcacggccaagggcagcagcaggtgaacagcagacggagaagaaaaagacggacaactacaagaaaatgatgagcaacaccaatggaaaaggtgagagaattggttaaaaggataaactaatgagatagagtgggaacgagagagaatgagcgcgagagagagataaaaagcgagagaaagcgagagagagctaaagagagagggagaaaatgccaatggagggctaaaataggagagaaagatttacagcctttatttatccctcttaaattaaaaattttataattattttgttgaaaaatgtttttcattactccctttccttttaaaacagtccatttggtgtcatcgcctcgtaattcggccgaattgctattgtttgaccgcaaagggaatgccgtcgtctgaacgctgtgcctttcggcaatttgctagaaaattgcaaaaaaaataataattcatttttttgttttcctaaatttccccattttacagtaacctcacccgtttttttgtactgctattatcagtaatttcattaattgacaagaaaa

SEQ ID NO: 77141 - DNA, 744 bp, Heterodera glycines
  Genomic contig location: Contig_ID=SeqID_1977; Location=2863..3606; Strand=-
  SCN-specific regions: Sequence locations=1-553,576-744
atgcaccaatttatcattatttcgttttgttttaattacttgctactggttcattttgtagttaataaaagcataaattctcaaaacattaaaagtaattacttaaagattaaaaaaattatttgaatgcaatttttttttgcaaacgtccccggtacgaaaacggtggtacgaaaaggtctccggtacgaaagcgtcctggcccggaaaaaatgttttcttttgatggttttttgactaacgccaattttgatggtttttgagtaacatgatagcaccctactgatcggcaaaaaaatcaaagatggattggcccagctctgatgctaaaatgagtgatcagaatcaatgcaatagttttccacttctgttcttcgccttctcaggcgttaacactcgaatggacatgtcacgaccaaattaatccatttgtggtatcccaaattgcaaaatatgtcacatggaagcgtaaaaacatgcatattattttcccaaattgagggaaacatttctctaatccttaatttaagctaatgaaaatggctaagtaatacaatttttgaaatttctttaatattctcaatttccagaaattgagttttttaaatttcagtcttcacgagtaaaaagtgttactaatacagctgaccgtctaacatcagttttagcttaatgacgaaaaacctaacaaattattttttctttttgtgcttctctgcgaccacaacagtttgaccaaataaa

SEQ ID NO: 77142 - DNA, 821 bp, Heterodera glycines
  Genomic contig location: Contig_ID=SeqID_1979; Location=992..1812; Strand=-
  SCN-specific regions: Sequence locations=1-357,380-557,579-821
  Gene Ontology: Mol. function=UDP-glycosyltransferase activity; Cellular component=endoplasmic reticulum; Biological process =metabolism
atgaaatttcaaagaaatttgtgtcgcttttggcgacaaattctaattcaaaacttaatccgacagacaaattcactgatcagtcgaagtttgggcacaaaagagggcgttgttctggtcagttttggcacaaacgatgcttttactgggcccggcgatgcgcaattcgtcaaagcattggctggcacaatggacaaattcccaaacattttgttcatttggaagttgacccagggaatcgaaggccaattacaattcaaatgggacaatgtgatcacgcagagttggatcaaccaaaaggagctgttgggtaggcgacgaaaaggaagggcactcactcacttttcaatggccaacaaatgattgatcagcaaactctgccgatcaatcggcccacaatttatgagttgtcaaaataggacgaaagtagattcaattatataagcgaattaaaatgggcaagaacagaagccgggaccagtaaaaaaaaaagaccaaaactccgctttttaacacccaaaatgagtgatcggcacaaaggcaaacaccaatcaaagttcagcccatcccaaaacaaaggcatttgtgtcccattgcgggatgaacagtcttttggagagcgttttccacggagtgccaatcatttgtgtgccgttcatcggggaccaatattacaacgcggaattgatggcatttcggcacattgggctggcagttgacagggaaaatgaccagcaaacagtgcaaaatgatctgatcaacgcattatcagaggcattgggacggcagcaggggaaaaagtgacaaaaattgaaaataaa

SEQ ID NO: 77143 - DNA, 1273 bp, Heterodera glycines
  Genomic contig location: Contig_ID=SeqID_1979; Location=2816..4088; Strand=-
  SCN-specific regions: Sequence locations=1-32,55-136,158-246,268 -365,387-668,800-879,906-956,979-1051,1073-1215,1237-1242
atgttggtcccaataacagatgcaacttataaattaaccaacaaaaatgatgaagtccaactgaatgtgcggtattttgtgcagaaaaagacgaaaccgttgcacgagtttatcatggagggagacttaagcaaaatgaatgacagaatttaccatggtaaattaatgcaaaaaaaagacagcgctctaaggatttaaatgagcagtagcttctcaacttttttttaaaaattagaaaaaactatctaaaaattttctctttcctggcgggaaagtttagataaacaaagcatggaaagtgttagccgcctttcttacgcccgttcaatccatggggctttttggtgcttttcctatcaataattttattgtgacaaaaataattcaaatatactttttttaactccctaattagaaattgccgatgactttgaactgatggacgaattacgtgccgagaaattcgacgtgggaatggcagaggcattctgtttcacggagtattcgttggcacttttccactttctgcaaattgcggtcacaatctctacccaaagtcagccgatgtctccgtttcagctgtatttgatgggccatttgagcaaaatgaaccattcggagggaatgccgacgggtaaaaagtgccaaaaagcttaaatgaattaaaaagagagagggagagagcgaaagagagagagtagatagagggaaagagagagagagagagagcgaaatagagagagagaaaagagtgagagaaggggggggggggagaagagaaatagttagagagagagagttcgtgatcaggggccacgaaaaccacgtgaaaatcacaaaaattatgcaaaccaaaaactcttcgcacattgtttttggataaaattaaaaaatatttattattagctagcgcctaaatttatgactcatgacttttttttaatatgtgccaaaagaaattaaaattattttaattttgtccgttttttgttgcttctgagcaaaaaaaaaacagaaattttaacgggtcttttcatttttcgtcttacttttgaaaattttcagaatttatcggaatttctacaatgaatttttttcgaaatggtggggagcgtatgaaactgctaaatatgcgcacaaaagaacaaatggacgaggaattgaagtggagaagagacgaagtttggaagaattgcgtggagcaaacattggccaaaatcaaagaacacataaatatggtggaaataataataatttaaatatttataataaa

SEQ ID NO: 77144 - DNA, 361 bp, Heterodera glycines
  Genomic contig location: Contig_ID=SeqID_1979; Location=4238..4598; Strand=+
  SCN-specific regions: Sequence locations=1-177,220-361
atgacttcgaaggaacatgtaatttggttggacgactaatattttcaaagtgtttgccatttccgcaacaaatgaactcattagtaaaaaggttatcgtaattaaagcagccatttggattaattattttctgatgtgccaaagaaatatcgaaatagaaaacaaataaatcaagccatttaaatattaaaaatcattcgtaatttaaatttaattttagccaacaatttccgaatatttgccaattttatgaaaaccaaatccgcctcatttccactttaatgttccacaattttcctttcctttccatcatttgccacacttttgcttcacttacaacaaattccccccccccggaaaa

SEQ ID NO: 77145 - DNA, 921 bp, Heterodera glycines
  Genomic contig location: Contig_ID=SeqID_1980; Location=231..1151; Strand=-
  SCN-specific regions: Sequence locations=1-230,338-661,723-921
atgccaacggaacctgcattggatggcacggaattgtcccgaagcatgtgccaaaaaggaggacaaacgacgaacattgctggacaaatgcaggtgaacactaatgaatagggactccatttttaggcacaaaaaatcgagaaataggcactaaataggcacaaaaatcctcaaataggcaaaaataggcaaataaattttttattaacgctttttaggtagcaaaacagataaaaattttaatttgtaaatgaaattattaaatattttaaagtttttttcgaaaagaacaaaatttaaacaaaaatttttattaagaaaaaaatattaaatttttgtcgatcaatttttgagaaattttcaattcttaggagtgtattttctgaaaaaattttttcggttcatttcttaggggtgtgtttttcgtttttattgcatttttgttaaggattttttcaaaaaccctaaaatacgcacattaggcacaaaaaccccgaaataggcaaaaataggcattataagagtcatcgtagacacctcaaaccaagcggaaaatgcgttttttgtgcttatctatgcgtattaaatgcgcagaaattttaggcatttgcctaaaaatggagtccctaataatgaattatccaataatatgaaattcagcttaattttgatatttttttattcaaaaatacataaaataaataatatttcaattttattttggggttggacgcggcaaatttttataatttcagcaaaataatgccaaaggatttggaaaatccttctctggacgattaattcaatgtcatgcttacaaataaccggtcgaaaaaaagataatgacattttttcgtttttttcataatccattcgttggcagtaatggcgaatattttgatatattcaaagctcaataaa

SEQ ID NO: 77146 - DNA, 296 bp, Heterodera glycines
  Genomic contig location: Contig_ID=SeqID_1980; Location=2385..2680; Strand=-
  SCN-specific regions: Sequence locations=1-139,192-296
atgatacaatttttccattttagtaaatttgaaaatttgtgtggtaatgctttttaagtgttctgctggcgtgagtttctttctcgatactccaatggtcccattcattgaccctccgcttcaaaatcgcggttctctcttttttatgattttacaattttattatttttaaatttaaataaattaattttcagttggactgagcaatgcctacacttcgtatttgtataactacaaaatgaggccaacttgcagttccactggtggctgtggatcaccgtaatttactcaataaa

SEQ ID NO: 77147 - DNA, 1459 bp, Heterodera glycines
  misc_feature (252)..(252): n is a, c, g, or t
  Genomic contig location: Contig_ID=SeqID_13300; Location=2265..3723; Strand=+
  SCN-specific regions: Sequence locations=1-461,487-569,625-904,926 -969,996-1085,1127-1279,1301-1302,1325-1459
atgggcatttattgcgaatatttgataggcaaaaaatttaacatttctattccactaacagccccactaattacaaccgaaggttgtgagtttcattgattgtctgcctcaaaaaagatggtgtttaatggaaggtgctcaaggttggcacgtgcgaatttagaaaattagcatttttattgcaggcaattcatttagagaagtcattaatttatttgttatgaagttctttcattgaaattagtttaaccnccgccccccccgcccttcagaattttgaaaaaaaaataaaataataggagactcagaattttgaaaattttttataaaaactgatgacaagctaatgtgataaaacaggttaattcttttcctttcagtatccctgcaaagtttggggcgcttctgataagtttctgaaaaaaaagttaagcctaaactttttggcctgtttaaaaaggaattaaaaatttttaaaaatttattcatctccctttttgatagaaaaagcatcagagtgcctaaactagcatgtaaataaaatttggtgcgtttcagagcattttctgaaaaaaatatttatgaattaattatgcaaaaataaataaaaatttctaaaaatttgatcgtccataaataatttgtaattgatcaggggctcaccaaattttgcagggatacgtatcggaacactacaaatgcttactaattttcctagattttttaaacccggtgaaaattttttgcagacaccaccacttttgcacttaaaaaaatttcaaaaaactttaaaaattcatagaaaatttaaattcataggtactactgctaaatcaacgcagagacgcctttccttgacctttttaggcccctgcaaaatctggtgcgcttctgatcactactcgaaaaatgagtgattgaattttcactaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaaatatttatgaattaattatgcaaaaaacaaataaataatgaactctcttccttaataattttcctgcaccgaaggtactcactcggccgcttcgcggctcgggtgggggccttccccccccaagcaacagttggtcaatctgttgggtggtattgatggtaatggcaattagtgtcgcgtaaatcgggagaaaacgttttgatattttaataatttcttccactaatttcagatgcccaattgactgcctatacaaatttgccatcaaacaaatgtaaaaagattgaggaatcggatggcagcgtgttttacttcattcacaaccacgaagaacacgttaaaagccgaaacattgaggagaaacttcaattttga

SEQ ID NO: 77148 - DNA, 483 bp, Heterodera glycines
  Genomic contig location: Contig_ID=SeqID_13300; Location=764..1246; Strand=-
  SCN-specific regions: Sequence locations=1-231,258-483
attttttgcctatcaaatattcgcaataaatgcccatctatttaaaaaatattctattctattaaaatgttctgtattttgctatatattaagaatagccgtacatctaaaggcgtcagtaattgaacaaatttctcaaatttcaagaaaggttcaggcagtcgccgtaaaaattgtcatataaaaacaatggcgatacgcatttcttcactaggtcctttttcaaaattgatgtgcttttattgaaaaaacatgtttaacgggccacaaattaatagacaaattcaggcacattcttaaaaaattctgcttttaattagttcatttaatagattatgcttttgctttgtttttttaaattctacaaccgcgattatctgataggacaatgatatcaataaattttcttctgaagaagcgaagagttagcccaaacgttttccttcctttctatttaatgatctatcatttcagatataacag

SEQ ID NO: 77149 - DNA, 484 bp, Heterodera glycines
  Genomic contig location: Contig_ID=SeqID_13300; Location=1818..2301; Strand=-
  SCN-specific regions: Sequence locations=1-232,259-484
attttttgcctatcaaatattcgcaataaatgcccatctatttaaaaaatattctattctattaaaatgttctgtattttgctatatattaagaatagccgtacatctaaaggcgtcagtaattgaacaaatttctcaaatttcaagaaaggttcaggcagtcgccgtaaaaattgtctatataaaaacaatggcgatacgcatttctgcactaggtccttttacaaaattgatgtgcttttattgaaaaaacatgtttaacgggccacaaattaatagacaaattcaggcacattcttaaaaaattctgcttttaattagttcatttaatagattatgcttttactttgtttttttaaattctacgcccgcgattatctgataggacaatgatatcaataaattttcttctgaagaagcgaagagttagcccaaacgttttccttcctttctatttaatgatctatcatttcagatataacag

SEQ ID NO: 77150 - DNA, 2589 bp, Heterodera glycines
  Genomic contig location: Contig_ID=SeqID_13303; Location=607..3195; Strand=+
  SCN-specific regions: Sequence locations=1-417,439-1152,1174 -1184,1207-1249,1271-1467,1489-1525,1547-1567,1616-1748,1785 -2215,2238-2529,2551-2556,2585-2589
atgactcaaaataaaattgcacctcgaaaacagaggacacatgagctcagctggctccgggacgacgaaatgcgcgctttggccaagctgaccgacgtgcagtccatctggtcattgctgcggccaatccttgtcgagcgccaagttggcactccgcaacacgacgcggttgcccatgtgagcaagttcggcagggtttttggttcatttcgttgtaattgccttggctacattaattaaggaattactaattaaagggagtgccaaacgttttaatcatattttcagctggaagattaaacaaaacatcttttggggccttattttgaacaaaaaaaggaaacgagttctttggagcattaattcggtttattcacaattcgcccgcttaaacctgaagagattaaagcaataaattggcaacaattaaacttttttatgctctcaattagcggcttaaagtgcaaaaattctacaattgcccattgtttcagtatttgaagacaaaggtggaggagttcggcttcaccgccgaatgggacagctttatggcacacactccgatgggggtgaagcggtttcacaatttggtggccactttcgatccgctcatccatcgacgactcgtgttggcctgtcactacgattccaaaattaattccggggtttgcacaaattaattcttggattaaaatgatgaggctaaaatttcgtttttctgctatttttattggggttttacctattttttagacatttttgaatattttacatttttaaattagtgtccatatttatccttattctaagaaatggaacagcttcaaaatggtccatttttggaaaaaatttgaaaaaaatacattaaaaaatgctcaaaaaaattctttgaaaagacgggacaaatattatatttttttgacaaatcatacccaactcatcaatctcacattacgtgccgtggcattttttgagttgcgcggtcttcattgtgacttttcctggacggattgggttgggtttggctgtctgttgggtttacccactttttaactagtgctagatttattttggcgaattttcattccgatttttttttaaattccctaaatttcgacgaaaaaagggatttacttgattcctttttttacaattaaatgattttatacatagaaattcgggcttcttttcattgaatggaaaaattaacaaaaaaaggccataattagtccatttttctattcacaaattcccccaaacagaaaagttttcattggcgccaccgattcggcattgccttgcgctttgctgttggacattgccaaaacgcttggccctttgttggcgtccagaacaaatcaggttcaagcaattgtgttttttccattggtgggggaagggatgaatcctgaaaaattctcaaaaattcctaatccaaaattttaaaaattttcagagaatttttcacgactctccccttcccccactatttggttgcttacttgagtttgggaaagaaaggtgtgagtggagtgagtgagtgggatgccgtgttcgggacaaacacaaaacaaatacaaattaaaatttattatttactaaaacagactttcaaattacccaaaatgcctcaggcatttaaaaacttttcaaattgcttgcattgtttgcttttgcatattattcggcatcatattaatattatttcactgcttctgctgacactgaattcgcatattcttctaactttaaaatgctttttagttttgttgcttttttaaatatttatatggcctgaatttcgcattcattgttcaatcaacttgattttgttcagttggttcgttttgtaaaagttccaattttacagacttttcgagaaaattttgtcataacttttattaatcacaatcaattaaaatcttgctatcatagaatatctcttggatagttctattaagcacaaaagattttcttttattccgtttcaaaatgattgtgaccaaaaagcccaaaaaatagccataactaactaaaaaatgaataaaattttcaaaaatttttcatgctaatacataatatttggttgtgtttaagaagagttatgacgattttttctcggaaaatcttaaaagtggcattttttacgaaagtcaatgattgccaaattttagaattttactaattgtgagcattctttttcaaaaaatttggccttctttccatctcctcatttgccaatttcctttgtttttgccgccgtttaccttaaaaaggaaaagcctttcttttcgagtcactgctttcccaaaacagcgccagcaattccaatttcggcaccctcagcaatggccagttggcccaccatcgtcgccgacttggccaaacattggccaccgtcgtcgccggcggcgggcgacactttttgtgccgcccccaccgccgccaacatccagcggtggcggtgccattttagcacagttgccacaatcgcgtgccagcgttgtgccaaactcgtggccgattccgccacagtcaccaccaccaccagcaaacacgaggagaggaggaggagaaaaagtggattcg

SEQ ID NO: 77151 - DNA, 884 bp, Heterodera glycines
  Genomic contig location: Contig_ID=SeqID_13303; Location=2194..3077; Strand=-
  SCN-specific regions: Sequence locations=1-234,257-687,724-856,878-884
atggcaccgccaccgctggatgttggcggcggtgggggcggcacaaaaagtgtcgcccgccgccggcgacgacggtggccaatgtttggccaagtcggcgacgatggtgggccaactggccattgctgagggtgccgaaattggaattgctggcgctgttttgggaaagcagtgactcgaaaagaaaggcttttcctttttaaggtaaacggcggcaaaaacaaaggaaattggcaaatgaggagatggaaagaaggccaaattttttgaaaaagaatgctcacaattagtaaaattctaaaatttggcaatcattgactttcgtaaaaaatgccacttttaagattttccgagaaaaaatcgtcataactcttcttaaacacaaccaaatattatgtattagcatgaaaaatttttgaaaattttattcattttttagttagttatggctattttttgggctttttggtcacaatcattttgaaacggaataaaagaaaatcttttgtgcttaatagaactatccaagagatattctatgatagcaagattttaattgattgtgattaataaaagttatgacaaaattttctcgaaaagtctgtaaaattggaacttttacaaaacgaaccaactgaacaaaatcaagttgattgaacaatgaatgcgaaattcaggccatataaatatttaaaaaagcaacaaaactaaaaagcattttaaagttagaagaatatgcgaattcagtgtcagcagaagcagtgaaataatattaatatgatgccgaataatatgcaaaagcaaacaatgcaagcaatttgaaaagtttttaaatgcctgaggcattttgggtaatttgaaagtctgttttagtaaataataaa

SEQ ID NO: 77152 - DNA, 312 bp, Heterodera glycines
  Genomic contig location: Contig_ID=SeqID_13305; Location=2054..2365; Strand=-
  SCN-specific regions: Sequence locations=1-312
cggaacgggccaactccgtctggccaactccgtctgagccaactttgagtcaatataactcttgaagttattgaccgaatcaaacaatcttgatatcattcgaaagctcttcacaggctctattagcctactaaaaattacaaaaaatttcgaactataaaaaaagatagaaataaaaaactttgaaaattctgccttttttgcggttttcaactgacaacttttttgagagctgattaatcactgagaaatagcttataaatatcttctaaacatctagggctttcgaatgataccatgattgttgaagtt

SEQ ID NO: 77153 - DNA, 230 bp, Heterodera glycines
  Genomic contig location: Contig_ID=SeqID_13306; Location=66..295; Strand=+
  SCN-specific regions: Sequence locations=1-161,203-230
atgtgccaaagtgagttaagaaaagtcaaacaaacctcaaaagaaaaattcgaaaaaatgaaaacaataaataaaagcaaagcagtaaacgaaaaaacaaacttctagcaaaaatacagaaaaatttacgtaattcttttttttaaaaaaattattcatttaaagaaaagcaaagaaaagaaaaaataaaaagaaaagaaaaatctgccaagtgaattaagaaaagtcaa

SEQ ID NO: 77154 - DNA, 846 bp, Heterodera glycines
  Genomic contig location: Contig_ID=SeqID_13306; Location=782..1627; Strand=+
  SCN-specific regions: Sequence locations=1-136,182-237,259-389,417 -638,661-796,820-846
atgcgctacgacgagctgcgcttcccatgccggcgccagggcggcgacggcagcagtggcacgttctgccaacagtgccgcttcgtgttcccgaacgcggactgctttgaggcgcaccgccggcgcgtggatgttgcgccggcaccgcctccgggcgtcgccgccgctgccgccgctgctgtgcctcacggtggtgaggaagcaacgggtggagacggtgacgacgcggtttctttagctgctgctgttggcgccgctgtcgcgccagcgtttgcggaccgccgtcgcgggcggccccaccgttcaatgtgtgaggagcggcgcctgtgtgagtggtgcaatgtggttgtgtgggcgcgaagcggtccgcacgtgtgttgccgccgtccgcagcagcaacagcagcagcagcagcaagagaatcgcgcagttctgcagcaacaacagcagaaccaccaccatcagcaaccgtcacgaccaaaatgtgaaaagtgcggcggtccacacgatccggaacgaacgccgcacttcatccagcccaagcagtacgcgcgccagtgccagtggcgacgcggtgcggcacgtggcgcccacgacaacgctgacgacggagccgttgctaatgctgcgactgctgttgaggatgacgacgatgatgataatgtcagtgaagaggaaggggcggcagctgttgccgagcgtgatggtgctggcgatggcgcacgcggacgcgttcgaaagccaaagccggtgcgcttcatcttttgggatgttgaatgcgcacaggagcgcgtgggtgagcagcaggagcagctggaggacggtaaccaattcgtttttaaatga

SEQ ID NO: 77155 - DNA, 1456 bp, Heterodera glycines
  misc_feature (1450)..(1450): n is a, c, g, or t
  Genomic contig location: Contig_ID=SeqID_13306; Location=1700..3155; Strand=+
  SCN-specific regions: Sequence locations=1-10,35-564,586-1116,1138 -1365,1387-1456
atggatgcagttcaacagcagcaacagcagctgcctgaactgttgaagcacgtgccggtgttggtgtgcgccgaggtgatctgcgagcgctgcatcgcctacggggtggacattgagcgtgagccgttgcgccgcgcgccccagtgccagtgcggtgtcccgtggcgtggtgcgaaccggcgccggtggtgctctcgcatcggcgaggagctgtttgacgacgacgacaccggtggaccagcgaccgcacaacaacaacaacaacagatgccgccggatggattgaacccgcggcggctgcgcttcttctgcgacggcgagccgggcaccggacgtggcgcaatggcccaatttgtggactttttgctccacaccggccccaaagggacgcgcaccgtgatgttggcgcacaacggggtaagagcagcgagggggtggggggtggcaaccgattagtagtgaaaaaaataacatttttcagggtcgttatgacgttcacctgttgttggaggagttgcagcggcggggcgagcggccaaagaaggcggttcagcacgggctgcgcgtctacatgctggagctgcgcgggacgcaccagcgccagctgatctgcaaagactcgctgaacttcttccacgcagcgctcgccaccctgccgcgcacctttgggctgcacggggtgctggacaagccgtttttcccctaccatcacattcgggagcagaatctggatgttgagctgccggccggcactctgccaccagcagcggcctacgacccggaccggatgcgtgccgcgcagcgtgccgatttcatggcctggtacgagcgcgagctgcaccggcccggacggcaaccgtttgtgctccgccgtgagctgttgcgctactgctggaacggttagttgttgtcggaaatgggggtgcgggagtggtggaaaaatgtgctgtgcatacagatgtccgtatcctgcgtgccgcctgccttcgcttccgggagttggtgggcgaatgcgcggacggcatggagcccttcctggcagccacgaccattgccagcctggcgatggcggtgttccgccaacaccatctgcgcccgcacacaatggtccacacgccggagggcggcttcctgcgcgggcgtcgcgcgtcggccgagtcgcgccgcttcttcgcactgctcgccgccatgcgtcctgacttgggcccgttgcgcaccgcccgctggtcagtcggagagatggtggtggacaacagcagctggggcggcgacgacgacggtttccgcctcgactgtgtggcctacagacggccaccgttgcgtcccctctgcatcgagttcaacggctgctacatgcacggtgagtgttgttgttgttgttgttgtcaattgcggcaattttttcccaattacgccattgtcttcaggctgccgtgaatgctatccggangcgtga

SEQ ID NO: 77156 - DNA, 675 bp, Heterodera glycines
  Genomic contig location: Contig_ID=SeqID_13308; Location=2347..3021; Strand=+
  SCN-specific regions: Sequence locations=1-585,607-675
atgactaaacgacctcgctctcaaagtgaatattcgccaatgtcaaaacaaagcgacattcaccaacttattgactcacaaatgaaatttgccaaaaacaccattgatgccctaaacaaactccaagattccttcacccttgaccaaaagccaattctctcccacttaatctccaccttgtcgactcaatttgaccttttgaactcatcgattgttcatctccgctctgctgacccaactcaaaaagacgtgcccatttcagcagaggagttagaacgacaaagaagtgtcgtgataataggcctgcctgaacataatgacatttcaccatctaagcggggggagatggaccggtccaaaatcaattgtctattcgattcgctggggatcgaatgcggcaccatatcgtaccgaatgggccgtccttacaacccagcacaaaaaagtgcccgcccactcaaagtgctcttgccttcccgtgcttttcaaagacaagctcttgtggaatggcggaacaaatcgaacacaattcgtagcaaagacccatcgcttcaaaacgttcgcgtccgcgagtcattgaccaaagcacagctggatgaacggcgtcgtcttcatgcacagtgtgtcgaaaagcgtcagagagacggtcaggattggattgtctatgcaggaagc

SEQ ID NO: 77157 - DNA, 310 bp, Heterodera glycines
  Genomic contig location: Contig_ID=SeqID_13309; Location=395..704; Strand=-
  SCN-specific regions: Sequence locations=1-200,222-310
atgttaaacccagccatatactgtagttgttttgttgaacaaatgtcgcacaaaatcgattcaaaattgtcgcaaggctttgaagcgcgtatcattacgccaacattgttaagaatggtcaatgattttgaacgaaatttgaaaaatggcaagtgcaaattttcgacgacacctgctatttcagaatattttctgcgcacaattgtggcaggcaaaaatcaaatttatggccaaatgaaaattggtcattcaaacacatttcgtctggcattatgccaactgctgcatttgaacaattttttggcagaaa

SEQ ID NO: 77158 - DNA, 628 bp, Heterodera glycines
  Genomic contig location: Contig_ID=SeqID_13310; Location=208..835; Strand=-
  SCN-specific regions: Sequence locations=1-44,66-399,460-628
  Gene Ontology: Mol. function=calcium/calmodulin-dependent protein kinase activity; Cellular component=nucleus; Biological process =calcium-mediated signaling
atgaaagtgctcgacaaattgaaagtgattggacaaatttttggatatatttttaaaaattaattggggccaagataaaaacgggaaaaagccgacaaaaagcgaggaaaagccgaaaaaatgtggggaaccggtgaacccatgccattcaggaatggacgaaatttcgtttccttttcatttcttcccccctttcggcactttttgagtttcgaaaaagcaattttaaattagaaaatccggtattgtttctgttgcaatttaagtaatcatttttaaaacttttttgcatttttaacattaattttggcgatttatttgtcatttttagtttcattccttacgctaagttttgggtgttttttcctataatatgcgtaaaattcatttactttttcgaataaaaaaaaattttttttttaatttcttaaattttccatttttaaaatttaatattttcaaatttcagctcgtcaaaaactacgcctgcttcaagccgccgcccattcgcaaaaagaatgccaatccgcttcatctggcggttcatcgtaatccccttcaacttgtccagcgcgaaattgccattctgaaaaagctttcacatcccaatgtagtcaagctgatcgag

SEQ ID NO: 77159 - DNA, 671 bp, Heterodera glycines
  Genomic contig location: Contig_ID=SeqID_13310; Location=1344..2014; Strand=-
  SCN-specific regions: Sequence locations=1-314,337-566,590-671
atgagcagtgatttggccccgccgaccattcaggtgaggcgaggaatgcgaggaatgaatgaataaaatggggcggggcgccggacggaccggtctcgagactggagaacccaatctgatgacgagagcctgaccgcgtctcatgtagagattcccggactcgtaatcttgatctttttgaaaaaattccgagttctacccaaagaaaattgaaaattttcaacaaaaatactatttttttctttaaaatttcggggtggaatggtcttgggtcgggggggggggagaacgggggtgggtaaataaatactctgtgtacccctccccccacccacctgggaccgtcccggggtttattgtcggatcagaatttagcctgattctgtctggtcttgatcaactaccgatttcaatcccgggaatgattaggacaaaagaaaaccgggagaaaaaaaacgaaaagaattaaaaaattggaaattcatctcccatcccgttaatacttatgcagctgatcacaaacaaaagcatacaatgctgctttatacttgataaatttgattcaaaattttaaacaaaaattaattttcagacaaatcctgtcgagacgggggacggtgccgagagttcgtacattcagctgaaccaggcgagccattagacaaaataaa

SEQ ID NO: 77160 - DNA, 1835 bp, Heterodera glycines
  Genomic contig location: Contig_ID=SeqID_13312; Location=369..2203; Strand=-
  SCN-specific regions: Sequence locations=1-112,134-147,175-250,272 -330,377-382,404-408,433-800,845-1008,1031-1068,1091-1452,1475 -1519,1541-1627,1667-1835
atggtaccatcgacttctatcttagaaagggatcggataaatatatttcatttgtatacaaagtcaaaattgttagtaatctgcaattttacttaaaattcagatcatttttcttggtttttggaaattttccgttctgttactcgaaaattggtttgtttgtttttaagttcgactttcatgccaaaaagagatgctctgttctaaagctggtgatttctggtttgattttggtggcatttataatgacgttgagttttctgtttgttttcactgagttgagtgagcatgtcaacaaaatcagttcttatgtggcgcagaaatgtaaagaaaatatttttattttatttaattatgaagaaaatattataattaaccccactgagcatcacactaaaaacctcaaaaaatctaaaacaacttttaaaaattgaattcttttttttcttacggacatttcactggttatttcgactgaatgttagagttttatgatttaactaggtgttccttaactcaagtcgtgaaaaattcgtatccaagattttgaaaattttcaaggccttccccgcaaattggacctgggattttatcgccgaacctgacatttcattcaacgaaaatcgcttaaaaacaaaccctaatttagataaaattgaaatttaaacttattttcttatgcttccttcttcagggtttatttaaaaaaacatagagagatggcaaaagaacccaaattaaattattcaagagattaaattaatggttttatgcgcataataaatcgaagaaaccggcactaaaaatttaattttatttatgaattaaattttattttaaattactttttagcgccgtttactgcatgtagtttgtgtacagacataaaagtgattggtggcgaggaatatacaaaatttgaaaaatggacggatgggaatgggtgtctccgtttgacaatcacttgcggattagaacaggagacagaagcaattatacaggtattaatagattttttaaaatttattgatttaactcaattatcgatttgcaaaaaagcaaggatatttgtttttaaaattttaatgattatttaagcaaatttttgaaaaatatcattcgctggcttcaaaaatttcataaatcgcgttgttattatcccaaaaaatgaagcaaattggggtttggaagttccaaaatcaatgaaaaaatagtaaaaattttgtcgagaatattttgcgatagaaactttttgctaaaacggattcatttaggttgtggtgccaaagaatttgctaaataaatttcatggcacaaataatttagtggttcaatgaggacaagaacatgggtgcgtcatttatggagcgatttggacaatcaaatgtgatcagatcgttggaatgcaatgcccgtgggcgttatgaacttttcgagaatggaaaccgaggcatttcaaaatgaaagttcatttaagttaataatatgtttcatatttagatgaaattactaagattgaatgcattgttgtgttgaaacgcaatgaactttgatcattacaaaaaaaatattcatcaattcattactttttatatcaaatttttttttcttaaaatgtgactaacagtttaattttttaaaatttttattaaagattttatataatgcttaggatggaatttggctaacatttcaaaaagtttaaaaattcattttaaatttatttgtagaaatttcggtctgctctctctcaattaatttcattatttaaaaaaagtcctcaaaaatgctaactaaaaattgcaattttttcattttttattttaaacaataaa

SEQ ID NO: 77161 - DNA, 73 bp, Heterodera glycines
  Genomic contig location: Contig_ID=SeqID_13313; Location=17..89; Strand=-
  SCN-specific regions: Sequence locations=1-73
atgaattttgatgccgccgatattgttgaacaaggcaaaaatattagtcgttcaccttcaactggcacagaaa

SEQ ID NO: 77162 - DNA, 288 bp, Heterodera glycines
  Genomic contig location: Contig_ID=SeqID_13313; Location=2108..2395; Strand=+
  SCN-specific regions: Sequence locations=1-18,41-51,73-152,174-288
gttacatttttattcataaattttgagcaaaacacaaaaaaggtcaacataggttttgttaaacttcttagggttcaaagaaaataaaaacgataaaataggtgctaataactcgaagagttgcttaacaatcaccaaaaaacatattttccatgctttagggccactggaagttcaggaaaaataggtaaaatctaaaaaacatatttctatgtagtaatattatttagcaatacacattatatgttaattaaaaagaaatttagtaaaactgacaaacaataactt

SEQ ID NO: 77163 - DNA, 888 bp, Heterodera glycines
  Genomic contig location: Contig_ID=SeqID_13313; Location=333..1220; Strand=-
  SCN-specific regions: Sequence locations=1-108,130-155,184-204,242 -246,285-565,588-600,622-651,693-888
atgcaatttgaagatgactccattttgattgcatttatcgaggaaatatttttaaatctgctcaacgataaaaattttgttgatgagttacagggagagaacaatttcaacaacatgagattaaaaatgtgagagggaaattgcaaaaatctatcattaattatatgaaaaataaaatatatacaaaatccataaccagtctttcaaaaattttcaaattttatttcttatataaatatgttcgagtttaaaaaaataataatataaaatataaaaaaataaatcaggaaataccaaaaccaaccgtaaaaatagtgtgttaatgatgatgtgaatgtcagacaaagaaactagagttaaataaaatagtacatcattttcaccaatgtctcaccctttttcatccccagacaaaaaaatgcataaattttatcattccatataaaaatagaggcaaattagggtttgctgtacaatttgctcgctcacgccgtttgtcgctgcgggacagtttctctgtcgcaacaccgaaacagccgttatccagcggcctcagtcgagggtcgcggcatttcctggtgccctggcaatggactccgaaaaaacagcaaaatatgcattcggttggagttggcttgagcaaaaatcgtctttttaatgatttatttattttttttgtttttaaaaattaagaaactctttttttaattttagagtccattggaaatgcagtccatcgggcacggactatgatgcttatgtggcttttcttaaaaaaattttacttggacggaaattttgtaaattttgcagactattagcgcttatactaaggtatttctttgcaaaatattcaattattctaaaaactacggattaagtaataaa

SEQ ID NO: 77164 - DNA, 558 bp, Heterodera glycines
  Genomic contig location: Contig_ID=SeqID_191; Location=1062..1619; Strand=+
  SCN-specific regions: Sequence locations=1-316,361-506,530-534
atgtccgggataacctctgccgtcgttaaccttgaacaaactgattctcaaacgagctgtgcagtgaagccaaatttgcacccaatgcttcacaacgtgatttggcatcttttgaattggcaaaattttctgcgccatgtgagccataaaaagtgaaaacctatacaaaaaaaaatttctgaataataaaacacactaaaaagttgcaaccttaaaacaatttattccaatttttgaccatccttcctcacaagaaaatctttttgcggaagtcattgagcagcagcagccaattagggcaaaaagaattgaaaagtattttaaaaacatttgttatttatatattttattttttattttcctaaaaataagcgcaccttttatatttgtaaattcagagaaatggaaaaattaattatttatttcaacaattggtttacacattttttatgttattcatttatttttgtcattcttttattccttcaaactaattgcttctctgactttttcttttgttattttgctttaatgaaaaattattttataaataattaa

SEQ ID NO: 77165 - DNA, 180 bp, Heterodera glycines
  Genomic contig location: Contig_ID=SeqID_191; Location=322..501; Strand=-
  SCN-specific regions: Sequence locations=1-157
atgagtttgactcgcgcgagcaatggcacaattttgagtgccaaatggtcagacggcaccaacacacactacggtaatcccctcaaagttgccgaccgtacgccgtggtacacgcccgaacatcgtccgaaacaggacagccccgaaagcaattgtgtgttcatgttgttgaccaattca

SEQ ID NO: 77166 - DNA, 298 bp, Heterodera glycines
  Genomic contig location: Contig_ID=SeqID_191; Location=1638..1935; Strand=-
  SCN-specific regions: Sequence locations=1-117,139-298
atgaagaatgtgccgccgaatcattggatagaaagaatggagtggccccctgggaaagagaacgaagtggtcctcactccatgccgtaggggcgaacaaaaaaaagtggcaccaaagtgctgctttctattggcattttggccgaaggcactttttgaatgttatttatcaacggatgagagaatcgatgatgcaccagcaggacagaaagttttggaacaaaaatatgaacaatgccaaaaaatttgatgcggaaaaaattgtgcattataactcgaaaaaggacgccaaaaataaa

SEQ ID NO: 77167 - DNA, 1690 bp, Heterodera glycines
  Genomic contig location: Contig_ID=SeqID_200; Location=913..2602; Strand=+
  SCN-specific regions: Sequence locations=1-9,31-60,85-99,135-279,301 -346,377-388,423-743,765-1125,1149-1451,1474-1690
  Gene Ontology: Cellular component=integral to membrane
tgctttataggtgtgttaataatattacatggattggcaaaaaaaaaatcaataaatttctggcaatttgcttaaaatctctgtctgctattcggcataaagaatttgccaatattttttgtttcccttttcttctgggcgtagcgtccccaattttcactggtcggaagcacaaaattggttccctaatgacaaattttacataaacccacataacatttaagcgaaaaatgacagctgctgtgccgtgccgtgccggcttttactgctggacaccaatttaaagaaaatgtttgtttacttgaggacgaaatttaaaaaagcgacaaaatggactattttttccaataataatttacattatttattattttatcgctcgctattctttatttattgatttttaatttattttaataataggcatttttggcattagagcagggatgtgtgatttgttatgatttatcagattttctgatttggagggttcaaatctgacaaaataaatgtcctgatttatctgataaaatattctgatttgggggtagtgactaaattttattttgatttcttaaacaggctcataattttgaaaatttatggcataatttcatttatctagaattttttaaattgaatgaaaatcggttttaagtgattttaaaaattttctgatttttgacccaaaaatctgatttttttgtagcccgaaattttgataaaataattccaatttttttaaatgaattttatatctaaaattaggtccaataagaaattttcttgtaatataaatgccattttgaaaggaaagaattaaacttttaaatgccatcaaattttcggcattttattttttgtttggtcccacattttttgttcagccggttcggctttgtcaatgcacatttggcggttagcaaaaatacgccatgcagcatgcagtcatcacaaagcaaaagcatcatggccgtactgctccaagactatgacaaagcatcgaacccaaccggtggagtcatagaggtgcaggcggaggtaaaatccaattgtttgggttactctttttgggcgcaggattatgggtgaaagaaaggcatgtcccaaggtcggcacatccgtttttaataaaagggccaaacatttaggatccaccagggtttggtcatctgctgattagattctgagggtcagatatgtcggaggcggataagttggtgtcgtggcttggcccaaaatttggtattctggagcgccctgggtaaaaccacagcaaggctgggcgaaatttcagattcgttacgtcagatttttaattttgaatttcgagttacaggttcgaaaatatttactttagtgtcgagtttgggttgctcgatgagttattttgatcagccctaatgaccagacagagaatgtgcctattcgggaattacttccgccctaataaaaatcaattaatctctctaatcccattgaacagataaccgtgcaggatattagctcattatccgagacgagttcctcctttgtcgttgatttgtggttctcccaaatttggtctgatcctcgtctcgtctactcccatctgtcgtgcaaatccaacctatcgcttgatgagtcgttggcacaacaattgtggaccccaaatttatgctttattaacagccatgacacttacatacac

SEQ ID NO: 77168 - DNA, 873 bp, Heterodera glycines
  Genomic contig location: Contig_ID=SeqID_201; Location=881..1753; Strand=-
  SCN-specific regions: Sequence locations=1-73,109-109,131-204,271 -382,405-497,519-572,646-705,727-769,809-819,841-873
atgcgtgcatggacgaaattgtaccagtacaatgtcaacggacaacgacagtccatgatgttgccagcagttccaacaggaacaacaacagcaacaacaacaacaacaccagcacatttgtgccacaatctagaacagattcggtaaaaagcagttttggtgctgatttgtaaacagactacttgagagagtaaaggaggatttgcttcggtagttcaatggtagagcagtccacgggctaggtggaaggcatgggttcgattcccacccgccgagacattatattttgcacatttatttgatattcaaagcactttaaaatctcgcccaagtgtgtatggaaaatgagtgtttgagtatcgctgattattttggcaccggtggaaaagttatggaagaaaaacccctactaattttgggaacataatgccaaacattttttaagcaagccccgttcttgctgacaataagcaaacgattgattgaaatggaagcgcaaacacaaaagtcagaaaatggatcagttgtataaagtgtaaatgcaaattttattttctgccaaaatttaacagatttattttaataaaaattaaatttaattaaaaatcttaatcaaatatattttcatgttaattttataaaattcaacagggcacttaacttgtaaaaatgatttcacttattaatgggattggtgaaatttgctacaaaattattaatacttttccagaatttactatcttagaaataaggacacttatgaagcaagtataatacaaattaattgatttatttaaaatttattaatgttattgcctttttattaaacaaatcattcttaattttatctgctcagatagtaggcccaataaa

SEQ ID NO: 77169 - DNA, 68 bp, Heterodera glycines
  Genomic contig location: Contig_ID=SeqID_193; Location=850..917; Strand=+
  SCN-specific regions: Sequence locations=1-68
gtctcgggatcggacgacggcatcacatttctttagcctactctccaaccctgaaaatggaagactag

SEQ ID NO: 77170 - DNA, 1705 bp, Heterodera glycines
  Genomic contig location: Contig_ID=SeqID_194; Location=721..2425; Strand=-
  SCN-specific regions: Sequence locations=1-138,160-369,396-1476,1498 -1705
  Gene Ontology: Mol. function=transposase activity; Cellular component= nuclear chromosome
atgaatttctgtcagttaaaaaaatcgctttaactctgatgggtggacttcaaaggataatcgccattctttgatttcagttactgggcattttttggaccaaaaattcaagccaaaattttttgttttgagcaccaaaccaataaaaggtttttaatatagtcagagttcgaacattttatttttcagggcgacacacagctgaagcaattgtggcatttattagagaagcattaaatgattttcaaattcaagaggagaaaatttcggccttgacgcgtgatacagaaaatacgatgaaaaaggttggcaaggacttgggttttgtgtcagtggattgcgcagcgcatgttttgcaattggtctgacaaaataatttaattaaatattaaaaacaaggattttagtgcattaaagagggactgaggtcaattgaagaggaagagcgtttaaaaaatcttttggaaaatgtcaaaagatttgtacgaaaggtgcgaaaatcaagagtattgacggaacaactcgctgaactccaacaaaaggaggaagtaccaccaacagttttgattaaaaatgtcgaggtgctgttcttctatatttcaccattcttataaaggcaatcaatttcaggtgcgctggaatagttcgtataaaatgattgaacgttttatcagaaacagatctgcggtgaatttgttttcaattgatcattgcgagcttccaaaatttaacgctgatgattggctgcttttgtcatcaattaaaagcgtactttctcccatttacgaggcaaccattcttttacaaaacagaagttcttcatgctcaattatcattccactttttaaagttagcgttaatttttttcctatttattagaaaatttaggcaatttctttcggtctacgtgaggacaaggacaatcgtttttcaaatattaagaaaacaattgcgaatgccatcgaattgcggcttaaacaagccgaagaacaaaaaaacctagttcttgcaactattttggacccacgttttaagaccatttaccttgacagcagtcggctgaatcagtacaaagactggttgataagtgaagttgagagttaccatgcaaagactgatgtgattttattttttctatttttgtaacttaatttttttaggaaattgatttacaaattgacgtaagagactgcagtggttcaagttcggctggggatattttttctcgttttgaaaaggacgcagaatttgagcaaatactgaatactgtaaataaactttatatacccctcataataattaatttaaggcaacatcccccagtccatctgccttggagacaagacaaaaagccgaagttgaagtaaatgaatatttgcgggatccaaaaattaaatccagggccgatccatcattatactgggaagtcaattcacaaaaatggccaatgattggtgacgttgtacggaaatttctttctccacctgcaacaagttcagaaagtgagaggcttttctcaacggccggtctaatttcagatgacttgcgaaagagtttattaccagaaaatcttgcaaaacttttgtttcttcatcacaatttgcttttaaccggtttctcaattgaatgattttgcttttataaatttgctttttaatatgcttttaaattgctttaaaagatttataggattttttaaaataaa

SEQ ID NO: 77171 - DNA, 1287 bp, Heterodera glycines
  Genomic contig location: Contig_ID=SeqID_195; Location=18..1304; Strand=-
  SCN-specific regions: Sequence locations=1-191,225-655,677-796,818 -1027,1055-1287
atgtcaaacttaaatcctggtaattggtggtattattttgagcgtcaaggcaaagcaactgctaaatgtaaagccgatggatgttcctactcaaagacattaaatgcttctctcagtacaactgtactgacttttcacctcaaaaatcaccaccctgaactttacaaacagcgtgaagattttgttcaagcagagaagcaaaaaacagaaaagaagggacaaagtggaataaacccattaaaaagggcttttgcaaatgcattttgtggttcaagtcaacaaattactgatgacgaagaaaaggaagcgccgatttcatcaaaatcacctattttaattgggctaaatgcaaaaagtatgatctgatttttttttctatgcgttattacattttgattaaggccagtggagcacggacggagacgcaacaattggcgcaaatcgagcactaatggaaatgctggccactcaattactgccatttaatctcgttgacggtgttggatttcgacaattcgttggaaaattacagccaaaatacaaaattcctcggcgcaatcatttcgctcaatatgaactgccaaattgttttgaagcgatgaaagtaataatcaaatttgcgctttcataattctaaaatttagaaaatagtaactgatgaatttctgtcagttaacaaaatcgctttgactgctgatgggtggacttcaaaggataatcgccattctttgatttcagttactgggcattttttggaccaaaaattcaagccaaaattttttgttttgagcaccaaaccaataaaaggtttttaatatagtcagagttcgaacattttatttttcagggcgacacacagctgaagcaattgtggcatttattagagaagcattaaatgattttcaaattcaagaggagaaaatttcggccttgacgcgtgatacagaaaatacgatgaaaaaggttggcaaggacttgggttttgtgtcagtggattgcgcagcgcatgttttgcaattggtctgacaaaataatttaattaaatattaaaaaaggattttagtgcattaaagagggactgaggtcaattgaagaggaagagcgtttaaaaaatcttttggaaaatgtcaaaagatttgtacgaaaggtgcgaaaatcaagagtattgacggaacaactcgctgaactccaacaaaaggaggaagtaccaccaacagttttgattaaaaatgtcgaggtgctgttcttctatatttcaccattctatataaaggcaatcaatttcag

SEQ ID NO: 77172 - DNA, 939 bp, Heterodera glycines
  Genomic contig location: Contig_ID=SeqID_195; Location=2201..3139; Strand=-
  SCN-specific regions: Sequence locations=1-95,117-138,166-939
atgcgccgcaacgcgtcctccgctggcggcggcagtgttcgcagtgaacgcggcggcggtggtggacaaaaggcgacgacgccggcgggcatggcacaacaaaacagcaacaacaatcggcaaacgccgccacaattacggccggagcgggaggaggagggcggtaatgtaagcagcagtaatgggacggcggcatctcaacagacaatggtatcgtcgacgggcaaggacaattttagtggaggtcaattagtgccggtcacttacccacccaaaaaaaaatatatatatcactgcccccaaatgtcaatgaacgaacgattcgttaattacaaaaaaggttatatggcaaatgtggcggcaaaaaaaagctttggtcctcttttgaataataattttttttttggtttgctatttgtcaggtggcattttgtccactccgcgttttgccaattgatttctcaatttatcaatgatttttttttgcctttttagataattgaagcatgcgagcttagaccgacaaagaaggactatgtttaaatttttgtgtaatcatatcatatgtatactgtatatcactcacatttttgtagacggtgcataaacaggcatagacagttaattttattattagtggcaaagccggtaattttaggcaaaaggctattttttttggggggggggaggggggctttgttatgccgaataggtatttcatttgccagaaattgctctatgactcatttatcgcgatttgaaaatgcatatttttgacttttcgcgactttattattattaatttaaacatttcctttataaaagcgttttctcttttatatttcggtataaaaaaatttattatcaaaatggatggcaaaatgagtaaaacataaaaaagcgtgaggttttaattaatttaacctatacaaaaataaa

SEQ ID NO: 77173 - DNA, 515 bp, Heterodera glycines
  Genomic contig location: Contig_ID=SeqID_196; Location=575..1089; Strand=-
  SCN-specific regions: Sequence locations=1-211,243-275,315-515
cagttttcggaaggaggaagcaatggagaaaaatgccaaagtgttgacgacggtttgagctgtgtgccgtcccggtccgacaatcgggcacatcgtgtgaatgcagtgaacaaacaacaacgtcggacaaccttaatcttggtcaccattgtgctattcttcttctttgcttggcttccccataatgtaaatgtgacaattttaaattgtctaattaaataatttattaattttatttatttctaaagcatatgccaatatttgttgccgctgccattaaaatttaaaatttcattttttaactaaatttaattgcctatttttaattagtcacttttcaagatctaggctttttttcaaaatgccgagatatactaattagacaacataattaggcgcatttcatcaaaataagtttccttaaagattcgcgaaatggttatcgaatatgacgagcaactgctgcatagggacgggatcaactacacatatttcttatcgatggtcactcacag

SEQ ID NO: 77174 - DNA, 191 bp, Heterodera glycines
  Genomic contig location: Contig_ID=SeqID_197; Location=87..277; Strand=-
  SCN-specific regions: Sequence locations=1-32,54-55,77-84,106-191
atggctagagatcgacattttgaaaaaagcctgtacctggacctggacctggattccatgttggacctggacctggatttcctggacaaaaatccaggaaaatccaggtccaggaaaaatccaggttcctcgggacctggatccaggcctggacctggattttttgaaactcattttaaaatcaaaaaaag

SEQ ID NO: 77175 - DNA, 1189 bp, Heterodera glycines
  Genomic contig location: Contig_ID=SeqID_197; Location=415..1603; Strand=-
  SCN-specific regions: Sequence locations=1-833,855-1125,1156-1189
  Gene Ontology: Mol. function=neuropeptide Y receptor activity; Cellular component=integral to membrane
atgacgctgacaaatgagggtgcaaacgtaaaaaatctatttaggaggcataaaagtaattattgtatctggtgttaaaattccactaaatggttccacgttccgcttcttcaaaaggcaacttgtacaattgcttaggctagaccaaggcttaggcttgggcctaagcttaagcttgggctatatttttgtaaaatacgagttgtcttttgtacgagttcccattgactctttttttttgcacactcagcgccctttttcttgccttttaaaaaaatctgtgagcccataaccgaaaagtgcctaaataaactggcatggatcaaattggcaccttgatctttttaactagctcagagcccggcttttcacagtgggactcggcatcattgtctcacgccctcaattccctattttcaaggcatttatttccctgacacctgtcgtcctccgcccaaaaaaaaacaatactgaaagatcgaggaggttcctggccaattaattttaattattccatcctacaggagcgacagcaatgccttcactatgttgaccaacagccggaccccagcaattcgcagtgggcaattgccctgtttctggggctgtacagcaacatttttgtgcttggattgctcggcaatttggccattgttctggtcacggttcagtgtcgccagttgcgcagtgttcaaaacattttcatcctgaatttggccatctctgacgtcattgtgtgcctgctgtcactgccgttcacaccagtctcatatatttacaagggagtgggatgtttggctcggccatttgccatctgttaccgatggttcaggtaatttataaataattattaagactgatcgagagtacaaattttccaagattctcgaggaccgagaccgagaaaaccgagagacgagacttagagcccaaaaagccgagaaatttcttgactcaagaactgagaccgagaatctcgagtagccctaataattatcattttagttgcttcttttttaagaaaaggaccctacaaattgctccttaaaaaagaattcgtaaaataggttaacattgactattagttcttacagaatgccaaatttttggggccaagtgccgccgttttcatttgaaatataaagtaacttgaaatttttcaaagcaaaaaaaaaagaaagaaaataaa

SEQ ID NO: 77176 - DNA, 529 bp, Heterodera glycines
  Genomic contig location: Contig_ID=SeqID_199; Location=647..1175; Strand=+
  SCN-specific regions: Sequence locations=1-301,356-367,407-415,478-529
atggcagaattatgggtcaaccactcccccgccctcccggccccagcatcggataataattggtcaattaatggattaatgatgatggcgtcgatgagagagagagtgtgtattggcgagacggacgggttggagaagagagggattttgagtgcaattggcacagaaaaaagtggcaccggaaaaggtgccgtggcgaggaaggacggaatgggcatggacaaaccacataaaagcagcattgggggaactaacccatctccaagaagcccatcaaatgtaattaaggcatcacatagcaaaaataaaaaataaacaaaaaaaaatagaataaattgaaaatgatgaataaaatttaaaaagcggcttaaaattaattacttaaattttcaagtccaataaaaagaatttttcgaaattttaataaaatattaaagaggatataaaataaattttaaaattaattacttaattttagagaaatacaatttctatttaatttttcttagggtattaattttcaagtcca

SEQ ID NO: 77177 - DNA, 280 bp, Heterodera glycines
  Genomic contig location: Contig_ID=SeqID_1981; Location=50..329; Strand=-
  SCN-specific regions: Sequence locations=1-33,55-280
atgcttttggatacaattcatcagccgctcagcttgtgtgatggccataatattgcaattgtgcatcggagtggaacgattaatggccgtttcatttccaatttggtaattttacagcggtcaaattttggcacagaaaaaatgtcgatatttatcgcattttcaggtacaatatgagcggaaagtatttagttttcaaagtgctggtcattatctctacaattaaagtgattgttgataaatgcgtggattattacggcagttccaagcattgggaaaa

SEQ ID NO: 77178 - DNA, 774 bp, Heterodera glycines
  Genomic contig location: Contig_ID=SeqID_1981; Location=3794..4567; Strand=+
  SCN-specific regions: Sequence locations=1-167,193-252,275-723,746-774
atgtgtcgtagagtaagtgataaaataaagttgatcacaggaattaaaaaagacaaatatgtgaaaataaattgaggtcaaagtcaaatgaggtcgaaataccaaatcacttagaaatttgttacattctagctttcccggtcttacatattaccctagtgaactttaagttttattttaaattgatttaaagaatttgttttgattagttctttatcgagttgattccacttaccctcccagcaaagggaatgaattttttgcccagtttgtattttgtgttaaatctataaaaggggatgttaaagcgtgctgatggattaaaaatagaaaatagtttcagatctgttcggccataaacaattttatgcgccataaacagattaaacagctttcgcctattctcaagtgttggcagttgcaggtattctaatcgattttggtatggaattggcggaaggctgcagtgatcagcaatttgaaaactttctcccctattttgggattttttgcccctacaaagcctcggcttaattatgagattaaatcgtagtggcctttatcacttaacacacatattcattcaattgcattttccaattatagaggattcgtatgattgcgtccattgtttatcataattggttgaagctgcaagttctgtacaggtgtcacgtggttataatttggccaaagcacggattggtatgcttgtcggtacacagaactgtaggcaattaaattagctaatttatttgccaaactaaaatttaa

SEQ ID NO: 77179 - DNA, 482 bp, Heterodera glycines
  Genomic contig location: Contig_ID=SeqID_1981; Location=5562..6043; Strand=-
  SCN-specific regions: Sequence locations=1-33,55-482
atgcttttggatacaattcatcagtcgatcagcttgtgtgatggccataatattgcaattgtgcatcggagtggaacgattaatggccgtttcatttccaatttggtaattttacagcggtcaaattttggcacagaaaaaatgtcgatatttatcgcattttcaggtacaatatgagcggaaagtatttagttttcaaagtgctgatcactatctgtttgaccaaagtgattgttgataaatgcgtggattattacggcagttccaagcattgggaaaagttgggcaattcggcaaatgacccattttactttaattgatgtttcttttttcacagattagtcagatgcgaactttccgacccggcaaatcaatccgaaatcattggttacacagtttataacatactgattattgaggttgctgaagttttgtgctacgcaatgctttggctgatcagttggtggaatcagtgtcagtga

SEQ ID NO: 77180 - DNA, 639 bp, Heterodera glycines
  Genomic contig location: Contig_ID=SeqID_1981; Location=6141..6779; Strand=-
  SCN-specific regions: Sequence locations=1-25,53-113,136-143,176 -363,385-534,567-639
atgcgcccgactggcaataatttcattcagtttatatttctttacatttctttcgtgtttaaattttccaatttgaataataattatgtcatcaaatgtaactgatcaacaggtaaaataataataataattaatgaggtgccaaaattaatataaaataataataataattaaagaggtgccaaaattaatataagctttttgaaatcaatcattcattgtttgtttagtcaaaggatgaggctggttttgtgttcatcgaaattgcaattagtgggatcattacggtggtttgcttttttggaattgcgctaaatacgtcacttgtttacatcaccgtcaaatctaagtgcgcctttttcgtaaaatgatcatattattttctagaaaacattaattagcaatcatattggcatttcctaccaaatatttagtagtgattcgagaaaaattctgattattgcatctcatctttgggtaaaacttccacgggtgtggacattttccgtggaataatgccaaattttcagtttcttaaatttaaatacatataatattttttatttggcagatcgcttcgttccaaatgataatattttttatttggcagatcgattcactcccaatgcaatattctga

SEQ ID NO: 77181 - DNA, 968 bp, Heterodera glycines
  Genomic contig location: Contig_ID=SeqID_1981; Location=7116..8083; Strand=-
  SCN-specific regions: Sequence locations=1-75,100-329,351-577,605 -799,848-968
atgtgtgacaatgttccaagaaaaatatggcgcccaccattccgccgtaatttgcccttggggtgagaaggtggaaatttaaaaaagaattaagaaaatcctaggagtttaaatacacgccattccaagcgagaaataattaatgttcgcaaaaaatggccaaaagacgggaaggtacaacgaacgaaaaaattctcatagaccttaaaattaaggtctaggcctcaaaaaattggaaaatgccagccatttcggcagaaaataatattccgggtttggtttcagggagttgccgccaaaattggcacttccgtgccattcccatgcactgagaatgatggcactgtcatcgaattgtcagcccattttccgtccaatggccgtgtggtggacacattggcggccggcgattgttttgttgccggcactgtacattttttgaatgccggcgatgggcttcgccaagcgctgatcaaagccacttttttggccggcgaaagtgtcggccagcgtggcctaatgggcctaaaagttccatctgatgattcttcaatttgatttagcagaaaaaatgctgttctataattttctctttatttgattgtcatattttgtgcagaacaatccttgttaatttgaattcaatttaaaattgtttcgaatttaaaaattttggtcgagaaaaaagaaattttttgaaagattttcaaaaattttaaatcctaatgtatgcaacttttgttatatgggtatttttggaaatttctcagaaatacccaaatttggcttcaaattatgcttaaatttacttaatgaattttacatttaaatttattttttttattaactaaactttttctctaatttgtttagcctaatgcattgatagcttctaaaagaaattgcaaaaaaaattggagcaccaattttaagaaattaataatttaccttagaaacaaagtaataaa

SEQ ID NO: 77182 - DNA, 97 bp, Heterodera glycines
  Genomic contig location: Contig_ID=SeqID_13318; Location=30..126; Strand=-
  SCN-specific regions: Sequence locations=1-97
atgtccacttggaccattatcatttattgtgcagcatcggcaattagttctttgttcatcctcgccattgtgtgcgagattcgcaagtctttaaaac

SEQ ID NO: 77183 - DNA, 2567 bp, Heterodera glycines
  Genomic contig location: Contig_ID=SeqID_13319; Location=1..2567; Strand=-
  SCN-specific regions: Sequence locations=1-85,136-678,730-832,854 -906,929-1220,1325-1440,1468-1828,1850-1997,2019-2231,2255-2567
  Gene Ontology: Mol. function=extracellular matrix structural constituent; Cellular component=collagen type V; Biological process =cell growth and/or maintenance
cggttgatcattactttgcaaattgtccatttgctttgtctgatacttttctacgcatttgcttatcaccgaatttgggtgtcacatatttattgaaaattatttttaaaaaataaataaaaatgatttaatattcgaaataataattgcatcataatcatttgtactattttagctgatggaacgcgaattggaagtcaaacgggtggagcagcataaggcgcggggaaagcgcgaagtgacgtcagagaaaacaaaagcagcagcaaagtcggcacgccaattggacagtccgggcaaatggagcaccgtactgctcggctacgacacaatcattccggtagatttgccagaaaaacatcaattctatggagaattgccattttcagcggcaagtatttgaaacgtcttgccaacgtgtgcatcggtattgcgcagataagggccaaaaattacgcggtgtccgtggcccctcgggcggcaaagggccccccgggccagtgggacccccaggtaaagattttagattttattaggtaattttaatttcttttatttcgggtcgtcggggcccctccggtcgaatggggccaattgggccggtcggagacattggcgccgaaggaccgccgggaagcgatggtaaatcatttatcagaaagcaaaggcattcaaaagtaatttaaacaaaaaattataatttatttatttttaaatttatcttttattgcccaggccgttgcaattgttctctgcccgatttgtatgttcagagagtgcccgtgccggggcctccaattcccattgaaaagcttgtgccggtcccaataattgtgctcaaagagatggaggtcacaaagctggtagcgtttatgaattctttaaatttcaaaaaaaaaatttcgaatttttattattccataaaatttttaggttccttttgagccaactcctccaggctttgcagtaaatgattaatttctttttgagaatttcactgatttctcagccccccttgggttgggtgccaggcatgccgatgccggatctgtcccaaacgcgacttgtgcccccgactgtccgtccaaccgcttcgagccaatatcgccattggtggtcgcgcccgtggcggcgtcgctccaccacaagcgcaacggcaacaacgacgacggcgactctaacaccaccgccagcgcatttaacaggcaaagatgaaaaacaaataaattcaaattaaaaaattaaaaattcaaatgtaaatgtaaaatttaattttataaataattataattaaaaacaaaatagatttgaaatatttaaaatagtaagaatggaaagcgcgtgcttacaattagtagtttattttctgtttagcctcccaaccgaccacgccaacgccgtacaccgggccaccaacactttccgagaatcggagaggtatttttaaaaataatatcaaaaatggaaaaactttaagatataatattaattcaaattttacaaacaaaaacagaatgccgtctgaatgcagtcgggattcccgtgctccatgccgagtcacagtatggcacgacaggatcatggtaaaattgagggagaagcatgagtacggaaaatgtgtaatccgggaatcgggtccgggtccagtgcccaaaccctgattattattcgtttttcattgaaattactttggcaccattggacttgtgtgtctttttttattaaaaactttgtctctgatgtcaatattcaattcttaatctgcctggatatatacatattagttgaacaatttaattaataagctaaataattaagatttatgtccttaatgattttattttgttttgcatttttgttattctaatccaaggtttcgcgattcaatgcctcgttcgggcaaatggaaagaaaagcggtaacaaatcataaattgttattatgattaaatgaaccgtaatcgttggtactaattagggatagaatgaaaaatatataattgtttttgtctatttatggcctttttcaatcgactttttgggtgtaacattatcatttgtttatcaattaagctgcaagttgttttgccaattagtttaatggctttagttgggtcaccgatggcgacgcgtcgccggtgctttatgaatatgcaaatgaacgggagctaatgaacaaaaagcagaacataaagtaagttgcaggctaattaataagctaagttgcatttcataaaattattaattaattaattggcaaaaggacgaagtttaattagctttcattaaggtattacgttgactttttggcatcgggaacgggcagtaccgtgaacaatggttcttatttttaccatcgtcatggttcaaatattttggtgcgctacgatttggagagcaatgatcagattcagagcgacgccttgggacctatcgcatcattggactgtgagaaataatgccaaattaatggtgccataattttgaattaaaggcccatggaagcctgaccaaacattcacggtaaattaattaatttttgctgttaattaaagctttactcttttt

SEQ ID NO: 77184 - DNA, 348 bp, Heterodera glycines
  Genomic contig location: Contig_ID=SeqID_13320; Location=655..1002; Strand=-
  SCN-specific regions: Sequence locations=1-273,295-348
atgatcagtgatcactcaattagttatcattttacatggcattctgaagctccgccttatcggactgatcgcggccagccgaggtcaaaaattgctgttcaatctgaagcaaagcaaatccgggataagcgaaaagctaacgaagacgaagcggaaaagcatgaaaatggaggattggccatttcagcaccaaaccttggaaaactcagtcccgtccaactgagtatattgacgaaacagcgaagtgttctccgaactgtccctcggcatttccttcttctcatggacacaaacccatttgtgcaattcatgcagggccaaatggtcgaacgattcattggccaatga

SEQ ID NO: 77185 - DNA, 406 bp, Heterodera glycines
  Genomic contig location: Contig_ID=SeqID_13321; Location=560..965; Strand=+
  SCN-specific regions: Sequence locations=1-20,215-274,369-406
atggccaatttctgttccaaggattccaccagcgccgaaatgcgaattgaaattcattttgacattactctgcacaaactttcatgtcccttggttaccatagacgtgatgagtcaatctggagagagtcaagatggcattcagcacgacgtgttcaagcagaggctggacaagcaggggaacaacatggaaggggcacagcccgagaagcagggtcagcagttggtcaaacatgccatcaataggccaaattgacaataaaccacgagtttaagttgtgaacacaaatgcatccaaaagtgctaatgtgtcaaggaggacaagcagtgacgaggagtgcggcagctgctacggggccatcaaagggtcagtgggccaattgggacggtcttccgactcatcgtga

SEQ ID NO: 77186 - DNA, 1140 bp, Heterodera glycines
  Genomic contig location: Contig_ID=SeqID_13322; Location=1042..2181; Strand=-
  SCN-specific regions: Sequence locations=1-17,49-85,124-140,166 -166,296-337,468-1140
  Gene Ontology: Mol. function=protein serine/threonine kinase activity; Cellular component=centrosome; Biological process =regulation of mitosis
cttcgccaatttttatgacattccttccccaatttttatgtcattctttgccccccccctcgctttggcatgctttttgtctccaccttttcctctcttcgtattggaccatcaaaggcgagagttcgcattgtacaaagagtccgggaatgccactggccccggtcataatgtccctctccacgcgagtgatcgcaaattgatggctgaccaaagtctcttccttccgcgtcactccgtaaatgtaccgagtaggcacaattttcagttgatattggtgcattatgccgcctttttgttggtttaaatgcttttgcgttttaaatggcttcaccaacctttgttggttatgaattgtttcccgtccaaaggatgcgttttgccggggaaaggctttccgaaggacaaatggtttatggtgtgagaagcatcaaaacgggcgggggagacggaatggaagtcgtggactaaaatggcaaattgagtggggggagggggggggcgccggaaagaatgaacgaaatggggtacagcttcaagtcggacatttggtccctcggctgtgtcctttacgaaatggccgcgcttcagtcgccgttctttggcgagaaacaaaatctgctggcgttggtccgcaaaatcagcaaatgcgagtacccgcccatcccggccaacatttactcgcaacaggcaataaataaaatagagaacaaagcggcaggagaaagccggggaggggggacggggattgggtgccaggaaaaccctcggccaaaacagaaacaccaccctcaaatcgtattcgttcagttgcgactgacaattgccaattgcatctgcacaaatccctcgagacgtttcgatgcgcaggatgtgctgacaatttcaggtgagtggcaccaactgacgggggtacggccaatggaaatggagccgtttggaggaatcggccaaaacagccacgggaagtgccaatgcatcgatttttttttgtgaaatgattggcacacaaaaaagcggtccccctatactcatgcttataattttgaattttggcccaatttcctacgacttgcagaacacatgcattcccatttctccgctctttccaaatcggcgcccgtttcttccgcccattta

SEQ ID NO: 77187 - DNA, 425 bp, Heterodera glycines
  Genomic contig location: Contig_ID=SeqID_13322; Location=1671..2095; Strand=+
  SCN-specific regions: Sequence locations=1-44,175-216,346-346,372-388
tttccggcgccccccccctccccccactcaatttgccattttagtccacgacttccattccgtctcccccgcccgttttgatgcttctcacaccataaaccatttgtccttcggaaagcctttccccggcaaaacgcatcctttggacgggaaacaattcataaccaacaaaggttggtgaagccatttaaaacgcaaaagcatttaaaccaacaaaaaggcggcataatgcaccaatatcaactgaaaattgtgcctactcggtacatttacggagtgacgcggaaggaagagactttggtcagccatcaatttgcgatcactcgcgtggagagggacattatgaccggggccagtggcattcccggactctttgtacaatgcgaactctcgcctttgatggtccaatacgaagagaggaaaag

SEQ ID NO: 77188 - DNA, 247 bp, Heterodera glycines
  Genomic contig location: Contig_ID=SeqID_13323; Location=23..269; Strand=-
  SCN-specific regions: Sequence locations=1-247
atggaaaggcagtgcaaatgtgcggagattaagccgtgcaaagaccgctatcagaagacgatggagccatgcttggacacgtgccaagtgcgcatttttcaagaaaaaaatcggcggaattcgctgcttttcagtctcatatcacttcgctcggtggcaacttccgccaggtgaaggcgtgcttcaccccaaaagagagtctgctcaattcggcgatgcgatgcaccgaaagacagcacgacaacgc

SEQ ID NO: 77189 - DNA, 1251 bp, Heterodera glycines
  Genomic contig location: Contig_ID=SeqID_13324; Location=1369..2619; Strand=+
  SCN-specific regions: Sequence locations=1-25,62-88,110-147,171 -1041,1063-1094,1130-1201,1225-1251
atgaattcaaaaacaattcttcatgtttttctgctccttttccttttctcttcactttttgtcattatttccttggcaatgcaaatagaggaacaacaaacaaagagtattcataatggagatgatgatggtaatgagaatgagaagaatggcaatgacagtaattttatgctaagcgatgcgtcagcgttcaaaacgtaccaaaagcgcgaaaacccaaaaagcgcaaaaacgggcaaaaacgacgaattggacggtgccggcgccgaaaagtctaaccgacgagggaaggcaaatggggtggaaaaagcgccgcaaaagcaaaagaaaactgaccgcatcgcttctaagcagcgaccgatggataaaagtaaggcacggaatgccattaccaaacaaagacggctaaatgaagaagaagccgctgctgtagccgtcgatcaaatgagtgaacccgcggggattgacggggaagaagccgagccgagtcggcaccagtcgctgacaccgagcaaaaggcaacgctcggcacgaaagaagccaaacaaaagccaatgggatgttcaactgacgccgacgggcaccgtttcggatgcggaaatccccgcagatgacaacagcacgcgcaatttgtcacccgcggccgatggcccaagcgaagagccgtcgtcgtcaaaaggcgtgaacaattcgccgttggcacttgtggacaattggcaacggccgcaaattaaaaaccgaattagagaacaaacacggcgcattgatgaacttggccaagaagtggcggaattaaagcaatggaaggcgcaacaagaacaaaaacaactgaaccaatcgcaggaagaagcgttgcggcaacaatggcactgttttgtaagcatacagcaaatgatggcactacaggtacaagcacagcaaatggcacattttcaatcagcgaatatccaagacttggaacaacaatcggagactgatcagcaacaaacgctgtttcgtccaatcgcctcacatggaagcgtaacggagcgaacagtaacagcagaagagaaagaaaagcaacatgaaatgcaagaaaatggacaacatgagcaaggaggacaccaagatgaagaagtgcagcagcagcaacaatttgaagaaggaaagcaacaacaaacgacgaatgcactgatgagctcttaccatggcttaccacgggaagcacaacaagaggaagaagaacaacaccaaatgcatcaccaccaacag

SEQ ID NO: 77190 - DNA, 4052 bp, Heterodera glycines
  misc_feature (29)..(30): n is a, c, g, or t
  Genomic contig location: Contig_ID=SeqID_13325; Location=1..4052; Strand=-
  SCN-specific regions: Sequence locations=1-275,298-344,367-538,561 -678,722-1092,1116-1565,1621-2408,2432-2536,2559-2701,2726-2744,2787 -2849,2872-3002,3039-3068,3090-3409,3431-3434,3472-3529,3552 -3585,3614-3624,3646-3688,...
  SCN-specific regions: Sequence locations=...3710-3831,3861-3889,3912 -3928,3960-4003,4026-4052
ttttaagttttgcggtgaatacaatggcnntgagggacatatgcagttgaagcttgcttacggggtaggttttattcaaatagatgcaaaaaaaaagaattagtatgttaattcgtagaatatgggcttaatctcatatgaagaaatttacgaattaaaagaaaatcaaaatttttctgccaaaattcaaaatttttacgatattgaatttcgttttcaatttcgtcacatttttttgaatgaattacgtcaatttttcagaattatatagccatgaaaatttgttaataaaaatttatgatatcggctagtaaatttgtgcatttttctacaaaatctgttagcaaaatgcataaaatttaaaaattttctctactggtgctggtcatcaaaaaatttttgagcgttttttcaatttcgtaaaaattctgagggggggggggtattttcgtaaaggcaattttctgaccaccccgccagcttgtccatgtatgcggatttatgatgataaaaatgtgttgaagagtggcatcccctcaaataaataattttaaaaaattgacctttgacttttcattttgaattgagatcagtttgttcaagatttcgcttcttgtcatccaatttctgatcccaacttcaatcatggcttactgctactggaaaattctacaaaaggtctccctccaattcttaaccatttaaatttttatttttaggttcgtcaggattggatggtgccagctagcttcagttccacaatgaccgttgaacaacaggcgcagaccgcaatgcgcaaacgccgtgtgatgttcgtgctaagaacgcctcttatttgttagctagtgtaaatcagtgccaaaatgaagcaacaaatattttcaatcaagaaatttctaatatgtaagaattaaaatattctaaaatagaaaatctcttttttcaagatcaaattattgctaagaaatttttgcatggaatcttttttaaaagttgtgattagtcctgatgaaagctgcactctctaacttaactttttcctttaggtacgtgctcatcttgatggtacggattattaattcattttttgatattacaaaatttcaattttcaaattaatgatctcttcacaatttccaattttaaataaggtgctcattttcatgggttcatggatgcctttgaccattgtgaatttggtaggttttttcaaaatttaaaacccatgcgatttgttaaatttttgggcaccatcgaatattgacaattcctttaccgcggactccgtattttttgaaaaattttcaaaaacttaagtatcttaggtcgcacttttaattctttgaattttttattgaatacgcgatacagtaaccaattatcgtaatttttgtccagcttagagacatggatttcttgcgcgatgccaccaacatgtatttcaagctgttaaatgtccacgccattgcgatgacttcaattgtgtccaatccattgctgtacttttggatgagcaaagtctgttcgttttgttttgtcggattggcgctgagccaagggattccaaaattaatttaaataataaatgacaacagtttttaaaaaataaaatttatttaagtcttctaatagtacaaatatgggcaatgatttttcttaaaatcacaagaagagatttgagaactaagcatagattcatgacccttgatttctcgacttacaagggaacattccgaactgtatgtgttaaaatcacttttaaaccacttttatcgtgtagagagcatagtcaatttgatatttccaattttcggcttttttggctccggcgccaaaaatgatcagaaaaaattgatcaaatgaaaagccgggattcgggcattgatcattaattcattcattgtctggtggttcggtctcattcctctaaacccgcgattagactttatgttctttttctagcggcatcgtcgtgccctccgggatgacatcaattggttcaccaatatgcgcaggcagcaacagcagaatgtcggcggtttgttgaacaaattcacaccaagtccttccatcggattgctgtgccgaaaaaatttggagcgccatttgctaatgaatgcggcagccaaatacaaccagcaaaggtacagtaaatgcgccaaccaaatgaatggaatacggtatatcaaacgtcaattaattcaacttattagacgctcccaattcaatcgcaccaattcgcatcactggttgtcccagttctaagtagagcccgaatttgttcggactaatcgggtttttgaactcggtttatttttttagaatattctttattctaccttgatgcatttatatttacccaccagacactttggaaaacacaccgtaccaagtccaatgtttgttttttcacagaactcaaattctttatctcggtctcgagattaacgaaactaaaaagccgaactcaggcaggacaaaagaaacaccaaacttttctctactttgtgattctcgggcattaatcactgtcatttttattttaaataacattcattactgctgataataaattaactttttttgaatttattttccttaaagaagaggcacgttggctgaccccacttgcatttcgcgtgaacgagcacttcaggaaatgcacgcaaattggtgaggaaaaaagaagcggggaatttataaaaatatttaaaccaattatgtaaaaatgtattccattggactaaaaattgttaaaaataataatgtttcattaatatttaattgcttttgcatttttttcagtttcctccttgtccccctaatgcctctctgtgtcgcaaatccttcacccccaccaccaccagcgcaacaacgagctcgaacgggcacacgcacttcactgctattgacttcccgagaaagaggagcaacgcttttttgactattaaacccagccaatctaatggattttgtataatatgtgtataattacgtaattcaataaaaaaaataattaatattaattagaaattattgtgcggtgccaatgtttgcatgaaaaataattacaccgctttcacctttcatcaaatcgtattttgtgtgaaaaataatttcatccctaaaaaacggggaacaaagatcaatatgcttcggttccaaaaaaggttatttggcaaataacaaaatttgttcaaataatttttgtgcaaatttgttaattaattgggtaaaaattctcaaattttttgtcggcggcgcataatgtcaacggactccaaataaagcaaacttatcattaaataataaatagagctcgcaaaaaaggcaccaaaaatcgcgaaaaaggcactaaaataggcaccaaaaaattgaaaaaaggcacgaaaaaagactttataatgttttcgaataaggaaaatttttaaacctaaaatttttttacaagaaaaaaataaaataaattttggtgatcaatttttgagaaattcaatcttttacggttcataataggtctaaaattagtaaataaaaaatgtttagtaataatgtgtgaaaatttaggagttaccgcttgaagactaattaattttttaaataaaaaaaaattggggacgaaacgactcattttggcttaggggacgaaacgacgcagggacgaaatgacagcgcgccgtcacctaataaagcctataaaagtgtttttatgcaattttgagtgtgggacatatgatggatatttacccttttttaacaaatttccaaaactcacaaatgatcaaaacacggaaaataatgaatttcatgcgcaacggcgttcttgagaagaaattattaatagatataatatttttatacctttatagtgatgttttttaacaaatcatatttcataatattttaattataatgggtaattttgtggattttaaaaattaatatttttattttttttagaaattagcataagataagacaccaggccaagaaataggaagttaagcacagtgagacaaaaaatgcttattggggttctcttttttaatcat

SEQ ID NO: 77191 - DNA, 519 bp, Heterodera glycines
  Genomic contig location: Contig_ID=SeqID_13326; Location=1139..1657; Strand=+
  SCN-specific regions: Sequence locations=1-127,149-282,304-330,352-519
atgttcaacaatttgttgccgcagcgccgccattgcctcttcctgatgcgccgtttacatttgaaaacatttttgaggtgagtctcacaaggaatatttgggatgccaagcaaaaatattcgaaaaagggtacttttctgttttcagacccccccctgaaattttcaaagaaagtcagtttctgaggttatttgtgacgctgatcacgaatatgacatttgttttgctgaattccgaaacttggacccgaactcgagcaaaaattcaaattcattaatacacaaggaaaatcatattttggtagaagttcagtttgtccctccatttttgaattttttatttttattttaagaccataaaaacatgttttaaggggttttagagaaagctgatcacgaatacaacaaaaattttgagcaattccgaactccgaacatgaactcgaacaaaagtcgaaattttaaactttcgagttacgcattttcggttcaaacaaaccagcttaatgcaaggaaacaa

SEQ ID NO: 77192 - DNA, 961 bp, Heterodera glycines
  Genomic contig location: Contig_ID=SeqID_13328; Location=749..1709; Strand=-
  SCN-specific regions: Sequence locations=1-530,552-929,954-961
atggacagagaaacactgaaacgattgcaaacgatggaaattgttgacgcaatgtccaattctggcggacaattggtcacgcaacaaatcgagaaagtgatcagaagacaccaacgccttaataaggtaattagcgagcaaataaattgacattagtaattaaaaatatcaagcaatttaagaaaaattatcatatttaaattgacaattcaaataattggaaatgatgcttttgaacaaaaaaaacaggcgttgactcaaagcgaaacgcggcacgaattacagacggacgcatgggacggtaaagcatttgttggcaacgtatcatcaacaccgtgtctgtccacagtatgccttagcgagcagcacacactgtgcaacggccatttgtccgcgtttgcccccttttggcattgcgtatgttccgtgtcgcccttccttcgttcctccgcttccgcgactcttcggcgttgctcatccgcttttctcattcgaaatgttccctccaaagtgctcaccgtccccctgcttttccccctccccgctctgttcggcttccaatcgcttttcccccaactgatggactcttttctcgcccattggctttcgaccacttttggcggcaaaatcaaatttgtgagaatttacaaatcgccaaaaattgcgtacaatgcaaattcaaattcttttaggaccaagtgcttttgctgagaaagcaatgtttggatgaacaatttttcgttgttcaatttgcttttctgacgaagctcagatgggccaacagaaaggtggcgaaaaatggccaaatgacagactccgatcttttggacattaaaaatgcgcaatttcgcgcgggtcgccgcgccctatggacggatcagacagtgctggagatagcagatgttgaagaagcatgcttatatcaaaccaattaattaattatatttaaaattcgaataaa

SEQ ID NO: 77193 - DNA, 569 bp, Heterodera glycines
  Genomic contig location: Contig_ID=SeqID_13329; Location=371..939; Strand=+
  SCN-specific regions: Sequence locations=1-239,261-302,324-569
ctccgtttcgagcccaaaaatgtgttggtcactggcgcctgcggtttcattggctcaaattttgtgaattttgcctttgaaaagtggccgcagagcaattttgtgaacgtggacaagttgatactgaacagtgactgtaattacgtggcacggaaagtgcgcaattcggcgcggtacaaaagcgaattggcggacattcgcaacggaaaagtgctgaaaaaagtgttggagcaaaatgaggtgaaaaagggagaggaaactaagaaaattgaaatgaaataaaacattcatgattaatgaaattcatcattattaaattgattcaattaagaaacgacgaacaaaaattgaaattagtaaacgaataattttttttaattactgttaatacatcaaaaagaaacgatttaaacaaatttaatttaattgattttttggtaatgcgtgttaattttgatttgtcaatttaataattgctttaattgattgatcagattgatacgattgtgcacttcgcagccgattgcaccagcaagcgatgctatgaacaacccaatggaaagcgttgg

SEQ ID NO: 77194 - DNA, 941 bp, Heterodera glycines
  Genomic contig location: Contig_ID=SeqID_13330; Location=1103..2043; Strand=-
  SCN-specific regions: Sequence locations=1-19,41-462,484-941
  Gene Ontology: Biological process=growth
atggttggtttgtttgccatttgtatttcccctgttaatattttccattttccgatcaccgcttctcacaatccgaaggaggacaacggcttcaaggcttattgggccaacggtgctcaaattctgagcccacacgacacggaaatttgtcgaattgtcgcggaggagtcaaagcccgaagaagcctattgggacacggtccaactcggcacaagtgcctttctccactcggccgactcggttttggagaaatattttgccggggagagtgccatttgctgccatcacaagttccatgcggcacacttttggttctcccttccctttccattttcggtcgctcaaccaaacttcgtccctccgtctcacttattccgctttccatggcgtcggctccaaattcgtccgccgaatgttcgctgagtttggctttccctcggagaacatttcgtacgttaaggtattttgtgtgtattttttataacagttgcgcagtgtgtcctgttgactcatttccattcaaattttcaggaacaagacgagcccgacgccgactttggcactgttccattccccaaccccgaggaagggcaccgggtcctcaaactgtgcattgagactgcaaatgccaatgactcgactttgctcctcgtcaatgacccggacgccgaccgactccaattggcggagaaagaggcaaagtccgtaaaacgggaccaaatttgaattggcatttgactgatttcgattttgctttcagcggagagtggcgcgtgttcagtggcaatgagatgggcattctgctgacgtggtgggcgtggaccaattggcgtgccgccaacccaacggcggactcttcgcgggtgttcgtcctccattcggccgtctcttcccaaatggtcgccacaatggccaaaaaggagggtctgtccctcaattaa

SEQ ID NO: 77195 - DNA, 358 bp, Heterodera glycines
  Genomic contig location: Contig_ID=SeqID_13330; Location=3178..3535; Strand=-
  SCN-specific regions: Sequence locations=1-358
atgaaacaaactccgatgcgacaacaccagcaaaggtcgcgaatatcggagcacgaagagcagcaacataaggcggaggaagcggcggtggacgcggttacccttcagtaccaacaacaaattggcggtccgctttcacaacggggcaccagcgaacgtcgttcgtactattccaaaacaacacacattgggcccagcaccgaaatggagtgagttttatcagcattttcgatgtaacataatattacaatattatacaaatatttgaaggaaaaggaagcgtgtcgaacgactattcgccacttccggcggcagcaatatcgtttttgaggatgggacgctgcagacgcaagtttaa

SEQ ID NO: 77196 - DNA, 344 bp, Heterodera glycines
  Genomic contig location: Contig_ID=SeqID_13331; Location=61..404; Strand=+
  SCN-specific regions: Sequence locations=1-344
atgacgcagcaaattgtccaactgagcaccaccgggaaagcacaagcggcgaatgtttggcgcaaaaattggccaaatttcacggacgaaaacatcccaaattggctggtcatctgtgccgtatggggaaagccacagacgcaaatcggtgcctcttccgtcaaaaatttgctgattggaacggaggaatgtgatgacggaatgatcgatacacctgaaaagcaaatgctttacataaatatcagtgaaaatcctttgatttactcaattcgaagacgattaaattgataaagtttccaattcacttaaaataggtaggttaaatcagacgttttttagatata

SEQ ID NO: 77197 - DNA, 388 bp, Heterodera glycines
  Genomic contig location: Contig_ID=SeqID_13333; Location=419..806; Strand=-
  SCN-specific regions: Sequence locations=1-78,100-187,216-223,245 -355,378-388
atgtttgccggaacagtccaaacaaatccaaatgccgtaggaaacgctggcccactgcgggttggccgcttggcactcaaaacaggacttaaaattaaaagaaatcatgaaatgtaagttggaatttttaagggtttctgtccccttgtttagtttttcatagggttcactaaactgcaaaaataccaaaaataaaatttaatttttttttttttgaaaacgcacattgttttcgtcaattggtctcagctccttaagcacttttagagttcgcgggcttgccattttgaccaagcggaatgaatacaattgtgatatgtataaaataaatatgtgtatgcgaatgtaagggatttgaggttgtgtatgtgtgtgtgaaattaataaa

SEQ ID NO: 77198 - DNA, 635 bp, Heterodera glycines
  Genomic contig location: Contig_ID=SeqID_13334; Location=69..703; Strand=+
  SCN-specific regions: Sequence locations=1-635
atgtcttcgggattttctttctttccgcttgaatccgatgtttcagtcggcaattgtgaggtgggagttgacaagcgaggttcttgaatcttgagaaaaaagagacgtgattcaatttcagcaataggctgagaaaaagctctagtgcactttaggcgttcaatcaatgaccaccttcacccccccctggcctttagatcttctagagccgaaaagagctaggaatataaaatgttcgctataagtgcctttaactcatctaaaagtgatcaatttttggataaacttatttcataaaactacctcagattcgttagatgttacagacatacaacgaaaatcttcgtcaccactcgaaactgtctcattcaataattcctgctgatgctcaaagaacacagtgctcgaaatgccttcgggattttctttcttttcgttggattccgttgtttcagtcgacatttgtgagtttggatccaataaaatggaccgcaattcctgtataaattcatagaataagtgcgtatatatatatacttgacatttaaaaaaataatcgattaattaactctgcgcattagcattttctgcacatgatgctgggtaatagtggagaattggtgtcccggcgaaaa

SEQ ID NO: 77199 - DNA, 521 bp, Heterodera glycines
  Genomic contig location: Contig_ID=SeqID_13334; Location=10..530; Strand=-
  SCN-specific regions: Sequence locations=1-521
atgtcgactgaaacaacggaatccaacgaaaagaaagaaaatcccgaaggcatttcgagcactgtgttctttgagcatcagcaggaattattgaatgagacagtttcgagtggtgacgaagattttcgttgtatgtctgtaacatctaacgaatctgaggtagttttatgaaataagtttatccaaaaattgatcacttttagatgagttaaaggcacttatagcgaacattttatattcctagctcttttcggctctagaagatctaaaggccaggggggggtgaaggtggtcattgattgaacgcctaaagtgcactagagctttttctcagcctattgctgaaattgaatcacgtctcttttttctcaagattcaagaacctcgcttgtcaactcccacctcacaattgccgactgaaacatcggattcaagcggaaagaaagaaaatcccgaagacatttcaagcactgtgttctttgagcatcagcaggaattattgaatgagtcagtttcgagcg

SEQ ID NO: 77200 - DNA, 940 bp, Heterodera glycines
  Genomic contig location: Contig_ID=SeqID_13334; Location=854..1793; Strand=+
  SCN-specific regions: Sequence locations=1-172,194-515,540-583,605 -607,634-824,849-940
atgcattctgggattttcggagtcgctgatcacgaatatgaccttagttttggccaattccgagtcccggacccgaacttggacccaaaggcgaaaattaaaacagatttttatgtgtgtgttttgaacttcgacttttgttcatgttcggtccgggattcaaaattggtcaaaattaatgttttatttgaaaacacctctaagaaatttagaaaagttaaaagatttgttttttgttgtttttctggaagtggggcggtaattatcagctccagggtctgaacagcaaagagaagcagttttcaaccagtttttcggtattttagaattaaaaaaaaagattttgcggaaaagcattatctttgcttcattgttgagctgaactgcgcatgagcgaaaccacacgtatggatggcccaatctgttgtggtgcaatttttgatttacagcgaaaatccgtcgtttgaacacaaaagggaacaccgtttggaatgcctgctggcgatactccgaactaaaataaattaaattattttttacacattttagtggaagactccaattttagtcatattcccgaaaaaattttcaaaattaagaatttctcaattttatttttattataaaaattttggcaatcccgaagaatcgggggttcctaatttaggtaactttttggtacttttcggttttgtgaccccccctgaaattttcaaataaaaagtcatttctagggtaatttgggccgctgatcacgaatatgacatttgtttttcaaaattccgaaccttaattcgaacaaaaatttgaaattcataaattacaatgaaaacatatttttgggggttttagaggtcgctgaaaacggttatgacatccatttgaccaaattcgaaacccggactctaacaaaaaaaaaaggaaattaattctcgacaaa

SEQ ID NO: 77201 - DNA, 1853 bp, Heterodera glycines
  Genomic contig location: Contig_ID=SeqID_1982; Location=620..2472; Strand=-
  SCN-specific regions: Sequence locations=1-37,59-89,113-1156,1179 -1701,1725-1794,1840-1853
atgtgcacattctttaaaattgaatgtttatttttgattgactacaaaaatagtattttgccaaataataccgtattccgtacaaaaggtaaatttgcaacaaaacaaaaaacggatttatggaaagaaaaaaattttcatggagtaattgccacttaatttggtataaataccgtataaatctacggccatttcgataaagtgcagtggtcaacttttaatgacgatttgtcccttataatcgttttatggtaaaaaatacagtacccaaatgcgtaatattttgacacaaaacaaagcgccaaaaatttcaccggtaataccgtgccatgtcatggtaactacaataacaaaaagtgcccctcccactgtttaccttcattttgcgcgagttgcaactggacgcaccggaagtcacttggaggccgtgggccaattcctgggcctgaaattatggcacaaaaatgccaaaaacaaaaaaaaagagatgactcaccctcagcttaagcaatgcttgctggtaggatggtgaaattggtgaatagtgtgaagcattcttccggtgcagccaatgcagcaacgacgaatggtgatcagagtttgcgtagcgatggtaacattcttcgcgcatcgtaaacgcttgatcagtggtgatcagcgaggacgactgatcggacgaggatgaaccatgccgagcagggacagcactgtttgggtggggggggggagtgtggagataggcattttggtcggaaaccctcagatcgagggggacaaatgggcaaatcattatcggaaatcctgataaagcaccgagtcgagaatggtcaacagaggcatcacaaattaatcagttggatgagactctgatcaaagtaaagcactgatcggagtaggttgtgggatcatggaactacagaatttcgccattattaggtttgggcttagactagacctgggtttttcaaaaattggaatcctgaaattcagtcggaaccttttctagcggcatgctttttagtcgcattttaatcacggttaaaagtatatccggcaaaggattttggcacacaactttcccaagaaatacctgcagatgaacaactgagatgtgcacaataaaaggaagagaagcgtgaaactgaagtgagatgggacagaaacagcagcagcagcagtattagtagcaggaagcacgggagaaaaacaggcggagaagcacgacaacggcacgggatgtgccaaaaaagatgaagccgaagacgaagccggggagccaactctaaaaatgttgtacccgccggatgaagaggggcaaaataacgaagcagcggtggaggataatgatgccgaaccggaagaggaaaatagtggtgccgaagatgaagcaacttcatccccgtggtgatcggccagcagttgtgccgttgctgctattttttgtcttgttgttgaatctgttatgcagcttctttggcgatgaatcgtcttttcctcttccccctcatccgcctcatcctccactgtttcagtaaatgccaatgccgtcgtcgtcgtcgtcgcacagccaatgaagccaaaagctttcaggcccccagctaagcggaggcggcggctgtcaatgctggcaccaccgctattccggaaacgacaattttcgtcctgtttggcaccacataaagccgcttttcctcctccccgtgcagcagaagcagcagcagctaatggcatttgttttgccaatgtttttgttgaactcattagttaatagatgtgcgcgagcgatatggctaatggtggtagtggtggtggtggtggtggtggtggtggttggtgatgtgccgatcaataaa

SEQ ID NO: 77202 - DNA, 1265 bp, Heterodera glycines
  Genomic contig location: Contig_ID=SeqID_1982; Location=1708..2972; Strand=+
  SCN-specific regions: Sequence locations=1-653,677-707,729-1238,1260 -1265
atctgagggtttccgaccaaaatgcctatctccacactccccccccccacccaaacagtgctgtccctgctcggcatggttcatcctcgtccgatcagtcgtcctcgctgatcaccactgatcaagcgtttacgatgcgcgaagaatgttaccatcgctacgcaaactctgatcaccattcgtcgttgctgcattggctgcaccggaagaatgcttcacactattcaccaatttcaccatcctaccagcaagcattgcttaagctgagggtgagtcatctctttttttttgtttttggcatttttgtgccataatttcaggcccaggaattggcccacggcctccaagtgacttccggtgcgtccagttgcaactcgcgcaaaatgaaggtaaacagtgggaggggcactttttgttattgtagttaccatgacatggcacggtattaccggtgaaatttttggcgctttgttttgtgtcaaaatattacgcatttgggtactgtattttttaccataaaacgattataagggacaaatcgtcattaaaagttgaccactgcactttatcgaaatggccgtagatttatacggtatttataccaaattaagtggcaattactccatgaaaatttttttctttccataaatccgttttttgttttgttgcaaatttaccttttgtacggaatacggtattatttggcaaaatactatttttgtagtcaatcaaaaataaacattcaattttaaagaatgtgcacattggcactcaaaaataattcataaaacgtttttacggatcagaaaacatctaccgtaatccaaattttttggagataaagtcatcaatcactgacttacaccgcttaccgtaatccagatttttttgaaggtaagtgatcactcactgccttacacagtgctaatctctttcactgatcgcttgccgtaaccaaaattttcgggtcaatgcccacatttctgcaaacctgatcactgatcattgacacacagtaatacccacattccgtttttgaaggtgatcagtgccagcactccgctcagggaacgggcattgtgccaatttgagtacgtcctcaactacaagcccaatgtttgttgtgcagcgtgcatttttggcacataaatatcccatatgatccgttcagagaatcccgtccacattcaccgaagtcaaatgttcatgtccacggccctccattaggatggtgggcaaccgtatgttcgagtgcgagccgttac

SEQ ID NO: 77203 - DNA, 159 bp, Heterodera glycines
  Genomic contig location: Contig_ID=SeqID_1983; Location=753..911; Strand=-
  SCN-specific regions: Sequence locations=1-54,76-159
atggttacggtaagtgtcgggatcagggactgggcgaagctcggcttagcactcgaagccgaagccgaaggcgaagcccaatttttttcgaagcacgaagttcgaagttcgaagcccaaaaaccgcgaagttttcgaagctcgaagcacgaagctcgaa

SEQ ID NO: 77204 - DNA, 1958 bp, Heterodera glycines
  Genomic contig location: Contig_ID=SeqID_1986; Location=843..2800; Strand=+
  SCN-specific regions: Sequence locations=1-5,28-328,350-400,422 -491,523-784,821-826,857-927,949-995,1069-1110,1132-1155,1177 -1222,1259-1299,1323-1457,1479-1958
atgccatttttgaaaatcatggaccaacatcattcattcatacaggtgcactggaacttcttcaaagctataaagaaggtgaggagaacaatgggatgactttatttaattggtgggatttcatattatgccacaggacaaaacgccaaaagaaaaaaaatgcaaattaattacgttaactgatcagtagggcttcgatttttaggtgctaaaaactgccaaaataagtaggttttaggttctaaaaaacccccaaaataggtgctaaaaatgggaaaataggtgccaaaaagttccgaatttaggggtgtaaaatcgaaaattttcatcaaaaagcaaaaatattttgccaagtcattaaggatatacataattttcaaaatcaaaaattatcgtcaagaaaataaaataaataaattttggagataaatttttgagaaatttttcatttcttaggggcgcatttttgaaaattttctggtcgattcttagggatgtattttttgaaaaaatttttgggtcggttcttaggggtgtatttttcttttttttgcatatttttaacaaattttgggcaaaacgccaaaataggtgaaaataagtttttttaaatttttttaggttttttaggtgctaaaaataaaaacctagaaaataggtgctaataactcgaaaagtagcttaacaacagcccaaaaaaacatgtttttcgtgcgtttcaggccacggggagctcaggaaaaaaatatgtaaaaacctaaaaatcgaagccctactgatcagtagggctggcaaaaataaatacaaaaagtggtaaaatatgtacataaatatgtaaaaaaaaaaaaaaaattttggtcatttttggaaaaaagttcttagtaaagggtgaaataggacctaaatagtcttagaatcacatttttgtatatttaaatattaatttttggtatctccttttttgaaaaaaaaacaatttttaggggtacatattcaaaaaaattttatttttttcacaagaaatttttataaattttaaaaatttctcaaaaaaatttagaaaaaaatgctaaaaagtccaaaatatgtaaaaaaaaaaagcccgaaatatgtaaaaatatgtaaataaaagtcccaacttttgttcacaaacacaaaaaagaaagtgtttttcctactatttagagcatggttggaaaatccaggaaaaaatatgtatttacataaaattgacattacaaaaaagcaaatttaaattccattaactgatcagctgatcattttgccataattaccgtatttgtttcttttctcttttttatgatactgtcctgtttccgttataacaaattagtgaaactaattaattatatgagctctaaatgtaattgactgaccataataccaaattcggccgtccctcattcattttgtaagtggacaatcaaccattggtttcggttttccttattggtaccccctcgaagacatctctcacccaaattttccaaaaaatttcgctaaatttttccaaaaatgccacaatattagcgcagttttttgtgaaaatctgataaagaattgagggaaaaccaacaaaaaaaaattcccggaaatccgaaattctcattttaaatccaaaatctttgtgtcagctttttaagaaatttttttttttggcaggctttcaaatatcataaatgaaactggtttttttcagtcccaattgtgcccaaattcacggaaaagcggaagaacaaattcgagttcatccgattcgggaagagaagacgatgatcaacaagagagagagagagtggaaggacagacagtcagacaaaaccatttgagtgatcagagagcggtgatcaatgatacatttttaacaaatacacgtacaattttggtaatattatcgctggcaatgggacattttttgcttttttgatgggcattga

SEQ ID NO: 77205 - DNA, 231 bp, Heterodera glycines
  Genomic contig location: Contig_ID=SeqID_1987; Location=291..521; Strand=-
  SCN-specific regions: Sequence locations=1-102,128-129,225-231
atggcactgctggaggagttcaaaagtctgtcctttttctgctacaagtgcaacgggttcaacgcgtccaaaaatgagttgacaataatgcataagaaaagtgcggcaacagcagcagcagcagagacggaagaagtggaagaggaagaagaagaggatgaggaagaggagaacaacaacgacgacgacaacaatgaggaggaggaaaaagaaaagggcaaaaatgaatga

SEQ ID NO: 77206 - DNA, 1055 bp, Heterodera glycines
  Genomic contig location: Contig_ID=SeqID_13335; Location=27..1081; Strand=-
  SCN-specific regions: Sequence locations=1-285,307-449,488-709,741 -810,832-858,881-1055
atgcaacttggcacgccggtgccgatgagtcacaacgtttgcgctgacaagcccgactacgcggtggagaagccagcgctggagaagtggtccattggtaagtcataaatggataaaaaaaaattggaattttttttaatttcacgcaattaatcatttttctaaacttattttgtttttattggcggggactacagaacagtcccgtggtcggaaaaaatatcggagcgggcaatccttcattttttgtttttttttttttgctctttggtcaaaaaatttttctcgtgttattttttaaagtgtcgttgccgaggagaaaaacactaattttataattttagccgtttttcgccaaaaaaaagacattgatttttgccattttgggattaaattccccccaaaaaatatgaaaaaaagacccggcagtacctttattcgtcgcaaagaaaatttttttttattataattaataattctaatttttgtaggtattcaagcgttccaacaccaaccgcccgcctcctccaccggcttcttcaaacggatgcacaaaattgtgaaaagtgtgcgcaaaaatggccccgcaggcgttgaggacggcgcagacaatgaaaacaacaacaaaaaggacaacgaagcaaatggaaaaaaggcgaaagaacaccaaaagagatgataattgggagaggacagaattatgagttatcaatcaaagcaaaacaaagaaaaactgtttttagttcaatttttttggtgatttgtgtgaattttttgcttgccaattttttcaatgcatttaatcgagccaattctggaaaaatttcgaagatgccgagaagattgtatgtcgaaatttttgatttttaatgtgccaatttaattgcgtttgaaatgcgcttacaaattagtgcttatttgttttttacggcccattaagcgcttaagctgccgattggttcaatcaaaaaatgaattgcaatttctttcaaaaaaattttcataaaatggtaaaagcaataagaaaacaaaatgttaagggggggaacaataaa

SEQ ID NO: 77207 - DNA, 102 bp, Heterodera glycines
  Genomic contig location: Contig_ID=SeqID_13337; Location=203..304; Strand=-
  SCN-specific regions: Sequence locations=1-24,46-102
atggtccttgacgacgattttattaatatgagcatggaagagcatgcagcgatgctgcaaaataaaggactgattcagcacaatgtcagctcaaagcggaag

SEQ ID NO: 77208 - DNA, 1166 bp, Heterodera glycines
  Genomic contig location: Contig_ID=SeqID_13339; Location=2..1167; Strand=+
  SCN-specific regions: Sequence locations=1-97,166-201,223-297,324 -344,366-368,411-505,537-607,644-730,752-1079,1101-1166
atggcgtacactgcaaacgtcaacactgctaatttccatggcacacttccgaagaacaacacgcaccattcattggccacaaaattggtgaaaaaacatttttatttaaatctaatttattcatatacttttaattcattattttgaaattaaataattaaaaatcaattttgacttctacttttactcttctttcaaatttcagaacatttctcattttttgactgatcatttaccccactaaaatctgataagcatgcctttcaaaatgattttctattaacttttctattaaacataaagtttaattaattaattgttaataagttttcactatcaataattggattaacttatatttcatacagaaatataaaaattttttaaactcaaattattcaaaaaattttgctttggacagccaacaattcgctcttcccaaccatttgaaaaaatttcaaaaaaaaaacacagaattttaagatgttttgctgcaaaaatgcactttaaaaaattttaaattttaaaattattttccattcggggaaaggaaacaatttcgtaaaagacaatatttgggaaaaataaaaaatgaattttttgtgccaattaaataaatataaaaaatatatatataataattcctttccacttgccatttcagctcaattgccttccatcggtcgctattcctttgccatcaccggatacgacctcaaccaaccaacgaaaacaacaaaagcaacaacaaccggggttagtttctcacaaaatttgttcccttgagctaaattaattgcaatttttcaatttcctcagcctcaatggcctgctgcgcactgcacaagttggacgcggcacaccagtgtctgagcatgatcaactacgttgttcgatggcactgaacgacggcacagaaaacgaaattggttggcaaaaaagcacttacacacaaacaaacacattgttaccctttttccatgctcataattaaacaaacatgcttttacataaattgctgcacccaaatcaacggcttttgataaattacattactgcaccaaatatacacttacacatttttaaattatgctgatttttaatttactctaaacaatgaaacatttctaaaatatggcattttcagacggttaaaaaagttataa

SEQ ID NO: 77209 - DNA, 1287 bp, Heterodera glycines
  Genomic contig location: Contig_ID=SeqID_13340; Location=539..1825; Strand=-
  SCN-specific regions: Sequence locations=1-8,212-231,472-479,541 -559,595-607,634-825,847-1287
atgaatttgaaaagaaaaagaaaaagagaaaatgaaattgaaaaggaaaaggaaaaggaaattgaaaatgaaattgaaaggaaaaggaaaaagaaaatgaataggaaaaggaaaatggaattgaaattgatattgtaaaggaaaaggaaaatgaatttgaaaagaaaaagaaaaagagaaaatgaaattgaaaaggaaaaggaaaaggaaattgaaaatgaaattgaaaggaaaaggaaaaagaaaatgaataggaaaaggaaaatgaaattgaaattgatattgtaaaggaaaaggaaaatgaatttgaaaagaaaaagaaaaagagaaaatgaaatggaaaaggaaaaggtaattgaaaatgagaggaaaaggaaaataaaactgaaaatgaaaatgaaattgaaaaggattagagaaaaaggaaaagtgaaaatggactggaaaaggaaaaggaaaatgaaaatgaaattgaaattgaaaggaaaaggaaaagggaaagagaaagggaaagggagagggagaggggaagaaaagggaatgggaacagaatttttttaaaagaaatatggaagagaaatgaagaaaaagaaatatttgctctacagaaggggaaggggggaagggtttggatgtccgactttcggctcaattgaaagtcggaacacgggccaggaaacccgggcgctgaacaattcatattatctaattactaatttttgcaattgttttttttaaaactgcacttttttgtttgcttttgttaaactaaaattttttttcttgcatgcgctttttgccataaaatttctattttttctattaattcaacatgtctctttttaagtgaattgttcagacccgggagcgcaaggggcctggtaaatccagacccgagcgcttggggcctgggaaaccgtaagccgcgtagtggcagaaactaaaccacaggtgcaatacggttgttccacggtggggggcaccaccgtagcagaacgggacaccgggcccgtggttgcccaagctacactggcacatccctaccaggctgttccacaaagcgctggacgtgggaagtgttgtccagctgagttcaaccagctcggaagccaattggtgacccgcggccccagcttggtaggtaatccagtggtgcccgagcacccacatgtcgcggggccaatggacaatacaaacgaaaaagacattaagacaaaatctgtgtgattttgacgtggacaaaaaaaagtgaaagtactacaaatacaaattcgcgcgcgcaataaa

SEQ ID NO: 77210 - DNA, 883 bp, Heterodera glycines
  Genomic contig location: Contig_ID=SeqID_13341; Location=242..1124; Strand=-
  SCN-specific regions: Sequence locations=1-29,231-267,442-461,640 -653,842-883
  Gene Ontology: Biological process=N-linked glycosylation
atgaataggaaaagagaaaatgaaattgaaaaggaaaaggaaattgaaaatgaaattgaaaggaaaaggaaaagagaaaatgaaattgaaaaggaaaaggaaaaggaaattgaaaatgaaattgaaaggaaaaggaaaaagaaaatgaataggaaaaggaaaatgaaattgaaattgatattgtaaaggaaaaggaaaatgaatttgaaaagaaaaagaaaaagagaaaatgaaatggaaaaggaaaaggtaattgaaaatgagaggaaaaggaaaataaaactgaaaatgaaaatgaaattgaaaaggattagagaaaaaggaaaagtgaaaatgaactggaaaaagaaaaggaaaatgaaaatgaaattgaaattgaaaggaaaaggaaaaggaaaatgtaaatgaaatttaaaagaaaaaggaaaagagaaaatgaaatggaaaagggaaatgaaattgaaaggaaaaggaaaagtaaaaagaaaatgaataggaaaaggaaaatgaaaatgaaaatgaaattgaaaaggaaaaggaaaagagaaaatgaaatggaaaaggaaaaggaaaaggaaaatgaaaatgaaattgaaaggaaaaggaaaagagaaaatgaaatggaaaaggaaaaggaaaatgaaaatggaattgaaaggaaaaggaaaatgtaatttaaaatgaaaatgaaaatgaaattgaaaaggaaatgaaaaagaaaatgaataggaaaaggaaaatgaaaatgaaattgaaaatgaaaatgaaattgaaaagaaaaaggaaaagagaaaatgaaattgaaaggaaaaggaaaaagaaaatgaataggaaaaggaaaatgaaattgaaattgatattgtaaaggaaaagggaaattaaa

SEQ ID NO: 77211 - DNA, 1467 bp, Heterodera glycines
  misc_feature (202)..(202): n is a, c, g, or t
  Genomic contig location: Contig_ID=SeqID_13342; Location=23..1489; Strand=-
  SCN-specific regions: Sequence locations=1-107,132-384,406-1467
atggctccaccaaagcgcaaacagaaatttcacgctgattatgagcgcgaatttcaggccataaaaaggagcaaaaagggcgatgaatatgcgtattgtgtgccgtgcagttttgatattaatttggaatcgatgggaaaggcagcaattccggtacaccaaagatcggaaaaacacaaacagaatttgcgagctatgtaanccagccaagcaatccaatctttcatgccgagtgcgtccacagcatctgaagaagaccgacataatgctgcggctgagggttttattgattccaaaaattgtgtgtaatggaataattgtttgaggtgtatggcgtatcatctctgtaggcacgcacaatcattcaagtcatcggattgtgtatcctctgacggattgttcaggactatgttttcagattcagcagttgcaaaaaagttcggatgcgcacaaaaaaaggcatcgaaaataataactggtaactttagtaaattcaatgtggtttttgtatccctttttaaaggcgttctcgcaccttattctgtccaaaatatgctaaatgaactcggtgatcaattctttttcattgcgctggacagttccaatcacaaaacaacaaagctttttcctattgtcattcgctatttttgtgccaaaaaaggaatacaagttcgtttgcttgacctgcaagcactcccaggagaaacgtctgaagaggtgaatagcgattgtatcattttttgacttgttttccaatttaaggtttaccaatggatcataaaaatgctgcaaaaacatggcctgaaattcgaacgaattgttgctttttgtgccgacaatacagctgcaaattttggctctgctgagcatcgcggagaaaacaatgttttttacaaattgaagacacacaaaaataatctgatacccgttgggtgtccggctcatttgctacataacgcagagaagcgaggagccgacaatttgccgatcgacattgagtccattgtcttcaaactgacgagtcatttcaagaattcaacaagagagttgaacaactgcagcacatttgcgatgattttgaggtacataaccaataattagaaagttatctgcctgtgacattacttttttttgttttaggctaattatctcacacttactgcgcatggtccgactcgatggacaactctttctaaaattgtcgacaaaattgtccatttctgggaaattttggagaattttttcagcggagatggcccattggttctgcgaaattttttcaacgcaaaaattgcaaaagtagttcttcattttttgagccatattttgccaatttttaattcaacaatcgatgctttacaggttaattgaaatattgaagaaaatagttttttttacttttttagaggtcaaatgccatactccctgaattgctataagaaatggaaagattcaagtcaaaaataa

SEQ ID NO: 77212 - DNA, 2705 bp, Heterodera glycines
  Genomic contig location: Contig_ID=SeqID_13345; Location=752..3456; Strand=+
  SCN-specific regions: Sequence locations=1-137,159-382,407-481,503 -953,975-1042,1070-1493,1515-1534,1556-1966,1988-2172,2194-2349,2371 -2705
  Gene Ontology: Mol. function=glyoxylate reductase (NADP) activity; Biological process=metabolism
atggcggcgtcgacagttgcgcttgggaaggtaagaatggtcaatcatcgctggggacggaagttgaacagctttttggcaggtcgaaatcgcaaaagtgaacggcaatcggccattccgtccgcttggggcgcagactccgcggggcgtccgtcgactgatccgctggcggtgctcgacggtggcggactgttgccattgggcggagtgtcggaggaggacggctcacacaaaggcaccggaattggtcggtggagattagcatcattgtgccaatcagcagaataaagggcattccaaatttagcgatgatgggcgaacttttttgcggtcttttgggaggcgcaagttttggcaaaaacgtgcgatcgtggcgagaagtgcaaaaggcagccaacctggtaaatgccgactttgcttgaacagtcgcttgtcggacaaattgccaaatccaatggcattattgtcaatattttgtcccccagggccaatgcttcgtggccattgaccccgaatgctttgctccaacatttgtggacaatttgcagttgttcctggaccaaacgcgtgggcttaagccggtgatcactgctcttcctccatggcattcgatcgcctcccttccctccttttagcgcgacccctccaaatcggtgttagtgcccggtgaccccgaaagaatgaacagcgaacggagcgcaaaggctggcggagttatttactcagaaggacaaattcgggatttggtcagtcggaggagcacttaacggcaaattatcacttttcaaattaaggagaaattggcaaaaaagcaaaacgttggcatgttcccttacaaggcaaatttgtagcagaacaaaaaaactgttttctttttgttccaaagcgatgactttcaattgaattggcattcatttccattattgaacaattaattcgttcccatttgctgctgctgataaagaaaaaagaatgacaaatatttgcattaaatgcagcaaaagtaacggagagaagagatgagaagactaatgggtgaacagaaaagggaaaatgggaaaaaagggaacggaccaccggcggcacttttaaacgcattcacaattaatttatgaaccgcggcaagggatcggcctattttttttgtttacagttttaacatttattaataatcattgaacagtcagtgtttaccaatcacagtcaatcattcctttcccctctctccgtccttttgccgatgagtgattgcccctctgctgtccctccccccgtctcttctctctgtcccccttttcctccgtctcttcccctcgtcctcgtcacagaaccgacctttgaagtgagcagaattgaacaacagtgagtcattctgctggagttcttttaaatttccattgtaaataaaaaaaataaaagtgcgcgtgtcctccaattccgtcccaaaaacgatgggtttttctcggaagatgaacagcaaaaatgggtcaaagaacatattggagaggctgaggtgagaaaaaaaagattttcgaaaaaggtttgtgaaaattaatttcggttgagataatttacacgatgggaccaataaaagtggacgcatcgcttttggtagttgccaaagcgttaaaagcagtggtgggcatttttggccactatttgttggcccttaattaagacaattagtcaaattttccgaaggtgaccatttctgcgggccatgaaaacatcgacaccgtggaatgtgccagaaggtggtcataatcacttacgctcaactccccacctctttacaaattaggggcatccgaatgggctttggcggtgccattctcactgaagcaactgccgaaacggcgatggcacttttacttacggtttcacgccgccttgtcgaagcagtacaaatagccaaagagttgggggagcggagttaaagtgcgggaaaccaccaaatgttaagaggaaaatggccgaacaattggtcaccaaagttttgtgttgggaaagcattggaagggtcgacggttggtatttttggaatggggcgcattggacgaagcattgccgataaactaagcgcatttcgcccgtttgaaatcatttatcacaaccgtaaagccaattctgaatatggtcggattgatggaagattaaacgattttgctaattaaatgaattatgttaattaatcagagggtcgcttccgttatgtgccatttgaagaactcatcgaaagaagcgactttttgattctgtcggcgagtgtcaatgatcagacgaagggactgttcgacaaagaaaagttcgaacgaatgaaatcggacgcaattttggtgaatattggcaggtggggaaagaaaaaggcggccaaaattggacggggaattcgactcgcccatttaagggggtgtttggtccgaacagacgacctttacgaggcactgaacgaccgcaagttgggcggcgccgcgttggacgtcactgagccggagccattgccagcggaacatccgctcttctcactgcccaactgcggtgccaagaatgaattagaaacgatgaattgcctgtctttcttcagtaataacccctcacattggttccgccaacggcgtggcccgaaaacggatgatggaaatgggacaggcgaatgtaatcgccgcgctgaagggcgaagaaatgccatcgccaattcgaattga

SEQ ID NO: 77213 - DNA, 284 bp, Heterodera glycines
  Genomic contig location: Contig_ID=SeqID_13345; Location=3718..4001; Strand=+
  SCN-specific regions: Sequence locations=1-284
atgggaaaagttagcaaaacaaaatccgcaaagaaatccgccggaggcagcggaaataaaacggtgatttgggcggtggaagacattgtggacggaccgaaatacgaaacaattgggacgaagagacagaaactctacaaagtgcgatgggggtcagaagagcacaaattgtgtgaggaaatgcgaacactttgttaagagagacgtacgaattggccagcaacattcccccgggactcatcgatttgtacgaaaagcgggaaaaggtcattaccaacccatag

SEQ ID NO: 77214 - DNA, 689 bp, Heterodera glycines
  Genomic contig location: Contig_ID=SeqID_13347; Location=6..694; Strand=-
  SCN-specific regions: Sequence locations=1-552,575-689
atgaaaatgatcaaaattttaaattttcctcaaagtgatcgaaatgatttatttggtctgattcaattggcaatgatcagaacaatgagcaatggtgctacgtcatttcgcgacaagtgcaaaaagggcactacgcgacagtgcactaattgggcacttcgcgaaaaatgcattaagtgtagcacttcacgacagagcagaaatgatgtaggaagggggtgctataggacgactggagaattatgaaatctaaactcgatttcggacaaatgataacaaaaatatttattattacgatattttagttgttatatatactaaatattttatgaacgatctatccaaggaatatcataactcggaaggatctcctgattccgtgagcctcgatggatgaacaaaaatacacgtagatgaatgaagaaactgacgaacaagatgatgatgaccgcgaaacaaatatatctccgcctacaaaggacaactgaatgcttataaatattgaatttacgagactataaaaactcaaataatatgttattatacgatgttaatcatctaagtttaaaacagaactagaaatgtgccaaatgttctggaatacatgaatatacgcaagacaatttaatcaaaatctgcaaatgtttgagtgaagagcaaattctataaaaaaaaaaaccgacaataaa

SEQ ID NO: 77215 - DNA, 1946 bp, Heterodera glycines
  misc_feature (1)..(1): n is a, c, g, or t
  Genomic contig location: Contig_ID=SeqID_13348; Location=373..2318; Strand=-
  SCN-specific regions: Sequence locations=1-78,114-404,426-1214,1237 -1401,1423-1946
  Gene Ontology: Mol. function=ATPase activity
nttttacttgaacaaaaaaaaacaacacaaattttgaatatcagaaagagcaaatattaagcctcgtgtttttgagtcaattattgtaaaataaaatacaataatttttttttggcagttcagtacattttttagctaaaagtgatcgaacatttcgaccgattacttcttgaaattgttgctcacagtgaaaaagggacagtttttccttcagtgaaaaccatcggcggatttttttcgcgacttttcgcggataaaaatttgaaaaggcaacagcaaatggacgcaccgatgggcatttatttacatggggccgtgggtaagtgaactgatttataattaattgttcattttatgttttttaatttttcgttttttccggtggcggtaaaacaatgctaatggatttgttctttgagtcggttcaaatacaaaggcgggagagaatccattttcacgagtttatgcagcaatttcacaaaggtccgttcttcctaatggccaaatccgtcgaatatttctctctttttcagatttgcatcgtctgaaaatctcttcggctgtcccttcggctgatttggtcccaaaaattgccgaggcgataatcggtcgggcggtgcttttctgtttcgacgagttccaagtggtggacatcgccgatggtagccaaaaatgaattggttggactgaccaccttttccattttaacaataagcccttttgtctgtccgttctttcacacttttcctatcttttttttgtgtccaatttcaacatttttcccttttttcagcaatgattctaaaacgattgttcaccgaacttttctcccgaggattggttttggtggcgtacgaatgccctttttcactcaaaaacaattcaaaatatttgaaggacttcgaatcgaccgcccgtcgatctgtacaaaaatgggctccaaaggcatcaatttgtgccattcattcgtttgctggaacaaaagtgccgtgtgatttgcctcgattcgggcattgactacagaaaagtgaacgtgttgaaagcattttgccaataaaagtgccttttaagcaaatttctgacaaaatggcagaagactctttttttgttggcagtgggcctgaaattgatgccaaaatggacaattcctttaaacttttgattttgcatgagaacgacggtgagtgccggggaattaatgtgccaacaaatagagcaaataataacaataatattggattgttgaacaaatgttcagttgtcggtccaaaaacgctcaacattttgggacggaccctcaaaattgagcgatgttgcggaagagtcgcggatgttcactttgacgacgtaccatcaaaacgattaatcaattactatagcaattgtacggctaattgtaagtgccaatgtttttagctttgcaaaaagccattgagtgccaacgattacttggccatttcgagcgttttccacacggttctcatccgtcgaattccctttttcacccgtgcaaaattatcagaagcgcgtcgtttcatcactctaatcgacactttttacgaccaaaaggtgaaagaagaaacaaaagttttaatttctgtcgttcgaaggtccgtgtgatttgctcggccgacgccgaaccggacaaactcttccaatttgaggaagaggccgaattgagcgacacgcagcgaatgctaatggacgacttgagcatgtgcgacggagaggtggcactttctgttggccatcgcttaacatttctcaaaatgacattttaatgctgccgtattgcattcggtcttaaggaatccgcgactgccaatgtgttcagtggttccgaagaaatgttcgctttcgcgcggacggtgtcgcggatggcggagatgcgcaccgaaacgtttcagaaacaccgacgaccctcctgaagaaaactttcattgctg

SEQ ID NO: 77216 - DNA, 539 bp, Heterodera glycines
  Genomic contig location: Contig_ID=SeqID_13349; Location=336..874; Strand=-
  SCN-specific regions: Sequence locations=1-167,189-278,300-466,488-539
atggatttgctgtcccgtgcaaatgccctcgacgttctgaatcttactgacaatgtgcagaaaaagcggtttgtcgttgaggacagtgccggtcaatgcgccttttatgtgtgcaatgaatcaaaatcagtccaatgccaatgccattcaaacggtggcatttgttaatgtgtccgtttaaaataaactttttacagatcaaggctttcatctctgtgagcacattcttgccattgtattaaaagacaattgtttcgcgaggaaagtcagcgaaataatcagccaaaacagaggacggacggcgaattcggcgacgatggtcaacggactccaattggacaggtccgaccggacgaaccccccttaaaggtcgaacaaaacgcaatccgtcaccttttagttcccccgtcgttgagattatttgctgctcctccaatgggtcaaatacctaattgacttgcagacattctgcattatttatatcatcctatctttttgtttattattttatcgattttgtttttaattttcttaataaa

SEQ ID NO: 77217 - DNA, 606 bp, Heterodera glycines
  Genomic contig location: Contig_ID=SeqID_13351; Location=195..800; Strand=-
  SCN-specific regions: Sequence locations=1-104,133-569,592-606
atgcaagggggccaggctatacggtaattagaatttttagcatttaaaaaaaattttcagccaatttttgtcgttttgccttttccattattggtttgtttatctaattaaaatattttcaataaaattttacctctcaaaaaaataaaatttttacaacaacagtatcgaccggcgttctgaccaacgcggaagtgattagtgtgtttcttttacactcaattaaggacataaatttgccggaaaatcattacaaaatgccattctctgccgctccatccggcaacacaaataataataatttatccggccgttgttggatacgcagcgggacaatcatttttacaaatgacaaattaagtgaattttggaaaagcgtggaaacaagagattataattactttagagggtaatagttccgattagggttcagccccgagccctcggggcaaaatgtcaggggccggggacctcgggggacgacatgtcgggtgtcggggcggggaggagctcaattgtcgggggtcggggaccccgatcgggtagtgatcaactaaaatttttaacgaaaaatccaatttttctttttaaatgcacgtaaataaa

SEQ ID NO: 77218 - DNA, 782 bp, Heterodera glycines
  Genomic contig location: Contig_ID=SeqID_13351; Location=1102..1883; Strand=+
  SCN-specific regions: Sequence locations=1-263,297-782
atgcagagtctcggaattctaagaaattacccccattctttaatttttgaggggtcgatggacgaaaaagaaattgccgttgacgaactgaagtgtccatatgcattgggaccagcaggactggcgactggccgtgatcacggatcacggaaatcacgagatttttggggtgccgtgatcacggctcacggatttccgtgattgcgaattcaatcacggccagccctgattgggactctttttcccagtgctcttatggcgtcggtttcaaaaaatttttatttaaaatcttttatgggtaattttgggtgcaattttagtgatttaaatcggttaaaaacagattctttgaattttccgcttagaggtcattagagattgattacaactaattttaggcggttttttaacgggcccacttaatctaaagcctttaatttttacgataattttttttaaacttggaatttttataatttttgagaattgagttttagcattcatagtggaatatgaagctttttttaaggctccaatgagaaggtgggggggggggggtgaattttgtgaacttttgtgttcctaccgatatctttaaatatatgtatttgtattatgttattacagcatgccaaattgcaatttaatcatgagtttctaattgatcacgttgcaaaatttggcacaaaatctgttgatcaatttccaaaaattcatctgattgcagcaatgataacgcattttggtcaatgtaatcaaaacagcgatcagcgaacgcctta

SEQ ID NO: 77219 - DNA, 909 bp, Heterodera glycines
  Genomic contig location: Contig_ID=SeqID_13353; Location=182..1090; Strand=+
  SCN-specific regions: Sequence locations=1-694,756-909
aaggtcactcggccgacggcgaaagtgcgaaaaatgggaacgaattgcaaaagaatgtgaaaaatttgagataaatgtatgctatctaaaaaaagctgaagaaattcaatttgatgatggacaaactctaaaatttggttgcaaatgggacattgaagcacagaaatgcgggccgaatgatgaaacggagaaagcattgaaaggggaagagaaggaaaagccgaggaatttgttggcatggcttatacaatgatttgatcgttgattgatttaatcattgatcatctgattagtgttggtgattaaaaagatttgttgctgattttgcattaattttcaaatgtattctttggggtagggatttgttaattagattctgacgaaaaatggcaaaaaaagagtgaaaattgtgattaatttttttttggtaaaattaattataaaacgtttttcaactttttttttgcaaagaaaaagcgattttttcctttgtttcatttttttcaacggaacttattgaatttaactttagaaacctgtaaaacaaatttggctttttggccaaatatttgaacatttttttgcaagttacattcttaggtgattattttttcctttttatattatcaaaaaatagtgatgtccaaataattattcctaatgatgcatagataatgacgttaaaatgaaaaagttatttatgaaaattagaaaatgtttaaaaatagttttttaaaaaaataattgtaaattttgaatgtttttttgaatgctcatttgcaaggacatccttggaaaaaaggactgtttcaaatttccaatagacgaggccctaatccaaggacgtccttggcatccaaggacgaatagcagccctgacctatcacaatttgcactataatatattca

SEQ ID NO: 77220 - DNA, 682 bp, Heterodera glycines
  Genomic contig location: Contig_ID=SeqID_13354; Location=8..689; Strand=+
  SCN-specific regions: Sequence locations=1-128,151-157,179-230,264 -439,462-582,607-682
atgttcaccaatttcccattgcttttctccctcaccttggtttttctgctctctttgaccctgcaattccctcttaaaatgttaggaatgtttgctaattacaatgctcagaaaaatgacggtaatactttaatttataataaaataattgcttttgtgtttttctcatttcttttttgagtaaaataacaaaaactcggccgaaaggccaattcagccaaggatgacggaaaataaaaattaaaattctacatatttaaattgaaaaactagttatatctcaattaaagaaaaacaaaaataaaaatgagtcgtccgtcctcagccgagttgtccttgcctttgctgatttgtcctgaccaggggtgggcgaagctcggcttaccactcgaagccgaaggcgaagcccaatttttattcgaaggcgaagtccgaagtcgaagcccaaaaaacccgaagttttcgaagccgaagttttttcaattttttttaattccaaaaagttttaattttggttcaatataaattataacggaattgttaaatttgcagtgaatttcctttcgaaaaagggaataattttgaaaaattagaagaaaacaaatacttggatgggaagtgatccaaagcaaaaataaggaatagaaccaagagcgtaaccgacaaccatatatttgaacaa

SEQ ID NO: 77221 - DNA, 726 bp, Heterodera glycines
  Genomic contig location: Contig_ID=SeqID_13356; Location=523..1248; Strand=+
  SCN-specific regions: Sequence locations=1-353,380-385,439-463,490-726
  Gene Ontology: Mol. function=zinc ion binding; Cellular component =nucleus; Biological process=regulation of transcription, DNA -dependent
atggtcgacttttcgattaattattgcgtcgatttgaaaagtgctgacggcacagtccgtggcggttcgttggaccgactgatgtcaatggcacagaacggtagctacaacggcacaacgatggaatttgttgacaaaaagctctcgggacaatccgatgtcacaatggtaccagacgaagaagaggcgaagaacgaggacacaatggatggtggtcagagagcgggctgttcaaattaccaaatcaaatttagaagtggccactaccaatttcgtttatcgtccgtcctgccctccggcgcttcgaccggttgaatttgacacactttcggaaggcgacaaagccgaatgttacgaggaggaggaagatggaaaccagcaggcggaagaggagggggaagaagaggaagaagaagaagaggaggaggaagaagaggatgatgatgagtatgaatatgtgtatgaggaggaagagcagcagcagcaagacgagaacggagacggacgacagccgggggcagtggcggcaacgatcaaagaggacgaagacggcgacatcaaagtggtcatggaactcccgcccaagaagcggaccagcattcgtcgcaagaagttttccgcgtcgcgttcgcctgcgcccgaacgcgtggacggagcacaagcggagttggacgcagaggtgcgaatttgacaattgatggtcagcaagcattttggatatgcaaa

SEQ ID NO: 77222 - DNA, 579 bp, Heterodera glycines
  Genomic contig location: Contig_ID=SeqID_1988; Location=409..987; Strand=+
  SCN-specific regions: Sequence locations=1-123,173-239,278-299,339 -378,444-579
gcacttccgtttgtgttgatcgacaccgattgtgctctttctgggcttcgcttaaggaatgcgagacaaatgcagtttggatggtggttaactgtgctcggtcttgcaaaatgtgtaaaggtgaaaattaaaaataaattattattattattatttatttaaaattaaaattgcaggtaaagctgcggttcgggctgcgaatggtgaatttgaggaaacggattgtaagttttggttgcttaaataattaaaaatttaacatgattttaataaaaatccgaatcgctttgagaccatcgaattattttaatttaaaaaaaaatttttttttaattaaagcattaattttccaggcacatttgtctcaacgcatgaaggtaaatttaaaaaaaaacatttaaaaattaaaatataaaattctaataaaaaatatataattttaagacatttccattcgtcgaacgatttcaacaaccgatgttcgcatcagcaacggcgcgtttggttgtgtgccaacacagacggcgacaaactgcaagaaaaatttgtgctaccatttgaaattccgcagctttgacg

SEQ ID NO: 77223 - DNA, 1322 bp, Heterodera glycines
  Genomic contig location: Contig_ID=SeqID_1989; Location=186..1507; Strand=+
  SCN-specific regions: Sequence locations=1-36,58-157,179-188,236 -270,316-337,361-397,452-626,656-694,716-740,821-1272,1294-1322
atgctgagttcagcctcggaaattccggtgcgttggaatgcgttgttcatgcaatggggccaattcattgcgcatgacgtggccaagacgacaatgcttaacaaccaagtaaaaacatcattatcatttcaatattgactatttcagctcgagaattaacatcaaaattacatacaaaaataattttgaaccaaaaattattttaaaaagtttaaattcctataaaattacatatgtatgaaaaaaacccttttgtccaattaagatagaattttattgattttttaataaatatgttgttgttttttaagatttgcgccagttgtaagccggaaggtggtcaatgtttttcagtgatgttgagtcgaatggacccaacgtaacttttttttttagctaaattatttttttttaattatttaaaaaaaaattataaaattttgttaatttagttttggacgatttttgtgcttaccagtcgccagatcagcaccggtaggtttttttttgaatttgcattagcttttttatgcattttcttattcaaggtttgtggaacgggcagcgatcaaacgcgagaacagtacaatgagaacaccgcattcattgacggttcaatggtatagttttaaacaaatttaatttttatttatttgatttccaattaataaatcccaaaaatgatgaaaatttcaaacccattttatggcaaaattcggcggtgctgctgatttgtagagaataaatagaatatagaatattattttaataattttgtaaataattttaaacaaaaatttaattaaattttaaattatttccagatttacgggagcagcacgcgtgatcaattcctgttccgtcaaggaggcttcatgaagacgaacattctgcgcggtcgaattttcccgcccgttgacaacaatcaaaatttgattgcgggcgatgaccgagcaaacatttttgtcggcctcgccgcactgcacacactgtttgttcgagaacacaacaggtgaattgatgtgaaatcactgaccttggtagagttggacaaaatcattcaaagtttatagatttttgtaccatttgaattggtcactgattaaacagataagcgtttgttattaaacaccataaaattgtgtattcaattcggaatatcaaatcagaacgctgacccgtagcatgtgatccagggacggtcggtctattgacgaaccttttttgctagccaaccgacaaaactttttcccgcactatttattttttttccattttcccttaaaatttggagccaccgggtcttggagggtggtactaaa

SEQ ID NO: 77224 - DNA, 1955 bp, Heterodera glycines
  misc_feature (6)..(6): n is a, c, g, or t
  Genomic contig location: Contig_ID=SeqID_1990; Location=30..1984; Strand=+
  SCN-specific regions: Sequence locations=1-98,143-315,362-439,463 -705,729-732,771-994,1016-1183,1222-1241,1278-1639,1703-1955
  Gene Ontology: Mol. function=peroxidase activity; Cellular component =integral to membrane; Biological process=thyroid hormone generation
gaatantctgccacagttgtgttgggcaaaaaattcaatgaactaattgggccatacagaggatacaacccaaaggttgacccttctgttttggtgagttattttttaaataaaattaaattttatgatatttttaaaatatcatttttgtagaatgaattcactggctgcgcattccgatttggacatggcatgatacaggtcagaaaatttttagtgagctgataaattattaagaaaagaaattcgtaaaatttgaactttaaatacaaaaatttatgaaaaacaattgttattgtttgtgcttaaagttacaataattaattaattgcaaatacaaaaattaatttaattaatttatgttaaggaattttatccattcttcaatgagaaatttcaacaaattggtatgtttattgtttatttgtatgtcgatcagaaaaaataaataaatataattaaggtggaatcccattcaacgatggaatgttcaggagtattcatataatcaacaacggcattgatccattgatcaggggtaaactgattagttggcgggcactgatcagctttagcacaatcaacattttgaaaattttaaggccttatgacactgccagcaaaaatgccgcaacgcttaacaattgcagtaacggagaaaatttttgggaattccgatcttgggtgagtttttttcatgttgcggcataaaattcaatttaaaaatttcggatttattttaacaattataataaatttatttattttttcatcaatctttgcttaagttcaatcaacattcaacgtggtcgtgaccatggcatccctggttacactgcttggcgcgaagtgtgcaatttgccgccagtgcgcgactttaacgacttgaacagcacaattacgaatccggttgtgcgcgaaaatttgcgtattctttacaaaagagttggtgcgtgagtgttattaacatttttagggggtgggggattttatgtattttataaatttttacctagagaacggtgtacaataccaccacaccctgcaatttataaatttgggaatctgaaaatcacaaaacaaaaaaaaattcaaaaaatttgttaggaaataaaaactttcgggcttgtccttatcttgaaccaaaatgttcaaaaccctataagctccttagctttgcacgaattaaattaaaaattaaatattaaaactaaattttttctctaattaactatctatccaaattaaacaattatttttaactattattaaaaaatctttaaagaactcattgacatgtatgttggaagcattttggaagaccccgttgaaggaggaatgattggtgagcaatttttaaagaatattttgctcagaatttccaaaatgatttaggtccaacgcttgcctgcattattggaaagcaattcagggcactcagagatggagatcggtaaaaatttcagcgttttccaacttcaaaaaacaaaataaaaaaatccagatttttctatgaaaaccgaaaagtgatgtccgaggagcacatacgacaaataaaacgtgcctcattagcacgaatgctgtgtgattctggggacggaatgaaattggtgcttagttttattcagttggaaatttcaattatttttaaagatttaaaatttaatttaattattattcaaaaattattattaaatttataggattgtttcgagacaaataacaaaaaaatactaatttaaaaaaccaattcttatttgatcattgcttttgaatttaaaaatgacaaatgatctacagtatgatcattattaagtattgaaactttaaaattcaaattttaggtgccaaagcacgcattcaatcaaatccaaggacagaatgagctgttcacatgtgaccaaatagactcaccaaattacttcaaatggaaagacacctcatttttctcataa

SEQ ID NO: 77225 - DNA, 334 bp, Heterodera glycines
  Genomic contig location: Contig_ID=SeqID_1990; Location=2264..2597; Strand=-
  SCN-specific regions: Sequence locations=1-10,52-68,97-156,179-334
gtgcagagggtgacgatgatgatgaagaaggcgatgatgatgacgaagatgccgagggggatgagggcggtgaagaggaggaagaggaagaatgagcttttcgcatctgttttaagctaactcttctggcgacaatgttttgtttgtttgatttcttggccaattccccccttttgccctgctgactgagcaacatggttcaatcctctggccaaactgatcggatcacacacaaacacacacacaacctttttggccaacatcaccccatcccctcgcccatgttatttatattatgaatgtgtcgtggttggttgaacctctgcgcaataaa

SEQ ID NO: 77226 - DNA, 234 bp, Heterodera glycines
  Genomic contig location: Contig_ID=SeqID_1991; Location=1..234; Strand=+
  SCN-specific regions: Sequence locations=1-65,87-234
gaccccctcatgtctctctgttccttcctctctcacgtgtgcccccccccccactattttgtccgtcttcgccttctctctgtgttatgctgctctctctctctcttttctttatgattgcccgtgccgttgttcgtctccatggattgtcgtgccccttttgtgcgtgttcgtccgtcgtcgtcgtcgtctctgccgtggtgtcccacaaatcgccgtcatatccttgggcca

SEQ ID NO: 77227 - DNA, 607 bp, Heterodera glycines
  Genomic contig location: Contig_ID=SeqID_1992; Location=357..963; Strand=+
  SCN-specific regions: Sequence locations=1-188,220-541,563-607
atgcatgttagaagattcaaacagaatttagaacacactttttaagtcattttatgaaaccatttagagtcaacaaaaaaagccatttgacttaaattcccagtcctatttaacaccaaacataaattgcccacccatacggtttaacaaaattgtttcttaaacataattcatcgtttcaaatggttccaggcttttccccaaaaaagttgacaaatatgtgttaccgacgggcggaggatgtttaggactgggcaatcaaatggtaatttttgtgaacaagccgggatgggattaccgttcacaatatttcaaacaaaacaattagggaataaatgattttagggactggtccaaaagttttaaaattcaccccccaggggcaaggaaatttgagttttacgtgttttattaatttggtttttgtttttagttccgttttgccgcattgtacggaattggaaaaccttatggacggaagccgatttacaaggacagtcaaaaatgcaaaaagtcaagcgtaaatgcggtagaaaaaggcgagaagaaagagcatcttttcccgatctttgccagccaagaaaaatattttgtaattttaatttaa

SEQ ID NO: 77228 - DNA, 739 bp, Heterodera glycines
  Genomic contig location: Contig_ID=SeqID_1992; Location=1049..1787; Strand=+
  SCN-specific regions: Sequence locations=1-148,190-323,410-739
atgaaactgtttgtgtacagaatttattcattcgatgtttttcatatgtaaacccacaaaagtttgcctccttttttgattaatttcaattcattttgcttaagttttgctttttcgaggatcaagcagaaatatttggaattggatgtatttattaataaacaaaaaataaataaatttaaaatttaagggcgacggttgttttcaatcttataaattctttgaaagccgaagaatggaaatacgtcaaatatttcagtttgggcatcaactttgtttaaatgtgacggcattcaaaaatgaattatttgggtaagtatttgaaaaaataaataatattattattaatatacaatatatatacaaataaataattaaatttttttattaaaattaatatataataattgcaatcatttcagaaatgatcagtcacacaaattttgtgtgcacacccgcaggggagattttgttaaaagaggttgggactcgaagaaggaacctacggagaaaggaattgatttgggatttgaatatttaaaggcgactcataagttgtcgatacaagacactttgagatgaaagtatgaaaagttaaaatgggctaagtacgaaaagctgttcgaattgcctcattaagtctgtcggcaaattcacactctttcgtctgcttgtaaattgagaaagcttgtctcgctattgagcgcatattttggttttcttttttttttattcaaaa

SEQ ID NO: 77229 - DNA, 376 bp, Heterodera glycines
  Genomic contig location: Contig_ID=SeqID_1993; Location=1948..2323; Strand=-
  SCN-specific regions: Sequence locations=1-158,181-316,355-376
atgccaagggctaatgatttggcttttgccgtgttgggatgcgattctttgtttttgtcggcacagacatcaacttttgcttggtggattgcttatttgatgcccgacgatgctaccattttgtacaattcagattttcttccgggtcagtttttttaatttaatttcgttgaattttaaaataatgagtaattctgttttaggccttcatacacgtgaccattttttgcctgaatggattccgataaaactgatcaatggctcaatgactcgcgattaaatccaaacggagtgttctcaaaaaatgcttttattgttttaatatttttgaaaaaatttatgcttttgcaaaaatggatttgaaactccgaataaa

SEQ ID NO: 77230 - DNA, 678 bp, Heterodera glycines
  Genomic contig location: Contig_ID=SeqID_1993; Location=2410..3087; Strand=-
  SCN-specific regions: Sequence locations=1-148,190-323,403-500,522 -557,585-612,634-678
atgaaactgtttgtgtacagaatttattcattcgatgtttttcatatgtaaacccacaaaagtttgccttcttttttgattaatttcaattaattttgcttaagttttgctttttcgaggatcaagcagaaatatttggaattggatgtatttattaataaacaaaaaataaataaatttaaaatttaagggcgacggttgtttccaatcttacaaattctttgaaagtcgaaggatggaaatacgtcaaatatttcagtttgggcatcaactttgtttgaatgtgacggcattcaaaaatgaattatttgggtaagtatttgaaaaaataaataatattattattaatatacaatatatatacaaataaatttttttaattaaaattaatatataataattccaatcttttagaaatgatcagtctcacaaattttgtgtgcatatccgcaggggagattttgttaaaagaggttgggactcgaagaaggaacctacggagaaaggaattgattttggatttgaatatttaaaggtgattcatatggcgaatggtcattttttaatttttaattaaaaatttaggaaaaatttgacaacatttccatttctgttgttttgcttggagaagacaaacaatttttggcgaatttatcattcaatcggcaggcaaataaa

SEQ ID NO: 77231 - DNA, 1269 bp, Heterodera glycines
  Genomic contig location: Contig_ID=SeqID_13357; Location=489..1757; Strand=-
  SCN-specific regions: Sequence locations=1-46,70-165,187-225,280 -281,303-372,409-413,437-541,634-845,867-1269
atgacggcgaccggcgacactgccgtgaacacggtacgccgtcggtgcgtcgtcgccccgcgcgcccatctcgttttgccattaattaccgcgtctccgtcggcggcatttttctatgccttggggcgttttgtttggcgcttcaatgctttaaaagcaggggacaaacacagcaaaatcatcacaacgcaacagcaacaaacagcagcaaagctcctcactgtgtttattaacaaataagtaatattttcaaaataataaatattattaacaattaatccaaaatcaatccaaaattttggcacatggaatccctctttcgaaatttattattacactaaattctcttatatttttaaaaaatgctcattcatttaaaaataatttataatcaattttcatttttaagagctcaacaaataaaatgaaccaaaaactcttcctgatcgctcttttcggcgtcatcgctctgttggcactgatcgatgccattggcctaccccaacagaaccaatgttgtcagcagcagcagtgttgccaaggcggatgcagcagcgggtgctgcggaggcggcggcggtggctgctgctgctgccaaggcggagggggcggcggacttggcggcctcggtggactcggacgccgacgtcgccgtcgcggagccaaggagctcggacaggtgaccgattttttgaaattctgcatgaattttctgaaatcgacaactgggcgacaacccgttttttgagtataacacctttcataatacatagttgtccgagttcaaacaatttattaacattagatagtcctttgttttttaattagctgcaaatttcgaaaatttttgttgtggtttcaaaaaagttataaacaattaataaggaaatatttcaacaaattaatgcattttttccaccaggtctctgccattcagcctcattacaaagccgtcgaaacgccgtgcccccaaacggcatggcaagaaaccttggaaaaggtgaggcatttttcgtcattggcactttttgggcaatcactggcatttcccatcatttcattataacttaaaacaatcttcagagcattctggcgggcgacgccatcggctcagtgagtgccatccaaagcggactgtacgcgcgctttggccaaaagttcttggtcacatgcgctgacgccaatgagacgaaagagggccaatccgtgcccaaccgtgtgcacttcagctcgtccggcgacggctactgtaacatggtcaaggagaaa

SEQ ID NO: 77232 - DNA, 1637 bp, Heterodera glycines
  Genomic contig location: Contig_ID=SeqID_13358; Location=130..1766; Strand=+
  SCN-specific regions: Sequence locations=1-391,413-537,559-588,610 -633,655-719,744-814,891-891,913-1152,1174-1204,1226-1234,1256 -1445,1467-1536,1558-1637
atgccattgctgcatgttcacctcttcaaatgcttccatcggctgcacttcttgcggctgcgacattttgccgttctgttgtccaacccgacactgctccaatcgcagctgtgcatgccgttcggatgcgaagtgaatgttggccaagcattggatgcgcgtcaacgctttttgctgcgggttggccgcgctttgttctgccgattggagtccggaggcaatttgggcgttgtagatgaagctgtactcggtgtccttctgctggaacggctgcagcagctcggcggcgtcgttgtcgcccgacgttgggccaacccgtgccgtgccaaagttggcattcgccgaagacagaaagccgccaaaactcatccggttggaatggcgtattccgctggtgccaacactgaggaaggcggtgaccagcaccaaaagtgccgcggtacgcatttcgtttcttttttgattgctgtgttgcgatcactcactaatcagtcggaatggtcggttggggaaggaatgaatctgagggaggggagattcgaatgtgctctcttctgcctccgatgcgctatttatacggcccattttcggtccgttttgcccccggcggcgtcggacagtcgccgcaagggacagaaatttgggaattgttttgctgataacagtcaaatgtacaaaaaacagctagccaaattgacaggcgattgaccccaaattgacagctgctgctgctgctttggctgactgattgtttggtgctaatttaatttccccccggcgcattccgccatcaatcatttcgcatatgccattcaattttttttacttttttataaaaatattttttggtaattattttttaatattacattttgcttttattaaatatagacaacaaagtctattatgggagaccctgtcagaagttaacgaaattttcatcctgattttgtgcaaaatccaaggactaagaccccctagggcataatcacgaaaatccaatccattcacagactttaagctggattcttgaccgattttcggtattccctttttttatacttatttcaggttcgaatgtgatggtgtaaataattgtaacaccatcgctaccgtacaatgtttttttttttgctctttttgactgtaacaattggcaaaattttaaattgagaaacaacgcaaaagtttggcattttattcgttaaatttttttttaattattgcactttttccaattccttttcaattttccgcattttctcttttagcaaacgtccaaattcgtttagcatttttttatggaaactctgctggacaaaaccattttttcggtcatcgacccgcccaatttgcgcattaatttgccgcgatggtttacggttttgaaatgtttttttttaattgtcaaaatttgcctttttcagttcccctcgcccatgcaaacctttttcttcattcttctcacttatttcctcgtctccggtggcattgtttacgatgtgatcaacgaacctccgtccatcggtcggcacatttcactgatttctcccattttacaaatttgtaattttatactttactaatcggaaattccgacttttgtcaatgaataatgaacgttttagttttatgca

SEQ ID NO: 77233 - DNA, 728 bp, Heterodera glycines
  Genomic contig location: Contig_ID=SeqID_13360; Location=515..1242; Strand=+
  SCN-specific regions: Sequence locations=1-151,265-728
atggctttaaaaagtgacggacaaatgcccaaagagacacatcgccagaggaattcggcgcgaaagggaaactgcccgatgatgccgatgcttcttctattatcacttttggcaattactgtcattttgtcggagggaaggccaaatatgtggagaggggacggagaaaggaaacagacggaaataggcagagagaaaagggaacaggaaaagcagagagacaaagaggaaaagttaacggaaaggggagaaggcaggagaaggtacagaaggcaatcactgccaacggacaatgtgttggtcagttattggcttattggcatttaaatttgagagaaaaaagcggaaaaaatcatttaatcttataaatttatttgatcattctccgtcttttcaggtgtattcttccaattcgaatgtgtccatcgccgatcggatccaagttttgtccaaagaatcgcaaattcgaattttggagcgaaatttaaacaccaccgtttggtcaaatgcgtcgcttctgcaggcaaaaaatgcttacgatattatgtcaaaccttaattttgtgatcagatgtcacaaaatggtgagcaaatttcgatgagtgcgtcgcaagcgatcgctttggtaatgaaattgggcggaggagcgcaaatggaaggcacgggggacactttacaggtggagagactaattaagggataaatgggaagaaagggactaattaagaa

SEQ ID NO: 77234 - DNA, 1039 bp, Heterodera glycines
  Genomic contig location: Contig_ID=SeqID_13360; Location=2895..3933; Strand=+
  SCN-specific regions: Sequence locations=1-35,57-365,473-761,783 -944,984-985,1007-1039
atggccgacccttccgagctgttcactttccgtcactctttcccccctccttccgtttcgccctcttccgctggtccctcctccaccgaatttgaatcgcttgtgacacataatgagtcggcgtccgcttttccttcccccgactctgaactgttcactttccccccgtctcttgtgcccgatgccgactttctcgtcggccaatttgaaactgtgccctctcagcggaccacccaaagtcttttcccattgtcagcgaccatttcggcactccaattccccgaagaaacggcagaagaacaacagcaacacattgccgaacaattcccgggcattcgacgggaaaatttgctaatttggagaccggaagaaaacgaaggaacggagggaaaggaggggggagagaaattggagacgtatttggtggatgaaaaggaggaagagggagaggaagggaagaggccgagaaggacactgaacgacgacgtcaatggaagaaagacggaagaacgaatgccgagggcggagatggaagtggacattgctgtggagggggaggaggacgtgagggcggagagactgaggagagagttgggggaaggcatcgagaggatgttggaagagtgtgaagagaagaggacgaaaacaatggaaagagaaacagatagagaagagacactacggaacgagacgaacagagaggacgaaaagataacagaaagcgacggagcgagtgcagtgagagtaacggaagtgaaattgaaatatttgggaaagatggactcaagcaagaaggaggtgatcagaatgcacttcacattggaaggggaacagaatgaattggagaagggcattcgaagaatcggacagatggacagagaaacggcggacaaaacactgaaacaccaagtgactaatgaggggagggagcaattagggggtacggataaacagtggcaaaaaataaatagcattcaaatttcggaaaaataaatgaaaatctgcgaattttttcacatacctattcaattgcaaacaa

SEQ ID NO: 77235 - DNA, 1280 bp, Heterodera glycines
  Genomic contig location: Contig_ID=SeqID_13361; Location=156..1435; Strand=+
  SCN-specific regions: Sequence locations=1-1096,1118-1280
aaaacaaaaaaatcgattttttcaagtgtccgtttggggtactcaaacaattatggggagcaaaaatccaacgcagaaattaaagtacaggctatagggaagctattcccgaaggattcggtctccccataaatctgagcgcatcggtagggggacggcccgaaaagcaaaaaaatcgattttttccgtttggggtactcaaacaattatggggagcaaaaatccaacgcagaattaaagtacaggctatggggaagctattcccgaaggattcggtctccccataaatctgggcgcatcggttcgggggacggcccgaaaagcaaaaaaaatcgattttttccgtttggggtactcaaacaattatggggagcaaaaatccaacgcagaattaaagtacaggctatggggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccggaggattcggtctccccataaatctgggcgcatcggtttggggggactgcccaaaaacaaaaaaatcgattttttcaagtgtccgtttggggtactcaaacaattatggggagcaaaaatccaacgcagaaattaaagtacaggctatagggaagctattcccgaaggattcggtctccccataaatctgagcgcatcggtagggggacggcccgaaaacaaaaaaatcgattttttccgtttggggtactcaaacaattatggggagcaaaaatccaacgcagaattaaagtacaggctatagggaagctattcccgaaggattcggtctccccataaatctgagcgcatcggtaggggggacggcccgaaaacaaaaaaatcgattttttccgtttggggtactcaaacaattatggggagcaaaaatccaacgcagaattaaagtacaggctatggggaagctattcccgaaggattcggtctccccataaatctgggcgcatcggtttggggggactgcccgaaaacaaaaaaatcgattttttcaagtgtccgtttggggtactcaaacaattatggggagcaaaaatccaacgcagaattaaagtacaggctatagggaagctattcccggaggattcggtctccccataaatctgggcgcatcggttagggggacggcccgaaaac

SEQ ID NO: 77236 - DNA, 912 bp, Heterodera glycines
  Genomic contig location: Contig_ID=SeqID_13362; Location=379..1290; Strand=-
  SCN-specific regions: Sequence locations=1-63,85-112,149-673,698-912
atggcaatgtcagcaattccaattgaacatgatgcagcatcacaatgggactgtaattttttaattgttttttgaatctattttcttccattatgaagtaaaacttgataccatttttaattcaaaaattaatatttttaatttaatagggccgctacaacacactgacggagttgtcaaagtgcacaacacaaaagataaatttgaggttggattagacgtgcaattttttgctccacaagaaattgaggtcagaatgccaaaagaaaagagaaaaattatccaattaaaaaaaaaaacaaggtcaaagtgtcgggccaagatgtgatcattcattgtctccacgaaattcgcaaaggttggtaatttctgccaatattccttaggcaattgagaaatcggcattttgaaaaagcgttcgttttggcagttttttaaattaaatcggttttccgtttccttataccgccaaatagcataaaaacattacaccacatttcttttaaagcatattagaatgacgatcaaaatccacattctgtctccattttctccattcatagagcaatgcattggttttttggtctgttttttaaaactaaatttttctatttcgattcaaaaatttagaaacgcttttttcccctccgccactaccgctgaaagaaatcaatttttgatttgttttgtcaaaatttcagatcagcacggaagtgttaagcgcgaaattcaccgtcaataccgactgccaaatgacgtcgacgcggcaacattgaaatctcatctgtccacccgtggcgtgcttacattgacagcctcgaaaaaggactaactgagaaggaaaattgagtgaatttgatgggaaattaggacggaaattttgctcatcttgtgagctgctgttgaaataaa

SEQ ID NO: 77237 - DNA, 1050 bp, Heterodera glycines
  misc_feature (23)..(23): n is a, c, g, or t
  Genomic contig location: Contig_ID=SeqID_13363; Location=360..1409; Strand=-
  SCN-specific regions: Sequence locations=1-491,534-766,794-830,852 -892,914-1008,1039-1050
atgccgtttcggttacagtatcnccttctcccatttagtggacatcaaaagcaccacaatacggtattcaccaaacatgggcacagcgaagaagatggtggtgatcaacagcagctgcaggacggcgaaattacgctacacaacgaatgctattttcgttatgccgaaacggatcaccactacgcattcttgcgttggttacaccacaaaaatgtgtcccattacacacccatttcgccgtcatatgagcaaattttgcgcagagttcaagtacagcaatttaatttgattagtggttttgccaccattttttttattaacttgtcaatagtcctcttgacaatttcgattaatgagattttgtgcagatgattttacacacacacacttttcagcccgatgacataaagaacggactacagataaccatgggaacacagcaccgacaacagccaagctgtgacatcagacatcggagaatgaaggttcagaatattaattaatttttttgtataattttaagaatttattttcaaatgttatgagagggactcattattttataagaagggtaaaaaaataaaactaaatttttgggcccattggtggcaggccagcattaagcttgggaagggcgccgaaaatccaccccacccccaaataaaaaggtaattttttgaaaaattaagcatttcaattacaaaaattttctaaaattttgaaaatttaaatcttcagagtctttcattgcaactatttgctgaccaatacttttgtttgtttgattttttaagtttaaactaaaaccctcaaaataagtcatttttggcaaaaattaatttctctctgaagcacctaattggtaaaaaatacgctgggtttcatcaatgtgttattttaaattaaacattttcagcctgttcacccaaacatgccaatcattgaccgcgccttgtgccaatacgagtacattttgaactacaagccaaatgcaagtggccaaattacaaaaaataaaataattatttatgattaataccaaataataaa

SEQ ID NO: 77238 - DNA, 1845 bp, Heterodera glycines
  misc_feature (302)..(302): n is a, c, g, or t
  misc_feature (371)..(371): n is a, c, g, or t
  misc_feature (394)..(394): n is a, c, g, or t
  Genomic contig location: Contig_ID=SeqID_13364; Location=473..2317; Strand=+
  SCN-specific regions: Sequence locations=1-54,86-433,455-635,676 -941,963-976,1004-1014,1042-1388,1411-1473,1504-1810,1834-1845
atgattggacctattcctgctgctatggcattgctgctgctcgtcttatgctcgtttttaaatagtaaaattaaaatatttttaacatttcgtaacagcgttgcctcgggttgataaaaagtttgggtcgggtttagggtttcgggaagccaaaaataccggattttttggatcgggttggcagaaaaaatcccgggtcgggctttgggtcgccaaaaagagcgggtttcggttgggttggcccgaataaagttcgggttaggtttaggggttttgggtcgccaaaaagaacttgttttgangtcgggtcggtcgaaaaaagatccgggttataagggtttcgggtcgtccaaaaaaccgggttctcgggntcgatcgtaaaaaagctcggacngcttattggggggtttggggtaacctacggtaacccttgttttatatgtatttgataaataagaattaaatttttagtggagaaacgggaccgatttcaaatgtacccccacaggcctcaattcaccagcttcatcaattttgcaccaaatgggaaccgacaatctgttgaacaacaaccaacattaacaaacacaaaattgaaaaagagcgtagtagcaaaagtggtgatttaggtatacaataatttgtaaaaattaaattttgaaattattaattttaggcaaaaacagcaaacacccgcacaaaaaagagtaagtaaaattagattaagcaatcggcaaccgaatccattgaactgttcgaatgtgttgtatcatatagcaggaatggaatcgggttccagacctttttttcaaaaaatcccggacctgtctggagtttttttttgaaagtaccccaaaggtactattagaggaaataaaattttttaggtgagattttaagtgatttttgacggaaattgacccaaaaagctttagaacaattattgctaaaaatactataaaaattcactcgctcaataatacaattttttaaaaatctaattcaaacatagttaaaagagaagaaaaaaaaagaaaaaaagaatttttaaaaaaccgaacattttcccttttttaaggttagtttttatcctttttttgattaaagcaaatccattgaacttttcgaataagttaaatgcaaacattgatagattattttgaaaagaaataaaaactaaaaaagctttttgataataccttgttttttaaggaattttaattgaaaggcttgtgcttaggtatttgctagtcatattttaatcggaacacgttctttggtttatatcaattctgtcaaaattggtcgaaagcctacctatgcagtttttcgcattcagaccgaatcaattgttgcaattcgaattttcatggatttcaaaattagaattaataaaacaattttatagatcagcaaccaaaaagcctcatagaaaacttggagttgagagtaaggtgaaagtggaacaaaaacgcaaaagcaaaaatttaagtgaaaagaaagggcgatttgggaaaatcatgtaagtggggaagacaccaataattgagcaattatgatttatttccttgtcaaggttttacgtgttcatgttgatcactataattgtgccccatgtgccgcaaaatgtgacgctcagtatgtgtacaataataaatagggctgccaattttatgtaaatacatttttttcctggattctacgtagtctaattagtaggaaaaacatcttcttttttccatttgcttataaaagttgggacttttatttacatatttttatacatatttcggacttttagtacatattttcagatttttgggaaaactgcttaacaaaaatgca

SEQ ID NO: 77239 - DNA, 1169 bp, Heterodera glycines
  misc_feature (1154)..(1154): n is a, c, g, or t
  Genomic contig location: Contig_ID=SeqID_13365; Location=733..1901; Strand=+
  SCN-specific regions: Sequence locations=1-243,265-337,359-487,509 -539,562-626,648-729,756-756,779-857,887-1169
atgatttacctagttacactctctttggcaaaccaatgtgatcatcctgtttgggtgttcagcaacgcaattcctaatgtgcaaatgccggtgcttttggaatcaaaccacggccagcactttccaattgcatcaactcaggcagcggcacgtttatgggttgaacagcataactgcaacgatgtcagaattaaattaagaaacattatacacatacataagtgtataataagcatatattaccccataattcctatattaaaggccactggggctctattttttaacctcctcaaatgtggggctttatttctgagggggggggggggagtggctctatatttccaaccctctcaaaagggggactttatttcaagggtggctttattgcaggggagatttaatgtaggaattacagtatatataactagggctgctaaaacaggcaccagaaaatcgcgaaaggcaccaaagagggcattaaaaactttcaaatacgaatgttttcaagatgttataagcaaaattcttagaaaatcaaatatttttatttaaaaaaaactactctttcggagtgcattttttaaattttgatagcaaaaaatcgattttactgctgtatctttttgaatttttggacaagaaaaatcgatgataagtccatccttaggggtgcattttgctaattttcaaacaaatttaggaccaaaattcaaaaaaaaccccgccaaaaagggcatcaaaagggggcatcaaatgtaaaaaagggggcatggaagggcataagggcacgaaaattgcaatgctaataataaacaaagaagagtcacataatatttgttcataatatgtcaatgtataaaattttaaaaaaatgttttttttagctcaccgatgatgaaaaacaaaaaaatttaatatgcaaccctgctggggccgacaaactttcactctttgaatggacctttgatggtattagccagttcattgatgtcagttatgtggacggtgccaatgtgccgatgggtgttcatgtgcccgaattcccggacaaagacatcattatcaacacgcccacgggcactacccacacagtggaacaactgtttgaagatagcaacggtcaacttgttgtgccactggaaatgatcatncacgattatgccggt

SEQ ID NO: 77240 - DNA, 507 bp, Heterodera glycines
  Genomic contig location: Contig_ID=SeqID_13366; Location=1403..1909; Strand=+
  SCN-specific regions: Sequence locations=1-507
  Gene Ontology: Mol. function=hormone activity; Cellular component =plasma membrane; Biological process=skeletal development
atgctccaaatttggccctctctcgccatccttctcctccgccttctcatccgacttggaacagttcagagccagattgacgtacaatacgacgacgtcaacagtatttatgtggacgaaattgacgacgatcggtcgatggttttggacggggaaaacactgctgagtcatcggctggcaaattgccattctcgagaatgtttcggtctcgtccatcgtcggcaccgtcgtccactcggccgaacattcttgttctgatggtggatgaccttggctacggagaccttcaaagttacggcaatcctactcaggtgtgactgcttggcaatgacttaactgtcccatctctcaaggaatggacgccggtggaccaactgatggccgagggggtccgctttaccaatgcttacgctgccgattcgatgtgttcgccgagtcgtgccggcttcatgaccggtgccccctccctcccatcctccaattcacgcctcccctcctgtccttag

SEQ ID NO: 77241 - DNA, 750 bp, Heterodera glycines
  Genomic contig location: Contig_ID=SeqID_13367; Location=415..1164; Strand=+
  SCN-specific regions: Sequence locations=1-266,288-389,412-491,513 -559,581-586,608-695,717-750
atgtaccctttggtggacagcgcaggcgaatggacggtgtccgtcgtgctcgacaaagtcggcacaatcttggagaagcacattggcacaatgtttcccgtcccaccccaattgggacacttttcgccggaagtgaaacgggtgagttttgtgctcatagtgtgggaaaatacttcaatgcatttttaaaattggcagtgttgcgattggccaaaatgccgttgcgattatctgacgaaggagcgaccgaaaagtgaggaggaggcggacactttcaaggagagatggacaggcatttgaggcggaggagcgagggacagaaagaaaagagaatggcgatcactcggccgatcaatcgcctgcggcgttttgccgaacatccacattttagggcatcgacactgtcctccgctttgatcaatttcgattctccagattctccgctgttactgattgatcactcccctcccctcttccaatttaattcgcacaaaaacttttttgctatttttctaatgggccgatctttttttgcttttagacaatttagagactaattaaaaaattataatgaagaggaaaagccaaagcaaaaagtaacttaattttgtgcagatttccacaaaacaaaaagactttgttcagattaaatttattgtaaaaataggaaagttttaatagaaaatgttttattgtaatatttataaataattgaacaacaaataataattgttacacatattttgatga

SEQ ID NO: 77242 - DNA, 249 bp, Heterodera glycines
  Genomic contig location: Contig_ID=SeqID_13368; Location=25..273; Strand=-
  SCN-specific regions: Sequence locations=1-181,203-249
ttttgttttatttattttttgtgaaatattaatgaaatttgaacataaatcactgaaaattcatttttatttttatagccaaacgaacatttctttctttcttttttttgtttgcgaaaaggaaattttcaatgagattttgccagcggcgaatgccatcgttgggaacagccaatcggagtgggaattctgaagatgaaagtgctgagcaggaagaacaaagtctgaaattcagcacaaagcattgac

SEQ ID NO: 77243 - DNA, 482 bp, Heterodera glycines
  Genomic contig location: Contig_ID=SeqID_13369; Location=247..728; Strand=+
  SCN-specific regions: Sequence locations=1-482
atgacaacgaatgacccaagtgtaagcggcgacggcaccgccacgaacagtgcgacgggggcacgcattggtgagggaaacatcgccacggaacagaagcgaatgttccgcttcctccactcggcattggccatcgtttccatcctttgggccaccgtttgtctgttcctttacttccacgcgccctcctcacaggtgaaatgcccaatcgatgctctttcgtcccaccgttttctccctttggcaccactctctcctctcttttcgccagagtcaacagcttttcgactgtcgatggcatttgtccgttctgctggtccaagcttcgtttggccatgtgttcgtcttctgctcgcgcagtgccctccttttctgtgccgctttcgtgtccactcaatatgccattgtctactcactgctcactttggtcatttactcgttggacaccgttttgcttatgctctttccccgcccatcggctg

SEQ ID NO: 77244 - DNA, 582 bp, Heterodera glycines
  Genomic contig location: Contig_ID=SeqID_13370; Location=253..834; Strand=+
  SCN-specific regions: Sequence locations=1-325,398-582
atggactcggaaatggcccaggcggaccaacaatggactgagacgcgaaagcgggagaccaaatggcgagtccggcagaatgagtgtcaatgccaacatttgcttgtatgtccaggctttactccgtggccgcctgtgttttggccgtggcggttggccatttgctgctcaatttcggctacgttttgcagtcgatgattttcgagtcgttgtccgtcgccactggcctttccttcgtcttttccatgtgtcttctcggcgctgtcggcttttacgctgtccggcttctccgtttctgcttggtattacagttcttccctcgatgtttttttctctcttttcttttcctctcccttctctcttcatccctccttttttttaattttccattccattcagattctttccgcgtacatctctttgaacttgtttgtaactgcttccctgcttctgttcgctttcatccaagacttcttcttcttggccacaacactcgatgacgaagtaaaaaaaaaagcgaggagagggggagcaaattcaccatcaatgcttgctctgatcagtgatcattgctctgactga

SEQ ID NO: 77245 - DNA, 1036 bp, Heterodera glycines
  Genomic contig location: Contig_ID=SeqID_13370; Location=997..2032; Strand=-
  SCN-specific regions: Sequence locations=1-429,459-571,623-784,817 -964,1002-1036
gggaatggccaaagaggacgaatgggtgacgaaaacggtggaggcggagccatcggcggaggaaagaagcggacgacggaaaagcgcttcagtgacgcggtaaaactgaatttgcgattaaaattggcatcattttcagcttattgttagtggcgtaaaaacgacctgcaaaacgctgttcacgtaaatttggacaatgtccgtctgttgtccgatcagatcaagcgtagtgatcccaaccgaggcaagcttaatgagttgttggggagatgcagcaattgaacgaaaagcattcatcagttcgctgattacctgcagtatttggacgggaagcagtgcttggaagcgttcaaagcgagtcacataaaaaaggaaaacaaattgagcagaagtgagaagcctgagagaagagacaattaattagttgggtaataaaaactaattaattaataaaatttggaagaccaatcataaaagctcggagttgacggaaagatgagactgaaaatggaaaaggaagtgaaaaaatgacaaaggacggaccattgaagaagttttgccaagacgaagctaaattaaatttaaaaacaaaaatataaaatttaaaaaaaagaaaattaaagtcgcacttctgccaaaaggacaaattcaatggcagcggaaacaatgccaacgagggaaagtgcgcggagcaatcggacggccctttgcacatttgagggctgagtttggagtatttttgtcctgacgagggtggaaatggcataacggagggcaaaagctaaagaaaaagcaatggaaagatgaaagacaaatgcaattaattaatctgtgccgttattcaccggcgatgaaaaaagtgccgacggaaagggcaaaatcggataaatatagcaaaatcttcagagtggagccaccgccgtcagacgaatcggactcatccggcggagcagaaaaagagccatttttaagggcggaagaaaaaggaaaggaagcggacgaagtattaagggcagtggcgatagtatccttctaa

SEQ ID NO: 77246 - DNA, 902 bp, Heterodera glycines
  Genomic contig location: Contig_ID=SeqID_13371; Location=276..1177; Strand=+
  SCN-specific regions: Sequence locations=1-4,26-750,779-828,850-902
atggacgggggaaaaaggggaaaagaatggcaaaaccaaataaacaatgcattcggggatggagatttcaccgagaagttcaatctgaggaacgaatcggttggttttaacaaatttagcgataaatacgcttttacttttatgtcccgaatttcgtcctctttggccgggtcgcggatcagcaacaacatgaacagtctaatttttacaaggatatttaacaattgttcattttcagatcaccttccagccatatcgcccagcaaaaagcgttcccccgtccggtcgatgcgcccgcaacaattaaaacgcgccatgtgaatgagaggcggggcaattgctgtgtaatggcttggtctctaaattaaaatatcatttttctatagcaatattcgtcgttccctctgcccttttctttttttaatatattttcccatttctccccgttttgaccgtcctctgttcggctcaccttctggtaaatgatcgattcttggcccaccacaattaatccgccgtaaggcgacggcaccggcaccaaaagagtggtcgctgcttcgatattacctgcccaattagttgtgttttttttgtttagaaaagtgtaagttcgcagactttgttgccagagcggagagtgcaattctttgttttccaaatccaattcgcagactttcaaatggcgaccattcaaatcctggtagagataagcgatggtcggttcatctgaaaacttggcattctttataatccaaatttttgtttttaaaagattatttagcaatgtcatgtaattgttcgctatgctaatttatgctatgagaatggtacaaaaagtatcccttcagccaggggcgtatctataaacatttttcgggggggggggggttgctctttaccca

SEQ ID NO: 77247 - DNA, 1674 bp, Heterodera glycines
  Genomic contig location: Contig_ID=SeqID_13371; Location=143..1816; Strand=-
  SCN-specific regions: Sequence locations=1-616,638-692,714-763,792 -1674
gaactgaacagtttgctgattttgaccgccaaatatcacttggccattctcagtttcgcggaggacggacagccgcggacccgcgcatttggacacgtggcggacaaagtgggaaggccggccgagacggggatcattacatgtgtgcacgagtcgggactgatcgcactgcgactttacgaggcccacttaaagctgatccaatggcaggacgggcgggatttgaagaatttcaacgttcgttttgaagactacgacatcacggacgtggcatttttggaaaacacgggcaagttttgctattcccgaaaatttttaggtacttttccgttttgtgcctacacctcaaaattttaattccccccccccccgaaatgaaaatttttaaaaattttccagcaaataatggaaaaatttttcgaatttcctcccaaacgaaaatttaaaaattttataggcgattttcgtaacaaaaagcactctaatttccaaaaatttttcccggcggcgcctatcggcaccgccggacctcaattttccactatttttactaagttttttgccttaaaacggccaaaattgggtcctttttagtgaaaaagtgcttacccagcagcggaaaaagggttttttgtttattgggtaaagagcaacccccccccccccgaaaaatgtttatagatacgcccctggctgaagggatactttttgtaccattctcatagcataaattagcatagcgaacaattacatgacattgctaaataatcttttaaaaacaaaaatttggattataaagaatgccaagttttcagatgaaccgaccatcgcttatctctaccaggatttgaatggtcgccatttgaaagtctgcgaattggatttggaaaacaaagaattgcactctccgctctggcaacaaagtctgcgaacttacacttttctaaacaaaaaaaacacaactaattgggcaggtaatatcgaagcagcgaccactcttttggtgccggtgccgtcgccttacggcggattaattgtggtgggccaagaatcgatcatttaccagaaggtgagccgaacagaggacggtcaaaacggggagaaatgggaaaatatattaaaaaaagaaaagggcagagggaacgacgaatattgctatagaaaaatgatattttaatttagagaccaagccattacacagcaattgccccgcctctcattcacatggcgcgttttaattgttgcgggcgcatcgaccggacgggggaacgctttttgctgggcgatatggctggaaggtgatctgaaaatgaacaattgttaaatatccttgtaaaaattagactgttcatgttgttgctgatccgcgacccggccaaagaggacgaaattcgggacataaaagtaaaagcgtatttatcgctaaatttgttaaaaccaaccgattcgttcctcagattgaacttctcggtgaaatctccatccccgaatgcattgtttatttggttttgccattcttttcccctttttcccccgtccatttttccaatttttaggataattccgtggcatttgttggctctcgtcttggcgactctcagctcatccgtctctcaaccgaacccgtagatacggaattgaattcgtttgtcaatgtcatcgacacttatccca

SEQ ID NO: 77248 - DNA, 568 bp, Heterodera glycines
  Genomic contig location: Contig_ID=SeqID_13373; Location=16..583; Strand=-
  SCN-specific regions: Sequence locations=1-160,195-207,231-512,534-568
atgatacattggagggcaaattgcttctttaatgtcatcgctgtcattggagatgtaatagaggccaaaatgagaaagttttactttaactctctgaattaacaatagtaatttagggcacttgtatagagtagaggtcgacaaaaacgaaaaggcacccttttgaatttcataatttttattgttttaaaaaagatttgataaaattgtttggaaaacaagttttttaaagttttctgggcataactttttgaaacataacaaaatttttgaaatttgcaggctaatagaatattcttggggctatcgagtgatatcaaggatgttaaattttggtggttctagaaaaagtaatagtgcattaaagttgtcttttatggtcgtttaaactgcaacagagcccaattttaaagttactctgatcatgaatagctatttactttggtcaaaaaatttctgcccccttttgtttttgtcaaagtctgtgattttttgccacaccaagtgcataatttaagattaattaaaagaagcgatttttgagaagagaagccaaaattcaaataaa

SEQ ID NO: 77249 - DNA, 477 bp, Heterodera glycines
  Genomic contig location: Contig_ID=SeqID_13373; Location=864..1340; Strand=+
  SCN-specific regions: Sequence locations=1-477
atgggctcgtgccttgaaaatctgctcgattctgtcgaagtttcccggcccaccttcaaagagtcgcgtcactttctcaaaaatgtcctttattctgtgccctttgattgtctccaaattgctcccgtggacagacccgactcggcgactttactcaaaattttagaggacgaaaatcgacgaggagaaaacgaaatgactaaagatattgcgactaatcagcccattgatgaaacaattgattcgattaaaggtaatttggcgaatgtttgtctctcaattgacttaaaatgaagcccctgctcattgtcagaacaaattcgcaatgagtcggaattggccaaattcggattcaatggccaaacgatcaacgaaatgtttttcctgtggaaattgtgcgggagcagcgtggagagcattctcatccgaaacggagtcatcaaaaaccggccgccggtgctgacacttcccaggtga

SEQ ID NO: 77250 - DNA, 3320 bp, Heterodera glycines
  Genomic contig location: Contig_ID=SeqID_13374; Location=1..3320; Strand=+
  SCN-specific regions: Sequence locations=1-853,875-1350,1394 -1486,1509-1846,1868-1874,1945-1997,2019-2279,2301-2626,2648-3320
ataatagattaaaatttgaaactcccattctgcaggatttacgattaaatacgagtccctaaatttgtcttatgaaattgcttattgtcagattagtcatcgatgatttgcaactttacgggaatgaaactgctcggaaagtcaatttgtctctgaatgtcgccgaacttccgttgagcaacctttttgaagtgccatgccattttcccatttgcctacccaattgtttagagactcaatgccattcctcgcgacgatttgcatctgagcatggaatttatgagcatttgtggccgggagggaaagtggaaagaaccctctccgaccgtagaagactcagtccaatctttggttgtcagggaaagggacattgcttaccaggtgatcagtgattggttggtttcggatggaatatttctctttaaacagatttcccccttgtttaaacgctctccttttgtttaagtttgaacggatgcgtttgtttcgtcgtctgttgtccgcctttcctttcaaatccgatttgttccgtttcgaatgtcaaaaggatattccgccggtgtatcgtggtgccatctgggccactttgttgggtgttttgcccacgtcttctgctgacgatgggtcaaatccccaggatgagttttacaacattgacacattttcggagcattccgctgatcgccaacttcaagtggacatcccacgttgtcaccaatacgacgaattggttgggaaaactcccatccgttttaacaaactttgtcttcctccacttaagatggcttctccgatggcccatcatcggatgaagttgctgatcaaggctttgctcgtctctcgccaggacgatgactttgtttattggcagggactcgactctttgtcggcgccctttctcattttgcacttcaatgatttatgtgccgtcaaaatgcccttttcccccgttgaatttgctttttccagcgaccgcttttcgttgtctcaacgctttcattgagcgttaccttcgcggctttttccttcgcgacaattcgactgtgattcgcaattatttggctgagtttatgcgcatgctcgagttcgtcgactcggagctgttcacccatctcatttcgttggactttcttcccgaactctttgcaattccgtacgttttccatgccgtttaattttcatttgctgtttttgaggtggtttttgacttgttttgcccatgttttgccacttcataaattggttggtttgctctttctccctttttttctgatttattaaatcgctcattttcagtttcatttatgggattctctgcttcttgccgattcgtattttcccctgtgtctttttttatttttaaattatttttaatttattttttagttttattggcgttgctattctcatccaactcaggtctcgtctcatttctgtcagttttaacgaggcaattttgttgttttctgacttgccaggtcaacccaatattaaaaaaaaaattatttgcttaataatttgttcatgtttagatttacccattgatgaaattgttcaaatcgctaaaattcattatgccaaatggttatcaacaagtgatgggcaaaacacgtgaaaaattataattagggctgagattatgtattttaaatcgcaaatagtgcctaaataagtgaaaaatcccttaatccccccccccccccaaataaatgctaaaatagaatcacaaacatttcaagcttttcagaataggtgcaaaagtaggtgaaaagaaagtcaaattttaaaaatctcccccagccctgagagacttcttaaaaataggtaaaacctaaaaatcttgccctaattataatcaaaatattttatagtgcataatttatatattgtattttaaatatttatgtgtatgatatttttaaaataaatgcataaatatttatacgcattgcattctccatccaatcactgacaatgattcgttgtcttttgcctcataataaatttctgattttaatatccataaaaaaaattttatcgttttttctgaaatggcaacgattctttctcatttcggcacgccatcagctgacggcgtcagcgcaaaaaaggtgacagagcggcagccaaagcaaaaaggagacggcacaaaagaaaatgggacgccgaatcactcgacaaagccatgggtggagaaatagtgggcaattagttattattgtgggacggcctggtaaatgtgctgtttaagtaggccgaaaaaagtggaggaggtggcctaccaggaggaagtggttgccgtgctgaagagatgtgtgcagggcgcggatgtggggttttggcatttgcaattttactttttaatttataataatgccgactgattattctcattcagttgccgaatttgttgttttatgggccacccggaaccgggaagacttcggcagccgtcgctttgtgtcgtcaacttttcaaaacagcacaactttacaaggacagggtgttggaattgaacgcttcggacgagcggggcattgacattgttcggcacagagtgcgtttaatttttgccaaaaggattcattttcatcgtttaatgattggcggactttcagataaaagaattttccaaagtggccatttcctctgtccgcgttggcaaagactcggtcgtcccgttgaaagtggtcattttggacgaggcggacgcgatgaccagcgctgcgcagtccgcgctccgacggacaatggaaagcgaaacgcagtcgactcgcttctttctgatctgcaattacgtcacgcgcatcatcgagccgctcacgtcgcgttgcgcgaagttccgcttcaaaccgctttcaatggccgcgcaaaaggaaaggtgtcattttgagacgggcggggggggggcgacaaatgccgactaataaatagtgacgcggacaaatattgacttgatcagaatgttggacatttgcaatgctgaaagcgtccaagctgatcaggaaacgattgaagaattggttaatttctgttgcggtgacctgagaaagtccatcactttgctacaatcgttggcctcccttggccgccaaatttctgtgagcgatgtccgagaggtggcgggcaaaatccccgacgaagaagtggctttgcttataaagacgtccgaatccaaaaataccgaaaaagtagtcccaatgccatgtttaatttcattagatcatttacaaaaacagatcctcgacaccgttcgacagattatgagaaagggttacagtgtcacgcaaatgcttatacaattggcggacgttctgttg

SEQ ID NO: 77251 - DNA, 721 bp, Heterodera glycines
  Genomic contig location: Contig_ID=SeqID_1994; Location=2467..3187; Strand=-
  SCN-specific regions: Sequence locations=1-721
attcccgaatcggccaaagctgcagtgtatttgccgggaatgaaaggccccaattggaacattaaaccgggcaccgttgttgacacccaagtacgtttaccaggcatttcttcgcaatgttttatgttttatgcaggtgactcatccggaacacagcgaattttatttggccacgcacgcggctgttcaggtgctaacaatagaaagtttaacgttcaaaatattggccatttatcacagggaaccactcgaactcctcgctattctgtgctcattgacgagtcgcatatgcccatggaccatattcaacaggcaaataatccccggggggggggggagttcaacgcattttaatttaaaaattacacattgtttccattttcagatgtgcaattcgcttgcctattgtcacaagatcatcaatacgcccacttctttgccagctccagtacattttccacgaatttaatgcattttgtttggtaaaacttttaactttttaggtttacatcgctctgatgtacgccaaacgtggccgagacatttacaaagtgaagtgagtgtgcttctgtgatcattaatgtgtccatttttgatggatcctttaagtcgcgagaccatccaagaacgaagggatgacggtcagctcgattaccaggccatctctgaacgactttgctacgcgcacacgcaactgcgcgaccaacgcgtgaacgcctag

SEQ ID NO: 77252 - DNA, 661 bp, Heterodera glycines
  Genomic contig location: Contig_ID=SeqID_1995; Location=277..937; Strand=-
  SCN-specific regions: Sequence locations=1-201,235-551,574-661
  Gene Ontology: Biological process=gametogenesis
atgtgccgtaagcatggcatgatcatctctaaccctgctgaccaacaaatgattgacgcgaccccgggcgatgtaagtgccaaaaatgggcacatcgttgtgatcggaatatttaaaggtggaaaacacaatcgtggagtgcaaacggtaccattgcaacttcgtctttttcatcaccagcgacgcggtcaaagctctccatggtaaactttttgaaaattaaacttttgtaaaagcaattccacttttagaagtcataaaagcatgcgaacagaagtacgaaattgtcacacaggacctcaaactttcaaatgcctgtgaaatttcgcgcagaggaaaacccgaaacggttgagaatattgtggccaaatcgaatgaaaaattgggcggcattaattattcggtaagggtttacgaaattgaaggaatccatgatattttgttctttaggtccgtgtcacaaaccctgagtaagaaacgctttgtcgcatggaacaatcaattaattttcgttcctaataataaattgcatgcttttagtgtgcaacgaatgcttgaggagggcactctgttcattggccttggcgtgtcgcaccccggcgccatgggaagttacgaaagggcacgcggtgccactccgagggacccttcagtgattgga

SEQ ID NO: 77253 - DNA, 663 bp, Heterodera glycines
  Genomic contig location: Contig_ID=SeqID_1996; Location=349..1011; Strand=-
  SCN-specific regions: Sequence locations=1-663
agaggagcacgtgatcattggcgggggtaacacttacctaatcaacgcgtccaatcacggctttgtggcggaggatgggcccgtgttgagtcagcacaacaaatatttggcaattggaattcataaaagcattcgctacgtggaggttggtgcaatttatggccaaaaattgagtgaccattccttttcatttgcaggggccacgagggcgcggaaataaaaaagtcggactgattgtcgagagtaaaaaagtcagcccaatttctgattcaagactcattataatttttgaattcgtttagactccgttccacaacatagacggcactttgcttgataaagtttcttcaattgttggccccaataacatcaaaggggacggccaagtcaggcccaatttgattggcagtttgaacgcccaactcaaaggtgcaacgaattgttcgaaagttgaatgaacccatgaatgaatgacccaagtgatgttgttcaggactgcatgtcaatgtgaattacccaaagggccgtactcgcgatgtccgactcagcggagtgtcgacggcaaccgcatcaaatcacataatcgacgtgcagggagagaaagtgccggtttcggaatatttcaagcgcaaatacgaatacgaactcgagtcagttggatga

SEQ ID NO: 77254 - DNA, 2566 bp, Heterodera glycines
  Genomic contig location: Contig_ID=SeqID_1998; Location=2814..5379; Strand=-
  SCN-specific regions: Sequence locations=1-32,54-393,415-645,667 -751,811-1446,1474-1478,1500-1779,1801-1905,1927-1966,1988-2293,2315 -2382,2404-2566
atgcaaaactttatggcacggagctcgggcaaaacaataacagtgaaagtgatttgcgtgagccgttccaaatcgatcagtgcccggggacgggagttactcatggaaaggcgtcagagtgacaggtaatttagcccaaaatatgggccccgaaagttagtgtgtttactcaatttctaatttgattgttcagaatcgtcgaatgcactgccatctccgagaaggttcaagaaccgcgaaagaagctctctcttatcagataccgagaacagtttgactttggaaatgtcgtccccgtgttcatcgtcgacacggcaaaaaaagagggcactgatcagacacactttaccggggaggtcagttaaactttctttttttcactttaaaatgtaatgaaatgaatttgtttttgtttagatcaatcccgaattccgtgcaataattcaaatcactcaatcggcaaaaccggcagccaaaaaggacgggacggacactgatcagtctgaaaacaccgcccaaatgttcgactctggggaattgcgctttggccgagtgattggcgtaaataaaacgaagaagggacgcgttgtttgtctgagcttggtgagaagcgacgaatacgatttcaacgagttgaaacaaaatgtgagatacaaaaagaaaataatatgggaattaattaattacccaattttagataaatactcaaaaaaggacaaaagagagtgtaaactctgctgaagagaacgttgaagaagaagaaggaggaaagaacaacgaaaaagaggaatcagaggaagacgaaaaagagaatgaggagagaggggaaggaaatagcacaatggaaaagacggaggaagagggcagagatggagaggaggcgcaaacaaacggagagcacaaagaagtaggggcgaaaatcaaacgggaaaaaagagtggggagcgaaagtcaaactttcataaggaatgatttaaaccctttatagtcatatcatcccttggttgcacttcgttttccctctcctcaccaattccccattttaagccaaccttttgtttcggtcttccggatgagcattccctagcatctgccgaggaatatgagaagcttctcattgccgattccaacttgtcctccgcgtggattggctttgttcgcttttatctgacccacgaagggctaaaagtgtgccgaaggtacgaacgcggaagagctgttgctgaaagggccctcaagaccattacatttcagtaagtaaatgatacccttttgttaggaattcatatgacaaatttgaccagaaatgacaccgaattggccaatgtttggcatgcttatttgaatttggaagttgcattagggacggaagaatcgctgcaggaagtgttcaaaagggcgtgtgccgcgtccaattccatacaaatgcatcggtatttgattggactgttgaagaagcaaacaaacgcaaaaggaagagaagaggcaggcaaaaagaaacatcaaccaaacattaaagcatcgtttgcaggagatcagagaattatacgaatcaatgataaaaagtttcggcacctcgaacttggaccatggtttgagtacgggaggcacctttacagcaaaacgatgccgacgcatttcaaaacttgcttaagcgttctcttcaatgttcggagaagaaaagacgtaaatttagctttatattatgctcttccctttaaatttcaccggccctaaatccttaattctcactcccttttaacgaaatgatttaattacgtttattgttctattttgcaattttgccattcttagatttgactattcttatgcgatttgctcagctggaaaaaggctgtggcgacaaagaaagggcaaaaacaattgacgaactgatcaaaaatgtgaaggaaggaaagaaaagaaccgatgcttccatagtggaatgatttctatccttagataaaaaccccttttctcttttattgttgaataagatttgcatatgttaaacacgcagactattgcattttaggcctaccatcgacttttaggctttctcaattttttggtcaatgcctacattattggtgtcaaaaaaacaaagtctacagaaatatttaaactgaattccgggctaaatgccacacaaaaggccggtctcccgaagaccagattcttccgccgtgccctctaaaaaccgggctcggttcggtctttattaaagtgtactagaactttactgcaggcatatgtatgtgttcagaccagggtattttcgtgccggcccgaatttttgggttctaacttttttctttgtcgtcaaatcaaacaatcttagcatcatttgaaagccctttgcatgctctgtcagacttacaaaaaacaccaagattttctaatctgcaaaagttaataagaaacaatttcaaaaatttcgactgcaattttcatattataacttttcaggtaattgtttaatcacgaagcaatagcttaaaaacatcttctaaacatgttaagctttcgaatgataacaagatagttggatttggataacaataaa

SEQ ID NO: 77255 - DNA, 1585 bp, Heterodera glycines
  misc_feature (1585)..(1585): n is a, c, g, or t
  Genomic contig location: Contig_ID=SeqID_1999; Location=200..1784; Strand=-
  SCN-specific regions: Sequence locations=1-200,222-960,982-1158,1180 -1304,1326-1585
  Gene Ontology: Cellular component=cytosol; Biological process=growth
atgcaaaatttaggcagaaaatcggtgccgactgtcactgtctgtccaaacgaggtcaacagtcatttgatcccttctttgctaattgccaattccgtcttaaatggagccgttattagcactgaagagaaaggtgcgaaaaaatttgtgcctacatttagttttatttgttgttttttaggtgccgtaatcgatttgggcttttcaacaagttctgtcaatggtttcgttcatagcgatgatctcccgccccatctttcactggacaaattacatgttggccaagtggcacttttccgagtgaaagagagtccgactccgtccacccgtgtgatcaaactttccggctttaccgaaatgggctgtctcatcggcgaagaaggccaagatgttttagaattcaagcatttgactcccggttcaatcgttgaagttgagccggagaaaattgtgactgatggcctttttgtgggattaatagcggtaataatttagctcataagaatgtatctttgatacttttctcttcaggtccaaaggctttcatccgaaaggtccatttgcctcctcggctgcgctttgacaccaaccgaattgccaagaaattccgagcttgttgtgttggctgtcagccgaacacttcggtgctgatgctcactgctcacccggacattctcgcgttgtcaaagtgcgaaaaacggttgctgcctccggtaattattgcactgcttgcagaaaccagaaaatgaattggttcaggaatttcgagttggttcacggatcaatggatgtgtcttttttgtggacaaacagcgaaatgtctatttcaaattggacgatgacagtgagaagcatttactcaccgcgaaagcactccgaattcacattgacgatgtggagacgaaccgtaaactgtccatcatttatggcttcatgtttctttatgttttagtgtccaaattcgcaattggttccgtccacgaatgtcgcgtcatcggattttcaatgtctgaacgacaactgttcgtcactacgcgatcggctgacctccaacaaagcgttgtctgtgcggaagaagcacttccggggatgaaaatcagcgggcggatcaactcagtgaatgctaacggcataaaagtgacatttggacgggatatttctggatatgtgtcagcaattcacgcattggacaaccccaacaaacactggcaaaaacggtttcagaaaggtatttagggaagcttaataacgttaattttcacttggaacagctttgttttttatgacctagtaattgcattgtctattaattatttattaaatttcaggtcaaaaagtgtcgtgccgtgttttgtacctcgaccacaatttgaataaactctttttaactgcgaaacattcgctcgtcaaacaatcaaagacagagaaacaaattgttgcaatttctaacgacgtggtgggagttgtctcaacggggacagtcatcaaacatttggacggtggatcagttttggtcgctttttacgaccgaactatcggctttttaccatccaggttactacgctttacaataaatgcgttttan

SEQ ID NO: 77256 - DNA, 1222 bp, Heterodera glycines
  Genomic contig location: Contig_ID=SeqID_13375; Location=1219..2440; Strand=+
  SCN-specific regions: Sequence locations=1-506,549-668,690-1199,1221 -1222
atggttagcatcaattttggcatttttgaactattgacctttttccagaaatttcatagcaaaagtgccataaaacgaaaagtacaccccctaagaatcgatcacaacaatttcagaaaataactcctaaaaattgaccaaaaggtcaaaaaataaaccctaaacatgaaaaaattttcccaaaaattcgccttcaaaatttattttttattttcttgacaagttggcattgttcaggcgaaagacttttggaattattgtgcctaaaaacattgaatttttccaaattttaacatattttcgcacctattgcgtattttgggcgtttttatccgtggtgcgacttttggggatttgcaacttggggacccgacatttggggacccgacttttggggatcccgacatttggggacccgacatttggggatcgacatttgagcaaaaggcacttaaggaaaccacggatatttggcaacccgacatttagggacccgacatttggggattttaataaaacaaaaaaaatattagaaaatttaattttaagcccaaaattagacaaattgtgccagctttttacttgcttcgacaacgagcgaatgagctcggaatacaagttgttccaattgcaggacaaccaatcgcaatattcgattactttgggcggtattgataaaataaattgaattgtttattcattatatccaagaaactatgtgcgtggtcacgatggaagacctccactgtttcctgttcatacctggaatcaccatgatagtgttcttcaggacttggggcgcacaaataacgcccaagaagggttccatttggctttaagaatgcaatttaacagtgtgcatccgccattatcgaagtgaaaatcgcgtttaatcagcttaatattttaattatcagagttatcactgttctgaagaaagaagagcgaatcgcagccgataagctgcggcagtatgagttggacccaactcaagggataagaattcgagaacggaagaaaacataccgtgaaaatgatttggctatcagaaatttggttgaaggctttgatgccattgagaacccaaacgaagatgagattcttgctcatctcagatcgttgcaatacagacttatgcgcaatgattttgagaattgggacgacccaaatggtgattaattctgttttcacatcccgttggcacttgggaaaggcactttaa

SEQ ID NO: 77257 - DNA, 852 bp, Heterodera glycines
  misc_feature (24)..(24): n is a, c, g, or t
  Genomic contig location: Contig_ID=SeqID_13376; Location=52..903; Strand=+
  SCN-specific regions: Sequence locations=1-84,106-221,251-672,701 -783,830-852
atggcaccggcacatccaaaggcnggtatgtcgatgtagagcgagaacgggcaactaatgaaatttaaattaattaggcaattaaaatgcaaaagtcaaaatatatgatgaattttttacgaggaacagatttttaagttttagactttttttttttgcggatagttcttgatgagagaagtacgaaatcaatctaacattttttttcaaaaatacaatcgattttttaaaaagcaaaaatcctggcgccatgatttggcggacaaccgaaataaaatcttaaaatgtgtttgatttacaattgtgtaaccgaaatggacaaataatgaggcaattttggaaaattcacacatttcttgacaggtttttccaattttttagcaactattttggcatttttcagttttttagcaactatttatgtacttatttcgctatttttagcaactaaaaatccgttccctgactattactatgtatttatggaatttaacacatttaaaaacgaataacaaatgatacggaagcgctacgtgcagccgcaaattcagtcccgcgcgattcgcttggcattcgcgcagtggacgccgaacggtaaatgccatacacgcgacgtggcattatttgatctaaaaataatcttagaagggaagaattggttgttaaataaccaaaataagatttaattattaatttaaatgattgctggcgaatgtttaaaaaagaaattaaaattaagcaaaaaattttcaacaaaaaatagaccattcaattttttcagactataaaaagaattatttaaaaaaaaaatttaaattaatataaaaatgggtaaaaatccattcaaaggaa

SEQ ID NO: 77258 - DNA, 638 bp, Heterodera glycines
  misc_feature (612)..(612): n is a, c, g, or t
  Genomic contig location: Contig_ID=SeqID_13376; Location=49..686; Strand=-
  SCN-specific regions: Sequence locations=1-385,415-530,552-638
ttttagatcaaataatgccacgtcgcgtgtatggcatttaccgttcggcgtccactgcgcgaatgccaagcgaatcgcgcgggactgaatttgcggctgcacgtagcgcttccgtatcatttgttattcgtttttaaatgtgttaaattccataaatacatagtaatagtcagggaacggatttttagttgctaaaaatagcgaaataagtacataaatagttgctaaaaaactgaaaaatgccaaaatagttgctaaaaaattggaaaaacctgtcaagaaatgtgtgaattttccaaaattgcctcattatttgtccatttcggttacacaattgtaaatcaaacacattttaagattttatttcggttgtccgccaaatcatggcgccaggatttttgctttttaaaaaatcgattgtatttttgaaaaaaaatgttagattgatttcgtacttctctcatcaagaactatccgcaaaaaaaaaaagtctaaaacttaaaaatctgttcctcgtaaaaaattcatcatatattttgacttttgcattttaattgcctaattaatttaaatttcattagttgcccgttctcgctctacatcgacataccngcctttggatgtgccggtgccattat

SEQ ID NO: 77259 - DNA, 1492 bp, Heterodera glycines
  Genomic contig location: Contig_ID=SeqID_13376; Location=929..2420; Strand=-
  SCN-specific regions: Sequence locations=1-128,151-368,396-641,664 -840,863-928,962-1151,1173-1224,1249-1269,1302-1374,1396-1492
atgccctcctctgctggcaggcccatagccagagggggcgggggtgtgaattccgcccctccaaaattaaaaatttttccagaaaaaattaacaatttaaaaatttgtaatctattttctaatcactgtattaatattttaaaaaattttcccgttggcgcctattggcaccgccagacccctattttacttcttttggttttaaattttgaccccaaaatggcaaaaattaggccatttttggcgaaaagctgctaaaattcctgcttttggctcttagtcgctgaattttttaaaagaagaccggagaaaatttttttggcccgaatagcaaaaaaaaaaaagatccggattcaccgctccgaaattttttctgtaaaaaataatttaaatgaattacataagtctcccggtgacgcctatttgcaccgccaccggcgcgcctctaattttccttagaatgtttcttcgatttaaaaacttttcagatgattggacccctttgtgttcggcttcgtttctcatcagttcacaaaagaaggggaaaaaggatttagtggtgaatgatgagatcacgaaatgtatcccggaatgtctggtttatatgccgttaaaggtaaatgaattgggaacggcacagaaagcagcagtttggatttttatttaattcaaattgataaaagcaattttgccaattcaaaattttctccgtctgtgtctatcgacaccgacgaaccccaaaacaccagtaccccagggacggtcccatgatttagtcaaattatgttgaaaaataattactttgttttcttttttaattaaaaaagaaaaattccaaaactcacatttacctatttttgtcggcgacaacggtaattagtggtttcaccgttaccattataagtaagacccatttagcgagcaccatttattaaagaatattttaaaacatcaaatatttttaattctgcaaaatggatggaataaaaggggtgaatctgttttttttgggagggaggaacgaaatgtttactaaatgaattaattttaaatcatattttagaaatttatggacccggccaatgggtggtacgacgaggaaaaggactcggtgattttggtcaccgaattatttgtggacgaagcaaatcgggaggaggaggaaaaggtgaagtgagggagaaaaatctgatcgagaaaatgacaattatggccattatcactaaatattgttaaaatcagcttaatatggcagatgaaataatttcgttttattattttgtaatttttaaattatttttgacaattattgttctttaacttttccaatttctcgcctatgttagcccattttttgaagttgaaagcaatcacaaacaaatcgattgcttttcccttttggcttaattacccacggcaataagctcacgaattcaatttttctcgtcagtgaagaaaacaactgatatatttgccagtttagagcattaaa

SEQ ID NO: 77260 - DNA, 83 bp, Heterodera glycines
  Genomic contig location: Contig_ID=SeqID_13377; Location=332..414; Strand=-
  SCN-specific regions: Sequence locations=1-83
gccaaggaaaatttggtcgatgcagtgattgatgggatgaaagttcgtgtggattattcggtgacgcgcggcggtggacaata

SEQ ID NO: 77261 - DNA, 1202 bp, Heterodera glycines
  Genomic contig location: Contig_ID=SeqID_13378; Location=222..1423; Strand=+
  SCN-specific regions: Sequence locations=1-175,197-206,245-325,366 -626,652-658,680-794,840-878,902-943,990-996,1018-1104,1143-1164,1196- 1202
atgttttttctgaattttattttcttctttttcgtgttcaatgttgaacaacatttcaccctcggcgacggatcaaatggaacacggtaattaattatgtaattaggagaatgtgacgaaaaacttgaaaaaaatcggaaattttaccaaattggatttaattaatctgaatagaaaatttattttacttgaaaaataatagaattactttttgccaaataaaatattttaagagattaattcttttaccaaatacggaaatttagcaaaaaccttcccaaaaatcaaaagtttgacaacagaaaattgtttatagcatatgagcaataaaaagttaaaaaaaataattattataaaataattatgcaaaattaaagcactgtgtcaatggaagcgactgaaaatggccccaaaacaatcaaatttaaattgttgtatagaaattgttcaaggttttcttggacctatttttttaataattatgtaattgaacaatagacacttaccaattaatgttaattaagcttttggttgtgctacaaaagtgcattgaatgccacaaatttgtcgtggaaattggcgaaacgtttccgattcgacaaaatgttgagcagcaacccaatgatcaatgacagtgatgatgatggtgatcagttttgtggacaaaatgacagaaaaatccaatttttgattaaaaatgaatcaatcactatcggaggccaacagttgttcagcaggtcaatcaattaatggcggattaaggaattgatttgaatttcttcatattccaattcaatttttaaaataatttttatgaatttttttctttaaattattttctcaaggaaaaagttccagtcccgatcgaaaatcaaggtccccccggtcccggtttttccaaaaatccccggtcccgctctactctattacaaaaaactattagtttttttaaatttttttaaatttaaaattaaaatactttaaaaaaagttttccctttcttttggccaaaacacaatttttgagaatacaattcattaatttttttttttcttttctgtggatggaggtcatttcttatgctttttatacaattttgttgtgaattttttgaaaaatttattaaatatttaaaaaaatttggatttgcaaataattgtttccttttaatttaattgaaaatttaaaaaattatcccaaaa

SEQ ID NO: 77262 - DNA, 844 bp, Heterodera glycines
  Genomic contig location: Contig_ID=SeqID_13378; Location=1588..2431; Strand=+
  SCN-specific regions: Sequence locations=1-34,59-93,115-316,339 -676,698-844
atgaatatcagcaacgaattttttgaccattcaaattttggatcatttttaactgattatgccggactttggctgttgccagcggacattgcgccaaaattgggtcaaaaatccaccaaattaacttttgttgtgccggatgaatgcatattcatgccgaacagaaccattgtgccgccactaaagtgccgcacttttaactttgaagcggttacacggcatggccgtgccaagagacgaatcaatccactcgtaagatttgtgttgagggaaatattttatttattttttggcatttcattatttggcactcgctattgcgttttcattgttggcatatttctttcttgcgcttcttagactctttattttttgtaaatattttttatttctcgaaaatgattttttgggtgtttttcttaggcatttttcaatggttggcactttgatttttatttgtctatttctttggcacttttttctgccttttttcccttgggtgcatttgctattcaattttttcttcttttacatttctccatatttggcactttttgggtctttttctttggcatttgctattaattttttttcttttacatttctcggcactttttatacatttttccctcccatcatttttcagatttacaatggcactaacacggagataaagcatttgccatggactgtgtattttgagggcattaaaccttttaatgccacagcaaatattctcgagtcgtgtactgcttcgttgatttcttcacaatttgtcctgttggcagcacattgtttaaaaggcgttaacaaaattaaattgggtaaaaattgaaaaaaaaaa

SEQ ID NO: 77263 - DNA, 931 bp, Heterodera glycines
  Genomic contig location: Contig_ID=SeqID_13378; Location=3032..3962; Strand=+
  SCN-specific regions: Sequence locations=1-127,149-277,333-419,441 -529,551-621,643-852,874-931
atgattgacattgaggaggaagaaccactgctagaaaagatggacaaagacggtgtaagaaaggtgccagaaaaaacgggtgcatcccaaaatctggccaccgaaatctcgccgatacaagatcaataaaaaacttcaaaaatagaaatgcaaaattctagcgattttcgaaaattatgatgaattactaattttttcaaaactttttcagaaaaatcgctagagaaatctttacaaaaaatttttcttgaaattttcttataaaaaattatcgaagattttttcttaaaattatcttacaaaaatgtttataaaattttaaatttaaaattcggcggcacggttttgttgcggcaatatttcggtcggaaaaatttcgtcccatctccgaaaaactctcttggcattttgtggaattttgaaaaattgaattttagatagaaagtcaaaagaccagccgcggcagagccaaattgccaaaagcaggacagaatggaccggtcagtatttttttttttggcattttgtaattaatttccattaaaaaatatcagtttgcaagcccacgaccaagagcaaaatcgagcgggccaaatgggccggtcagtgattgtttggcattatgaaaaatgattttttaaataggagactggtactctggtccgtaaaataactgctcctccaacacattctgatcaaacacaattatcatcacctcatcagtccaaacctcagcagctaaacaaccaatacagtaatccgaggaatgcggacagtacagtaatgcctaatgaggtaatgagcaaaaacatttttcattgaaaattcaaaaatggctaatttctgagttagtacttggctcttaatgttaaaggaatatcgttttcttcctgaacttgcctatctattattgttttgtatacatacaaaa

SEQ ID NO: 77264 - DNA, 2577 bp, Heterodera glycines
  Genomic contig location: Contig_ID=SeqID_13382; Location=2249..4825; Strand=-
  SCN-specific regions: Sequence locations=1-139,198-254,278-377,401 -416,439-623,645-824,849-1111,1184-1233,1262-1285,1358-1387,1418 -1471,1495-1733,1756-2324,2346-2420,2442-2443,2465-2577
  Gene Ontology: Mol. function=voltage-gated calcium channel activity; Cellular component=apical plasma membrane; Biological process =epithelial fluid transport
gacaatgtgatggacgcaatgatttcgctgtttgttgtgtccaccttcgagggctggcccgacctgctgtatgtggccatcaactccaacgaggagaaccgtggcccggtgcacaacgcgcgacagccggtgagtggacaattaattaattagttaattgtgggtggtcaattattagttaattaattgggtaattaggcaatgattagcaccaattaaaggtggccatcttcttcattgccttcattgtggtgattgccttcttcatgatgaacattttcgtcggttttgtcattgtcaccttccaaaatgagggcgaacgtgaatatgaaaactgcgagttggacaaaaaccagcggaaatgcatcggtagggagcaaaggaacaaaacaacaaaaaagttgtcgaataatcacaaacacattgttcaccattttgatcagaattaatcataactattctgatcattaaattatgataaaagcattctgatcaaactttttggtcaattagtcttgctcagattagcctgatcgaaccattttgatcgagtatatctctctgatcaatgaaatgtgaaaaatcactctgaccaaaccttttggtcacaaaatctatctgatcaatgaattgtgatcaagttagtcactctgattaaactttgataatctctgatcaataattcggaatttctatacccatttttccatcacagaatttgcgctcaaagcaaagccccaccgccgttacattccgcgcaaccgtttccaatacaggtggagcttttgtgccgcattttttgatgcattggcaccaattttggctaattttaaattaaatatttaaatgaaattgcttcctttgccagggtttggtggtttgtcacctcacaattctttgagtacgccattttcatcattatcagtgagttttatttttctcatttttgacaattttattttttgccgtttaagtgctgaacaccaccactttggcactgaagcattatccgcctggtgagcaaaggaatattgaaattattaaatttaattcatcaattattcaattaaatttcctcttataagaaatattaagtggggtcttattgtctggggatgtaactcagtggtagagtgctcgcttcgcatgcgagaagtccggggttcaactccctgcatctccaaaattttttttgcattttttggaaagcaattaaaactaattactctatcgttttaataaattttcaaattaaaattatgcaataaagacagatttattaattggggatgtaactcagtggtagagtgctcgcttcgcatgcgagaagtccggggttcaactccctgcatctccaaaaaatttttttgttaaaattaaatctagaacggaaatttttatttttaaatgttcatttgacccctgctgaccaagtcccgtcccgtttgagtccccacaaaattccaatcgctcattttttgtttaaattaaaaatccgtcaaattatattttgtgttgttcagaccccgaaatggacgtggtgctggacgtgctcaacttgatcttcaccggcgtgttcgccttcgaagcgctgttcaaaatcattgcgctaaatccgaaaaattatttcggcgaccgatggaattccttcgattttgtcattgtgctcggctcattcatcgacatcatttacggcaaaattggcggcaccggctcaaacattatttccatcaatttttgtcagttttaattttggaaaattgaaaaatgggggaggggagaagggacagagttgagccgactgatcagtcgcatattatcttaaaatcaaattggcaaaaatcgatgattaatttatccgatcgaattttggctgcgatcaaatttaaacgaacattccaaaaaggaaaattgtgattctgatcaaaaacaattctatttgatagagagttgagcttcaggtcagcgagagtctaaaggataagcggaatcagtgggaactgacgaaaattttcatttccaataattctgatcgaaaatgatcaatgtccccgcggtggtggcattttgggtttctaattaaaatttaagcgtgactaatctgatttaaatttccatttaattttaatggaattgatcggaaaattgtaatttcataatacaataagtctctgatcggaatgtgatcagaatccccccgtgacatttttggcatttttttaccaattaaagagtttcaattacatttttttcagtccgtctgttccgtgtgatgcgtttggtcaaactgttgagcagaggggaaggcattcgcacattgttgtggacatttatgaaatcctttcaggtgtgtccattggaatttgtccattttggcattttaaatttaaattttgaatttcaaaattgccccaggcccttccctacgtggccctgctcattgtgctgctgttcttcatttacgctgtgattggcatgcaagtgttcggcaaagtggcattggacgacgacacggaaatccatcggaacaacaatttccacacattccccgctgcggtgcttgtgctgttccggtag

SEQ ID NO: 77265 - DNA, 2999 bp, Heterodera glycines
  Genomic contig location: Contig_ID=SeqID_13383; Location=967..3965; Strand=-
  SCN-specific regions: Sequence locations=1-165,188-200,269-296,318 -367,397-492,516-537,574-694,830-977,999-1012,1034-1182,1220 -1285,1309-2230,2288-2388,2411-2420,2522-2809,2833-2999
  Gene Ontology: Mol. function=monooxygenase activity; Cellular component=extracellular space; Biological process=leukotriene metabolism
atgcgactttggatcggtgagtatttggtaattaactaatgcaataaaaacaagcattacaattaagaggcaaatttatacattaataatttttagggccaaagccaatcgtcattttctggaagcccgaatccgcaaaggccattttggaaagtgagtgccgacaaaataaaaatggaaatttaaattcatttgcccactttaaatttatttttttttaattttggtttttaaaaaagttcaaaaatattttattaaaatattttttctcgattttctcaggcaatgctctcatctccaaaccatttgaatacagcctattgcgagattggcttggcactgggctgttgacaaggcacacaattacaatattaattaaaattaaaataaattattctttttccattaacagtacgggcgaaaaatggcagcgaagacggaaattgttgacgccggcatttcactttaaaattcttgcaaatttcattcaggtaaaaattaaattaattttatttcattttcaatgctttcgctgtctaattaatttaaattaaaaaatatttaacaaaattaggtgttcaacagacattccaatgtgttggttgaattgttggatgaatgtgccaaaaatggatacccatttgacttttaccggatgatcaaactttatgcattggacattatatgtggtgacatttttttttaaatatatttttttttatcataattggcggtaaaaattaaatagatcattttttaattaaataataataactctataaagatataaagcacacattttttattatttaatttaatttttttaaatcatttttcagaggcggcaatgggcacgcaattggacgcgcaacgaggcggcaacccaaaatatgtggaggcggtcaaaaaaatgtgcgaactttcatttctgaggtattgtattttttttaaataaccctctaatttaagctattacctaatcttttgattaatttcagaatgcgttccccgtggctttggcctgcccctgtttggtggttgtccggaaaaggaggcgaatttaagcgcaatttgaaggcaattaccgagttcacccaaggggtcagtgcctcatatttcttttaattatgtgaattaaatcggattgcataaattgtctattttaactgaaatttgaaaaagaattttatcatataattaataacaaaaaataaataaagaaatgccggcataaaactagtcactaattattaggtcattgccagccgtaagcgtgaacgagctgtgcaacaacaacaaaaacagcgaaaacaacaggaaaatgatattaaaatgcagcaaaacggcgttcaaagccatcagcaaaatgacaccaccgtaatcagtcaaaatggaaacggtattgatgtcgatgtaaaaaccggaacaaagtcggcggccgcctgcttcttggacatactgttggacttacaggcaaatattatcgtaatacatgagaatatttgctaagattctaccgtttaaaattggcttaacgcaatttattacatattgtttgttaacaaagtttatgatatgcaacagggctatagcgtatttaggaacacaacaacttcagtgacgaggacatccgcgaagaggtggagacatttatgttcgaaggtcatgacactgttgcaagcaggtggaatttcaaatatccgcagtttaatttataaatttacccaaaaacaatatgaatcaaaattccaaaaatggttaaaaaaataactgcaaaaacggcctttttttgcaccgggacttcatattcaaagaaattttcttgaatgtaaatccatacaaaagtaagctttatatctcaaaaagtttgcttcaaaaatgtcaatttcttcgattaaatcaacatttaccgtactcacattaatttaagtgttggttttaccgtattttcgcttggacaccgtccgcaactacaggaacgactgcatacagaaatggataatttgtttggggaatgtgccgaaagggacataacttatgacgatttgccacggatgcgatacacggaacaggcaaatattacaatgagaaaattgacgtaattgacaataagtgtactttgagccagtgaaggcaaacgaaaaatttgaaatttgaagacatttaacaggctagcataaaattaaacttacgaatataaatctgtttggaaaatttataggtatttctgaatttttttttaaagtttaactaattattaagaaatcaatttaaattctaaaattttcgccctttttctcaaaaattgttcatcattaagtgcgttcgtgaaacaatgcgtcttcttccttccgttcccttaattggcaggttcatttctgtatatttaagtctatttttaaataatgtttttgagttgcattttaaaaaataatttaacccaaaaattgaatattttaaaataattttgaaaaattttaatttattttccttttatttttttaatatttaagaaatattactgaaacaacagaaatttgtggcttcaaaattccggccggttgcacagcgatggtcgcccccttctccattcacagggacaaaagagtaattttttgcgagtttcaaattccctacatatttaaattcgaatagcaattacagtattcaatttacagtattaccatgcaccggatgactacgatcctgaacacttttccgaggaaaatgtcctttggcgaaacaaagagccattcgcatatttaccattttctgccgggcctcgaaattgcataggtacaaaatactaggaaatttttaacaaaaaatgaaaatttttaggacaaaaatttgctggcactgagcagaaaatttccttggcgaaaatttttcgtcgctttcgagtgatttctgtccaacacgagcttgaaagtcgcggccttcctgagcttgtgctgaagccaagtgacggcttttggatcagaattgagcggagataa

SEQ ID NO: 77266 - DNA, 680 bp, Heterodera glycines
  Genomic contig location: Contig_ID=SeqID_13385; Location=407..1086; Strand=-
  SCN-specific regions: Sequence locations=1-66,96-565,587-654,676-680
atggcatttcttgcagaaacacgaattggaaatagccaagaaaagtcagcaactccaaatcgacaacagacaacggaagaagaagaagaacaagttgccgctgctcaacttcaacagcaatgtgccagtttcggccgatttgcttcagaacggattcagcggagggatcagtcggtgggtaaacaaaccgaaaataaatgactgacacaacgcttcaacggaagaagaatgagctacggacagtgctcgcattcttcgtcggccccgctgttctatgggcaagcgttgttaagtgaaagcgagtcggactttgcgtacgatctgagaaggacttcgacgccggctccgtgcaaatcgaaattaattgtggaaaagcctaagccagtccgcacttccgattgcttacggtggtgacaaaagtgctttagttatcggacgaccggccaaattcaaaaacaaagattcctgggcttcagccaatggttgcacccaaacagcgcaaatcacagtcgaaactgtcgagagaaacggctgctgctgctgcccaaaagaacgcagcgtcagcgaaggagaagcaacaacaacagagagtgaaagcggaagaggaggcgaagctgaaggatgaagtcgactcgtcacaagaaattgtgttgcttaaacgggaggaggaggaaatggta

SEQ ID NO: 77267 - DNA, 676 bp, Heterodera glycines
  Genomic contig location: Contig_ID=SeqID_13386; Location=1237..1912; Strand=+
  SCN-specific regions: Sequence locations=1-218,249-356,379-676
atggcgactctttcacgacaacaaaaatatggcgtgagtcattttgtttctcttaattggcttctttctttaaatgtcttggttgatttacattgttttgttgacagattttgtgagccactcaaaactatgtaaaacagccggcaaatgcttctaccctaccaaaaacattttttgttttttcaaaaaacagcggaggcagttgccccccatttttgaaaaaaaataatttttattttattttatttctaaaagtcatgaaaacatgtttccaagagtgttatgggtcgctgctcacaaatccgacacccatttcgaccaattccgaaccccgggcccgaattcgaacaaaatgttgaaaattcaaattttaaaaacgcaaaattacgccctccattttcattcactcttttgcagctgattttcctggtcggttggcttgccaacctgttcctgtgctgtttggttgcttttgtgcttgtccgtgcactgttcgctgttgctgaacctgaccattgggtgctcgtctccttttggacacacatttgcctcttcctcggcttcagcattgctttcctacttttcctgctgttcaacaattacacggacgtcatttttgccactgtttttacggagtgagttgtttcaaaattttatagttttttagttgctaaaa

SEQ ID NO: 77268 - DNA, 1394 bp, Heterodera glycines
  Genomic contig location: Contig_ID=SeqID_13387; Location=1066..2459; Strand=-
  SCN-specific regions: Sequence locations=1-784,807-1333,1355-1394
atggcaattccccagcacaaggacctcctcttcggaggaaaaactgtcatattcagcggtgactttaaacagtcactgccggtcgtgcctcacgaaggcctaactgcacaagttacggcctgctttcaaacctctccactgttttgtcaattcacgactatgaaattgacaataaaccagaggttgggccaaggacagcaagcgtacttgcaaatgtgccgccaaatcggcctcggagagaccggagaacacttctggattcctccgcagttcctcgtactgagcagggaagagttgatagactttgtctatcccgacttccaaagactccttggaaatgacaaggaactgctcaatcgtctgatcctcgcacctcacattgacacgtgcgatgagatcaacgaaattatgatggcgaacgtgcctggtcaagtgcgcgaatatttgtcctcggacaaaccgcttgacgagcggccactggacatcgatgaaatcgagttagaagtggcagcgttgaaccgacgcacagactctgggatgcctccccaccgtctgcgactcaaggtcggaagcgtcgttgtcctccttattaacaaaagcgataaggaaggactgatcaacggcactcgcatcgttcttgaagatccgttctctcacccccccccccccctccttctccgcctagcccacccattttcaattggaaatgccgaaatttgctctctccatctcatctcttccaccccgaaactcaagattatcccattccttttaacttttaatctttcagtttttgttttcctttccccgccgaatgtccatcccacgccgtcctccgccaattgtcgccgcttttgcaattgtgccgatggcactgttcggctccgccagcagtgccacccaacaaaatcatttagactattcgtccgcttcttcgccgtgtccgtcccatcccttcgctttcgaatgccgtcactccgcctgctgtgcctcctaccaccagcggtttctgatgcttctcttctccttggccatttttgcgtttgcgcttctcgtcctaatcatttggttggccatcgaatggcgcccccggcggtggcggaggtaaaaaatcagcggaaaatgccaaaaagaaagagcaagtttattcagaagccatcgcaatgggaagcgaatgtccgaagttgaaatcagaagcagcgaagagacgcgctatttgagacgaatgtccgaattgaagtgagtgaatttggtggaaattcccaacaaaggcaaaattggcattgtaaaatgttggcaccggggtactgtatttaccatttaccgtaagcataaaaacaaaacaaattttcaatttcagtccaaacgccagaagagaaattgtggacggataa

SEQ ID NO: 77269 - DNA, 1348 bp, Heterodera glycines
  Genomic contig location: Contig_ID=SeqID_13388; Location=137..1484; Strand=-
  SCN-specific regions: Sequence locations=1-701,724-1099,1129-1348
gtgctcaatttctgttcctccgtctcccgttgtgccatcaattctcatccgtcgttggacgaccctttcgccgtccaattagccgtcgcccattcgcaaaagccttttgtacacattggaacggtcgcagacgccgaatttgtcggtgatcgaaaggtatacagaacgacaatttatcaaattatataaatccttttcaattcgaaaggtctcgactatcggacgtgtcgtcaaaatgtctttcagtgggcattgtttgtgttattcaacggactccggagcattttatgtgcaaaatctgcaggcaaagagtggcggagcactcaaactgttcgatggggcgaccgacggacacgcaatttgtacctttggaatggtaaagaattgaggaaatgggaggctatgaataaatgaaccatccacataaaacattattcttttcaggaagaattcgctcttagcggtgtccatgagttggtggtgttcgtcaatatgcacggcgtttcctcccggccgcccatttccgtgagtggtcggagtcgaattgtcgggctttctctgaaggagccgtttctgcatgtgttaagcgaagatggctccgtgtatattttcaggtggaaatattattataataacagaagttttaagattattttctatgatttcttcccaattcccccctctttcagtaccgtcgatgcccatttggtccaatcgctcgcttttccaaccgatgaagttcaagaggtgcggcaaaacatttgcggccgatcacctgcgccgatcacttgccaattggagaacattgacggcgttattctgatcgcatcacccggcgactcggcactgtacgaactcgtccccgtctctgtcgttgtgcaagtgaatttattgccgatggaaaatgacgaatgcttcgctaacaataaattcataacagattgaagaacaaattcaactcggaaatttggacagtgccctttctatgcttggcaaaagtgcggctttttgtttgaatgacgtggaaattgttgtccgttatttattttgtcgtatttcttttttaaatttcacttttttaaggaattaaatcatctgcgcaagaagttggcctttctcctcctccaaaatgccaatttctccgatggcattgcccttttgtcgtccattgatggcactgactgtgccctcacatttctttcattggttgtcaaccagcggccacaacttggcatggaccccgtcacacaaaatggtcaaagtcaagttccgatcgatggtacttttccggagattccattagagtttgtcaaacagtatttggaggagacaatccgccaaagagacg

SEQ ID NO: 77270 - DNA, 3418 bp, Heterodera glycines
  Genomic contig location: Contig_ID=SeqID_13391; Location=238..3655; Strand=+
  SCN-specific regions: Sequence locations=1-129,152-152,174-217,239 -459,505-820,860-900,922-967,990-1003,1026-1089,1118-1147,1174 -1478,1501-1936,2020-2164,2189-2472,2494-2595,2625-2839,2880 -3062,3086-3122,3163-3304,3339-3418
  Gene Ontology: Mol. function=carboxy-lyase activity; Biological process=dopamine biosynthesis from tyrosine
aacggaatgaactcaaccgaatttcggcattacgggcgcaaaatggtcgattatgttgcggattatttggagaccattgaaaagcgaagggtgagaagcattttgtgtgttgcaaatgcttttttctccagttattgcatttttacaaatttaattaatttaacaggttttccccgccatcgaaccgggctatttgcgcaaattgcttcccatggatccgcccattcaaccggagaattttgaccaaattctgcaagacaccgaatcgtacattatgcccggagtaagaaaaattcataatcacgagaccgcaattgttgagagactgtaatttcgtagaataaaattttttcaaaatatatgaaaattttgggaaaacccaaaaaaatatatagtttttgaaaaataactcaataaaaatggctgcttcttttcaaattaaaagaattatttttggtctttattaaaaaaaaatctatttttgaaaaaaattcatttttttatggaaaaacattgcgctaattaatcgatgctttacttcctttaaggtgacgcattggcagcatccccgcttccacgcttatttcccagccggcaattccttcccatcaattatggctgacatgctctctgacggcatcggatgcatgggcttttcatgggtaagatccagtatggaatttcggcgtatggattgggtaatagggattggctttatcgggctcaaaaggtcggtgggtgttgaagttggccaaatcggtcggagtttggagggtttcaatttttgccttatgccatacggtaacatgaagtttggggctataatattaatttttaaaattgaaaaattaaaaaataagtaaataccctgtgatttttacatccttaaataacccaagctgtgcttaaaaatcttaaacagactgagccttgaaatgtacaaaaaattacataagtatgacattgaaacataaattgtaatgcatccagcaaaataagcatgtttaattaagtggctaattcgttaaaaaatttaagattacgaaaatttcgacacagcgaaaatatttcaagcagaatttttgatggataaaaatatatttaagaaaattactattcgccttacatttgggaggcaaaaaagatgaaaaaaaattttaaattaaaaattttgcgattttgtccaattttctgtgccccttttaaggctgcttgcccggcgctgactgaattggaaactcatatgctccaatggtttggccaaatgcttggacttcccgccttctttttgccgtattccaaaaattccatcggtggcggtgtgattcaggtgtttttggtcccgtttctcagatgccaaaattattaaaatctggcaataattaattaattatccacagacctcagcgtccgaggccattttggacgcattgttggcggcacgctttgacaaattgaagcagctcaaggaagaatcaaataaaacagagggagagctgctagacaaactgattgcctactgttctaaagaggtgtgttgtgccaaggggtgcactaattatcacgccgtcccgccccccccccccgccctgaaaatctatttgatccgaccagtccgacaaatgttttttttagagttgtacgggaccagaaattttggcaaaaacatgggacccgaactagaaaaggcttgatcaggatagagacctggatttttgaccggtaccaatgggtagtttttccaaaaaccgggaaaaaaattcaaaatattttttttccatgtttaaaaacaaaatatacccgtttgtcttaatttaaaaaaaaacaacaaaaaacaatgacaaaaatgcctaataaagtcatataaaacgacttttctgccgcattattatttttttaattttgcactaaaaatacttctttttttatatgctggatttaaaatattaaacctaaaaatacataatttaaaattaaaaaaaaatatatgtattaacaaagagaaaaataattaaaatagttttgtttatgaagcgaatttaaccaaggcgaaagcattattaaagcattttgtcatggaaacggtgtgcggagggacaagcttttacgtgtattggatttttcaaaattttgccaaaaaaatctcaaaagcggattagctttaggaaataatttttatttttccattaaggcccattcatcggtggaaaaggctgcaaagatttcgatggtcagagtgcgcctattggaaaccgactcacgccttcgcttgaggggcgaaactttgcaaaaggcactggacgtgagttggatgttaattcgggaaacgttaaggctttcacttgagttcgtatgggtttttggcgttgccatttaagcgacgccattttggtgttcaatttggacgttatctttaaaattgaagaattattttatataaatcttagaaaagctttcattttgaggaaaatgctaattttattaccctttttcaattttttttgtttgttgtcattttatgacttttatttgaataattgcatgtcccaaaatcctttctctaacggttagagtctaaccgtataaaattgtgtgataaataaattataatattttaataatttctaatgaggcaattaacgttaaaacatttgtcaacgaccatttctgctctttagaaagatcgcaaaaaaggtttaatcccgttcttcgtctcaataacacttggcacgacttcctgctgctcatttgatgtgctctcggaaattggaccggtcgccacaaaaaacaacatttggctccatgttgacgctgcatacggtaggtggtggggggaatatggtaacggagaatatgattttcaaaaattttattttaagctggttctgcgatgatatgccccgaatttcggtaggtttttttgttgttttactttgtaccatttgcagtgggcaacgatagctcattacctcaaagcaaaaaaaaaaatttatggaaaaatctgaaaggctgtattgaaaatttctgcaaatcttccaacggtgtcaaaaaggccttgcaaaattttcccaaaattcatgttttaaattagaaattaacatagcctatcggaattcccttactttatttttttcataaatcttttttttaaataaaatttttctgtctcaatttctagccccattccggtcccccatggatacggtggtggacggcacatcaccttgaatcacggcacttaatacattaattaatttagctatttaatggaaggcattgaacatgcgatgtcgttcaacacgaatccaaacaagtggggcattaaataaaaactgaatttaatagcaaaaacttatatttttttcatcatttcctcagatggatgcttatcgcctttgattgttcggccatgtggttg

SEQ ID NO: 77271 - DNA, 492 bp, Heterodera glycines
  Genomic contig location: Contig_ID=SeqID_13391; Location=2133..2624; Strand=-
  SCN-specific regions: Sequence locations=1-199,224-368,452-492
atggcgtcgcttaaatggcaacgccaaaaacccatacgaactcaagtgaaagccttaacgtttcccgaattaacatccaactcacgtccagtgccttttgcaaagtttcgcccctcaagcgaaggcgtgagtcggtttccaataggcgcactctgaccatcgaaatctttgcagccttttccaccgatgaatgggccttaatggaaaaataaaaattatttcctaaagctaatccgcttttgagatttttttggcaaaattttgaaaaatccaatacacgtaaaagcttgtccctccgcacaccgtttccatgacaaaatgctttaataatgctttcgccttggttaaattcgcttcataaacaaaactattttaattatttttctctttgttaatacatatatttttttttaattttaaattatgtatttttaggtttaatattttaaatccagcatataaaaaaagaagtatttttagtgcaaaattaaa

SEQ ID NO: 77272 - DNA, 1491 bp, Heterodera glycines
  Genomic contig location: Contig_ID=SeqID_2000; Location=4..1494; Strand=+
  SCN-specific regions: Sequence locations=1-109,131-586,617-893,915 -1491
  Gene Ontology: Mol. function=Xaa-Pro aminopeptidase activity; Biological process=proteolysis and peptidolysis
gtcctcccgctcgacgagttcgacgcgtacatggcgggcacagttcgcaacggactgctcgccttggatttgccttcgatggccgatcacgctgccgatgcgcctgcacaaatgaagaaaatgtggaaaatgttgtcggacggcgtgtggacgcacgtctcactcaatgagcacgtggacacattgcggtggcgcaaatcagagacggaaaaggcgatgatgcgacggacatgcgcagtgggaggggaggcactgaacgcgatggtccggtgagaacggacggaccgaacaccttgctgacgaaatgctttaaaattgacggaaatttcaaattaaatagttgccgttaggggtaaattattgcagagcacggctaaggattgtggggatattggagaggagaggatctcctccccattggaacgcgtatcccgggaccaccttataataaacatggcttttccatccatcggggtcagtcatcattcccatagctaacccttttcataaagtggccgataagacaagctcaaaatttcaccgccataaatctaaaaaaacttatttgttaaaaaattttcaagagaaaattatttaaatattaaatgaataatttgcattttcctgtttttctttgaaccatatatttcccatcttttagggaatgtcgtaaagcaacaaatgaatctcatgtaatgcaaaagttgcccaccaaacagtgctattcctgccaccctttcctcagattgtcggcttcctcgagttcgagtgccgtcgacgtggtgccaacttcctcgcctatccccccgtcgttgccggtggttcaaatgcgaataccatccattacattgactcgaacatggtctcatttgcagcaatgtgtgtccctttttataatgtttttgtgtgtttaaagccgatcagacccaacgattgcgtgttggtcgatgccggatgcgactttggcgggtacgtatcggacatcacgcgctgttttcccgtctctggcactttttcggccacacagaaaacactgtacgacgctctctgtcatgtgcagcaacaattgctccattttgtgcagaacactcgtccactacgactgaatgaagcaagttttgtaatatttgctgacacttggaagccaaagcccatttatctcgtaaattgagcctggattctcattctcttgattgagtctttttttatttgtccttttcgatttcgttttccttttttgtgtccatacatttcgcgctgttcattttagctttacgcgttcatgttggcaaggatggccaatgcgttgagttcgattgtgttcttcaaaagggacggactcagtgaggacgaactcatcgccgttggttggggaagggggggaggccaaaaggccacaatgaaaagaatctgtgccattccaaaggaatgtgacaaactgtgcccccatcacgtgtcccattggctcggattggatgtgcacgacacgtc

SEQ ID NO: 77273 - DNA, 1830 bp, Heterodera glycines
  Genomic contig location: Contig_ID=SeqID_2001; Location=709..2538; Strand=+
  SCN-specific regions: Sequence locations=1-131,160-786,808-826,879 -1117,1139-1275,1307-1352,1375-1428,1450-1512,1534-1784,1811-1830
atgtgttctggaataccggaaggcacttatgaattgaaaattggcgctagttttctctgctcaaacaaatcgcgcccacccgaatttaacacattgcgttgtgagttgggtgaaacgcatttactttccgtttttatatgttaattataattaatgcaaggtgcaaaatcgttgatttgcccccatctccccctaaattttttgttgtaaaagttttttaaaaggtcatggcgggtttaattgataaacagctcagttttactgggtgtcttttcccaaaagccgagtcattcccgacgaaccctccctaacgtcccttttccgtccgttttctatcattcctttatttaagttgacttcaaaccagcttcaatttcctccgaggcctcggaagcgtacgtcgttcagtcgcagaatcaaaatgagaacaatttccaggtttttcaacggaattcatcccattaaatgcttttccattttctcaggtcgttgtgtttggagaggcgcagaaaaagaccattttcaaaggggcgaagaaggaaatcaaaggggacaaggagtgtttgttggtgtacaacagaaagagcaaggagttgtgcttggagagagtgtcggccaacataaatgtgaagaagacgaggtgacaaagcacgagggaaatggaccgaaattggggaaaatagcgacgatttgagtaaaatttaaaaaacgagtcacgattatacaaaagttgactccaactgggggaaagaaaaacaaaacaaaaaaaaaaataataagaattacgtttctgcgttttctcacaactatcagtgcatttttcgttttgtgatccctcttttccagaaatttaacataaatgaaaaaatgacattttcagggacaccgatttggaccaaaaggcaatcagcgaaatcgaacggctgcaaaagcgtaggaggccaaagcaatctccgccatcgccaaaggctcccgtcgaaaatgccacggcagtcgaaccgccggcggagcagcgcaaagagcgcacattttccacttcttcggcaggggacgaaattgacgaggacgacgaagagaatgtgtcggcattggaacagctaatggtgggaaaaaggcgaaggaaaagcatttttattggaattggaaaagcaaaattaagtcatttgaaagttttagaaaaagcgagttaatgcactttctaaagatgttgtttaatacgtttccaccggaaaatttctaaatctcgaaacttttcaagacaaattagaagatttctttatatatatgaaaaatttatttattttttcgataaatacaaaccttaacaattcatcatagaatttgaaaaattattaaaaagttttgttttttcttcaagaaattatatgtttaattaattttttccgtgagaaaatggcgggcgaggggaaacaaactgcttccttctaaagcaactggaaaatcattttctaaattttaaaaattgaattcgaagccgtcgttcaatgattcaaaaaaaatttttttttttttgttaaggcgccaacgaaagtcgaacgatcggaggcggaggaggacatctttcacccagcacaacaacggccaaaaatggagctgaaaacggaggaacaccaaaatcaaatggaggaaagtgccaacggaacgacggaaagggaggagaaacaatcgccacaacagaaacatccgatggcggtgaagaagacgtcgtcattcgtacggaaaagcattttggcggaagatttgcagctgagcgagagcagttcggaggatgaggaggaaggagggagggacagcgaagacacggactga

SEQ ID NO: 77274 - DNA, 257 bp, Heterodera glycines
  Genomic contig location: Contig_ID=SeqID_2001; Location=2434..2690; Strand=-
  SCN-specific regions: Sequence locations=1-172,199-257
tgcatcttcatcatttataccgtatataatttaagcatccattttggcttataacagcagcatcaattataagtgtttaagagcatcccgtgagtgcagttttatggacatttaaaaggctccggtcagtcagtgatcattctctcctccgatcagtccgtgtcttcgctgtccctccctccttcctcctcatcctccgaactgctctcgctcagctgcaaatcttccgccaaaatgcttttccgtacgaatgacga

SEQ ID NO: 77275 - DNA, 836 bp, Heterodera glycines
  Genomic contig location: Contig_ID=SeqID_2003; Location=273..1108; Strand=+
  SCN-specific regions: Sequence locations=1-166,188-650,673-836
ccgccactttgccttttggtcagtccaaacgtcgcgctgtgctgctcgaagttcgcaaaggggcggacatggcgacgccatcagcagcagaaaatggcacggcccattgtcagtcgccgcacaaagagaaagtgatcatcggcaacagaacgacgccggacggagcggcggagggggaaaaagcaacgcaaagagcaggtgaagcagggaaatggcacaaatggggagccaaaacacggggcaacggggcaaaagggttggcccggggtaattattgaggaaatcggaacttaaccccccccccccccccctcacgtgtataattcggtggcaaataaaacacttcccccggggcattctccgttcattccttcctcccctccgtattttttggttttcccctgtcctttttggctgcctcttcccccttcccaccgttttcacatttatttccatgaactcaattccatcattcagtttacgaccagcatttcctcctgtctcaaactcagccgagcacttccggcactgtcattccgttggcgccgtccgcggacactgaacatcctccaaacatccacctcaaacagcagcaaccacattttgctgcttccgtttggcatccgtcgcatggccaagaggctgggcccggctcgccctctgtgtctgtgttcatcgccttggccaaagagggacggcgcagatggtggcactgctggcgcagcggctgcgaagagcggcggagacagcgacggcacgagggaaatggcattggcaccgctgctgctgatcagtcagtcgctgcacactttgccaaattcggcgattgcttttga

SEQ ID NO: 77276 - DNA, 358 bp, Heterodera glycines
  Genomic contig location: Contig_ID=SeqID_2004; Location=530..887; Strand=-
  SCN-specific regions: Sequence locations=1-43,67-229,252-358
atgaatgccaacggaaacgccgagaaaagcgtcgagaacggacagagagaaaatgaagaggaaaaagtgacggtaattgcgcagcccaatgcaattgccaacccagggactaatgggggaaagtaaaaggaattggaatccgaaaaagcgaaagtgccaaccaatggtggtcaaagttgagcacacaattgtcacagatggagcaatgcctggggaaaaagccattgtatttatttgttaaaatggtaaaagaatgaatgccttttgaccattttgagacaacgttttggcatttaacaaaaactacgcatttccattgaattttcagatttgttaattctctaaatgagtcaataaa

SEQ ID NO: 77277 - DNA, 1880 bp, Heterodera glycines
  misc_feature (114)..(116): n is a, c, g, or t
  misc_feature (1555)..(1555): n is a, c, g, or t
  misc_feature (1619)..(1619): n is a, c, g, or t
  Genomic contig location: Contig_ID=SeqID_2004; Location=1..1880; Strand=+
  SCN-specific regions: Sequence locations=1-273,295-460,485-636,659 -821,845-1044,1067-1290,1312-1435,1472-1780,1802-1880
  Gene Ontology: Mol. function=palmitoyltransferase activity; Cellular component=integral to endoplasmic reticulum membrane; Biological process=protein-membrane targeting
aattttggcattttctcccaatttgtccgataaaagtgagtgttttcgccccctctcttttcagtcttccctttctgagtgaactcgtgtcgttgctcatcccagccgcaggcnnnggggggttcctcttcgtcatggccacccttttcaagacggccttcgtccgacccgggcattgttccgcgcgcctccccccgcgaagtgctcgagtgggaaaggcagtgccaagagacgggtgaattcgatggcacccaatttccccccccccccccgattttcgggttttcttttccctaattaattaattgcccatttcatttgtctcccccttttttcgattccccctttttcgggttttccttcatttattcccctctccctcctgttagatccctatttcaacgcggacgaatgggcccagccgcgcacccgcgtagtgaacatccgcggccagccggtcaagctcaagtactgcttcacctgctgcattttccgaccgcctcgctcatcgtaattttattttcaacattttattgactcatttagagaattaacaaatctgaaaattcaatggaaatgcgtagtttttgttaaatgccaaaacgttgtctcaaaatggtcaaaaggcattcattcttttaccattttaacaaataaatacaatggctttttccccaggcattgctccatctgtgacaattgtgtgctcaactttgaccaccattggttggcactttcgctttttcggattccaattccttttactttcccccattagtccctgggttggcaattgcattgggctgcgcaattaccgtcactttttcctcttcattttctctctgtccgttctcgacgcttttctcggcgtttccgttggcattcatctttatttatgtgagtgatcaattaatcaattttaatgttaattagcatataaattttcctgttttcagtaagtctcgaaaagggttctttcgtcgaagcggtgaaactttcgccggcttccattttgacaggtcaatcaatggaagggacagattcatttgtttatttgttattatttgcatttccactaataataaacaattaagccttcctccaatttaatgatggacttgcagttctatggccagttaattgaacgggttcccgtcctcattttttacttcgagttttaaattgatcttaataccgattgtgaaaatgcaaccgcaaaaatcaaatgatatgacccttttgaatccaatatttcccggactgttttggcacaatcctctccctccatccattttttgccttttctgtttattatacccccccccccccccctccttttgggggacgggacaaaatctcgccgcagaaatttcaaaaatttttttttcaaacataaatttttcaaggaaaaaattcttagaagtttttaataaggaaaaatttaaagaaaaaatttttttaagaatttttaggcaatttttttgaaatttaatgataaattactgttttttcaaaaaaaaacttctttgcaggtctgatcaacatcatctccatntggtccgtgctcggcctgtccggcttccacacttatctgatcgcacttggccaaaccaccaacngaggacatcaaagggacattcaatcgcaaattgcacccgcaggtgaagaatccgtacagcagcggaaattgcgtcaaaaatctcatcgccacactttgcgcgccggagaggccgaggtgagagagaattacaatcgcattaaactcacaattaaagttgaatttcaaaaattcactttttcctttccttttcagtttgctcgaccgtcgcggttggcttccccccgaaaatttgggcccgacaatttacgtggatggtgcc

SEQ ID NO: 77278 - DNA, 715 bp, Heterodera glycines
  Genomic contig location: Contig_ID=SeqID_13392; Location=152..866; Strand=-
  SCN-specific regions: Sequence locations=1-1,23-373,395-501,527 -552,581-715
atgccgttggtttggcttttgcgacgggtgtttcttttcgttgccattcgccttctccgactatggagcttcttctggcacggtgatcatcagcggtttgttctttatacataattaatgctaatggtcaaatgattcgttctaattattcactaaaattaattgtctggcggcgttccaaaagtagtaaattaatgaagtgaacaaagagtgcaaatggacaaaatgtccccaacttcttttatttaatagaccatatgcaaatcaatcgcctgaagcttaattgttttgtaacatttccggaatatgtttagtgccctaattgatctgggcacggacacttgcggaccaaaaatttaaatgatcagaccaaaatttaaaattttctaaattggcacaaagattattttaaatgattgactattacgaaaaaagactttttgatccgtgaacgtaccccacaccgaatgcatcagttggatactgaatttaattaaaggctataaatatttatttttaaaattttcagaaaattgcgcagcctcaaaaaaagataatctttttcaaaaacaatgctttttagaaatctttaagaaccatgaaagcctttcaactgcgaacacatcggcggacaaaactcaacagattggaagcggagattaaaattaaaaagcgaatcggcggacaaattaacggatcattcggtgctaataaa

SEQ ID NO: 77279 - DNA, 157 bp, Heterodera glycines
  Genomic contig location: Contig_ID=SeqID_13392; Location=2802..2958; Strand=-
  SCN-specific regions: Sequence locations=1-89,122-157
ctggcattttggacccacccaccggtttggagctgtacttgctggcaatgctgttggttgcactttgctccatcctcttcactttggcattgttgtgctgctgctgttgttgctgctgtggacggcacaaaccgaagtgccgtcaatgctatcagca

SEQ ID NO: 77280 - DNA, 182 bp, Heterodera glycines
  Genomic contig location: Contig_ID=SeqID_13393; Location=742..923; Strand=-
  SCN-specific regions: Sequence locations=1-182
cgaagttgccaatcctgcgcttggctggctcttttttctgatcagtttcgccgcttcaccacctgcggttgtcgagaatggcacttcggcacgcatcctttcgtcaaatgccgttgcatcggcaaacaaaaacagcgtaaagccaccgccgttagatttttcgctgatcaaactgcgtaagg

SEQ ID NO: 77281 - DNA, 726 bp, Heterodera glycines
  Genomic contig location: Contig_ID=SeqID_13394; Location=673..1398; Strand=+
  SCN-specific regions: Sequence locations=1-200,229-726
atgacaactgatacaattaacaccattctcaaccgtttcaacgacgtggcacaaagcaagaaacaggatggagtgacgctttggggcgaaccgtttaccgtgaccatgaccacagtcaaccgaaacggactgcccgagaaacgacaactgaaaggaggagcagcgcgcaaattaacacacgtccaccaccaaattcattcaattaaaaataattttatttttaaaaaacatagatacaaaactttgatggagataactactgtctattcttggcaatgcaagcaacaatgattcgtactctcggtggtctggcacgtcaacgattttatgactacatgaatggaaaccattgtttccatggaaagctgaaaactgaagctcgggaaatgatgaatgccgtcaatgcaccgccaaatctgccaaattatgatgccgaaactctatttcatttatactatttaattaaatatgtacattaggcattagtctgaatatttattgaattaaatcacaataattaatcaacaaaaacaagatttaaatatcatatgtttcactgatttaaaaaaataatacattggcaaattgtataaatcgttaaggagcttaaaaagcgaccaattgtaaagaaagtttagaaacgcaatgatttatattagggtatcgataatttgtgaaaatgggcgtcgaaaaagcaattgtttcatgataaacagaaaacatcaa

SEQ ID NO: 77282 - DNA, 560 bp, Heterodera glycines
  Genomic contig location: Contig_ID=SeqID_13397; Location=644..1203; Strand=-
  SCN-specific regions: Sequence locations=1-347,370-560
atgagcgcattatggtcgcttgtcgggcttctgtggcagggcatcacaaaaatgcgacgttctgtggaagcatatgaagtgagtgatcgccgcaacgcgtagccccaacaaaatcgcgtccaaatttgctttttagtcgaaaatccgatggattttttgatcgagttgaaattaagtttttgtcgtggttgagtttttgtgttcgcgtagtatcaaaacgcatttaccaaccattgtgtcgcttaattgtttttgtttttaagcgcttggcctttttcaatgccttcttttatgccttctactggtgtttgtatgctgtgctctcattcaatttgctgttctattggacggacttatggacttgcgtcaacttccaagcggatcacacaatggtgccgttgaccattttggtgaattttgttttttgtcatttggttttgcgcagcattttccttcttttaggtgttcagcattgtcctgatgtgtttgtacgcgaaagagttttttctccgaaaacccgcgtggatccatcgaatcaacttacaattacgcagaaacgg

SEQ ID NO: 77283 - DNA, 193 bp, Heterodera glycines
  Genomic contig location: Contig_ID=SeqID_13398; Location=505..697; Strand=-
  SCN-specific regions: Sequence locations=1-193
caggttggcttttcttctacaacatccagcgcagctacggactgttcgattggcccgagaaaatcaccgccgtttttcccctgggctatgtctgattcggatgaaaaaaaacaatttttttttcatttttattgtatatggaattttccaaaatactgaaaattggctgcaaagcaaaaagggcaatgataaa

SEQ ID NO: 77284 - DNA, 342 bp, Heterodera glycines
  Genomic contig location: Contig_ID=SeqID_13399; Location=1190..1531; Strand=+
  SCN-specific regions: Sequence locations=1-158,183-342
atgaaaatatatttgctccttttactttatgcctcttcacaatttgttatttcaaactctaaaaagaatgaaatggccaaaaaaattggtcctctcaaaatggacaattcgaattccattaaaaaggttgtaaccaaaaattaaagtaaaaatggaccaattaaaaaatttattaaattataggcatttgaaggaaaggaaaagccgaatggtgtcgaagagtgtaaattgatcaaaagtttggaagatattgtgattacggaactgatcagcgaagaattggaccaatttgctgcgggaaacgagaacgacacaatttagcgacaaaaagtgcaaatttaa

SEQ ID NO: 77285 - DNA, 658 bp, Heterodera glycines
  Genomic contig location: Contig_ID=SeqID_13399; Location=1770..2427; Strand=+
  SCN-specific regions: Sequence locations=1-74,123-179,208-359,407 -480,502-521,545-658
atggattggtccaacggacggtggcaagcagtatggctggttgtctccgaggagggcaaagagctaaggtgatcaatttaaaaaatttattattttaaataatcatatattaaaaaatatttcaatttcgttaaaattttctattgcacgaatacattcttaccaaaagtatagtaccgttttttacttattttttataaattttaagtaagaaattcgcaaagaaacattttaaaaaactaatctacaaattaaaatgaatatttgaattaaaaagtcttattaagattaacaaatgatttatttagcactaatggcataacaaaagaggttagggaacattaatttgcctgtgcaaattttaatgtttaaaaaatgactcatagtggtcagtttttagacgaaatgccgtcagcaaatgtcaatcatttctttaaataacacaaaattggattaagaataaacagaaattttcttaacattgcaatttttgaccattttcgaagtttattcaatgtaccataaaataataaaaagaaaatccaatgggttatttttcgaatttaatttgttattattttcagattcctgttcccaacaaattcacttatttactactactcttaccttcaaattattgtatgttaaattcaaataa

SEQ ID NO: 77286 - DNA, 1174 bp, Heterodera glycines
  Genomic contig location: Contig_ID=SeqID_13399; Location=2494..3667; Strand=+
  SCN-specific regions: Sequence locations=1-635,657-669,691-711,733 -1150,1172-1174
atgacttgggaatggtcttccaagtgcttcatcaaaatagagcctgaaccgatcacgcttaacccggttgttgttaatgcttgccaaggagaaaagaaatttgattttgaaaacattcctttgcctgtgccagaaggaatcagagaattttcgcgaattcaagtcaggttaaaaatcagataatatgatttggtcaaatttcacattgcttacagttgtcttgacgaaaatgttatacgtttccttggccaaatcaaataccttttcaaagaggggataattcttgagttggaaaatgttcatcaaattatgcctagcattttcgctgcaatttggccaatcattaaagaagacctttacgcgcttagcgttgactatcatgggcttaattttatgcgacagtgcatctccaatacagtactcacttcatgcccaaaacttcgttggattgaagcaagcaatgtttttccccagttgccggacgacgacgacagtgccgaaacagctgaaaatgcccttcgggattggcttcatctgccattatctgatcctgctaagccgaaaattcttcaatgccgtacaaacgaccaagaagagttaaaaattgaggaaacagcggacatacaaacggtcctttaatgatttttaattaatattcgtttgttcggctttaaattaaaatttaaaattcaagaaaaagttgtaaaatcaaataaatgatatttgctttttatgtacatatttttttagaaattcaacaatgccgatactcgatcttcatacattttgggccttgcaaatccattaattgagcaaaacgaacacgaaaatcttactgagattcgcaatggcattagcgaatgcatgcaatttgaactcaaggtgaatggagacgacgaccgagataattggtttttgttgtcaggccgtacacttgacaccgacaacgattggagttcgttttacgatgaagcaactagcgagctgacgaaaaaaagaaatgttgtctgcattaagattgtcaacgaacaggcatgataatggtaataattagggcttccctttttaggcaaatttgctgattttggaccttttgtgcttaatccctcattttatacctttttcaccatttttggtgactatttcatgattttcggaaaacttttaaaataca

SEQ ID NO: 77287 - DNA, 633 bp, Heterodera glycines
  Genomic contig location: Contig_ID=SeqID_13399; Location=3852..4484; Strand=-
  SCN-specific regions: Sequence locations=1-485,527-633
atgactggtctgaagttaaatgaattatacgaattgatgcaaatgacttctccgtccattcttcgggagtgtgccaatctcagaatcgtcgggtgtgacaatacttttcccgagagtccgtcctacgatggtcccggggcatcacaaaaccaggcattgtccaagtggcttcacaccccgcgcgacgatgagcgccccaaaatgctcaaatgttattatctttacaatatcgaaaggcaattggaagacttaaaaatggtattgaaatttccaaaatttaccgtatattattgggtttttaggcatttttaaatgccaaatcgcccgtcagttatgtcatctatttgaactttgatttttcgcttaatttcactctttttttattgatcctacccatttgtctattgtcccattaaatggcacccattaaacagtcattttccgtcttctccatcactctccgccacttttcaaaaagtactaccaaataaattttattttttgtataattttaagataaatatttgcgatacatatatcacaaacagaacagaataggaagatacagtatacgaagtaacgtaatttccgcgccatcagcttacaacaacgatctgaaaatggtaaaataaa

SEQ ID NO: 77288 - DNA, 696 bp, Heterodera glycines
  Genomic contig location: Contig_ID=SeqID_13401; Location=363..1058; Strand=-
  SCN-specific regions: Sequence locations=1-376,398-521,544-696
atgatcgacagattgatcgacgaaatttcactgagcgtcgagcaatttatgacaaggtgagctggcacaaagtttatgccaaatattgtgcaatttttatttaccaaaatttttgcttccttttttctggtaaatactcgaccaatttgaaaaatattttagtagtgatgcagcatttgaagaaatgggatagatcatctaaaagttcatgctttaattagtataggaagaaaactacagcttttcccttacagcatgcttttctttttaagagtttgtgtaatttttcgagttaaaaaactgaattaatgtatttggaaccagcttaattcagtccattttaatcctttataattataatatgttgctgcaaatcctaattttttaaaaatactgtgtcaatgatacattttcccggcatccaaacacaatcagcaattttttgcacagaaaaatgcctttccatgcttcccgcacgtgccaccaccgccaaccattctcgagttccgactgatgaacgatgagcccacaagtccgagaccatgcgcggtaatgaattggagttaaatgtgccagttccatctggacactccgtcttttccaagtccaaaattccataatattttattagattgtacaatcgatcgcttagtttagcgaaagttttcagatggaaccggtctttgtaataataaa

SEQ ID NO: 77289 - DNA, 75 bp, Heterodera glycines
  Genomic contig location: Contig_ID=SeqID_13401; Location=1..75; Strand=-
  SCN-specific regions: Sequence locations=1-75
gtcacttcggcaacatcttcacatattttgaatgttatttagcctatctcaatttaggaagccaggacctgcagg

SEQ ID NO: 77290 - DNA, 239 bp, Heterodera glycines
  Genomic contig location: Contig_ID=SeqID_13402; Location=86..324; Strand=-
  SCN-specific regions: Sequence locations=1-26,52-99,121-179,201-239
atgtctgaagaagaatagtaagtcagaattatttttaaaaaaattattttacagcctaaaatggaagaaatctaatttaatttgaagattttatttccattgtcaattcttaatttattttattcaatatgtaatctaaactttgatttgcattcagcagtgaagaggaggttgaagttgaggaggatgtagaggaagtgagccaaatgagcccaacagtgaaggcaccacccgagtaa

SEQ ID NO: 77291 - DNA, 2546 bp, Heterodera glycines
  misc_feature (48)..(48): n is a, c, g, or t
  misc_feature (2095)..(2095): n is a, c, g, or t
  Genomic contig location: Contig_ID=SeqID_13406; Location=1120..3665; Strand=-
  SCN-specific regions: Sequence locations=1-184,206-292,315-411,443 -820,849-872,894-923,945-1230,1252-1466,1502-1531,1553-1694,1717 -1832,1854-2143,2175-2365,2388-2546
gaacacacttccgaattgcaccaattggagcggcgccgagaccagtgnagagaggagaagaacacgttggccagctccaaggtcaatcgactggcactgttcggggcgaacatgccgaagttggtcaaactgatcgaaatgaaccgggaatcatttcgaaggctgccaattggaccaattggtgagcaaaaattgataaagtcatgcgtgccaaagtctaattgtttccccattttaggcagtttcatcaaactcagagaccaaaaatgggcaaatgccgtggaatttcacatgaagaagacgctgtccgccttcatttgcgactcgtccgaagaccgcgcggcactcgacgacattttcaaacggaatggccttgacccgccagagatcattacagcagcgtatgctctcttttttttatacaaattttttaaaattttatgaattctaaacaaattacggcaggttttcggacaccaaattcgacatccgtgaccaggagccaccttccgaatatttgacgattgaacgcgtgttaactgatgacattgagccgaccgtttacaacattttagtggacttgaaatacattgaaagcacattgttggtagagaaggacgaggaagcgcggaacattatgtacccacaagtgaggagggaaagttcccgacagttttcatctccggaattttcctggaatttatgcccatgtcgttgggcacgaaaaacaaagacttcctggacaaaattgtattttatttcaattgaccaaattgattaaaatagtatgtttttttagatgtttataagcaattagtagtttttttaatttttgtttattttttaaacaaatttcaacaaaattccaggccaaattctttcagaaaatactaaggatttttgctgccttcaagaaagtgtatcttcattttttaatgtttgacatttcagcccccgccaaacgtctcgatggccatcaccatgttatgcagtcaggtgtatccggcccggggcaggcagccctaccgtttcttcgccaacaatggccaatttcgctcgcgcgcattggcacagcgctttttggcacaagacccagcagtcataacggcacaactgcggcaaattgagcatcaaattgtggacgaggaaattgtgaagaacaaagtcagttggagatagtaaaacttatcgaatttattgttttaatcgcatgaaaaataaactcgatgaattttttaaaaaattgttgaattttcagcacgagcaaaaagttcgcggagcagggcacgcgttgagcgaagtgaactcgacgatcagcgaatttgatcgccaattgaaccaattgacggagcagcgattcaaagtggaggatgagctgcagaagttggaccaactctgcttcagcggggaaatgatcgacaatttggtgtgcattttaaactaacatttttcctacaatttttaccatttattgaaattttatatgattttttatttttttcatgtatagaattctctagctttttattgctaatgatatttgtttgtgtaaactctttaattaattttcctttttagcaagggactatccgtgaaatttccaaacaacttgcacaatgtactggccaattgaacgaattgaacacaaaatatgcacaaaaaacggaggaacaaaaggaaacgaaacgacaaattgacgaagcggacaaaaaagttgcttatctgaagaacaacgtcaaccaaattgaggtcatccgatttgattattatgaagattggtctctctggagcatacatgaacaaggggtgcgccaggaccaatttttcatacgaaggcccccaattttccccggcgacgactttttttttctattcaaaccactttttttgcggcgcgtttttttccagaaaacatgtgggaggtgttggagcggtgtcgataggcgccgccggggaaatttttttgaattttctaacttgttcaaattttaacttttctcccctttcgttacgaccccccaccatggcgacccccccacccccctcctttacagccgccccccttacgacgaacgaggggggggggggggggtgnccggcgcacccccttgtttcaagttataattttcggaaattaaataccatatttaaataataatattatttctaaaattctccaatttttttagaatgacattgacagtttcgatttgcagcagaggaaaattgatgaaaaaattgaaaactgtgaaattggttcggatcagcagcaaaagaaaattgacaaattgcagaaggaaataaccaattgggagtaaggggacaaattcatcaaaatcaacaaaacccgtaaacattcactcagaaatgaaaacactgaactccaacaacacatcgcatcgatggaattggcgcctgaccaagaggagtttccgcccgatcttaccaagataccaccgacggatgaattaaagagaaatctgagggaaattgagcgcttcatcaaaacggaggagaacaagtacaataatatgataaaaatctga

SEQ ID NO: 77292 - DNA, 529 bp, Heterodera glycines
  Genomic contig location: Contig_ID=SeqID_13408; Location=557..1085; Strand=+
  SCN-specific regions: Sequence locations=1-421,443-529
atggcaatgctttctgtccgattcgattgtcttgtggcaacgcatttaaaaacgcggaaatgggcatttaagagaatgggtatcttttatagcaaagagaacggcggcggtgctggcgaaaggtaaattaacaattttatgaataattctgcacacacaaataaaaatggtctgtcaccaaatattgctctaattttcataaattttctccgcggcaggcccctcaatgttctaataagtcatataaattattcatttttggactattaacaaggttcattcaacttttacaaactgcgcctatttgcactgccgatttctcaataaattgggttttttcaagacctggttcgaactggaccctgatcttccggatccagcaccacccggacctgactttttcaaaatacccggactatcctattttgtagtttttaaatttcattaattttaaaggaaattcagtcacttagaattggtaactccctccctccctcccacttcggcaaaaatgtttgataatttataa

SEQ ID NO: 77293 - DNA, 1505 bp, Heterodera glycines
  Genomic contig location: Contig_ID=SeqID_13408; Location=1685..3189; Strand=+
  SCN-specific regions: Sequence locations=1-623,742-893,915-1505
atgggcatcacattgaaacatatgggagatgggatggataaacagaggagttggggactgttcatccacaaaattcttcctctgatcggcatccccaacatccacaagttgtacgttacttgcgggtatgttttggccaacaatgactctttgggcatctcactgatcatgattaaatagatcagtagggtggggaattagacaaaaaaaatcaagaaaatactaaaaattttttctttttctctcattttggcgtattatttcaatagtacttgaagcacaaaactcaatcgccatattttaaatacctaaaatttgcatccctagcaacaattattcccaatttttagtggcgctaaacgactgcgtggactgctcgcaagcacttcaacaacatttctgatcgattgtcccaatctccgatcaatttactatgatgggaataccactggccttgatcgtcccgttgacgccaacgcaaaagtgcgggaataatggcttctgtggccacgggcagatggccgtccgaaagtgttgtacttttggtacgatataagtgacgaatacaagcaggcaagcggcggaaaagcaaatccataaaaatgataattaatcgaaaagtaagagagggagaaagataacagagagagagagagaatgggagagcaaaagagggaggaacggggagggatataaaaagatgagagagtgggagaaaagagtgagtttgagagggagagaaaagacatgaaatagagaaaaaaaagaaggagaagagggcagataaatgagactgtgagggtgaataagtttcaaaaaatagaatttcaaattattcagttggcagaatcatttaggcattcatttccatttccaggaatttctgagtgccacaagcgcagtcaatttcatcatttgtttcacatcgttttgcattgacgaacaaccggctgaaccggacgacgtcgaactgtttcagttggacaacaaacgcaccaatgaacgactggcactagaacgaatggtgttggatcagcagagcaaagtttgcatgacgagggcgccgatcggaagagacgagcgaaagtgggcggaatggatgcgaaaagcgtgggaggaggaggaaccgagcaatttgctcatattttggataacggaagcgaacatggggccggacatttgattagacccaaattctgttccatttttgcgagtcgtttcaattcgccgcgtcaaattttggaatgtcataacgtttcttattcagttagcttaagcaagagaggcttcatttcaaagttatggagctgcacatttatatgctaattgtaagatcaaaaacgatcattcattctaaaaaagggattttggcgaaatgactcgtccgttttgctaacctctgtattctcaacttagttttacgcttcttggcattctttttcatttttaatattggcctaatttaattttgtacttaatttaacatttgtttggaaaattcatta

SEQ ID NO: 77294 - DNA, 1116 bp, Heterodera glycines
  misc_feature (17)..(17): n is a, c, g, or t
  misc_feature (49)..(49): n is a, c, g, or t
  Genomic contig location: Contig_ID=SeqID_2005; Location=1..1116; Strand=-
  SCN-specific regions: Sequence locations=1-56,78-110,143-246,283 -458,507-550,572-1116
  Gene Ontology: Mol. function=GTP binding; Cellular component=tubulin; Biological process=microtubule-based process
attagataagcgcacanatgtccggcgtcaccacttgcctgcgctttcncggccaactaaacgccgacctgcgcaaattggcagtgaatatggtccctttcccgcgtcttcactttttcatgcccggcttcgccccgctcacttcgcggagtgagtgccaaactccgtcggccattagcaaagcccgcctttttcagattctcagcagttccgcgccctctctgtcgccgacctaacccaacaaattttcgatgccaaaaatatgatggccgcctgtgacccgcggcacggccgttatttgacagcggcagtcatttttagagggcgaatgagcatgaaagtgcgccaaggagctgaaaatgggcagaaaaagcaatggacaattgatatttgtatttgttaaggatgtcgacgaggaaatgttggctgttcaaaagcgcaacaaatcctttttcgtcgaatggattccccacaatgtgaagacggccgtctgcgacattcccccgaggggtcttcgaatgtctgccactttcatcggcaattcaacagccattcaggagctttttaaaagggtcactgagcagtttaacggtaaagggacatacaattggcagatgaaatttttcaaaaaacttatttgttgcagtaattcatgaattagggttgggccggtgccggtcacgcgtaggttgggtcgggcatttttttgggaaaaaaccagacttagccaggttcagattatgccgttttgggaggacaaatataagccggtttccggcacctagtgggagcgaaatcataaatctatttttggttcaaaatttacaaattttccccggccgcgtttgtcgcgccgtcaaactttcaattctccgaagttttttaaagtaaattccaaagtattatgttagaaagtgactttcgaaattttccaagagagaatttgctttttgattacaggtttaaaatatttgttttaatttatgcattaatttttggttaaataattaattgaaatatccgccggttgaacccggcaataattgtccaaccaatcaaatgcttcttctcctctccattagcaatgttccgccgaaaggcttttctccattggta

SEQ ID NO: 77295 - DNA, 1436 bp, Heterodera glycines
  Genomic contig location: Contig_ID=SeqID_2006; Location=1624..3059; Strand=-
  SCN-specific regions: Sequence locations=1-1,23-40,88-89,111-129,175 -246,356-374,447-484,507-617,648-1003,1025-1436
atgcaaaacaaacagagaaagcttttgcggaagagagtgcgagagaacaaaggaaaagaggaagagtttatggaaattgaaaatcagccgaagagaagaagaaaagggaacaagtgagaggatagtaaggaaaaagagaggagagagagcaagagagagagagagagagagagaaaaggagcaaaaaaggaaaagaaggattagagaaaaaagaaagaaaataaattggaagcagaaaaagggataaaaggaagtgaaaaaaagaaaaaaggaaaaagtaaagcatagagaaaaagggaatgaaaagaaaattggaagagaaaaagagacaaaagaaagtagaaaaaggaagaaagaaactgaactccgttcctttttcttttccttttcccaattgtaatttctttgtctttatttcctttttctccatttttctttcttttattgccaaatcactgaatatttctcacgcttttgaaaattcgaaaaaggaaggaaaatgaaaacaatgggaataattaattaattaagaattcgctaaaaccgcttcagattgcgagtgaaggaccttttgcatgcggtgggtcgaaagtgcggcattgacccttcagagatcgacaaaatcgacttggagaacattgtgcaaaggcaaattgcactgaacgtgggtcgctgctctctttgcctttggcctttccctttcttttggcatttccattcactttttgcttttccttagattttggctttttctttggcttttcttttcacccctcctcaaactctcaggaaggcagagagcctccccccgacacaaatgatgatccgccgccgccgaaggagccgaggccaccatcgcccgaggaacaaaagccgctgttgcagcagcggttgccgcttcccccgaagaagccgccacatccgagtccgcctccaatggcactggcggaccaacgcttcttcggaggaccgccggaggagcggacatttccgttggacgaatcgcaccacaaaagagaaaaacaattggtggacaatgcaataaaaaagtgaattaaaggagaattgttaagaatttggaattgtgcaaattcattgccattgacatggacgaattgccaaatgccgtagaagttctgcctgaagagcaggcattgagctggacggatccgcccaaagtgaatgtccgtccccagcaaaacctggtggagccgaaccccgacattgcctcccccgcccaattggtggcgcaaacaccgccccaagtgatagtagacgacacgacccatcgaatgatcgacttggaacccaagaagttcaaagaaaagaaggagaagtacggaaggaatccgaagaagttgtacgagacgtatcaggaggaatgggacagattggagaagctgtccgacaaaaagctgggcccgcggaggaaatcg

SEQ ID NO: 77296 - DNA, 813 bp, Heterodera glycines
  Genomic contig location: Contig_ID=SeqID_2006; Location=1..813; Strand=-
  SCN-specific regions: Sequence locations=1-33,57-105,135-414,437 -640,662-761,783-813
  Gene Ontology: Mol. function=GTP binding; Cellular component=tubulin; Biological process=microtubule-based process
atgcgtgagattgtgcatatccaaaccgggcaatgtggcaatcagatcggtgccaaagtcgcattccccgtcaggccaacaaatttgctgtgtctcgtttagttttgggaagtcatctccgacgagcatggcatttccccggatggcttttaccggggcgactcggacttgcaattggagcgtgtcaatgtttattataaggaagcagctgagttcaaatttgtcccacggttcgcagaaaaccggcgcttctttcgcaatttctcgcattaagtgccgttttggcggacctcgagccggtcacaatggacgccgttctgtttcccattatttggtggttttaactgtatttttggcaaattaggttcggaatggtccttacggcaatttgtttcgtcctgacaatttcatccatggccaaagtggggcggggaacaattgggcacgcggacattacacagagggcggggaactttcggatgcgattttggatgtaattcgcaaggaggcggaggattgtgaatgtcttcaggtaattgatggatgacagatgtcaacccatcccatcctttgagggctttcaaatgactcattcgttggggggcggcaccgggtcggggctcggcacgcttttgttgagcaaacttcgcgaggagtacccggacaggtgggcgatgccttccgagctgaataccaaggcgacaatccctgcagaataatcagcacttattccgtggtcccatcgccaaaagtttcggacactgtcgtggaaataggtgaaaacccgagctaaggccaaggaatgtttctcaa

SEQ ID NO: 77297 - DNA, 2605 bp, Heterodera glycines; identical to SEQ ID NO: 2007
  Genomic contig location: Contig_ID=SeqID_2007; Location=1..2605; Strand=+
  SCN-specific regions: Sequence locations=1-684,706-1339,1361 -1585,1609-1932,1954-1969,2002-2045,2072-2123,2145-2605

SEQ ID NO: 77298 - DNA, 2605 bp, Heterodera glycines
  Genomic contig location: Contig_ID=SeqID_2007; Location=1..2605; Strand=-
  SCN-specific regions: Sequence locations=1-461,483-534,561-604,637 -652,674-997,1021-1245,1267-1900,1922-2605
aaacaaatcttttgtatttaccatttaaggcattccgatgacaatgatcgtaagataagcagttaaaacatttccgacattccttctgctgatcacagatcattgctaacattggccaatttctcaatcaatttgctggcgccacgcgaaaaaatgtaaataaacaaaataataaatcatagtttttgtgtttgcaaatttgcactttttatgatcgccttttcttcactcgccgcccccccccccttttttctccaacagatcgaagcgtttcgcgagcgacggcgccgttcgcgcgtttcgctcaacggcgaagaaatcggcgattcgtccattgaggtgatcgatggcgtcgtcttttgccactgaactgcttgaggtgatgtccgtcggccttttggtcgcctttctgctttacgtgtgcttcggtgccgtccttttgccccttttgaacggaaaggtcattttgccattttagtcaatgctttatccttcttaatggattttcccttttgtttcagttcgatttttacaatggcatttacttcaatttcctttgtctgactgccatcgactttggccaattggttccgtcccggtcagtccctccccccccccccccccccccctctccccaatttctgtctcttccctttccgttgggctttccttccaattacgtttctttacgtttgcatcggattggccatcaccacaatcgcaattgacattggttctgaatacatgaagaaattgcatcatttcggaaagaagatgaaaaatgtagccagcacaaaaatttggttcggtggaaagacgtaagttaaacggaatatttataaatgataatggaaaagaaaagggacaaattgaaaaatgaatgaatggcaagtgaaattaatggttaataagcgatgagagtggggaaggagcttagcaagcccattttcgaagcacgaaatttttcagaaaaccttgtaaatttagtgggtggtaaattaaaacacttgtaacaaaaaacatgatcatggcatattcaataaaagggaatgcgagagatatatgtaaccacttgcaataaacagtgaattttacttgaaatccaaaaaattgtaaatcttagtgctttcactttttgagtcaatttataaaactcaagggattttaggggctccgggggtgccgataagtgccgccgaaaaaaggcaatttgggtcttgtttcttaaaagatttaatcaaaaattgccaattttgtggctttttggatatattttaacgaagctcttgttccgaagcccaaaaatgcgaatattccaaagtttcgctcacaaatcagggttaacagtgcgtccccccttgtggaaaagtgccccccccctcttttcaatcgccgctcatcggtgtgccactcgtccgcctcctccgctgcttccgatgccattgcccaattgcgtctgtttctgctgttggctgcttatcgatgaatgccgtccgcctgccgaatgttcgatagtctgcggcgatgtgtacgttttgcattggacacattgccaagtcacttccgcgcagttcgactgcgttttgcacctgccaaatgcgcgggtataaacagagctaatagaaagttcggaataccgcgaacagaggtgaactgccacgggttgtagtggccaattcgggccgccctgctgttggaccaactgagcgaagcggtccatctgcgctcatttcggtgtcttataaagggacattctcttcgcttaccatctccgattttgcgcgcaccgacaaacattcgtctgaacggaagggacggaaggaaggctttttccctcaaaaggccaagtcactgacacgtctgctgctgactcatctccacaatgttctccgccctgtgcaccatcagcaaacattgggccaacaactgctgaagtcggcaccggtccagcagagagagacgcacaaacacactgagctgagtgtgcgggctgagcagaagggaggcgcacttccgcagcagaccgtgggactccaatttgcaggcggccattagcacgggggcgatattacattctgagaagaaattgggatgagatgagaaaagggccgggcgacgtcaaccagccacctgtgatgcgcagctgtggcggataaatggccatcagaaagtacttcagttcttcgctggaacacggacagtaaatcaaatcgtcgtcatttggcactccgtcgctggaaatgccattgcatagtctctcctgaaagagagaggaccaagcggccacgtaatctgaggggaaggctttaagctaagcattgtccacaacggacccacatgggttcacatggtacgctcgccccgtcttcgccttcaccgtggcaaaattgaggtcgcttgcactcagcagatgctccatgtccacggggggctctggcaattccttaagcctaacaaataaataatttacgcaaatcgaatggacgacctccggggccggtgacccgtgcatgcgttccaacacagcactttgactctgtccgacagtccagtgtatcggggccagaaaggtcccaatttgtggacacttggacgcaattctctg

SEQ ID NO: 77299 - DNA, 1098 bp, Heterodera glycines
  Genomic contig location: Contig_ID=SeqID_13409; Location=2127..3224; Strand=-
  SCN-specific regions: Sequence locations=1-468,490-618,643-686,708 -1077
atgggaggcaaaacaaaagtcgaaacaatggacgaaattcgaaattggcacacaaaacggtgagtgataatccgaaccaaagaaaaaggacacttttggagggataattataataatattacagactaattaggcatgtgacaaatataattgcaaaaccaggtcgaaccaaccatactttattcgctttctcactatatttaaaaatgattgttgtatgattattgcatcatcaattaattgcattttaattggtttggtcctcctcaattagcgaatttagtgcctctcttagatccataattacaaattctcataatttcggactattcggcatgtccatcgatgccctcgtccatggcctgtcgggtttctaaatcctgcgcttttggccgactcatttacccatttgctcgcctcttggcgggtgtcaattctcgacccttttgttcaattgccaccaacaaatgtttggaggcacaaacacaacttctccgatttgcgggtgccctttgcgttaagtgcgttcgctttgtccgtccgtttgcctttcgcgcgccgcaacccccggggggaaattttgttgaatttgttacgcccttttacggatggatgaggccaaaaaggaagagagaaaaaaggcgtgggacagagagaagaaacacccacgcgaaacgaaacggtggaaaaattaaaaatattttgaatttccgcgaaaattggcaaaacaattaaagacaaaaacaaaaacattttgtacaggggaagaaggaaacggttaggggtcaactccatctcagcaaagttcaaaaggctataacttttttctttgtcgaccaaacttaacaaacattggtaacattcgaaaattttaaattttagaagatatttctgctatctcgaagtgattaaggagctcagaaaaaaagttgtcgcttgaaagaattttcgtaagtttttcatctctatctttttttagttcgactttctctggaattattagtaggctaatagagactgtgaagagctttcgaatgattcaaaaattgttgtattgcgtcaacaacttaaaaagttaaatggaaatggaaaaataaa

SEQ ID NO: 77300 - DNA, 419 bp, Heterodera glycines
  Genomic contig location: Contig_ID=SeqID_13410; Location=2089..2507; Strand=+
  SCN-specific regions: Sequence locations=1-126,149-216,251-419
  Gene Ontology: Mol. function=heterotrimeric G-protein GTPase activity; Cellular component=heterotrimeric G-protein complex; Biological process=phospholipase C activation
atggcctgctgtctaagcgaggaggcacgagaacagaagcgcattaaccaggagattgagaggcaactccaacgcgacaagcggaatgcacgaagagagctcaaactgcttttgcttggttagcattttgtttttccatttctgaaaagccacacaaaatgtcgtcgtagtgaattacaattgttgttttttaggtactggagaatccgggaaatccaccttcatcaagcagatgcgcatcatccacggcagtggttactccctggaggacaagcggcagcacatccgacttgtctaccaaaacgtgttcatggcaatgtgaggcgcttcaattataatgagcgttgactcgaaaggatttaacaaatagtttttttataatggaaattgcatgaatcccttcaaataccaaattgtaa

SEQ ID NO: 77301 - DNA, 546 bp, Heterodera glycines
  misc_feature (497)..(499): n is a, c, g, or t
  Genomic contig location: Contig_ID=SeqID_13412; Location=460..1005; Strand=+
  SCN-specific regions: Sequence locations=1-112,148-546
atggaattggatatcttttgtagtttatttgcatgtgaacacttgtgtgacattcctgtggtaaaaaatgaaagcctagagtaagttttattttttatggattttagtattcttaaaaaaattattaatatagatatattaaaaaatgaattgattaattcagatcaattggccttttataccaggaatataacgaaatgcccaatttccgagttttgattttggctcggaattccgcttttctattggcgaaattttctagcgcccgtcaaaattccgattgccgaaatttttgagggcatcggcatacaaccctgttttatactacaaaatttcggtccttcctaccgggtgcaccccaaaaatctcgccgccggaatctcgccgccggaatctcgccggccggaatctcgccgagacaaaatatcgccgccgaaatctcgccgggcgaaatctcgccgcagaaatttcagaaaaaaaatttcaaacctcagccnnnccccaaggaaaaaaatccttagaaaaatttgtttaaaaaaaattgta

SEQ ID NO: 77302 - DNA, 1749 bp, Heterodera glycines
  Genomic contig location: Contig_ID=SeqID_13413; Location=875..2623; Strand=-
  SCN-specific regions: Sequence locations=1-97,124-133,182-391,413 -543,611-656,699-859,881-1557,1601-1749
  Gene Ontology: Mol. function=extracellular matrix structural constituent; Cellular component=extracellular; Biological process =cell-cell signaling
gagtgcgaatggcaattccgttatcatcgatggaactgctcaacaccacaagagctgaaggaacacattggtccaatacataagaaaggtgaatttgttaaaatttaataattaaaataaaatgtccgcgttcataatttcaataaatttaattttaatttcaaaattttataaaattaatgaacttattatgcccacttaaaggaactcgtgaagcggctttcacatatgcaattctttctgccggtgtcacacatgaaattggacgccgttgtcgtcttggctttctgcgaagttgtggctgttcagaaagtgataatgcgccaaatcgcgtgggcttttaacaaaaattgcacctaatcaaaatcattgcatttgataattattattctggttttaaatttatattttggcagatttaatcgaaaaactggcaaatatctaataaactcttgtgggacagaaaatttgggtactcttgaaattgggtgtgtccaaaagtgtttgactataaacgcaatcgaaaaatttcaaagaatttgcaaaaaaaaaaaatttttttttttgaattttaattttatccaattattttaattaatttaatatatttctctgtgagtgtaattttaatgagcaaataatgaattttatcattgggaaaatgtgatttggcactcatgatgatgatgaagatggatattctatgtttttccacattcagcaacaaagccgtggtgttaatgaggattggacttggagtggctgtggcgataacatcgattatggctaccgattctcgcggtgagcagctgattgtgagacaattactgagtcgggattttcgcccaaactcagaaagctctcaatgaaattctggaaaatatcttccttattatcattaggacttgtcgaatattagcaaaaaccggggattttagagaaaagtataactgaaaattctgcttttgaaaatcccaaaaatcccgggttggcgctcacaatcagcaattgtcaaaactgggattttttgccgtgctgtttgttgcccgccgccgttttccttcaaaataatttgtacggctgggagtggaaaaaatttcgccctgtttttgatatttttattttttcctgaattttttgagttttttttcgaaattcctactcaataccgaaatctcgattccgggctcaagagacaatacaatgacaaattaaatttaatgaagagcaatttaagcgatttcattgatgtacgtgaaaaggaggagagcaataagcgatccgcggaatggcatggacgatcgttgatgaaccgatggaacaacgaagttggcaggaaggtaataatgcaatgagaatgatgaaaaaatttcaaagaatttatgcacttggttaaagttgtaaataattcacattttccagattttaaaaattcataaatcaaaaattttggtcaagaaaaaaataaatttagtagaaaatttttaaaaatctttccattcttagtcgggatgtgatttttgatttttagcatttttgtgatgaacgaaaaatgcgaaaaatatttatgtaaataaaaaatcgaaatatatttttttaactttcagatagtaaagcgacatgcaaagccaaagtgcaaatgccatggagtgaggtcaactacaaaaaaatttgaatgccatcataaatgcatgcttttttcagcggctcatgcaatttaaagacatgttggatgcaattggtgtgtaa

SEQ ID NO: 77303 - DNA, 1913 bp, Heterodera glycines
  Genomic contig location: Contig_ID=SeqID_13414; Location=193..2105; Strand=+
  SCN-specific regions: Sequence locations=1-798,822-1758,1780-1913
atgccaaaacgtgcgaccgaaaattggcaattggggacaattgctaaagaatgtatgggggcggataaatatggaatggaaaaaagtagtgcaaaaattctcagaattaattgcctaaacctgaaattgaaggtaaaaagggaaagaaaggcgaatttttcaggacaaacgcaaacggacgccgggatttgttggacttcggtttgcagtcaaaaagatgccgagcatgaactctgcacggctttgaaattgggcgaattggaccctgttcttggacagtctggcccaggcgccatgatcgtacagtcgccgcttcaagctcttttggccgtttttctgcttcgctccggcacagtcacttcaaacaccgcagcccgaacattcgtcgaaatgatcattaaaagtggaccacaaatggaaatggccacttattcagagaagcgaggggattatgttggcaccgggaaattcccacaggaaaatgaccaagtcaaagcgctcgaaaaatgcttcgaaatgtgcttcgttgcacgtgccgctttaagcgcaactggctacaaaccgcttgcgatggcaccaccaattggtttagagttgctggcgggggctgatcaggaagggtggaaagaagtcttcgatcagagcgcatggtttttggaacgtgcccgtgccaaaatcatccacaaaaccgagtcatttgtgtcccacgaacgtgtttttgttggggactcatctgcacgccacctccagggcttcttcgaccgatcactttacattggacccaacgaaggcccagttgctgatgtgatcaggactttcaaacctgttgtgatctccagtcgcgtgaaggtcatggttgtgtttgtggggagagattctttagctgcaggcgaaaccccggaggccatcattgaacaatgcaaacttttggccgaattgtgcaaacgtttcccggttcaagtgctgtggagctgcccgccctacattcacaaaaaacagcgagaattcgaaacgctggtggcacaaatgcaggggctcataaatgatccccctcagattctgccgatctgcacgacaccgaatggccgctcggcattggaaatttttcgattcggcgatcatttcaatacgcacatggtggaagaagacggaaaattgaaaaaatgcgggctgtcgggcacttaaggcttggataatgactcagaccccattcccaggcgataacgaaatgcacattcgctcgctgccttcggccgtcattattccatcgggagatcgggccgatcaccgatcggaacagctggaattagggcattcttcgagagatcgggccgattctcgtagaattgttcctaatcgttcggctgatcgtccggccatccgttaccgtccttatgagactaatcgccagggacagtacggtaacgaacgccgtcgggaattccgtcccaatcgccgctgagacacctgttggaccccacctttcggtttctgacttctaaaggcagggacgccttttctgattgttgagggatgttgtagaattttaattataatgactcattagtgttaattaaatttggcataatgtcttgtttcgcgttttttctcatttaaaatggtattctttgtttttttttttcttccatctttcattccaattttattatctggtaatttttatttttttgtgccgtccaatctcttttgactttaaaattgatattcgtcaaattgtttctcatcggtatttgtcttttggaattaaagtgtttggatttgacagtggcctactctgtgtttggtataattgcgtccctgtcttaagtcagtagcaaaagtacaatttggcgctcccgaggaaacaggtacaaaagcggcgatttttaaagagtttgagggtgagatcggga

SEQ ID NO: 77304 - DNA, 979 bp, Heterodera glycines
  Genomic contig location: Contig_ID=SeqID_13416; Location=465..1443; Strand=-
  SCN-specific regions: Sequence locations=1-221,243-646,676-708,730-979
atggacattaggaaatattcaaattcaaagcaaaattggagaaaatggcaccaaggaaatggaaattgtcaattccgatggaaaaccattgccaattccgcaaattcaaatgccacgcaaagtcaccggattcaaatgcatccagatcctgtaaaagcaaaaaatttggcagcattttcccatttatgtatttttagttttatcgaccaaaatgccatcgcttttctccaccgttttcgccaacttttcgcctcaaattgtccaattaatttggccatccatacgaacaatgttcgtattttgttgttcattttgcgcaacatttggccaatgatcgggaataacatttgtgggataggattgttcacgaatattttctatcgtttgcgaaaattggtcccgtcaattctcaacgattgtccatcgcttcgcgttgtctcctcctattttgacgaattcttcaccgattttccatgcgatgacagtgccatggcatcgaatggacaagcggtggcaaaatggctttttactccgcttcaaaacaatgtgccaaaggtgttgagatgttggttgcacattgatgatggaaatttggcttcgaatattgaagccttaaaagcggtgcttcgaattgacttattagtacttttttttaatcaattttttaatattttaggctttttcctcggcttcatctcctgccaatttcattgttgtcattccctttccgccgtcttttgctgattccattgtgccatttgatctgaccaacgaatttactcgtgaacaatttgcattgaaaaggattaagaaaagcaatcgttttctgctgatccgttgcccaattgtgcgagatgaaagcaaatggacaaaatgggaggatgaagcggacgattggcgaattcgtgatcagtgcaatcaaattaacattcgaattaataatgagcgtgaaatcggcgacgggtcagccaataaataa

SEQ ID NO: 77305 - DNA, 600 bp, Heterodera glycines
  Genomic contig location: Contig_ID=SeqID_13420; Location=3284..3883; Strand=-
  SCN-specific regions: Sequence locations=1-9,33-103,232-541,563 -570,592-600
atgattacccaacaacagcagcaaaaccaagaagttcaagcagtacaacaagaacagcaaattttgatgggaaacgagatgaagatggacaacagcaaaaatggagaaacaagggaagaggagggaaatagcattggggaaggaggagagacggaagagaaagagaggaaaaggaaaaattcggcgcaaaaaggaggagagaatgaagctgaaaagagaaaagaacagcagcaaatcggcacttaatgttgccggtgctaattgctaattttgtgtgtcgtaaatcccgcgtcaaaatcccgaaaattaattgccacaattttcaaggagaaattcatacattcgatagatagcaagccatttttatacaatgttggagttttttttgcacttaaacccatttttgaaacttattaggaccgtgaaatggggtccacttcgtttcggcgccagctcgtttttccactaaacgttttttctgagtcatctaaatccaacattgttgatatcattcgaaagcttaacaaaaattttgaagttttttcttaatacattttttccaggcttgaaaattttgttgctttttgtaaggctaataaa

SEQ ID NO: 77306 - DNA, 2413 bp, Heterodera glycines
  Genomic contig location: Contig_ID=SeqID_13422; Location=325..2737; Strand=+
  SCN-specific regions: Sequence locations=1-99,121-462,484-1509,1531 -1713,1735-2099,2121-2413
atggtaatcaaagttgaagtccttggcgaaaggacgaaagcaatgcttgacggaggtgcccaaatttcggtaatcgatgcagcatttttgtataagctgatgaaaaacaaaaatttgaacccaaatgatttgcgagttgccaaatcggagacacgaatttctgatgctaatgggaatccattagcctgtctaggtgttgtatgccttccgattttgagaaatgattgcactaaggaagtgcaagttgctttgcatatcgctcaggcaccaattgggtttgatctgttgtttggaacgaatgctttgagttctttgggttttaaactttttgatgacacaacgaacacaaaaatcaattttgaggaagtccagctacgcaagtcggactctctgactgtcatataccagacaattttggccccaaaatcaactcaaatagttgaattgggcattaaggaagagtttgaaggcaaagacctttttctctggtctgaaggccaccaaaattttcgaattgagccaacagttggaattggaaaggacgggaaagtcattgttctgatgacaaattttacgagtctgtcaatcaaattggaaccagggaattccatcgggaaaaatgaagtcgtgaatcatgtcgaagaatgcgaaaatttcctttcagcttcgaacgaatgcttcagaattaattgtgttgcaactgatgaccagaatgtgtcaatcgacaaaattttgattgaaattctggaaaaagggacatttccagattcggaaaaacaaaatctgttggaattgctttcgcaattcaagaatattttcgctgtttccgattcgcagttaacccaaacaacccttgttcagcatgaaattgagacaggaattgcagcaccagtgagatcgaaaatgagaccagtgccttacgcatatagagaaaaattggccgaaatgttgaaagattatttggaacgggatttaattcgtccttcatattccccatgggccagcccaatcgttatcgtaccaaagcgcgatgggtcactccgtttttgtgttgattaccgtgccgtaaattcggtgacacgaaaagatagtttcccatttccaaacatagacaatactcttttgttactgggaggcaaaaaattttttacaacgcttgattttatgtcaggctattggcaaattcggatgaaacctgaatcaattgaaaaaacggcgttcgtaactgaatttgggctccacgagtttgtggtaatgccattcggtttatcgaacgcagtggccacttttcagcgctttatgaatcgactttttgaaggaatgatcaataaatttctatttgtttatatcgatgatgtgttaattgcttccgaatcacttgagaaccatctcgaacacttgaaatgcgtttttgaacgtatacaaaaagcaggcttaaaactgaaactctcgaagtgccgtttttgtgtcgaagaattgccgtttttaggtcatacattgactagaaatggaattaaaatgaacgaagaaaaaatacaacctgtaaaaaatttaccagttccgaaaactaaaaaggaattgcagtcattattaggcttcttcacttattatcggaagtttatttactcatttgggaccattgcagcaccactttttcgtttgctcaagaaggagacaaatttgaaattggcgaattagaaaagagtgcaattgataaattgaaagaaaaaattttaagtgatgttgtactgtattttccaaattttgaggcagcgaaaaatgacccaatgaggaatttcattataatgacggacgcaagtaaaatcggtatttcggcaattctcagtcagcaggatgaaaaaggaagaatccgtccaatctattttgcctccaggcaatgtaacaaatttgagagccgttatgcaccaactgagctggaagcattggcaattcgatttggcgtcaaaaaatttgctcaatttgtaacaatgattcctacaagagtcataacagaccataaatcactgatcggaatgtttaagagtaaaaaggaaaccggaaatgctcgagttgacaaatggatccttgaattaaactcaaaattcattttgaaagttgaataccaaccagggaaaaagaatgtgattgcggatgttttgtcaagaacatttgagacaaaagagcgtgaaatgttaaaatttgctgctccagaagatgttgcattgattggaatgttgaaaattgcaggacaagaaacggagttaactgttgatgagaaaacggaatggactcgcgaaacaaaagaaagcgaaatgaaatttgtttatgattttttgagtcagagaattattcctgaagaccctcggcaacaaaaaagtctaattggacttgggatgagcgactttcatatgct

SEQ ID NO: 77307 - DNA, 202 bp, Heterodera glycines
  Genomic contig location: Contig_ID=SeqID_13423; Location=1224..1425; Strand=+
  SCN-specific regions: Sequence locations=1-96,148-202
atggcattgtctttttcacagatcatcatgtacgccattatgcagaaaagcgtgcgggaaggcgaagagcttcacctgaccaactgtgccctctccgtgcgcttttttccgcccctttaaaaatgaaaaatttccatgccatttaattccgtattttttttttcaggagattgtcttcgctggcgccggaatgatttgctgg

SEQ ID NO: 77308 - DNA, 529 bp, Heterodera glycines
  Genomic contig location: Contig_ID=SeqID_13424; Location=148..676; Strand=+
  SCN-specific regions: Sequence locations=1-529
agaccggtcaatacttcggctggctcggggtcagttcagttctgtgtggtggtcactgatcagtgatgcttcccgttttgttgatctctcattgcctttcaaggcgtgtgccggcatcatcgtctgcctcttcatgggcgtggtgagtagtaaaatggtgcccagatttggtgtttaactgatctgatctggttcattcggaccgcaccaaaataataagtgatcggaatgggaaagcgagcagtcaatgctaatcagaaaatcgatttaaatgtgctttttcaatcaataaattcaatttttaagttggccgtttttgcgctggacattctcacgaacaaaattttgtcgccaacccgaaagtatcgctacagtacgccgcaaatgtgagagggggaatacgatgcaacgcgaacaaccatctccagctacagtacacacacataccaaataccaatacaaatttctcatttaccatttgctttttgtctcctgccaacttttgagtgtaagcaaaataaagagaatc

SEQ ID NO: 77309 - DNA, 1000 bp, Heterodera glycines
  Genomic contig location: Contig_ID=SeqID_13424; Location=880..1879; Strand=-
  SCN-specific regions: Sequence locations=1-357,379-583,605-1000
ctgtccttttgcagaaagtggccatcccgctgaccagcagcagcaatttggccaatccgattgtgcacaggtgggatcgaggggggaggggttaacgggcaaagaaaatttggactctcggatttatcccgattcggtcgagctggttttgccatatgttatcggagaaaatgccattttatctttaaatgtccccgagttccggaattaactgtttcatatcccggagataaaaacggaaaagcggcttggaataagaaaacgatgatgagctttttcgatatttgtccttgcttctcggcctagttgagaaaatcgtatgaaaaagcaattgattaaaatcgaaaatttaatggctaaatatattttttggcatttcagttggccgcaggggacgaagaaaggatgttgttgtgccagctgtacgagagttcggcactgctcgcccaactgggcattctggtcaacgaaggcattggccgattggccgtcagccaaggcgagtcgttcaatgatttgttttttggggatctaatttggcaaatttacaggaatgggcaaatttgttgtagcggaagcaggccgagagaagaggaaacacgaggtgagtgatgatgagctgataagtgatcagaattgggggattcagtgacaagaaaatgccatgttggatagagtgatcggaaattgccagattagctaaagtgattgcaactgatcaataattgcttagaaaaagtgggtccaatgattacaaaaaaacagaatagttcaagcaatcaaggatgatgataaatgtttaaaaaggagggaatatagtgaccgaaactgattagacttgcttacctaactagtcgagtcctgatcggtgattgattgggccatgcaactaagatccacaggagcttgtctgatcatggcagatcgatcataccaatccacatttcagtatctccgttttggaaagcggaaacacgagtatctgaggttcggcagaaag

SEQ ID NO: 77310 - DNA, 925 bp, Heterodera glycines
  Genomic contig location: Contig_ID=SeqID_2009; Location=138..1062; Strand=+
  SCN-specific regions: Sequence locations=1-80,105-111,227-477,499 -532,718-925
atggcaatggtttctttgcttgttggcatttattataatgtgattgtggcctggtcactcatctacatttttactgttagattcatttttaaagcatcatattttacttgcatttttaattagttaattagttcatttatttttttaattgctgaaataatatttaataaaagaattattttaatatttttttaaacaacttttattttgtttatttagattattactggtaaccatcacgatatatcatcatgcaacagcactttcaatacgatttgtgagttatgcatcggaaaatttataagtcaaatccctaggaaaattcgttcaaattataattttggattattttctaccatttattccttcaaaaaaattttaattcgtaaccaattgataattaaagaacctacaagaaaaattttaaaaaaatggtatgcgattttttaatttgaatgaatatttcatcaaatttgcttttttaatttaaaaatttttgagatttattgaaaactttgtactatctataagctcatttaattttaattactttgtctaattacttttttttttttattccatttttgattttttaatttataaatttttgtcaattttattaaaatatgcgacattcatatatatgtttatttaaaatttgtttaattaccttttactctaattactgattttgtttattccattgtttatttattttccttaatttaaagattgtgcttcttcgctggaagatgctcgttgtgctcatcaactgaatgccactggggcatttttcttcaacaaatcatgccatttgttgactgatcggctggcagcaacgctcagaaatgaaacatacaataagctgccagctgttagtccggcagaggaattttttgagtgcctatttaacataataaactaa

SEQ ID NO: 77311 - DNA, 2668 bp, Heterodera glycines
  Genomic contig location: Contig_ID=SeqID_2010; Location=791..3458; Strand=+
  SCN-specific regions: Sequence locations=1-138,193-211,238-488,521 -1084,1108-1356,1407-1522,1545-1546,1569-1664,1721-1763,1787 -1987,2009-2097,2119-2180,2206-2313,2373-2517,2563-2668
  Gene Ontology: Mol. function=sodium:amino acid transporter activity; Cellular component=integral to plasma membrane; Biological process =synaptic transmission
gaattatgtattggaaaaagcgccaacaatggacagttttggtggacttaatttgaaaatggtgattgccttgggctttgcttggctaatcactgttcttgtgctgatcagaggggtcgaagtgatgggaaaggtggcaaattataaatattatatttaaattttatttccaaaatcttttttaaatataatgactgttagcacatttttcattaatttttttatatttttataattgtcaaacgcaaaaaaaacatgagcttattttgacagattgcatggctaactggcacaaccccatacataattattgtcattctcttcatacggtaccaattaaaataatacattaactagttgaataaaaaaaatcaattaattcattaatgtttttagtgccgttacattggatggcgcaaaaattggattagacttttatttgcttaaaccggatgtcagtgcgatctttttggcaaaggttggcaccctttttaatattaaaatatattgaaataaaaaagatttcgattcagttgtcccgttaaatataaggaaaaagtcctgagacgtttttgaggcctcttattaaatttaaatacaaatcctttacactgggaaaattttccgggtttccggttaaatccaagaaaatgcgtccttgaaaattttatggcctacagttacgcattatatatacagtgtaacttgatatatttggtcgcctcctgttaggcctaggtgcatgtccttgaaaattaatcaggcccatcgccagaaaaaaatttcggagggtgaatccgaacgaagacctattttttcttcgggtcaaaattttgtaaccagcgtaattcaaaatttttagcggctgccgtgcaaaaaatcagatccatgaattatggccttcagttacgtccttgaaaattttatgtcctttatttcctctctgttaattgtccatgggagtttttagagcctccaattcaattctccaaacactcttgtccattaagacatggcgtacagctgcaacccaagtgtgctacagtttagcggttggcatgggtggactgctttcactatccagcttcaacacctttcacaacgattgcttcaaggacgcgttcatcatcacggcagccgacgcaatttcaagcatttttggtggcactgctgtgttcaggtatggaataaaaagtgccgagatttaaatgtgatgcaaaagcccttcttaaatatgtgcaaatcataaaaaaatgccaaaatatttaagttgctaaaatgaggacaaaaaagaaaacaagttgaacaaaacaggccatgctccaaaatttctcctacttataattacaaaaccacaaaaaaaaatttttttttttatttttaaataatttttaaatcaaatatttgtcaattgagcggagaaaatatgtttttcgtgcctctctcgtaaaaggttatctgcaaacatataaatccacaggcccacattcgcccctgtttctctctttaactctctgcccataattgggcaaataacttttttcattttctataaataaattctattacttttctaaaacaatttaaaaacaaatcataaacaaaaatgtgcataaaaagaaatataaaaatttttcttattcttatgtaaacaattttttgggaaatattattgataaaaaaaaaatttttaaaaatgttaccattaaatttaataattctaacagcacactcggcttcatggccaagcagttgaacgtgtccattgaagctgtggtgcagagtggcaccgggttggcattcattgcttacccggaggcaatgagccgaatgccgggctggacatggctttggcaactgttgttctttctgatgatttttatccttggcgttgcgtcccattttgggttggctgaagtgtgtgtttgttcatctgttcctttaaaaaaaactttatttgccacaaatggggtttcccctgtgaaaattatttttgatttttgaaaatagtccattttatgcgaaaaataggtactaattagggagtttgctactataccctcggggagagaaaattcgggatccgggtggaattacccagcaaaatttgtcctgaaatggctagaaaaattgtaaaaaaaaacatctaaagacaatgcaaaaaacaagcacaaactcctaaaaataattttgtctctaaaaatatctcatgttttttaggtctcgattggcactatttccttaaccataacaattcaaaataatatatgattaaaaaatgaaaaggctcctcctataagataaatgaataagaaatttataaaaattacaatttttttagtataatttagcaattaatttaaattaaattactttttgtacacattcttaaaaacatttaggtaatgtgtactgcattgtatgatcagtttccagccttacgacgttataaaagtggtcttgtgatcggagtttgtctttcatgttatttggcaggcttaacaatttgctcaagagtaatttaaattttttaattaattatatttaatttcaatttaaattgatcaggcgggcattttttattttaacattttcgacgattatgccgcgtctttctcaatgatgcttcttgtttttcttgaactcattttagtagcgcatatttacg

SEQ ID NO: 77312 - DNA, 1286 bp, Heterodera glycines
  Genomic contig location: Contig_ID=SeqID_2011; Location=258..1543; Strand=+
  SCN-specific regions: Sequence locations=1-140,419-765,787-971,1016 -1173,1252-1263,1285-1286
ggtggaataattataaagctgacatccaggcaatgttaggcactccaaggaatttgttgtccaaattctatgggccatccgggctgtgcatcaaatacatttacagttatattgctcctatccttttgattgtgagtgacaattttattcatttttatatatatttatatttaattatacaaataaatttttggtttattaatcaatttaaattttttagatttattttatcctttatgttcattgaatatttttgattctatttaatttagccaaaataaaaataagcatgatatatttagcattatttatacaaaaaaaagaagaagattgtttatgtgttaaaaagatcaaatttaaattatttaaaatttcatattttttttttcaattattaataattttttatttaaatataggtcgttttggtttttgcatttatgcaacaagtatttacaactcgggtcacctacgggcgcgacaaacgactttacgtgttcccggcttggtccatcgttttcgggtggtttttgtcgctgatctcgtggatatttttgccgggtctaattgtggcaaacactgtcaaatttatacgtcagggaaaggtccgaaaatcaaatttattaaaatgataattgaaaatcatttctaatatataatttttcgtgacctattttttttaaattaggcatagggtgtatttttgaaaaaaaaattttcagcaattcttaggtgtttattttttgttattgcattaattttgggcaaaatgccaaaataggtttttcaaaaaattaaaaacctaaaaaataggcactaataaacttgaaaagtagcataataaccacctaaaaaaaattttcgtgggtttcagaccaattgaacttcggaaaaaaatagaaaaaaaacacctaaaaatcgtacacattgttatcaaacatcaatttgactttttcggttttttcattaactataaatttaaaaaaaaaattcatttaaaaaatattattaatttcagccacttaatgagttgctaaagatgcagcctaaatggccttcctatgagcgtgtcacacgaggtgtgggcaagtctaagacttcaaatattatgagtgccaacagaaaccaaccaccacttaacataacaatgaatgaatttgcgaatggatcgtcttaaaaaaagaaattataaaaataattaaattgttataattaatgtaatttaaaatttaatttttttttattttaaaagaaagcaacacattttcttgtatcttcttgagtga

SEQ ID NO: 77313 - DNA, 1004 bp, Heterodera glycines
  Genomic contig location: Contig_ID=SeqID_2011; Location=2425..3428; Strand=+
  SCN-specific regions: Sequence locations=1-50,87-615,637-792,814 -978,1001-1004
atgtacagctgtggcgctgaatatgccgcagcactgcaaaaactgaacaaattaatcatggtaattaaaaaataatttgacaacttttgaaaatgccatttttcaaataccgaaaacattctaatctgtgaatattcattataattaggagacatacaaagaatattcggagtgtaagaaactgcttgaacaagttgaggacggaagacacaaatcactcgcaaatttggccgctgagttgggcatgttcgaccaacttgttgattgattgaattttggacaaaaaatgcttaaagtttgttgtaacgaaattgttcaatttattcaatatcttaccaatacgctgacgattgtaaaaaataattgataaatttaatcattttgaaaagccactttttgaactccgaaaatattcaaatccgtgaaccttcaaaatatttaggagacctcaaattttaccgctgagttggccgtgttcgacccaacttgtgaactaaatcttgacataaatatttcgttagtttgttgtaaaaaattaaataaaacctgaaattaaaaaatatttgccagtatagaacgcgcttgattggcggtactgaatttgcccttctttactattttttgaaactgaaatttgttgtttaacattacaacaatgacccactggaattcgtagaaaggaatggcatggtaaaagtttaagtgcaacaggatcaagcaatatccgccactttattggtcgccaaaaccgacctttttgcctatttacgtgtaatcgctcatagaatgcctgaataaattaatttgttcaaacatatttttaggaaatattctgtttatatgccaaaaaaattatttttcaaaattttagtttattgtcggaccgttcacttttatcggattgtcctcactgttggattgtccaactgtcggattgtccgtgagcctcgaaagcgtgctgagccgaatctaattctttttatgcctaacttttttggaactta

SEQ ID NO: 77314 - DNA, 577 bp, Heterodera glycines
  Genomic contig location: Contig_ID=SeqID_2012; Location=138..714; Strand=-
  SCN-specific regions: Sequence locations=1-188,210-430,453-577
atgtccacaacaatttttaaaatatttctccaggatatccccgacaatgtcttcccagaccgccttttgaaactgaaccatcatttgctgctgctggggcgtcatcatgccggaattgccgctgccgggctggttaagcatcatttgctgctgggacgtcatcatgccgtaattgccgctgccaggctggttaagcatcatttgctggtgtgtctgttgtatttgctgttgtaaaaaaccccttttttggctggtgaaaagtaagcataacaaaattttatcttttttttgttgcaaaaaagcagttttctttaattttattaggaaatttttcagcacgaaaattcaaaattcgttgttttaacttcggctaaaaatacatatgaccaaaatttccatttttcatggtcatcgcctttcggcaccaccgaagggccctttccctttttccaacattaaatgaatttcaatggacccgagtaggtcagcagaaattcttgaaatgccgcctccgcatgacctttgcacattacgctcatttttgggatcaattaattattatggtcgtttcattaaa

SEQ ID NO: 77315 - DNA, 188 bp, Heterodera glycines
  Genomic contig location: Contig_ID=SeqID_2012; Location=1209..1396; Strand=+
  SCN-specific regions: Sequence locations=1-188
atgccaactatccttgcaaatgctgcagcaaccgcaaatgatgccgcaacatcaaatcatacagccacagcaaacgacgccgcaacaaggacaaattacaccagcattggtctgtctgtttgtttgttatatgcagcagggaccggatttttagggttttcacatattctttttgaggatagcatatg

SEQ ID NO: 77316 - DNA, 618 bp, Heterodera glycines
  misc_feature (376)..(376): n is a, c, g, or t
  misc_feature (387)..(387): n is a, c, g, or t
  Genomic contig location: Contig_ID=SeqID_13425; Location=962..1579; Strand=+
  SCN-specific regions: Sequence locations=1-75,97-127,163-476,499 -581,603-618
atggaatcagcgggcgaaacaattctgtccgtgccaccgttactccatctgttggctatccaacagcagcaaaaacagaagcagcagcagaacaacgggtgggtgattgatcagtgatcagtgaatgtttaaaaataattatttaaaaatatgatataaattgcagaaataatgccgacacgaacaatgccacgaacgaaatgactttgtcttcatcggatggcaatgtaaattaatcagaaaagtgtcaacaaatctgtaacagccatttttggacactaaattccttttttaattgccctaatttttatttgattttttcgttaaaattatttctatagattgacttcaaaaatgattgtaaaagcacttttgnggtctgaaatntaatcgaaacgtgacccattgaaatataaaatgtagtaataaatcaaatattttcaactttgttagttctgtattgctgaacagcaaatgcaaatcggcaccaatggcagcgaaagtgccgaagagagcggcgcatcggacggggaaaacggaagtggagaaaagcggagggaagaggaggatgaaaagcagcaggggaaggtgagcatgggaagaagcatcaccaaataa

SEQ ID NO: 77317 - DNA, 2471 bp, Heterodera glycines
  Genomic contig location: Contig_ID=SeqID_13426; Location=730..3200; Strand=+
  SCN-specific regions: Sequence locations=1-137,159-505,530-605,628 -876,940-1350,1372-1438,1493-1622,1646-1811,1848-1906,1984-2370,2398 -2430,2454-2471
  Gene Ontology: Mol. function=transcription co-activator activity; Cellular component=transcription factor complex; Biological process =vasculogenesis
cttgaaattgtcgaagagtccgctactcctcctccgctgtttcgacaacaaacactgcaattcgctgaagagatgatggacgtgaaaatcgaatcgccgcgaggtaaaatttgaaaaaaaaaaattcaaaattacggtttttaatttaattttagatttgcacattcaaatccctccgttaaatgcattcaatgggtacggcactccgtcgatggctcagagtgccgcatccactcctaccgaacaacagtgtgagggacagggagatggggggggggcggaggtattagtggttaattaatggtccgtcagttttgggaccactggttcgatccttaattttaaatgatcataaatttcagctaacaaaccgttgccggtgatcaagcccccgggggatgagaaggaggaacggccctcactgagctacaaggacctgatcatcgaggccatcgaaagcagtcccgaacgacgcctcaaactcagcgaaatttatcaggtcgagtaaattaataaaattattatatttcaataactttttggatttcctttgcaggtgatcaaatatctccacccgtactaccaacgtcggtccgatcaatggggctggcagaactcaatccggcataatctgagccttcacgactgtttcgtgaagcttccgctgaagcagaccagcgcaaacggagttgtcggtaataattaagcatttcaactaatttcgtgatttttaaagcgggaaaaatatttacaggacacttttggacggtggtcactcgtgggccggacgagaagccattgggtccaactcggcgtcgaacccgcggcagcggaaaggccaaaaagggaacgatggcctcgatgccattcaatgggtcacaaaatggtgaaaaaacaaataaatttaacacaataaataatattttcaaacaattttcaggcggaactgcttcaaatacgctttctggcatcaaacacggcacaatcaaagggctgaagggccgccaaagtgttaggtgaggaggcctcatattcattgtcagccacaaaatgcttaaaatacgaatataaatacagctccgacagtggcatcatgagcgacgagggcggcgcgtgcagtcactccaactcgccaaccgaaatgggcacgcgcagtgtgccattgctgcacgcgaacgccgaggcggtggcaccggcacgcgctgcacagttttcggcaaatgttaatcaccaacaaattatgccaaataatcaatccttttaatctttgcagcttttccaattccctcgacccaccgctcaaatgccgacacttgcgcagcaccaccaccaggtccaagcagttcattcgcccgccccaacccccgcgggccatggccacgcgcagagtcagctgagtccgctcgaattggtcctccaaatgcagcaccaacacaaccagcaacaacaactccagcaacagcaacaacaactccagcaacagcaacaacaaaaccttcatccgttcgcttctctccagcaattttccccaattcccaaatcggattctgttgccgcaggcgttgctgacgaagtgaacagcgcaccggctgctgcttcaacaccgacactgatcatggtgagggagggatgaaaagggaagggaaggtaattttatttaatgtttagccgaacgatgccatcggtggtgccgccgccaataacaacgcttttttaccttgcgaattgcaacaactattggcaattgcggcacttactcagcaacatcaccaaccgcaacagcaacaacccatggttccggtgtctgcggccaacggcaccaacaccaacaacaacagcaacaacaatttgccatcatttcactcactgccaccgccagcggcgccggatcataatacgatgacggtataaattaatatagaaaatgagttaaaaattattaaatcaatttttaatatataaaatgaataaaattattaaaatgattcagttgcttcaactgctcaacacggctggcacaagcagtggcacgccaccatcggatggaggacttggccttctgagcaatttggccacccaattggcaccagcggtcagtccggcgccaccacaggtgatcagcaaagacatgatttttagcaaaaaactacaaaaaccttaaattaaaatcaaattaattgaaagaaaatgtttagcatccgaacaacgtcgccgtcggcaacaatttgttggcatcggccgccgctgccgcaacggcggaattgcaacgtttgcacatgatacaattgtacgcacaacagcaacaacaacaggtggaaagcttagaaaaagcatttaaaggagtgaaactgattatgaaaaataaatcaaaataataataataataataataaaaatttcagcttcagcaacaattggccgctttgttggagcagcaacagcagcagcagcagttgcattttcagcaacgg

SEQ ID NO: 77318 - DNA, 2789 bp, Heterodera glycines
  Genomic contig location: Contig_ID=SeqID_13427; Location=682..3470; Strand=-
  SCN-specific regions: Sequence locations=1-313,335-416,438-721,744 -793,817-871,893-1980,2002-2016,2042-2207,2250-2263,2286-2789
  Gene Ontology: Mol. function=structural constituent of cuticle; Cellular component=extracellular; Biological process=cuticle biosynthesis (sensu Nematoda)
atgctttgtgtactcagtgtgccatttgtgtacaattacatccaacaagcccattccgtcgttcaaaacgaggccgactattgtaaggtaaatgccagtgccatgggggggggggtgattagggggagatcataaaacggaggatgatcacattcttgatcatgtccagctcctatttccacattccgtccgtgatacttggaacaatacccctctcccccctctctccccaattttagcatcggtcgacttatctgtggcgcgaattgtccaggacgtctcagcacagcaattccatcacggcgaccattaagcacagaacgggcagagaagccaattacgaaacgcagtcgacaagtgctgtcggacagaaatgtgagaaaaggaaaaagacgggcctacgaagtggcgtttttgcatttggcaggtggttgcgcatacggagcacccggatcacccggggaagatggcaaagacggaaaggcaagaagatgaagatggatggcactttgttaaagggaaagcgaacacggaacattttcaggacggcatcgatgggattccgggagacaatggcccaccgggggaagatgcgaaaggcgaggcgaggccaagggaattctgcttcgaatgcccaccaggcaagtcaagaacaaaccttgtccaattgatcacccaattgtacaattaaggccccattggaccccgaggagcgccaggcccaaaaggaaagccaggagagccgggcacgccggggttggacgcggatgggggcatacgaggagcaccaggcccacctggacctcaaggacccccggtctgatatataatttagatccaaatgcactgtcatttgcagggaaggccgggaatgcctggcccaaagggagtgccgggagcacaaggcactttgtcagaccagccgggtccgcctgggccgccgggaaagccggggccaaagggcctatcgggcgagaaaggagcgccgggaatagccggaaagaacggagtgcccgggccgaaaggaccgccgggcgaacccggacaagtcgggccgccaggcaaagttggaacacgtaagttggccaagggttgtgccgcaaggaaaagaatcgcttgttcagccgggaagcagggaatgcagggggagcacggaatgccgggcgggtgtgcgcactgtccgaatccgagaacggcgccgggctattagcggcaaagaatggcacaaagccaaaagcgcatcgcgattggcccaaacattcgcctatttattcccaattgatcaatctcaccacgaagatgaatgtttcgatagcgaattgttcttcatttcgtccaataaatggtcgccctttcgctaattgctaattcccccgttaattaccccccccccccccaaatgcgtcgctatttaaaattttattttaccctccaatgcaaagtgtgcctttgcttgctcagctgctcgccactcactttccccttcaaataccgtccctttcgttttcctcgtgccatttccatttgcttttcatcccatttttaccttttctatgctttttccctcttttctgctactttttctgcccaccgtttttgctcccggcccaagtcgagaaaataaattgttcatcgaatgtgccgtccgcgcgccaaaaggtcgccatgggccggagacagtcgtttcgcatgccaaaatggagaacaatcggatgattctttttgtttgttaattgttggctttgagtcttttaaattccaaattttgagggattgggagggaatttgtacacgggagacagcgaactgagcgaattgtgcaaagaggacaaggaattcgcagcgacgtcgagaatgacaccccaaatcagagaaggggcacccgtggagcaatgcaaaaacggcaaattgacagtgaatggcaaagattgtacgaaaagaggggggggggggggtaattatgtaaaaatgagtaaacaatttgaaaatttatatatttaagagggaccatttaattattattttctaaatgaaaaagggaagtgtttcgaaaataaaataaatattcccatcagtttaaagcattggaagaaaagcatttttggtgggaggagaaaataattagttaatttaagtggatttaacaagcaaaaagcaaatggattacgagcagtgcttcgccgggaattacgaactgtgcgtttctgattttgctttttcttttgccttttcaatgaattaattaatttgtcagtttcgaatgccctgaagatgcttgcgatggcaaaagtgcgctgcttttggtcaacaaaaagcacgaaccaaaagcaaagtcttactcatttgtttatgtgggcaaaatgttagtgaacgaagtgacggtggcggaagtgagcgcggaacaattggaatgtgtgaggagagagtgcgcggaagagtcagtccccgtggtggaggaagcgatccgatggcggaggaaggcaaaagacgagcgcaaagagctcgcgcagggcaaggacaagttcaaggtgttcaaggaatgcgcagtgaagcggcgaaggattggcaaagacggaaaagcgatgggaggaaaggcacgcatcgaaacactggtggcacatgtgaagatggacaaactcgtgcttttcttcgtcagtttgccgaaagtgacggagaaaggaattggcgaccatttgaattttagggaatgggcggcaatttgtacgcgggcgaaagcattttgtcaggcgaatgcgaggaggacaaactgttcacgagaagcaaagtga

SEQ ID NO: 77319 - DNA, 2567 bp, Heterodera glycines
  Genomic contig location: Contig_ID=SeqID_13428; Location=7..2573; Strand=-
  SCN-specific regions: Sequence locations=1-126,165-891,914-1044,1066 -1263,1346-1390,1422-1769,1803-2567
atggcgagcaacggcagcggcgccatcaacaattaccataatcgcaaccagcaagcgccgctacaatacgcatacggtagtcggcggcgaccgtctccgtccttttacacaccgctcgccggtctcgctgctgctggcggcgccgccgccgcaccacggtcgccccgctcgttcggtggcggcggaggcgaccgtagtggtattgtcatgcagcaactaccgcagcatcgcctaccgtacaccaacaacaattacaggaggggcggttcaatgcgaacattttgtgctgttgcgccgggcgctgattgttgtgagccaggcgatgcttctgctggagtcgccggtgactatgctgttcagcgtcgacagcgagtacggcgcatttttgtgggcttgttaggtagtacggtagccaattgggcattacggtagaaaactgagaagctgttcatatcagcagtagtgtgctggtacggtatcgcatcgtactattttatggttacagtagttcacgcaatagtaaaaaattgcattactgtctcaaatttcgagggatacggtagcgcaaaaaaaacgaaaaaaattccacatcaacaggtctccttttctccacccgccgcctctgtcctctcgaattgctcgccgtcgtccatctcgcagcatcaccaaaacgcacttgcgctgctgcggggcacggacggtcgccgctcggctggcccagcggtcgccgccggcgaccccagcggcaacagcaacagtcgccagcagatggcgtcgctgatcaattttggcccaatcgtccaaaacaataatcatcatcaccacatcacatcgctgatcagctttgacccaaagtcgaacacgctgatccgtgtgcgcgagcatcggcgaccgtcctcctcctcctcgtcgttagaggaggcgaccggcgaccgttacccaccgacgcaaccggcagcgaccagcgctgcgactggcgactgtagcgagtccgtgccgtcgtcgcccgccaccgagttgtcgcccagcagctgtcctactgttggccgttttgagctgctccagcagcccgtttctgctgctggaaatgaccatatgaaagggcgagttcatgcgccgccgcttgtcaacaatggcatgtactcaaactcggcaccaccgacaagtgagtacagctgcttgttgttggtacgcgcgaacaaatcagtccccggaaaagtgccggatttcaatggaaaatttccaaaaattttattttggttgaatttttaaaaaatataaaaattagtttttatgcttttcatttttagtttatgatagtaaaattaattttttttttttttttgcaatttcgtaaaatttttggtacttttccgttttggggccacacatttaaattttaaaaaaataacataaataaagagcgggatgaatattcaaatacagccctttagctatttgagagtcataaaggcaaccatttgggccaaaagatcattgaatgggtccatatgacgattttttcagtcctcaggccaaaggaatttgcaccgatttgaatctgtggccccaaaacggaaaagtaccaaatttttattcggttacagcaattaattcttatacgaaatttattttttttaatttgctattcaaggaattgccaatgtgccatcgtccgatggtcggggtcagcagaaacagtattattacgattacggtggtttggacaacagcagcaacagttacggtggaaatgggcaaattggacccaataataacaacaaccaaaacaacaacaataattgtattgatggtcatgaaaatggtagaacaatgccaaacaacacgaacggtaagttgagatggttacggtagagcagtacggtagcaatttgggaccgaaactgtgggtggtcatggtggtactgtaacgaattgaacaacctcattggtagcctaaagctttgcgaattgatttaacaggtacggtgttcatttggtaatatttttgcaatttctcatttgcaacatgatagttaccgtataaattggtgggttacggttactttttccttaataagtaactaatgaaacacggtagaatacgataggacaaaaattgctgttagggcgagaaaccggtatcacacggtagcgcaattttaatgcgatacggtaacatacggtacaaacaactccttccacaactccactcatttccctgctattgcagcaaacgtccccagcagcgccggtgtgtccatgtacgaagcgtacgtcggcacggctgtgccattggactccccgcgcaccgctttcccggcactgatcgacggatctccgcggcagcggcaacaacagcagccatcggcgaccgctcgccgatcgctgctgtttgactgttcagcggcatcggcgattcgtctgtcgtcgcacagcgtcgacaatggcacatcggtgatcgacgccgtcgccacgactggcggcgattgtggcgaccggtcgcagacggcgactgcagcgacaacggcatttcggcccagagttggcacaaccaatgaaacaat

SEQ ID NO: 77320 - DNA, 591 bp, Heterodera glycines
  Genomic contig location: Contig_ID=SeqID_13429; Location=1103..1693; Strand=-
  SCN-specific regions: Sequence locations=1-208,230-236,286-392,417 -432,467-545,567-591
atgttgttttacatcggtgtcactgatatggtcagtcccatcattggcataacaaccaaagcacaaatgccaatcatttcagttggtcatgctgatgaatggcctcgagacgggtgagaagagacggttcttttcggttttgtgacccccctgaaattttcaaataaaaagtcatttctagggtaatttggggcgctgatcacgaatatgacatttatttttcaaaattccgaatcccgaacccgaattcgaacaaaaattctaaattcataaattacaaggaaaacatatttctaggggttttagaggtcgctgaaaacgattatgacatgcattttggccaaattcgaaactcgaaccctgacttgaacaaaaaaccgagatttaatttactaaaaaatttaaaaggtaaaatatccatcataggtcccagactcaaaattgcataaaaatacttttataggttttcttaggtgctgaaaacgcctaaacaatcaaaaaactgtttcgagtagtgatcagaaaagatcatcaaattttaatgcttattggttaaaatttaattttctggtccggattttaaagaataaa

SEQ ID NO: 77321 - DNA, 1249 bp, Heterodera glycines
  Genomic contig location: Contig_ID=SeqID_13431; Location=188..1436; Strand=-
  SCN-specific regions: Sequence locations=1-141,196-337,370-420,484 -573,595-596,647-1173,1195-1249
atgtcgtgtttcgggattcgggtggcaaccatgataggtattggatttattcttaaaacagaggtgcgtccttatcttataaatagaattatctatccgacatactaatagtgctattgattttaaaaactttactcagacaattattaaaaattactataatctaaaaatattaaaaaaatagtaaaataaaatctctaaagcatcaccaaaatatgcgcaaaccattcagattcaagcgccaatcttgtcatgaatatagaataattaaaagttaaatatgaaagagatgtaatactatattaaaaagaatgcaatttataatttaccgtttcataaataagataaaattcaaaatggaaaaaagaactttaaaattggactcttataatgaaggtagaacatcgattaatcttgagcaatattattaatttacaaaaataattttttaaatttaacaaaatatttaatctttattaaaatgtcaataaaacaaacgaagtatgaaatcttagaattagtggggaaaacaattcttttttatgtttacgaacaaaagttgaaactttgaatttacatattttaacatattttggattttttcaaaaaataatcatttcaaaaattttatttatatattttaatacatattagggagtttagttttggtcattcaaatttgaaagtaagggacttcaatggaaaaacaatcgatatggttggagagattgtacttccaataatgcgagatggaatgcgtcctgttctgataacacttcaagttgcttcgtctgattttgatttgatttgatcatcgagaccaatgctttgaatcagttggggataaagttttttgatgaagtgaatcaaaaattggtgacatttgaagcagcagatactgaaaactaaaaggaaactggttagagtggtgtataatgtgaaaattcaaccgcgttcatcggcgttaattgaagttgcagtaaacgacgagattgacgaacaagcgatattgattaaagtggcatcagaagtgtcggaacataaaattgaaccgacattaataacgcctaaatttggaaaagcaaccataccggtcacaaatttttcaccgcttccaattgttcttgccgagaatgatcaaattggaacgggagttatattggagaagcaaatcacaggagaaacattccttaaattgggattgtttgaatcattcagttgctgttatctccattcagtttttaaatga

SEQ ID NO: 77322 - DNA, 2599 bp, Heterodera glycines
  misc_feature (574)..(574): n is a, c, g, or t
  misc_feature (587)..(587): n is a, c, g, or t
  Genomic contig location: Contig_ID=SeqID_13432; Location=92..2690; Strand=-
  SCN-specific regions: Sequence locations=1-1710,1732-2054,2076-2599
atgttcgtattacgattcctcgctttaatgttcaaaaggggcgaagaaacaattgcttcactcgagaagcacagaaaggaaattcgccaaatttccaagtctggggaattcaaggcggaagacttctcactcgcagagcgagttcttatccgcctagaccagatggatgacgctgaagaattccagcaccttaaaacagtgattggagacgacggaattctccgtctgaaaaccagactggagatgagtgagaagccatacagcttctctcatcccattcttctcgccatacattccgctttggcaaagctgatcattttggatcgggaccaaaaaaggcatcaccttggagtggacaccactctgacagaattcttgagtgaattctggatgccaagtgcccgtttaaatgttaaacggactcttcgggactgtctccattgtcgccgaatgaatgcacaacagtttgcattaccaaccatgccacccttgccgggtgagcgagtgcgccgacacgctccatttcagtcgattggaattgactttctcgggccaacgacaaatttcgttgggncggagaaaaaatnaaaggcatggatcctcatcataacatgcctcgcaacgcgcgctgtctaccttgaggcaacattggacctcacatcggaatcattcatcaatgttctccgtcgattcataagtcgacggggaaaacccgacatcatttggagcgacaacgctacgaccttcaaactcgctcagaaaaccctggagcttctcagtgctccggggccggatcaggaagtacaaaacttcctgacccataaccgaatccagtggcgattcatttcccaaataagtccttgggcaggaggcttttacgagcgcctcgtgaagctagtcaaggactgcttcaagcgaactttgggtcgaaggattctttccttcgaccaactcaacacattcgcggccgaagtggaggccaccctcaattacagaccgattaccgcggtctcagacgcagtggatggaccagttccactgcgtcccatcaatctcttacaaccagagattcatatcaattaagaaacaacaacggacccaattgattcagaggaaatgttttcctccacacacgaacgtttaacttcccgaatacaagcactccgggaagccaacgacattttctgggccaaatggcactctgagtatttaacattactcagagaaagagcccagtaggaccacaaaggcccacgacaccaaaacttcggtgaaccgaagaaaggggatggtggtcctaatctctcaggacctcgttcctcgcaatcaatggccaatgggacgaatcgttgaaacacacggacggcctggagccatccgaagtgttaaagttgaaatccctgtccgagggaccaacaacaagaaaccaaaggacatgccacgaaagacagtccttactcgtccagtgaaccgcatcttccctttggaagcgggtcctgaaatgacggacccaggaactgaagccgttgccgcaaccgaacagccaaatgaaaaccatcccaagctcgctcgagtgccgggacaccaaacggtcaccagaagaaaagccaaactcactcggaaatcgcttccagtggtggctatcgaccctcctcgacacttcgcccttccatttgcaagtggtttcccaatcgggaaatgtgatgagtgtggcctcacttgttacacgaaaggaatcgtcgtaacagtgccacccgaaatccaaaagttcgaaatatgctgtgcagaaagctgcatagttcggcaaggcatcaaagccttgaacttcgaactaccaatcgaagtcctactcaacaatcatcactgtgaggccagattttggactgactcacagcacaccttcacatcaaacacgacccgcccggcagtcgatgaatgtgatctcatcgactgctacttttgtttcacacaacttgtgaatccaacatgccagcccgtcattgcggcaatgctggcaggaggcctgtccctaagcctcctgtgcttcatcttcaccatgtgttccatggtgggatacgccatggcaggactgagaatccttttttggattttctcagtcttgttcgcgcgcttattcaagccgcgaaaagagacatgggtattgagtgaggaggaggaaaacctcctctatcctcaccgacgaatacgccggcccaggccagcaacaagaaactggaccagtggccgagttagccaaatggcaatgcttgtcatggcatctctcccgtttgtacacgggggaattgagacagtggccataatggccaaatcagagagctgtctcaacaacggcacaactaaaatgtgccaagtcaagggaagcgtgactcttgcgcttctcccggcaggacaaccgaatgtcctgtcaataaagaccgatgatggtctcattttgggaacccttcaagtgatcttgaaaggactctccctcgaatgccaagccttcaccaaggcatggaaacgatcatacgagatcgcttccctagccagcaaacgatgtccgtctgctggctcatgtgtcggagacttttgtacaaaa

SEQ ID NO: 77323 - DNA, 735 bp, Heterodera glycines
  Genomic contig location: Contig_ID=SeqID_13433; Location=53..787; Strand=-
  SCN-specific regions: Sequence locations=1-444,486-589,611-633,656-735
ccttttgatgtctttggataaaattttgaaaagcgatgaaaagccttacatttctccggtgattaacattcgccaatttctggccgatgcttctgctcaaatggatcgactgaggcaatattttgacgacattccctcagcctcggctgctgccgattgttctgcagttgaacaatcgacttcttctaatgcgtcggacccccgcaaaaatttccttaaatttgtgatggaccgcggcttttccacggaagacgcggccaaggccattgcaagcggagagtaagctgaaaatcacacacaaataaaccaattaatgaacgaacattctttccagtggagcgttggccaaaatgttccaaagttgccccctgggggaatttgaagtcacttttccgcccatggacagcaaattgatgacgcacaagtacacatagagcaggggcaatagttaaaattgtggattttgaaaactattgaacaacaaagggcgtaggtactcaattggcttgcaattttttctaaaaaaatggttgaggcaccctgggtttttttcaaaattccaactaaaaaaaagccatgatttgttagaaaaaagaattcaaaatccataactgttaattaagcgccaataaatggggtttaatttaattttattgtttttttcagagtgttgcacaatattcgcgaaggccatcagtcaagtgcggtcaaaaaggtgttggtcgaacgtgggaa

SEQ ID NO: 77324 - DNA, 473 bp, Heterodera glycines
  Genomic contig location: Contig_ID=SeqID_13434; Location=607..1079; Strand=+
  SCN-specific regions: Sequence locations=1-376,398-418,461-473
atggccataaaatatggaccaaaaatcgcaaaatatggatataaaatatggaccaaaaatatggacataaattttaaatatggagaggtaaatcttatccatatataaatttgacaatttctgtctgtgtgtccgcggtgtttacgcattttgaatttgctcttatagatgttatgccaatgttagaatagaaaatgatagaatgaaatatattagagtccggtaaaaaaaatttccgggagcgggatcgggagttcaaaattttccgggacgggagtcccgaacgggattccccgtaaaaatcccgctccctaaatcccgtccatttttaacgggagtcccgggcgggagcgggagtaatttcgaaaatttaattaaaaactcccaaaaatatttttaatgcacaaatttaaagggcaataaatttattaaattaaaaatatatagaaaaatttataaaggagaaatttgaa

SEQ ID NO: 77325 - DNA, 2284 bp, Heterodera glycines; identical to SEQ ID NO: 13435
  Genomic contig location: Contig_ID=SeqID_13435; Location=1..2284; Strand=+
  SCN-specific regions: Sequence locations=1-77,99-636,658-712,734 -1455,1482-1492,1515-2033,2055-2284
  Gene Ontology: Biological process=DNA replication

SEQ ID NO: 77326 - DNA, 1219 bp, Heterodera glycines
  misc_feature (490)..(490): n is a, c, g, or t
  Genomic contig location: Contig_ID=SeqID_13436; Location=711..1929; Strand=-
  SCN-specific regions: Sequence locations=1-516,549-583,606-849,871 -1191
atgtccaagccacgaaatgtccataagggtaaaaaacacgaaatgtccaaaactcgaaaaagctcataaaaacccggaaaaggagtctaatttagggttttcggggtcgctgaatacgaatacgaccttcatatcgccccttgtctaacccttgatccacccgaagaagaaataagttcaaaaatttttaaaatatgtgctgtactgacgacttagatttttctattcatttagaccaaatgataagtaataagcttgaaagtctacaaaaagtcggaagaagcgttatatttcagacatttcaaacacaaatgaggatgccgtgaatttgggagtggagctttgcgaaccgaatgccgtgataattttcgacaacgttgaacaacagactttgaacgaggctgaagttcaataatgaacctttgagcgcggaaaaacatattttgggggacattgcctatggctgaatggtatgtttgaagcgacgcanaaaaatagactaaaattattccttttcagaagtgttctttctttgccacttttgccttccagcgatttgttttcgtattttttcgtcgatttccaaaagtttaattatttttaagctgaactagtgacaacaatttcgaccatcattcagaacacagctacgcggctactccaatacagttcggcatcggctcaccggcgccttgaactctatatggctaaccactgtgactccacaagaacagcctgttcaatattcgttgagctcgctatcgacttcaacagcgccttcagccatacattttttcacgaatgtcgtttatattaaaaatttcaacggactggaggcaacccatctgcattttatggttgttttttaatttactacaggcaaatttaaaaaaatatgtttgaaaggtctctgccaccaccctgccctcccggacttcatctgtaaaattaatgaaaacaccgactgatggatggacgctgcccgatctgagctgctcgccatttcattcgcatgtgacaaaagcgatacacatacaggacgccgtcattatgcgaattttgccggacgagtaatgcaacaacaatggtgaaatccatggccaggtgacgccgatcggtcttcaaattgaaggacattcaggaaaattgaaggatttcgagaattttgaggattcgattgtccatgttccgttataaattttattgtatttttaataaa

SEQ ID NO: 77327 - DNA, 64 bp, Heterodera glycines; identical to SEQ ID NO: 51065
  Genomic contig location: Contig_ID=SeqID_13437; Location=503..566; Strand=-
  SCN-specific regions: Sequence locations=55-64

SEQ ID NO: 77328 - DNA, 2122 bp, Heterodera glycines
  Genomic contig location: Contig_ID=SeqID_13438; Location=221..2342; Strand=-
  SCN-specific regions: Sequence locations=1-194,216-283,306-495,517 -657,708-770,792-802,824-895,917-938,960-1072,1116-1643,1679 -1702,1733-1944,1975-2122
atgcttatcccgaatcgcacttgcgccttcgatggtccacacggattaacccagcgattgacaggaatatggacattaaaatgcccggtaattagtgacaattaaaatttaaatgaattatatacaaaattttcttaagacatgaatttggtcagaattgaaacgggggagtgtaacggaacatatgtggagggtaaggaaggaacaataagaaaatatggaaaacaaatcattttaaaggaatttggagttgtatgactgcagtgttttacggtaattaaacgattattttttaattaattgctaattgttgggtaggccgaaaaaagtcgggaatttaaatgagatggattattgaggacagaatcaaaagagaattggagctgcaccccaataaaagtgattgttaaaatggcatttggtggtttaagttgagcgtgccatgctccaccatataatccaaacgtatgtgccgaccgcactgatcgtcataatttcatggtcaccaaatgcttgccaccttttcatttgtgccattcattattttttaggttcaatttttggttggacatcgattcggcaccggcacgcgtttctctgtccatcacaacacttctcacaattgccacccaagtgcattttatttttgtacatttcaataaaattaaatagtattaaaaataaaaaaaatattttcaatttttattctccaggcaaacgctgtgaaactttcgctgcccgaagtgtcctatatgaaggccattgactcgtggatgaacatgtgcatggcatttgtgttcggtaaaaaacaaatcctttaaaagctatcggatgcaccagagcaaaaagattcatttatcaaattcgaataatttcttttagtttacaatcttggtattatataatttttaattttgaaatttccaaactgtcgtttcttatgttttagttttattacattttcaatgaaaattttcaaaaaatcgccaaaatatttatgaaaacataaaagtagcaaaataatgtttttttcgaaagctccaaaagtaatccatacagacatgggtttgcctttaataatatatacaattaaaattaaattatgtattttaaaacacccaaaatgtaatttaatggactcccttcacaaaatccataagtgggaaaaagaactaaacataaaatattattagtcaaaagcacacgatcaaaaagtggtagattcataataaaattgtgggccatttattatttattcgtttccttatttcttttttcatttgtgccttttctcagctgtcatggtcgagtacacaattgcgcactttgccaagaatcaagagcatctgttccaaatggctcgtcagaatgtgccgccttcgcttgtggtcgacccggacactttgaattcgctgttcagttccgtcgccgccgcttccacgccgaactcaaacgacccgacggacgaagcggtggcggtacggcacgaactcgagcagttcctcacctcggaacaattgcacaggtagcgaagcgatacgattttcatagttaaagtggcgggtggggggggggggaatcaaccgccaaggctttttcattcgtgccgtaattccaattcaatttttgcatttatgaaaatgttttaatgtaaaataaaatcaaaaaatatttatttgtcctagagtcatcactaaaactgtatttaaaatattaaataaataaattttttgcttatcagcagacattggcgaaaaaaagtgtgcggagtgttggaaaatgggagacaaaatctgagagaaagttttcggcacagaaatatcattaataaaaataatgtggcgaagagtgccgtgcgttgttcgctgagttcgcggagttacaaaaatgggcggagaatggaggaaaaatattcggaaaatggggaaaaaggtgaaaaaagcgaaaaataaatgaaaaataaattaaaattatgttaagatgtatcggaaatcagtttgccaataatggaggaggagcagaagcagcgcaaaatcagcagaaaccatttgagtgccgacttcttcgacatgaacgaaatacggacgaggcaattttcaaggtgaacgaacacaacgtttaa

SEQ ID NO: 77329 - DNA, 837 bp, Heterodera glycines
  Genomic contig location: Contig_ID=SeqID_13441; Location=701..1537; Strand=+
  SCN-specific regions: Sequence locations=1-21,309-687,726-837
atgatggaggtgaaaatgatggaagaagagagaacggaagaggaggagcaaaacaacaacaatggaaagaggggagaaaaagagaaaatgaagggagataagatgaggaggacgagggaagaggcgaagaagaaacacaagagaaggaagagacaaataggtagaaggaagagaactgagagaaccattgaaaagaggcgaaaaaaagaaggaagaaggggagagaaaggaggaggaaaagaaacaaatagagggaggcgaagcgaaaatggaagaaaagccaaagaaggacgaggaggaggagcaggcgagaagaaacaaccgctgcccgggtcaaaaatggttcaacatttaacaattatttttatttactcaatgtgtattggccatcggaagtcaatcctttatgagtattggctaccgaagggccgggtccgtgggagtgttggtcgccggagggccgagtccttgggagtattggctactggagggccgagctcttcggagtattggatgccagtgggccgagctcttggggtttttggctaccggaggaccgaactcttagggatgctggctattggtgagccgagctcatagaggttttgatttccgaagggccgaactttgggttttgtgcgaattgtcaagggaatatgaccaaaaaaatttcttttaggataatggatcaaaataatataacaaaaagaaaagaaggaaatgttggagatttttgggaggggggaggtgtgcaaaacacatccacgctcatacattattattccaattatttaaaaatggaccctcccctttccacatctgctctacacttcaaaa

SEQ ID NO: 77330 - DNA, 381 bp, Heterodera glycines
  Genomic contig location: Contig_ID=SeqID_13441; Location=1546..1926; Strand=-
  SCN-specific regions: Sequence locations=1-381
atggcagaacaatttgtacaacccgaaactgcggaggagcaacaagtgaaagctaagaagccacacgttgatgagcgatttctttggaaaatcacgcggggccaatttgtgcttgcgattcggctgtgctcaggttaatcaaatttttgacgaccaaattaattgacagctttcagaggactggaacaatttatttcacaacaaagacaaggcacgccggctggaagacgggcgagtggcgattggactcgagatgtgtgaagaatgtgccagaatcaattgctgtgtcagtgatatgattgctgatcaaaagaagaagccgaaaaccaccgaataatacaccaaatttttcgcatttggataattttgactaccaataaa

SEQ ID NO: 77331 - DNA, 854 bp, Heterodera glycines
  Genomic contig location: Contig_ID=SeqID_13441; Location=2018..2871; Strand=+
  SCN-specific regions: Sequence locations=1-854
gtataaaagccccggcaatttgtcagctatgtctcatttgttctgctacaatggtccttgtcatcgaattttgtgcccaaattctcggctgttcccctaaatcactccgcgacaagctcaatcatcccgaggaccgagtgaaggcattgaaggagctggtcggaaaaaaggttcagacgacatacaaggaccggaatgggatgcagaaaacattttttgtcgacggaatatcggaccatggagcggctttgaccccagcatacggcagacttcgacaaccgtacaacattaacattgctgcccatttctacgctcgccaccgaatcaagctgcatctcccatacgtgccatgtgttgtggaaaaatacaccggttgtggcgaagacagatactatccaatggaactactcgaaattgtggatgacgactacaccaacaaagagcgatggcttggcaaattgtttaccgaaattgaggacgatttcattcctgtcaaacgccttggtcgagttgacgaagtcgaagaaattgacgacaatgatggtggtggtcgctacgaatgcagtcaaccgtcttacgtttattggtaaacacatgtatgttaccttaataatgcacttttctacctaaaaacgacaaattcgtttttaagtttatacaaattgtatcttccactccttaataatttacaaattgtgtcttctttctcttaattctgcacttttctacctaaaaatgacattcccaaatgcttaataatttacaaattgtaacttccattgcttaattctgcatgcatgttcactccttaattatgcacttttctacctaaaaacgacaagttcgtgcacata

SEQ ID NO: 77332 - DNA, 845 bp, Heterodera glycines
  Genomic contig location: Contig_ID=SeqID_2015; Location=844..1688; Strand=-
  SCN-specific regions: Sequence locations=1-278,300-490,514-733,757-845
atgccgccaccgcatgatttgagcaaccttcgttcatttctcggcgcattgaattattatggaagatttattaagtccgtgctcgaaatcgcgaacaactggaccaactttgcagacgcatcaaaagacggaattggcaccacaatcagccatatttttccggacaaatcggaaaaagtaattgagcatgcgtcatgcaccctcaacgacgcacagagaattacagccaaatcgaaaaggaacaattggttgtcaaaaattccaccgaatgctatttggtaggaaattcacgcttttcatggaccacaagccattgctggcgaattttgatagcaaatatctgtacggagacagattgctatatcaacgccatccgccaaactgctaccgatcaattgccgatcacaaagcagagatttcagaaatgacaccaatagacgaaatacttcggaaattttcttaacacacaaaatccgactggccacaaaaatgcactgacaataatctgtcaccgtattttcagattgccagagcgcccaaaagagtccacccaagcaccgttagccctatggacatcttgctcacgaccattcaaatgcattcacatcgatttcgccggtccctgttcagatggtcactcctatttgattttgatcgactcattaattgcctaccgactcggatttccagaagaaatcgtttcagacaatgggactcaatttcatgccgcagaatttaaggaattttcagtgaatttggcatcaagaataccttcacttcaccgtatcacccgtagtcgaatggccaagcggagcgattcgtcgatacgttcaaaaaggcaatga

SEQ ID NO: 77333 - DNA, 584 bp, Heterodera glycines
  Genomic contig location: Contig_ID=SeqID_2017; Location=471..1054; Strand=-
  SCN-specific regions: Sequence locations=1-207,229-267,315-546,569-584
atgtcttcaaaatttattgaccgattgtcttatcaaaagaatttaggtaagtttaaaaaaattggcaatttttgatgaaaatctgtgaaaaaacaagccaaaattacatggccggaaccccttcgcaattttatccgaaaaaaactgagaagaatacggtaattgcctaaaaataacaaagccatattttaatggtttgatgaaaattttaattttttgctttgtttgaacgttcaaagttcggcactttaattaagtgagtcaggagaaaatcattttaattattttttacattttgtgctaatttgtccattatttccaattgttcatctgttccggccatgtgaattttggatgctatccaatgcaaattttgccacattttttgtgccattaaattcaggcatcatttggcgattgattttgtattgctaataggaatttaaagattattagcatttgtattaattcaaattcactttgcagataatgaaaattatcagaggaatgactcacttcttctttgttattctgcagcaaacgttcatatggttccaaagtatttcagagttccgtatcaataa

SEQ ID NO: 77334 - DNA, 95 bp, Heterodera glycines
  Genomic contig location: Contig_ID=SeqID_13444; Location=420..514; Strand=-
  SCN-specific regions: Sequence locations=1-95
ctgatttaatacggaattggttcattgaatcacatgaaaagttgtatggagttccaattgctgctgaggaaacggaactgatatggttcgcatga

SEQ ID NO: 77335 - DNA, 790 bp, Heterodera glycines
  Genomic contig location: Contig_ID=SeqID_13445; Location=657..1446; Strand=+
  SCN-specific regions: Sequence locations=1-169,206-330,372-372,395 -405,427-520,559-790
atgtcgattgacacggtacatgccctcaattttgtgcatcgtcaggaagaaaatagccgaaaatcaaatagaattgatgaagaaaatcaaatttcatcaattataaatcagagtaaccctgatcccaagcattacaatcttggtagtgatcagggtactcttggcattcattttttgattttttatcttttaatttttaattttaggaaatttgcgcaaattcatccttcaatttaatgataaaatttcaacgcaaaatgaaaaactgatggaggccaaaaagatagccaaagatgaacaaaataaaatgcacgaaagatttttggtatgtaaatttaaaataataaaaattcttaaatttagtaaatttagaaaaaagaaatcagaagcattcagttagaccatccatttcaaaagtacaacataatcacaatggtattacgtgcacaaaacataacaattggacgttattttcttgcaaattttctcaatggaggaaatcaacagcaattgggaattgtaaaaattttatttaaaaatttacttatatttttaaatgaagtatgaaatacaaaaatccaaatcagtcccaaattagaggtaaatagcatgcgaagtaattatttgtcatttatcaaatacgcagtaattaggcgaccttagtccctattcttcaatttgaatgacgctcagaaaaggaattttcgcacatttgctaaatttgcgtttaatttattccaagcatcaattgccgttttgtttgttcattttgacactcgccttttatgaa

SEQ ID NO: 77336 - DNA, 1189 bp, Heterodera glycines
  Genomic contig location: Contig_ID=SeqID_13448; Location=2163..3351; Strand=-
  SCN-specific regions: Sequence locations=1-847,869-1058,1080-1189
cgacttctcaatgagctttccgaacgttacaaatgcaagtggggcttcgactttgaaactgaacgtccgctggaaagtgctgacagccgatttgaattcgaagctgtgcctgccaactcagtccccggcttctaccgcgcttcgaacgcactctcaccattgaatttgtcgtcaagcaacagcgacaccgagaatcatcactctgcttttgtggaggaagagccgatgctaatcgaagggaaagaatttgggtcggaagctggtcactgcccccgtaacaaaaagaggacagagaaaggtggcgcagtcttgagaaaacttcaacagaagagcattcaaacgccgaaaagacgacgaagcgaattgggacagacacgagttactggtgaggaaacagagatattaaaatagaaattggtaattatgttaaaagtaaaccattttattaggtaacccgttatttcattttcagattttttatcaacgcgaaaacattcgtcggttcacgccaaaaaagccgatctttgcgatgactcaaacgacgtcggttctatcgcggattactcgccgcacagtcgaagacgccgttccctgtttctgtttcctgaggaaatgccaactcctaagaaatccatcgtccgtcaaagacgttgcggagctgtagggccgtcgtccgtggtgtcgacacttttcaaataaatggcataaacgcttttttaagggatgaatgactttaatccatcttccatacgattttgtcatttcctctctctctgttctgtgaatagaacgactttgtgaatgagtctattgactttctttggtgacgaaattcccctcgggggttttcttttggatgggagcgttcgtttattttctgagctttggggaatttcgtctgttgatgctagtccttcctaattttcttagcatcccattcttttgtgtatgttcgtgctttttttacaactcgcattgctataaatgtgaccgaattctttcctttctccacaactgaaatgaaccaccttttcttatcctttcgtatcaaattcaactaaattttttattttaaaaatgttggttacaacatttcgaattgttcttttattttacacatttttttccttttccaccatcggaatagcctttttatcgttaatctttttatccaatttgtctgaataaa

SEQ ID NO: 77337 - DNA, 290 bp, Heterodera glycines
  Genomic contig location: Contig_ID=SeqID_13448; Location=523..812; Strand=+
  SCN-specific regions: Sequence locations=1-95,118-290
gttcgtacagcgcaaagaccggtggtcgtaatggtggcgccggaaaagcaaaaaaacggagaagagacaaaagttgggagagaaaaggacgagcaaaagcagcagaagcaaaagcaaatctgtggggagataaggcaaaagctgaagttggaagaacagtgaaaagagagcgaaacgatgggaggagagaagggaccgaagcggagggaaatgccgacgaggaaaagcaacttcttggacccggaaacagacagacttttggcaaacactctctgaacttagaattctga

SEQ ID NO: 77338 - DNA, 1762 bp, Heterodera glycines
  Genomic contig location: Contig_ID=SeqID_13449; Location=210..1971; Strand=+
  SCN-specific regions: Sequence locations=1-1147,1179-1477,1499-1762
  Gene Ontology: Mol. function=water channel activity; Cellular component=integral to plasma membrane; Biological process=water transport
tttgctcagctgtcgaagtttctttttagcaaattggtggccgaattcgtcggcactttgctcttcgttttcattggtcggtcttttgtcttcgtttcgccattctttcctttgtcccgttttaggcattctttccgccgtctcttcccaacattcggacagtgtccccgtgctcagtgtcgcttttggccatggtcttgccattttcgtcgtcatttcctcgttgggtcatgtcaggtgccctcttcgcccctttgttttttgctgttagccttccctcaatttccagcggcgcccattttaaccccgcggtttcgcttggcattgccctctccggcaaaatgcgccctttcctcgtccctttttattggttcgctcaactcagcggcggattttgcgccgcttttctcgtctctgttggtggacatcttcggctacatcctttgataaattattccttcagattgttaccaccaaaaaccaattccaatcggtcgccggtggcgccaccattgtgccctcgggcaccaatttgtggcaggtgagccgaagggaaaaagagagagggccatcgggtcttttgacactgtctcttccttcccccaggcactttgtgccgaggcattgctcaccgcactgctcgtcctctgtgtgctttgttgtgcaattgatgcaccagcacaaaatgctctgtttgccccgctggccattggaatgtccatttcagcggcaattctcggcgggtaggcatcatgaataaaaaaacgccaccaaaaccctcccgggcctagcgcctcaattagcggcgcctcactgaacccggcccgttcctttgggccatgtttggccgcttcgctgttcattgacgaggtaaggcaatgccaactctcctcttcaccgtccggttgtttaatgttctctgtttcccttagggcgccggttccattggcacaaaactcaccgacccaatttggtcccttcactttgtctattgggtcggcccctttattggcgctgcactctccgcctttctctacaggttttattctctcatgtcagccggccattcactaacaatggcttggcattttccttaggattttcttcgccagaggggataatcgtcttctcaaccgatgacaacgaaaaacttaacaaaaacagaaaaacccaaagaacgcttatttttgatcatacatataatagccaggtcacaaatccaaaatccggacaattgataaatcttttaaaaactcgtaaaaacagataaaatcctccatccaccttatgtattattgtattccgattgcactttttgtttatgtgttttgatcattcaaatttaaacttaaaaacgaacgacgaataaataatgaggtgagaataaagacgaaaataagcccaaagtgttgggattggtacagaaatacgactgatcaaaagaggaggaaaagcggggagagggggggggggtgctaattaaagtaattaaactgaaatgtgagataatatttcaatcattccgcccccttcccccgcccgattccagccgatcggtctcaaattttgcgatttcccccattttgggccacccccgagccgatcaagtccgcgcttctcgggcaatttcgataaatgaatttgtgcccatttggagacaatccctcgctttatttgttgggcggtaaggagaacatcggcaaggggtcgactgaagtctgaagggcaaaggaatataccaaaggaattgtaaaacccaaaa

SEQ ID NO: 77339 - DNA, 714 bp, Heterodera glycines
  Genomic contig location: Contig_ID=SeqID_13450; Location=476..1189; Strand=-
  SCN-specific regions: Sequence locations=1-41,83-105,127-374,397 -469,491-631,653-714
atggacagtgagagaaccatcggacaaatgcacactcccacgacagaaaacaagctgaagcaggtgtacatccccacctacaacaagcccagcgtccatttgctgggcgcggccaacgcccaaccgacgaaaaacccttgtgagagttgcaaggtcggcacttttggtgtttccttgctttttattggttcgatttgcattacgttttcagaatgaagaatctgaccattggtaccaatggggaccgacgcatttgcactttcggttcgtttggttttaactttactcatttccaatggttgtttaagtctgtgcggagattgttggcagaattggaagaaaatgggcggactgaagacgacccacgaatttggtgacattcataattagtgttgcttttgtttttacccaacgcccgttaagacattttcgatctcgacggttcaaccgatgttcgttcctcaatcgcttcttctgctcctgtaaatgggcgattgggaaaaatcgtacagttaatgggggaattgtcacaaaaattgaaaacatgcccttctcgcaatcaacatttagtaattttcagaatcgtttgagtatcggtaggaacggactgtcgcagtcggcgctgaaaggcagtggagtgtcatctttgcttggccaaaagggacgggtggcattttacctgaacgcggctttggaagcgcgagttgccaggag

SEQ ID NO: 77340 - DNA, 327 bp, Heterodera glycines
  Genomic contig location: Contig_ID=SeqID_13453; Location=1070..1396; Strand=-
  SCN-specific regions: Sequence locations=1-30,217-327
atggccaaaccagcccaggaaagccagacccaagccaagccaagccaggccaagccaagccaaaccaagccaagccaaaacccaagccaagccaagccaaaccaagccaagccaagccaagccaagccaggccaagccaagccaaaccaagccaagccaagccaagccaagccaacccaggaaaaccaacccaagccaagccaaaccaagccaagccaagccaactcagtcaaacgtgccttcgagcaacgattttgtcactgtgtttttgcatgtccaacaaaagttgaggtccgaccagtgagtcgacacttttctcgaatatga

SEQ ID NO: 77341 - DNA, 1386 bp, Heterodera glycines
  Genomic contig location: Contig_ID=SeqID_13453; Location=2522..3907; Strand=+
  SCN-specific regions: Sequence locations=1-675,697-854,882-1054,1076 -1162,1341-1386
atgagtgaaggccgatcaaggaagcccttttcccgtgacggaggaatgggaacactgcaaagggtgagaacgaaatggcaaggcaatggggggaggggcactatttgaacagtgatcagtttggtcggaaggtgatccttctgatcatcgcgatcggggagtggtccctctgatcactctgctccgagcgtttttctttcccatcaattttgagtttctgtccaattttctgggccctcccccccctcgccctttgaaatgtgcgaccgttttgcagaagttcgcccattctccgcggcttcacctgcggcctttggatggttttccattcgctgacagtcaatgcttttcggcagaacagtaaatgatgaatgtgtgaagtgattgtgcattctctgtgctttcgcaggtgatcagcagaagcagttccatccggtcgccgttcttctcaccatcaaagattgggtgactcatttcttcgcttgtgaacactgccgcgcccatttccatcggatgaccacaaaaacggccaaaattgaggcggcggtcagtcgttttcccaaaattcctctcacttttctttgctaaggttcgccaaaaggaggacgtctttctgtatttgtggaaggcgcacaatttggtcaatggtcggctgaggggccgcgagacggaggaccccaaattccccaaataccaattcccgccaaagttcctttgccccgagtgccgcaggggcgacaaattcgacgagggaaaagtgcgcgaatttctgctgaaatattacggccgagtgagaccaattgatggagagcagcgaacgacggagaacggtcgcggaaacggggaacacggcggaggaggggaggaaaaggaagaagaagcggataagcagcgaaacgaacggatgccaaaagtgatcgggggaacggcggaggaagaaaagtgatcaaaggtaaaagcagaggagaaaagtgatcagagaggaaaaacggaggagaaaagtgattggaggaacggaggaggaagaaaagtgatcaaaagaaaaacggaggataaaagtgatcagataggaaaaacggaggagaaaagtgatcagagggaaaaaatgtgatctgaggaaaagcggaaaagaaaaagaaaaatgattagaggaacgatggaggaagaaaagtgatcaaaggaaaagcggaggataaaagtgatcagataggaaaaacggaggagaaaagtgatcagagggaaaaaatgtgatctgaggaaaagcggaaaagaaaaagaaaaatgattagaggaacgatggaggaagaaaagtgatcaaaggaaaagcggaggagaagaaagatatagcaccacatttgatttcatttgcactttcaccaaagcatc

SEQ ID NO: 77342 - DNA, 101 bp, Heterodera glycines; identical to SEQ ID NO: 56211
  Genomic contig location: Contig_ID=SeqID_13454; Location=186..286; Strand=-
  SCN-specific regions: Sequence locations=1-101

SEQ ID NO: 77343 - DNA, 215 bp, Heterodera glycines
  misc_feature (87)..(87): n is a, c, g, or t
  Genomic contig location: Contig_ID=SeqID_13454; Location=2048..2262; Strand=+
  SCN-specific regions: Sequence locations=1-215
atggctgctgctggggtgccacctttgtcgtggcctcagtttctccagcgattggcagctgtcgaaatgaataaaacatgcagctcngtctgtgtgttaaagaaatttggcgagttaattgacttgtgtaaatgttgcctaaggcacaaatgctgtggggaactcagcactggggatgctgaacctaaagtctggtggttggtgttggtatacga

SEQ ID NO: 77344 - DNA, 2803 bp, Heterodera glycines
  misc_feature (37)..(37): n is a, c, g, or t
  Genomic contig location: Contig_ID=SeqID_13455; Location=1..2803; Strand=+
  SCN-specific regions: Sequence locations=1-177,208-574,596-1107,1130 -1232,1254-1336,1358-2102,2127-2803
  Gene Ontology: Mol. function=ubiquitin-protein ligase activity; Cellular component=endoplasmic reticulum; Biological process=ER -associated protein catabolism
gcagctctcggtggaaatccacttgcacaaatggctntggtagaaaaaatcggaagaccgcatcattaaaagaaatatctgaaatatcattcatctaaaggattttttagggctatcgcttcgcgaacggagtggggacaaagcaaaactgcgaaacggcgtgagaattacgccgcaaatggaaaaaacaattaaattttgaaattttagtttaatgtggtacaaaaaagtagccgatcgagttgcttcacaagttaaattgactggaactccttccattcagcgcattcgaatacctgacgaattagtatttgttatatcattttgatccaaaattggttgttttttcataaaatttcataaaggagtcttcctcgattacgggcactttgctggacaataacgttttttcctattacaaatatctcgcggaaacgggcgacatgcaagcgattgtgagtcgttgtcagtttttaactgtggtgggattggtgttttagctcggcttggctcagctttatctaaccggcgggaagggagtggcgatggatttggtaaaaacaaagaaaaaaccttaaattttttaaaaatttaagaattcagcagctaaatattttacaattgcgtctgaggccggcagcagtcaagcgaatggatatttgggcaaaatgtacttggaagggacgcacgccactccgcagaacaacatcaccgcctttcagttcttcaagaaggcggcggacaaagttcgttggggttgtcaagaattaactacaataacaaatttggtttgtcaattttggcacctttttatgcaaaaatagcgggcaagaatttttaacttaacggtaacatgtgattcactgaaaagggaaatcgactactgacaatttcaccgtgaaaaaccttcgcaaatttttaaattaaacaacgattgtactagtaaatagccttttacatgtccgtaaaattttttagggcaattccatcggtcaagcgggccttgggatgatgtttctttacgggtacggggtgaaacaagagccacagaaggcgttgaaactgtttgcacttgcggccgaacaaggctcacccgatgcgcagttgcacttgggacaaatgtattacaagggattgggcgtgaaaaggtcgttttatggacgaacattaatgaaccgacattgtttttttcagggatttcaagcaggctctgaaatactttcagttggcgtcccagtccgggcacattttagctatttacaatttggcacaaatgcatgccaagggcaccggagttctgcggaactgtcgcgtggcggtcgctctgtacaaaaatgtggcggaaagaggccgctggggcggacgctttatggacgcgtatttgcgcttccaaaacggtggcgctgtggatgaggcggcgtttcgttatttgtttttggccgagtttggatatgaagcggcccagacaaactttgcatttttgttggaccgtgaggacacgcatttgttcgcaaaggaggaggcgtaccgcagggcgttcatgaactggttgagagcggccaaccaggactacccggtagcccgtgtgaaattgggcgactacaaatactacggactcggcagcgagcccagcatggaggaggccgcggagcactacaaattggccgccacttcccatcagagtgcgcaagcgatgttcaacttgggatacatgcatgagcatggacttggcgtgcaaaaggaccttcacttggccaaacgctattacgacttggcggccgagacgagcacagaagcggtgtggccggtggcgatggcactgatgaagttgagggtggagtttatgctcgaataccttttgatggtaaacccggaaagcgagatttgagcaaacaaatccccggaaattcagaatttctaccaccgcagtccgtcgcttgatctgctggacgccgttttgggccccgactgggacttgtacctgatgagtctgctcctcggacttatcgtctggctggcctattgttacttcaggaacagacaaaacggcggaggaaggaattagcgaagaattttatatcggaaggtgtacactgacaaatgagtgactttttctgtgatttgctatttattttatttatcagtaaaagaaatatttgcattttgaaaagaactgttgccgattacttatcatatctttgtttacctaaatctttgttgatttttaaacttttgattgttacaaaatccatcaaagcttaaatttgtctccgtccctttagttgtattttattggccattattttttctgttacagttcgatctgaagtttgaaaatgttagaacggcttccgtctcagttagtgtcacgaagcgcgagctttgtccaaactcggatgacggcaaacaccgtcaattttttcatgcgtcgaaccggcgacactttgtggaagacggtgacgaacgtgtccatgggagggatgaagcgggggagggcgcggacgcggcagcccatccgaccgttgccccaattttaccgagtcggcatgctcaagtcgagtcagtcagtcaggcattgacacttcccaattggaaaatgccgtcattcattaggtccgatgcgcatccgttaccctgggttaaatgcgcccattgtcccgcaaagtgttgccgaattggcctcgagaccgttttttgttgaggaacagtcggagcaggaaagggaggaggtgctgcactttgtgaggacccaagtggccaagaagagcagtcagaagcgccatttgtgcaaggagcgcctcac

SEQ ID NO: 77345 - DNA, 890 bp, Heterodera glycines
  Genomic contig location: Contig_ID=SeqID_13456; Location=383..1272; Strand=-
  SCN-specific regions: Sequence locations=1-98,120-317,342-430,473 -571,593-890
atggaatacgtgcttaaactccgtggattgacactcaattatgatgtgatcaacaaccaaggctttagatataaaaacagcaagtcaaacgttatgctcaaacaggagagattgaaccaattaatgtaatatacccaaactttattagacccaatattcgtgatggtggatctgtaatatcaagctctatgcaaaaatgttatcagccttatgttgggaagggtattgtaggagccgattataatgtttatagtcttaaccattcattgtaactattttgtcagcacacattgtaataccttcttcaccaatcattgtatctctctcacacatacacatatgtacccttttgtattttgttcaccatttattgtatctctcttccacacgcataaacataaccccatacacacacgtactcatacatggaccccttttatttctctattttataccaaaaattgtatcattttgtcgttttattcacgtttttaataaaaatgcatgcagaattaggcaatggaagttacaatttgtaaattattaagcatttgggaacgtcgtttttaggtagaaatatgcagaattaagagaaagaagttacaatttgtaaattattaacgaatagaagatacaattttgattatgtgcacgaacttgtcgtttttaggtagaaaagtgcataattaaacacattaacatgtatgcagaattaagcaacggaagacacaatttgtaaattattaagcatttgggaacgtcatttttaggtagaaaagtgcagaattaagcgaaagaagttacaatttgtaaattattaaggaatagaagatacaattttaaaaaatacacgaacttgtcgtttttaggtagaaaagtgcataattaaa

SEQ ID NO: 77346 - DNA, 325 bp, Heterodera glycines
  Genomic contig location: Contig_ID=SeqID_13460; Location=1928..2252; Strand=+
  SCN-specific regions: Sequence locations=1-55,78-113,145-162,207-325
atgcagcaaatgatgtttgtggcggagaaaattgctgacacggcattcattcacaaaattttgaaattttatggcagaatgtcactattttatcaagaaaatgtaaggtttgcgcaaaatttggttatttttaagaaaaacccaaaatatgtaccaaatatgtaaataaaatttttaaaatggttatttttttagaaaaaaaaattcttcggaaagggtgaaataggcacaaaatgccataaaaatgacctaattaggcctagaatcacattttagtattttaaaaattagtttggttaatttttatttttcacaagaaatttta

SEQ ID NO: 77347 - DNA, 952 bp, Heterodera glycines
  Genomic contig location: Contig_ID=SeqID_2018; Location=53..1004; Strand=-
  SCN-specific regions: Sequence locations=1-351,385-397,439-440,464 -503,548-741,776-952
atgactccaaaaagtggcattaaccttgacagtaccttctttggtcgtccaaaatctgtacaagtacagtacaaagccagcagtagtaaagctggaaccgaaccagggattgatgatgaacaaagcaactctctaaatgagccagtattgcaacggttgctaacccaaaggagagacagtaacccaaacagtatccctttccattttgaacataaggtgatatatgataacgaatttaagaatatggatttaaaacccaaaatttattaaaaccccacaaaatttggaccaatatcctaaaaatggcaaaataaacgaaatataggctaaaaattgcctaaatatcatttaccatttagaaaattttaaaaacaaatttgaaataaatttgggtaccttaaatatttttgaaaacaaagcaaatatgaattattctgctgaaaacctttaaaaatggaatgggtcatatcctgtcttgaattttaatcattgtttatttattacaaaataatttctgtaataaacttaatttgcttaatgaagagacaggatttaaaaaacaattcgggattacacttcgagcagggacggcaatcttttggcgcttcgagttcaacgaatccagcaggcctgaatcctctgtatcgttcattaagtgtgcgatcagattcaagcacattaaatcgtatagataagataaacaaaatcagtcaaattgaagaggaggaaattacggtaaaagaaaaatttgtaatttaaaatgacaatatttttatgttttccgaatacataacaaaaaaatttaactttaaatccaaatcaatgttaaatttcataattttccatgacaactgtcaaggtgaagaagcaatataataattgctatctaaaatggctgaatatgtttgttaaaaatcattttagaccaaatatattaagttttggaaataaa

SEQ ID NO: 77348 - DNA, 1964 bp, Heterodera glycines
  Genomic contig location: Contig_ID=SeqID_2018; Location=1943..3906; Strand=-
  SCN-specific regions: Sequence locations=1-10,48-76,99-217,256 -289,332-393,415-530,620-872,896-940,962-968,990-1356,1395-1444,1466 -1587,1613-1639,1663-1676,1717-1964
atgaacttcctttttccactcatcattttttgttttgttacatttgccgccaatggaatggacctgacaaaaattgatttttcaaaagctcaacctgtcgttgatgacccgccaaggttaagaagcagaacaatgccgaggaaaactcaccgcttcagcgcggaattgaccaaggaaagtcgccaagaaatgtatggcatcacaaaaacgcatgtgcgtttcttaaaagaaattaaaataatcccttaaaaatcccgtaaattttaacgggaaccccgccgggaaatggaaaaaattttttttagttttttaagatttttaatcaaaaattcaaaagaaagtgagattttttagtagaaggttttttgatattattagactaattatttttcaaatgaaaataaaatgtcgaagtcttaggttaatttgtgggtttttatgctgttttaaaaaagaaagaaaaataatttaaagaatgactttgaaggacgaaaaaattcacaagaaattattttttcggtattttttccaaaataaatataaaattggaaattattttgatttttttctctattttcattaaaattaataaatttcaactttattttgttttttttttcttcttaaatgacttatcattcaaaatttagcaattttagagacttttagcttaattttaacgaatttgaagaaattttggagaaattttgccctcaattttcataagtttatgtgtatgtttgccatgtgacgaaattttattccttaaaatttaagtttaacaacacgactccgtctccatcatcgtcgtcagtcaatagattgaataacaaacagttggaattgttcaacaaactcttgcaagagctgaacaaaaatttggcacagattttgaaaaacattcgacgtccaaattggttcgtcaagctttttgagcacgaaaagaaagctgaaaaccccaaagtaatgaaagaacacatttataagacgttggacaatggggccatggagagcccatgcgaaaaaattatgccaatctgcgaccctaaaactagcaaactgtacaatgaccatgaattaagacaaaaggtacacatttgcccaaattgcaacaattgatcaatcgcaaaattttttattctgtgctgagacatttgatagaataagaaagttaaaaaaaattttgaatgcttttattaatttatataatgttataccttcgtcattatcttttgtcgtttcttaaaaaaacaaatgtagaaaaaatctagaccaaatattcctctacttgggttatatcatacgctgtgacatcaaataatgagtttttaaaaatatcgaaattgtagtcccgcgtaaaattaaaatatattgaaaaaggaaattaaatttttggtaaaatgtaccgaaaatttgtaggtaaaagaaattttggaccagttgacaagttggacggagttgaaggattccatctccagtgcgtttaaaaattcttcagagaccgatttatttgatggtgtcgacagcactggcacaactccattttattggtcgaacgaggtaaattttttggtaaaaacatggaaattttggaaattgaaattgaaatatatatgattaatgaaaccaacaactaaacaattaatggaaatttttaaatttattcaaaggaattctaaaaaattgtaattattttaataaatatttataaattatcaggcgcaaaactctaaaaaaaatttttaaatccttttgtaaaatttaacaatgtttagcatttaaattcttttgaacccctttgggattttcggatttttacaaatcattttgaaatctatgacccaggaatgcgatcttatgattttttaaacaacctttttatatttcacattccattttattggatgtaggataacagccaatgccaatcaatttaagattgtctaatgcaatagataaataaa

SEQ ID NO: 77349 - DNA, 4674 bp, Heterodera glycines
  Genomic contig location: Contig_ID=SeqID_2019; Location=2169..6842; Strand=+
  SCN-specific regions: Sequence locations=1-48,78-87,109-134,168 -715,768-906,986-1184,1206-1378,1402-2176,2275-2375,2407-2487,2510 -2591,2625-2831,2857-2859,2881-3009,3135-3216,3307-3325,3365 -3373,3416-3811,3836-4150,...
  SCN-specific regions: Sequence locations=...4184-4320,4342-4381,4404 -4674
  Gene Ontology: Mol. function=apolipoprotein E receptor activity; Cellular component=lysosome; Biological process=receptor mediated endocytosis
tggtttcggcaccatcgcttctttttgtcgtgattttctatttgtaagtaataaataaattatttgaaaatataattgagctcattctatctttagtcttattttttaattagatgaccgtccgctgaaaaacttgtaaattttccaaaatatttctaataaattggcgcaattttttagagcttatatattttttcgtgataaatctttttcctaaagtctacaaaatcctaaccccaaaagcagatgaaaaaaaacttgaaaatagaaaaaactcattaaaaaggagtataaaaatggcaaataaatattatagtatcttttaagcacaattcctgaaagcttccattatttggcaataaaaggacggattgatttgatcattcaatgggtccaaacggcgaacagttttgcctatattgcacagacagacaaagttgagcagaacgatgttgatcagctgattgagcatttggagcagcaaaaactgctgatggacaacactgatcaacccgtgatggtcaccaaatcaatcaatgaaaatggagtaaaaatggtgataatgtgagttaaattaagtcggcatctcacgacaagtcagaccattaatttatagttttctgtaataatgaaaaatcttgggctgcaattggttgacataggcaaaaacgcaatttttcttcggagagccctaaattgataacagacctatctccacttttttggcctatttttcattttagttattgtcaaataaataaataagcaaatttagacatttaataattaaattaagtttatttgtttaggtcatcaccatttattgagaagatcaaaacaaatgaaaagctgatcaaacacatttccattttcatcttattatggtacggagcaacatttttgttcattattttaatattattattattcaattaaatttattgtttaaagtaattaattaaaaattttatttatcaaaaaaattcctttaagggtatgcgacgcattcatttattacggggtcagcttattcagtacaaaacttgccggcaatcgctacatcaatttcacactcattgctttggttgaagtgccttcgtacgttttttcaccatggctaattgacaggtatcatgtttttaaataatcagaaccggcctttttaaattctcgatttccaagactctcatttttcgtgattttttaaaaaatgccttgacctattatgaatatgacccaaaaattacttgcaactttttggaaaacttgaaatttggattttattattggcacagcgaccggtaattcaattttgctggtctttctgcggggctggtaaaattatcatgaatttttgtttaaattatttaagaaaattttttggcataatgcattttccactacgggattgggattcaaattattgcgggagggttctcgattcaaatcccgcattttccaaaaatgcggggttgctgactgggatcccgcaaaatcacgcgcgggatccctcctgtgcagtttctatcagggatggaacggaattccgatttccgacatttttggggtcggaattccgatttcagacttccgaaaaatttttgggcctagggacttccgaaaaatttttgacccccggaattccgatttcctaaaatttttttggtcctcggaatggcatccctggtttctatgatttcatgttcattccggctataaatacttcattcaaacggcgtgttatagctaatttttactctttctgttcgtatttttgtttttttagaaaaatttttctattcccctaggaatttttcccgaatttacctaaaaagtccggcctctataaaacggtatgctgctaatgccaaattctttccatagaatgggccgtcgcctgttcactgcgtttacccacctgttggccgcgttggcattcttttctggcacgtccattctttggctgccgaatgtgccaccatttgtccaactgtgcctttggctgatcgccaaatttgccattgcttcctcgttcactggcctttttgtgtacgccagcgaagtgttcccgacatcgaagcgtggaatttgtatgggcatttgcacgaccgtctcgcaattgtgttgcatcattttgccgccaatgatccgagtgatggtgaatttatgcattttataattaaataaaaattaatttaataattgaatttaattaaatattatcttgttcaaattatattattttacggaaattttaattaataaattattttacgcatataataaaagtatagttaaacaagatttcaaattttattggcacttttatagcaaagggtacccactagaaaaacaaaaaaaaagtgtgaaacgctttacttttacttatttatttttggtttcttggtttagattagaacttcacgaaaattcattctttttttagcccctctaaactctgcaatttagcgtctctattacaactttcgccatttttccatcattttgacctttttttttgatttcgtccctactcatttgtaatttaatataagtaaatttccaacatatcgtttattgcttatctagtgcatttttaattaatgtttgtaattttgcactttatagctgtccttttcgcctatgatgccaatgtttttctttggcggttacgcattcatcgcaacatttttaacatttttgttgccagaaacgcggggaagagaattgccggattgaattgcacacgcaactcgtgtacaaattggccttaatttaattaattcatgcttttgtatattctcgttttaatatatttgagtatttttggctttttttataaatttattatttaaaggacaactagcagatgatttctttgaaaggacatgtagtaaaatcatgtacacaagggtgctatgccaaaatgataaaagtatgggtgtggagacatggccgagtatgcaattatttcagtcctaaaaaataaaaatcttgcgaaaatgattgttaaaattaataatataattttttttatagattcttaacatttctagttctttatacttcaattaatctttatttttaaaaaaatgattatttcataattttataaaagaatacaaattattaatcaacatttttagcgacttaaattaattttcagatgtttttaaataaatctgggtgattaaaaaaattgcttatgaattagttactgactgattgtccactgacggattgtccacttaccgacggattgtccactgacggattgaccactgacggattgccactgacggattgtccgggagcctaaataaggttttaataaaattattattttaattgataatttatttttccaccagtctataattaactattttaaatatatttattttttaatatttatccgaaacaattattagaattgtaataaattacaaaccacaattttatccatttaaccctgaccaattggtgcatcgacagttgctgatcaagttgcgcgagctggtcgccgttgttgtacacccatggcgaggctggctgttctttgccgaatcagaacggcttgtaattggcgctgcaatttggatgccaccggctgcacagtgatccgcgaccaaacactgggccgaccgtccgggttggtcatcgactttgcggacagtcgcctgtgcatgggtgactcgttgctgaagctgttcgcctgcatggactttgacggattgaattggcaacaaatccctgtggacgatccaatccctgtcgcaattacactgctgcaacgggtaaaaaaaattaatttaattgcaatttaaatggttaaatgttacttaattattatattaatgtatgactacttaattaatgtgtgtttaaccattattaagtgattggttaatgtttaattaccattgacaagtggctaattaacagttaattaccataacaatatttccctactaccactctgttaagtaccctaattaacaataactactatgcttaattacctttgattagtactaaattggtgataaatttcagctttaatgactgtggtgaacacgacttctccgatgaacatctatgtaagttccaaaatttaatcgacttttcaagaaaaaaggaatttcatttgtatatttaaaaaaattaatttaaattattttttccttaatttagcaatgtgttcatccttttctgagtatggagattgctctacggacgaattcaaatgctccaatggcaaatgcatcaatgccacacttgcttgtgatcggaaagatggtgagatgagcagtgatcagaatttttgatttttgaaatttcggagaaaattttgtccatcaaaaccaattctttctaaattcactcatactctcccctcttccgtgccaaaaagctttttttttttaaatttccgtttaaaagcaattttgtttttttgatttcctcattcaaactcgtgagtcaaattttctgatcacagattgcggcgatgccaccgatgagattggctgcgcgaaaaacaacggcaaaagttgccattccaagggggacaacggtgggtgcaagcactcgtgcactgatgtgcaggacggttactattgccattgtcgggacgggttcagaccagacccggccaacccgttcgactgtgtg

SEQ ID NO: 77350 - DNA, 1162 bp, Heterodera glycines
  Genomic contig location: Contig_ID=SeqID_2019; Location=3179..4340; Strand=-
  SCN-specific regions: Sequence locations=1-771,795-967,989-1162
atgcataaattcaccatcactcggatcattggcggcaaaatgatgcaacacaattgcgagacggtcgtgcaaatgcccatacaaattccacgcttcgatgtcgggaacacttcgctggcgtacacaaaaaggccagtgaacgaggaagcaatggcaaatttggcgatcagccaaaggcacagttggacaaatggtggcacattcggcagccaaagaatggacgtgccagaaaagaatgccaacgcggccaacaggtgggtaaacgcagtgaacaggcgacggcccattctatggaaagaatttggcattagcagcataccgttttatagaggccggactttttaggtaaattcgggaaaaattcctaggggaatagaaaaatttttctaaaaaaacaaaaatacgaacagaaagagtaaaaattagctataacacgccgtttgaatgaagtatttatagccggaatgaacatgaaatcatagaaaccagggatgccattccgaggaccaaaaaaattttaggaaatcggaattccgggggtcaaaaatttttcggaagtccctaggcccaaaaatttttcggaagtctgaaatcggaattccgaccccaaaaatgtcggaaatcggaattccgttccatccctgatagaaactgcacaggagggatcccgcgcgtgattttgcgggatcccagtcagcaaccccgcatttttggaaaatgcgggatttgaatcgagaaccctcccgcaataatttgaatcccaatcccgtagtggaaaatgcattatgccaaaaaattttcttaaataatttaaacaaaaattcatgataattttaccagccccgcagaaagaccagcaaaattgaattaccggtcgctgtgccaataataaaatccaaatttcaagttttccaaaaagttgcaagtaatttttgggtcatattcataataggtcaaggcattttttaaaaaatcacgaaaaatgagagtcttggaaatcgagaatttaaaaaggccggttctgattatttaaaaacatgatacctgtcaattagccatggtgaaaaaacgtacgaaggcacttcaaccaaagcaatgagtgtgaaattgatgtagcgattgccggcaagttttgtactgaataagctgaccccgtaataaa

SEQ ID NO: 77351 - DNA, 1081 bp, Heterodera glycines
  Genomic contig location: Contig_ID=SeqID_2019; Location=5012..6092; Strand=-
  SCN-specific regions: Sequence locations=1-89,114-509,552-560,600 -618,709-790,916-1044,1066-1081
atggtaattaaacattaaccaatcacttaataatggttaaacacacattaattaagtagtcatacattaatataataattaagtaacatttaaccatttaaattgcaattaaattaattttttttacccgttgcagcagtgtaattgcgacagggattggatcgtccacagggatttgttgccaattcaatccgtcaaagtccatgcaggcgaacagcttcagcaacgagtcacccatgcacaggcgactgtccgcaaagtcgatgaccaacccggacggtcggcccagtgtttggtcgcggatcactgtgcagccggtggcatccaaattgcagcgccaattacaagccgttctgattcggcaaagaacagccagcctcgccatgggtgtacaacaacggcgaccagctcgcgcaacttgatcagcaactgtcgatgcaccaattggtcagggttaaatggataaaattgtggtttgtaatttattacaattctaataattgtttcggataaatattaaaaaataaatatatttaaaatagttaattatagactggtggaaaaataaattatcaattaaaataataattttattaaaaccttatttaggctcccggacaatccgtcagtggcaatccgtcagtggtcaatccgtcagtggacaatccgtcggtaagtggacaatccgtcagtggacaatcagtcagtaactaattcataagcaatttttttaatcacccagatttatttaaaaacatctgaaaattaatttaagtcgctaaaaatgttgattaataatttgtattcttttataaaattatgaaataatcatttttttaaaaataaagattaattgaagtataaagaactagaaatgttaagaatctataaaaaaaattatattattaattttaacaatcattttcgcaagatttttattttttaggactgaaataattgcatactcggccatgtctccacacccatacttttatcattttggcatagcacccttgtgtacatgattttactacatgtcctttcaaagaaatcatctgctagttgtcctttaaataataaa

SEQ ID NO: 77352 - DNA, 390 bp, Heterodera glycines
  Genomic contig location: Contig_ID=SeqID_13461; Location=644..1033; Strand=+
  SCN-specific regions: Sequence locations=1-87,140-390
atgggcagaactccagtgagggtacaacattacatgaggtaagtcatattgcagctaatgatataaaaattgaaaaaatgtatcatgaaatattaattttataaatataagttaaatagattcttttaattaattatatcgccatattatatgaatagaaaaaatgaaaatttaattataggacaaagcaatacaaggaatgatatgggagcaacaccttcgtcggggaggaaattttcataaaaagtctaaaaaaagaaaaaaaaatccagaacaaaaaagtcttaaaactcatttaaagatacatccatcttatttcaagtgcaattcgactttcgtaatttcatttcccgaaacatgtcggggctgaaccctagtttataatatcaa

SEQ ID NO: 77353 - DNA, 642 bp, Heterodera glycines
  Genomic contig location: Contig_ID=SeqID_13462; Location=594..1235; Strand=-
  SCN-specific regions: Sequence locations=1-190,213-247,275-390,412 -443,482-597,619-642
atgattaaaactgaacaaaaagaggaaaatgaaagtatagaaattaataattatgttaatcaatacggaggagataatgaaaacatggaaattaatgatcaacaaaaaagagaaacaattcataaatttgataaaattaaagaaaaattgagaaaaaaggcaaaatataatcggaaaaaccttgccaaaactgagacaaaaattggaaaattattaggcgcaagtcgcgagaaaatatacaaatggaaaaaagaattaaatttattaatgaaaaagagtttttatgaggggaaaaagaatgaattcattgaacgatttgatgaatttaaaagtttatatggccaacgtaaacagaaagaatttgcgaaggaattgggcattggtgaaagaacatttataaaatggaaaaaagaattgctgccaaattatcataaaagtaagagatttttttaacttaatattttaattaatttttattttagcacaatattccaatgaagaaaaattgagaaaaatgaaacaatacttcaaaatcaaagaaatgaatccaaaaataagtgatgaaaaaattgccaagaaattgggaattgggtctcaaacactgatcagatggaaaaagaaatttgcatcaattccaataaa

SEQ ID NO: 77354 - DNA, 497 bp, Heterodera glycines
  Genomic contig location: Contig_ID=SeqID_13462; Location=2963..3459; Strand=+
  SCN-specific regions: Sequence locations=1-497
atgggcgtttgggctttcgacctattttgttcacatggaccatggagaacgttgaaggaaaagatggttttatgattttttcaagattttacattaaaataaacattttttcttatattaggtgaaaattttcaaaaatttagaattttacagaattctttaaatgaattttttcataatttcaagaatatttgtgagtttacattgtattgaacaaatattttttatcaaattaatgaaaatatccgtccatttttgaaaatgacaactcattcataactctaaatccacatatctttcataagtctcgtctcttctatcatctatcattcatattcgaccgttggcgccagctattctacgttggccttaaaatacaaaattttgaaatcatttttggcttttagaaattgactagtttttgctaaattttcttttttatgaaactttttttcgaaattttggcaaatttaaagttttttatacaatggataaca

SEQ ID NO: 77355 - DNA, 587 bp, Heterodera glycines
  Genomic contig location: Contig_ID=SeqID_13463; Location=55..641; Strand=-
  SCN-specific regions: Sequence locations=1-12,34-186,258-282,378-587
atgaataaattgattatttgttttatgatttttgcctcagtggccgagtgggacgttatggccaagcgcgggctaaaacttcgtaagtttgccaaaaccgccggtaaaaagacaggcgaggccgctcttgtcggatctcttttggaattggccgcgataggagtagataagattaaggtaaaatgcatatttttaatttaaatgataaataatattcaaattatatttaagaaatagaaattttttaaattatttaagaaacaaaacatttagggagaagagaccactacgacgaccaccacgccttccaccactacgacgaccaccacgcccagcaccacgacgacccccacgcccaccaccacgacgaccaccacgccgatctcaaatatataattgtttggaccttaccatcggctccaccggttgtgtccctcattgtcttcttttggcgcagaagacgaggcaacggcaaaaaaaacttccaaatggtcccgatggttaaccatggtgcccggaaacggaaatgcctgcaacattcagttggcgccgccaaataattaatgtaaatctttaaacacaataaa

SEQ ID NO: 77356 - DNA, 175 bp, Heterodera glycines
  Genomic contig location: Contig_ID=SeqID_13465; Location=1090..1264; Strand=+
  SCN-specific regions: Sequence locations=1-9,31-96,118-175
atgccacaagaaatctacatatattatcgaaggttggacaattttttgggttccctggtgcggtcagaccatcaaaaatgtatcaaatttatgaagggtcccaaaatccattaaaaatataattatttcgtgtattttcagttatttcgaagaaataactgacaataagtcgtga

SEQ ID NO: 77357 - DNA, 666 bp, Heterodera glycines
  Genomic contig location: Contig_ID=SeqID_13466; Location=118..783; Strand=-
  SCN-specific regions: Sequence locations=1-30,52-259,296-481,503-666
atgggcactgccattgtacggctttttgatgccgctgattgttgccatcaccattctggtaagtggtgtagttgccttgaaagtggcatacggtacatacaaaaatgcttagagacggaatgtcaaaaaaatttcaaaaatttaaaaccctctaaatttggcgcactgtttaagaccaattcgttcattgtcattgttctctcccatcgatctctgcgcactccaacaaattttgttcttggcgcaatggccataacggtaaaatttagaatttttttaaataatttttaaaattgcggtaaattttaaaatttttccatttttttaataatcgttttcaggaattgttgactggtctgcttggtttgccatggcttttgtacttttacacttttggtggctttcggacgtacgaatgggaagggttgccggcactttggtgcacaatgtttccatatttggtccgtccgtttcattttttgaaaattttcaaattaaaaaatgccaaaaatgtcaagactcttggaggaaataatacccccccccctacggcatttctaagcctccgggaatatttatgattatgatctctattgatcagtcaagaattaggggatattaactagaaaatcctacaaatcctttggattttctatccaaattaaa

SEQ ID NO: 77358 - DNA, 132 bp, Heterodera glycines
  Genomic contig location: Contig_ID=SeqID_13467; Location=1189..1320; Strand=+
  SCN-specific regions: Sequence locations=1-132
atgtcttccaatccagcgctaataaaagaaggctttgtggagaaatacaaaagcggctttttgagcagcaaatggaagtcggtgttcgcccgcctctattcggactccacattggcactgtacagtgaccgg

SEQ ID NO: 77359 - DNA, 2336 bp, Heterodera glycines
  Genomic contig location: Contig_ID=SeqID_13468; Location=355..2690; Strand=+
  SCN-specific regions: Sequence locations=42-265,301-428,460-527,549 -575,597-706,750-1075,1097-1177,1199-1233,1255-1271,1293-1438,1460 -1668,1764-1801,1823-1867,1893-2132,2154-2160,2197-2336
tatttccttacaggaaataattttttcaaaaaatgtcttccaatccagcgctaataaaagaaggctttgtggagaaatacaaaagcggctttttgagcagcaaatggaaatcggtgttcgcccgcctctattcggactccacattggcactgtacagcgaccgggtacggtacaacacaaatatactgtagttcctaaaatttgttcctaaatgaataaagttgtccggtgtggtaatacggtatatcatatattaacattaaacaccctttgttcttcatataaattattattgttttttaggccgattcacgtccatcggaaaccattttcctcaagaatgtgatcccctatgtttgcattggctttatgacagaccgaatgccggtccgtcgtccatcacttccgccgggcactgcggtgcaacgtaaattaaaattttcaaaaattaattaatttgatttactgtcttaattaggtttgattggcattggcatggacccgagagcagagaaagtccattggattttgttcccatctgagcagattttagagtaaacgcctaattatttttcttttataatttgttgtttttgttgaagggagtggcttaatggcattatgtcgacgctgccgccaccgccaaatccgccgccgcaacagcctacagtaccacagcaaaacattggatttggtactgtaaaactaatttactataaaaaaaaaagattaattttttataattaaatcttgaattatttcatgtttcagttccaccaccaaaatatcctgaccaaccgccaccctatggtggtcagccgatacaaccgcaacagcagtcaccgtattacccgcctccagcggcgggtgggtacggtgcacagccacagtacccgcagcaacagtacccggcccaacagactgtagtcattgacaggacaacaacaccgagcggaggctacggagggtaaacaaaagagcacggatatagaaaagcaggacccgcccaggatttttgcatgtgccctggtcttgtccctgcatttttgtggaaaattggagggattgcagtcccaaaaaaattaattatttttttctctggttcctgtcagcaccattttcaagtctttgcattttcaagctttcggtaccattgaaaattgccaataatgtttggtggaaagaggccagcagatcaaaaatcttggccgatttgaaatattttggaaaacgaataataattttaaaaaaaaacttgatttccattgtctcatgaatttaaaaaataaaatacgcacttagatcgtccggcttcggcaccggtctcgcagctggcatgggcggtgccatgcttggctcgctgctcggctacggcatcggcagttactttgcaccccacgggggttggggcggcgggggatggggaggcggcggatacggaaatggcctgggcgggggatacattcaggtggaaaatgagggatatttaaaaaaaaattaacaatttgcaggataatgacacttacatcaccaacaattactacgggaacaacgatgactcatcaacgcctacgcaaaacgccggaggcaataaattagcgctttttgaaattttaataaaaattttcatagattattcgacgcccgctcaaaatgactatggagacagcggaggcggtggcacatgggacgacggcggtggcggaacatgggacgacgggggcggatttggggacgggggattcgacgggggagggggcgagatggtgtgagagaagcgacggacgaccaaattgaacacaaaacataaacaaaaataaatgcaaaattgaaatgccgaaataggcacaaatccattctaaaaactacgcattgttttgttgtttttcttgaagccacaaacaaacaattttgctgaattcaccttttgaagttaagcatttgccagaaacgaaaatgcaaatttttgcttatgttttttacctttttgtttcattttatcaaaattgaaatttcctttcagtcgctttgtcaccttttattggaattaataaaatttacagaaatgcttgctgcactttttcaggagggtttttggtttcgcacaaattggcatcggcattcgttaagtgatgaaaatgtggtggtggtgatgctttgttttaaaaaaaataattttaaatttaacataaaattcagcaaacggggcaattaattaacgaattcgccggcaaagggagaaaaaaggaaaaattattgaagtttgaaaacatatttccttaagaaaattcatgaaaaatcccctaaaaaaaaatttttttcccggcggcgcctat

SEQ ID NO: 77360 - DNA, 1405 bp, Heterodera glycines
  Genomic contig location: Contig_ID=SeqID_13469; Location=144..1548; Strand=-
  SCN-specific regions: Sequence locations=1-173,195-401,423-465,487 -544,571-601,624-670,693-808,833-843,868-1405
atgtggcacactgcgggccaggggcgaagcatttgcattggacgccaagggcttgacgatggttggcacccttccatgcgatagtaatgtttttatgacagtttatgtaacaaaaatagcctggtgaacttttacgatttaactgacactttgaaaattccaagggtgaattggttttattatttattcactttttccgatttttttttttttgtaattttgtaaataggtccaaaacaccatttttagctttgttaattcgtgaactgcccgcgagtgccgatgatttgtctgtccgtcatgcggttgtccgttttactgatgttgagccattgaacgtccgtttggccgcctcgcgactgttcgcattcattcaaatggggtcactgtttgacgcagaaatggcccaccataagctgcaacgaacatgtttatacatcgacaattgtgccggtaccgaaaaccaaaaaattattccttttttaattggctataatctgtcgaaatgccgttgcttttgtaaaaaagtttccttttccccgaaaattctgtcctctttttcaaaaaatcaaatttctagtaattgcacctaatcaaaagtctaattgtatcttagaaaacgtgtaatacctataatattaagatttactcttttgcctcgtcattttgcaaaaaaaaatttttttttaaatgccctgaaaaatgtctcacaattaggcggttttccttgtcgctgatcacaatttggcgtccattttcgaccaactccgaaccccggtctcgaactcgaacaaagagtcgaaaattcaaaaaaaaatttttttttttttttgactttgattttgcttcaatgcacactaaaaatatgaaaaattgaaagccatcaataaatcattttgtttttaatattactatttactttagtgtttgtctcattttctcgtcattcgttggccaaagttttgagcgaagggcgcattaagttgttgccagaaacgcaagaaggttttgcatatttattggatttttttccataatttacacaaaatttagcaaattttttccattttcagatgtccaaatcattgaccaaacaactcataatcagagttcttcgtcttccaccgcaaattcagtgaacactccgtttggaattttgccaatttgttgtatgaaattttttgtttgttttttaattgctttttgtttagctgagcccgacccagcaaagtttcaatatgagcatagctcgggctatttctacgacccggcaaccggcttttaccatgacccaaaaaccgaattttactactcggccaagagcagaagtgtaagtgttatcattttggtgtagcaaattggctgtaataatcagccttccccccccccccccgaaaataataaa

SEQ ID NO: 77361 - DNA, 323 bp, Heterodera glycines
  Genomic contig location: Contig_ID=SeqID_13470; Location=1..323; Strand=+
  SCN-specific regions: Sequence locations=1-84,106-231,282-323
tgacgaataaaaaagacatagcagcactttgatcaaagtgaataaagaaaaaaaagaagacaaaaaagaaatttttaaaattccataagagagagaaacagcagatcatcaacagacagttaacgaatttgaagcataggtaaatttaagaaatttttgttgtcgacggcacattcaattgttcgccgagagaagagaccatctcacggagtttggaacattcgcgaccactaaaaattaattaaaaaagagtgaaaaataaaattttaacaaaaaaaaatgctgcctgcttttacatcgaagcaactaattttttttttatt

SEQ ID NO: 77362 - DNA, 637 bp, Heterodera glycines
  Genomic contig location: Contig_ID=SeqID_13471; Location=34..670; Strand=-
  SCN-specific regions: Sequence locations=1-249,271-476,520-637
ctctcaacagcgtgctttctcagttcgttatcttcgtccaacagtcaattcgatcaagtgctcgctctcaaggccaatcgcccgctcgttctcgttcgcgattcgattacgctcttcgaaacggtatcgaaatagaaaactcgactcgattcggaacagtacatttcttaaccgatacatcggaaattatagggtcgaaaatttaatcaaattatcgggtttaaatcgttggtgtatttcgttcaaaaattctctatttttcttaacctaaattttctagcggcctagcgaaactcggctcggcttctcttttgcaggcggttgaactgtttcggcaaagtgccacccaacgcttgacagccattttccgtcaattgaacgagctgaagcccaaaatcagacaacgacagcagtgcgttcgggtggctgaacagcgcattgtccgggtcagtctcattcaattatctgatccgttgaattttaattttattacaaatttatttatttttcttttttaaagatcgctcaatcaatgcactttttggtgttcccaacaacaaacgctgaacaaacggcggttgacaaaatgggcgaagtgcagcacaaattgagcaaatgcgctgaacaaacagcgaag

SEQ ID NO: 77363 - DNA, 2368 bp, Heterodera glycines
  Genomic contig location: Contig_ID=SeqID_13472; Location=575..2942; Strand=+
  SCN-specific regions: Sequence locations=1-1290,1312-1375,1397 -2171,2193-2368
atggatgcggataagctaaagcctgtgatggatttgcctatgccaacgaccaaaaaacaactccattctctgcttggttttctgacttattatagaaaatttatccattcattcggcacgattgctgctccgcttttcaaattgataagcgaaaaagctgaattcaaaatcggagaacaggaaaaacaagcaatcgaagaattaaagtcaaaaatcattcgagatgttgtgcttcattttccggatttcgatgcagcacagaatgacctaactaggcagtttataatcatgactgatgcgtgtaagaccggcattgcagcaattttatgtcagcctgatccggagaaacagattaggccaatttattttgcctcaagacaatgcaatgtccatgagtcacgctacagtgccaccgaattagaggctttagccgtcagatttggtgtaaaaaagttcgcacaattcatcactatgattccgactcgggtcattacggaccataaagcactaatttggatgttccggagtaaaaatgagacaggaaattcacgtgttgaccgttggcttcttgagttaagctctcgtttcatcctaaaggtggaattccaaccaggaaagaaaaacataattgctgatgttctatctcgttcgggaaaatcgaatgagagcgtcactgaatccttacaggaggaagacattgcctttattgggaaagttcgagtttttgaactcagtaataatgtcgaagatttcactgaacaccgggaaaaatggattgaggagaccaaaaacagcgaaatgcggccaatttatgagtttttggagaaaaaaattatgcctgctgatccgcgaattcgacagagcacaatggacaaatgccatagatttgtgttaattgagaagtttttgcacctttgtgaaaatgacggaaaacttagactctttgttccattatcatttcgtgaaaatttggtgaaagaacggcatgaaggaaagtgttcgggccacatgagcgccaaaaaattgtataaacaattggcagagttatatttttggccaaacatgttttctgattgcattcatgcacataatgcatgcagaatttgtgcacatacccgaaatgcacgttcaaatgaacctcccttaaaagtagttcactcatcagaaccattggaattggtctgtatggacattttggacgttgggccaagtcagtcaaacttcaaatatatttgtgttatcatcgatcatttcaccaagtacttggtcgctgaaccaatcccgaataaatcagcagattctgtagcaaaagtatttgtcgaaaaatttttgttaatctttggaacgccgaaaaaaattcactccgacaaaggaaaggaatttatgaacaccattttcaaaagaataagcgaaattcttgggtttgagaggtcctttacggctgggtatgacccacaggcaaacggtttggcggaacgagtaaatggagttttgattcaaatattaaaaaagtctacagcaagtaattggacgtgggacgaacgattaccgtactcagtttttgcttacaatataacgccatccgagtcaacgggtttttcaccatttcttttaatgtttggcagatcagcgaaaattccgatggataagatcaccgaaatgaattttaaccccttatacacaattgattatgaaaattattttcaattgtttttggaaaacctccttaatattcaaaatgaggccaaacaaaatttggatgagtaccggaaaagaagtaaagattggtatgatgcaaaacctcaagtgaaagccaataaatttgaaatttcggaacgagttatggtggcttttcccggaatgcatcgcaattcacgacacaaaaaattattgtggaatcattttggcccttacaccattacaaaaatctccgaatcgtccgccgaattagtcccagttgataaaacagctgctgaccctattactgttcctttggaaagactcataaaagtgccaaaggcagtccctgacatcgcaacattaccacggggaaaaaacccgtataaaaatgtgctaaatgcaatgattttcatgatttcggcccaactgaattttgaaaatatgccaaaacgtgcgaccgaaaattggcaattggggacaattgctaaagaatgtgtgagggcggataaatatggaaaggaaaaaagtagtgcaaaaattctcagaattaattgcctaaacctgaaattgaaggtaaaaagggaaagaaaggcgaatttttcaggacaaacgcaaacggacgccgggatttgttggacttcggtttgcagtcaaaaagatgccgagcacgaactctgcacggctctga

SEQ ID NO: 77364 - DNA, 311 bp, Heterodera glycines
  Genomic contig location: Contig_ID=SeqID_13473; Location=442..752; Strand=+
  SCN-specific regions: Sequence locations=1-164,187-311
atgcgcgactttttgcgcacggaccaaaggccgaaagagcgccggtgggcggacgacggcgaaacggcacagggaaaggcgccgcagcaaaagcaaagggacgacgaaaggggcgggggacaggcgcagaagcggcgccgaagacgcggcagcagcgctacggcacagccgacgacggcaccgcaaaagcaacgcgaaacgacggcaccagcgaatggcgccggcggagggatgggaacggaggaaaatgaacagcgaaaggaaaagcaaacgcagggcaacacaagcggaggaggcgaaggaggaacgac

SEQ ID NO: 77365 - DNA, 622 bp, Heterodera glycines
  Genomic contig location: Contig_ID=SeqID_13474; Location=1..622; Strand=+
  SCN-specific regions: Sequence locations=1-390,412-501,523-622
  Gene Ontology: Mol. function=arginyltransferase activity; Cellular component=cytoplasm; Biological process=RNA processing
ctcgacggtcgtctgatcgccgtcgctgtcattgatctgttgccccactgtttgtccgccaaatacttcttctacgacccggacttcgccttcctctccctgggcacatattcggcacttcggttggcctttttgtccgcattactctcatttttaattgttttttttgtggcatttttcgtttttaaattttgttggcatttttcactttttcaattcaatttcccttgcgttcgttcagtgaaattgcgttcacccaacagttggcccaacatcgtcccgacctccacttctattacatgggcttctacctgttcgactgtccgaaaatgcgttacaaaaatcggtttcggcccagcgaattgttgtgcgaccactgctttaattgggtgaacaattcaattcaatttttgccatttttgttggggtttttgtggacatttatttggaaagggccccaattttgcctctttttcctctgttgaaatgccaaaaatagcgtttaattaaataaatatttttcattttgttaggtccccgtgacggaatgcgaccgaattctcgaggcgaacggcggccgtttcagcactttccacccgtccgctgagcccactcgtgccga

SEQ ID NO: 77366 - DNA, 384 bp, Heterodera glycines
  Genomic contig location: Contig_ID=SeqID_13475; Location=375..758; Strand=+
  SCN-specific regions: Sequence locations=1-384
atgtgccaatttctctcgccggtgcctttcttccttttgcttcttccgctttttctgccgtcgctttgtccctccattttggcacatcagaacaatgcttttgcagcagccgaaaatttgaacgaacatggccaaattgagcagcaaaccactaaaaacaatgacggaatgttgggcaaattgcgcgtggcggtggcgaacgaaaatggcaaaatggtggaaaagcagaaaaagcaacggcaaattgagggggaggaggaaaagcagaggcagcagcacaagttgatgatgaagatgagagaaggcgccggcactttgactgataaaaatgatgcaactaatgatgacaatgacaacaatgagcagtcggtggagacggaaggg

SEQ ID NO: 77367 - DNA, 288 bp, Heterodera glycines
  Genomic contig location: Contig_ID=SeqID_13476; Location=870..1157; Strand=+
  SCN-specific regions: Sequence locations=1-11,38-288
gctcttcggaccaacaacaacaacaacagcatcaacactatcaacagctcccgtcctgctccaactcgggccgaccgtccgacgcggccgaattttttggagtcgctgctgaacagtgctcactgcaccatgaacttgcacttgttgctgaacacatgccgatgatgaacagcaacataatgacatgctgatgatgatggacggtggcagcggcggcgcacaatcgtacgatgtgccgtccaaggcattgtttgaggccgtgtgcaggacatttgaggaacgacgaca

SEQ ID NO: 77368 - DNA, 115 bp, Heterodera glycines
  Genomic contig location: Contig_ID=SeqID_13478; Location=46..160; Strand=-
  SCN-specific regions: Sequence locations=1-115
atgagaagaggtacaacatttgtcaaaagaggcacaacggtgattagaagaggtacaatcgtgattaaaagaggtacaaaagtgattagaagaggtacaacagtgattagaagag

SEQ ID NO: 77369 - DNA, 911 bp, Heterodera glycines
  Genomic contig location: Contig_ID=SeqID_2021; Location=85..995; Strand=-
  SCN-specific regions: Sequence locations=1-64,86-829,851-911
atgatggaccatgcgaactgttggttcggggtgggggacactatagtctggccgttatagtctgagccaagtttaaagtatcataacttttttctcagcgggccaaattttataaatttggcatcattctaaagccctatatgtttagtcgatggcaaagagaatggcgaatttttctcctccttctgacaacactgccccaaaaaatttctgtccgaccttgaccaactacaaatccccaaagaaatcgactcagacaactccattcccgactacgccaagttgcttattaagcagcttcattcccttttaagcaccgcctccgtcctaattcattcacaggctgcggctgtcgacgcggtcgaggaggaacgacgactgagaactgtcgttgtgacaaatgtgcccgaaagcaaatcggacaaagcggcggagagagcccgggaggaccgtgccgttgtggacgaaattttgaatgccacggacgtcgaccaggcaccaattgtcttccgcgtcggcaaacgaatggatggacgaccgcgcccgctcaaaatggaattcccgaccaaacatgcagcgcgacacgtcatccgcatgcgcggaaaggtgcaggcattgaatggtctccataatgtccgcgagagcatgaccaaggaacaactgtcggagcggcgaaaattgattgaggattgtgcgaagaaaaggcagacggacagcggtgattgggtgatttatgccaatcaggttgtgctgaggcaggacattgaccatattcgaaaaattttttaaattatccaaccaaatcactacaaattacccataattattatagaaaagtacaaaaatttttccggtcggtaaaaaatttataccaaaaaattacccatccaaacttttttacaaaaaataaa

SEQ ID NO: 77370 - DNA, 64 bp, Heterodera glycines
  Genomic contig location: Contig_ID=SeqID_2022; Location=1903..1966; Strand=+
  SCN-specific regions: Sequence locations=1-6,55-64
tgccctaccgagaccgggaccgggacctgagcttttcaaaacccgggaccgggaaccgggaccg

SEQ ID NO: 77371 - DNA, 973 bp, Heterodera glycines
  Genomic contig location: Contig_ID=SeqID_2023; Location=566..1538; Strand=+
  SCN-specific regions: Sequence locations=1-54,82-118,140-330,374 -684,706-973
caagttcgggttagggatagaaattggtcaaaataaatgtcattcgtgttaatctaaaatatattttattaacagatgaaccaacgtaatgtatactacatgtggacggtgagttgtattttgatttttaattatataaatgaatttatgaattggaaattgtaaatgatagattcccctttttttagattggcaacttttcccttcgtcccgagcaaatgggcgaatttatgaagagttcgacgttcaggtttttctttttaatgttttttgaattatgaaattggtccatttttggtacttccttgttttgctaccccctccccctcgaaaatttttaaaatttcaaaaaatcatagatattttattaaatcgatgactagcattgcccgtgggacttgaattttggatttttgtcacatttccgccttcttacgccgtaaaatttgtccattggttcagtgccggcccgaacgacaagctgaagtggtgcctgcacatcaacccgaaaggcctcgacgaagaatccaaggactacttgtccctgcatttgctgctcgtccaatgcgacgacgaggaagtgcacgccaaattcaagttcgccatacagaatgccattggcgaggagacaaaagcgctgggtgagtgaattaagtggagggaattgggacgaaatgaatggtgggagatggaaacatccatcgccacggtgtcctgcctccaacgactgacacagcacaccgtgacttcccaactctttcagtagccgatagttgagataaccatttctcctgcagattcgcagcgcgcctgccgatttgtgcagggcacagactggtgctttaagaagttcatccgccgcgactttttgctggacgaacagaacggactgctgcccaacgacgggctgaccatctcttgcgaagtgtccatcctttatgatagtgtaagcaattcatttatgtcttctttt

SEQ ID NO: 77372 - DNA, 1001 bp, Heterodera glycines; identical to SEQ ID NO: 2024
  misc_feature (948)..(948): n is a, c, g, or t
  Genomic contig location: Contig_ID=SeqID_2024; Location=1..1001; Strand=+
  SCN-specific regions: Sequence locations=1-216,238-263,290-711,733 -1001

SEQ ID NO: 77373 - DNA, 1545 bp, Heterodera glycines
  Genomic contig location: Contig_ID=SeqID_2025; Location=2288..3832; Strand=+
  SCN-specific regions: Sequence locations=1-315,497-630,678-942,977 -1545
  Gene Ontology: Mol. function=transcription co-activator activity; Cellular component=nucleus
atgccgccatatggtccggctcacaaccaacagcaacaaatgatgccaccgtcggcgctggtcggcgttccaccgggcgcagctgcaacgaacacttggatggattggaattcgtcagcggcgatgccaccacgcggcacttacccgatggcgccgacgaacgccatgaaggcgggcacacagacgggcacgtacattccgccgcagagtggcggaatgatgccaccgcctgctgggcaggtgccgtactacgccgttgggatgcccacgtcgaccactgctgtgcacggtcaaccgatggaaccggctgcataccatcagcaacaacagcagcaacattaccaagccgttcagcagcagtacacaaattaccaccagcagcagcagccgaacatgatatacaactcacagcaacagcaacaaatgctcttccatcagcagcaacaacaacagctcaatcaacaaatgatgatgcagcagaggcagcaacagcagcctaaaaaaacgctggggccgaatcgtgccggggacgaactgaggtagaccggttatttacatattatttcacgattgttcttacataaaaaaggaatccgtatttgagtatcatttaaaaaaaaacttgagccaaattatttcattaagtgattattaattaattacaaattaattaattacattggtgcagcatttaaactcgtagtgctcagcacagcaatcagttgacggttggccaagatttttaatgcaattgtaccatccgcagccgcaggtctccgctgcctttttgcactcgtcaatttgagcaatttgttttggcggtatctttttgaagaaagaaagtgtaaaacaatggcgcataccatagtagtggaaaaaatatggtacaaaaatttcaatcagtcatactgtagacgtaccggtggagccttaacagaaaacaaaaaaatttttatataaatatatatatatatatgatatcaagttccttgcgttttcgaggtcctgaccacgaattcggtatccatttcggccaattccgaccccggacccaaactcgaacaaaaagtcgaaagtccaaattttcgaatttagcatttttggttcaaaaatggcataaaagattccttattgaaggattgatggctttcagtttgtttccgggttttaaccttatttttaagaaaatactctaattcctaaaattttgacttttcgactgacgcattttctggtcacgccgtgggaacttgttggcacttttaaatttcccggtcgctaaaagcacgcggattgccttcacgcagcaagtgaagttgtaatgctccgcgcagcatgggctcgcccgttcgcccgctttcggaatgcattcggcccacccgcatgggcaagtctcccgcgcggctttgcactccaaatcgtgctcgatttgaggcttaatttttaaacgggggaccaattagcaaaacatcatttagagaattgtctaaaaagttgagtttttcattcgttcaattcggtgctttccgccgaccaaaacaaata

SEQ ID NO: 77374 - DNA, 1593 bp, Heterodera glycines
  Genomic contig location: Contig_ID=SeqID_13484; Location=2124..3716; Strand=+
  SCN-specific regions: Sequence locations=1-308,330-367,419-641,731 -782,805-852,876-1472,1494-1513,1535-1561,1583-1593
atgaattcgaccatttttctgtccacgatttgctgcttcctttttttggctttcaacaatctccaaagtgtcgctgctgtggtaaagcaagtgtgttttccaggcatagaaaactacgaaattagcatgtttaatgatcgagatgagtcgatagaagaaatcgaaacagaaacagttgtaacagacggcggaaaacaatgcttaatgcttaatgcagataaatgggatggatatgaagaggatgatgtgatttgtttctatgttgaaactgaggtaattcaaaaaaatttttaagcaactataaaaatatacaccaaaatcatttttgaaatcacctgttatttgattaagaatttaaaatttagcctattaaaatatttaggaaattttattatattttatattttttcaaaaaattccgatttgtgacttccgattcccgacgttttggggtcggaattctgatttccaactttcgaaaaaattttgggccgcggaattcctgtttccgatttccgaaaaatttttgaccctcggaattccgatttccgagaatttttagggtcggaatgccatccctgcccacggtactacacgaaccaatcgcacttctaatattccgtgaaatggctctaaccaactaaaattaatcaaaaaaataatttaaaaactaaatttattttataattttttatttttatctaaattcttaaacttagaaaattattttcaatttgtaacttctccaaaatttctattttttattttttgtggttgggaaattttcgtaattaaaattaaaaagaatttttactttttatgattttttcacaaggctttagtttcttttaacaaaaaatttccttttcttctaatttattttctctcaactccctcccccattcttaccattgcttaaaaattttggtttttctgcccaaattccaaaattcgaaatgaaatgatcaaaatccctgtgctactcgaaccaattgcacttctattatttcgtgaaatgctctaatcaacaaagctacaagattactttatttttgtccaggctccgccagtctcgccttgctcaactctttccgaagtctttttaaaccccaattttattcgagaggtaacgaattattatttttttgctaacttttcccaaataatataaaatgtcttggttgtttcagatgttaggttccgctccagtttctttattgagaactgatgatagtaactatgtcttagacttttcggaaggactgcgacattattattattactttaatcctgctattggtgggatggattttggattctgaacttggaagtgaatgtgcgatatcttggtgctatgacgtcactcaaaaaaccatcaaaacgacccggcaccgaaatctttgctaaaaatattatactctgttgatcgaattctttgctttgttgatgcctatattggcctgttgcataaaagatttttaaaattttgtatgcaattttaatgcttactgattggagcttcagtgattgatttggggatctgcagtgaaattgcaaaaatataaacaaaagggaaacaaaattttatagtca

SEQ ID NO: 77375 - DNA, 1028 bp, Heterodera glycines
  Genomic contig location: Contig_ID=SeqID_13487; Location=146..1173; Strand=-
  SCN-specific regions: Sequence locations=1-99,121-956,993-1028
atggaaacgcacgtggcaacggcgcagccaaggccagaacggcaaggcacctcgtttacggcgaagcgggcgtctcgggttccgccgcgcaagccggcctctgctgcggctgtggcgtgtccccgcccggattgcccggacctcccggcccggtcggacagcccggatttgacggagtgccgggagcacctggacaaacagggccaaatggtaagtgaaggggcgacaaattcaaaagagggagccaaatgaaggaattcatggagccttaatttgttgacatttttttaggccaagccggtgcgagtggtggcggatcctttggcgcgggctgtggtgaatgtcagcctgcccaacccggtctgcctggcccgcccggacttcccggtccttccggaaacccgggacttcctggcccgaacggaggccaagggccgctgggaccgcctggtccacctgggcctgatggtaagtacatcattctccaacagtcgccattgttcgtggatgcaaaattcccaatttaaggtcaacctggtgagtctggccagtctggccaacccggagcccccggcagaatcacagggtacggcccgacagtcgtcggacccccgggaccacccggacccaacggtaaagcgaaaagattgtcaaaaagacttaattttcatgggatttcagggtacccaggtgctcctggccaaccaggactgcccggctcgtttggacagcccggggggctgggacagcccggcgacgcgggaaagcccggcacgcccggaaaccccggagagaacggcggtccgggagttgccggcgaaattggaaatatgggcacatgcgaccactgcccaacgccacgcaccgccccgggctattaaacggaagaaaacagaacgaacaaaggaaattcgacgcagaaaacttctattttccgtaggaccagacgaaattcgttcagaaaatgtttattttattgtgctaaagatttatttgtcccaaaaatatttttagtagatttaaataaa

SEQ ID NO: 77376 - DNA, 81 bp, Heterodera glycines
  Genomic contig location: Contig_ID=SeqID_13488; Location=186..266; Strand=-
  SCN-specific regions: Sequence locations=1-21,43-81
atggagaccaacaagcagcagatcaaaaaggaggccgaggagctccgacggctcgcatttttcggcgttgtaatgtcaacg

SEQ ID NO: 77377 - DNA, 1161 bp, Heterodera glycines
  Genomic contig location: Contig_ID=SeqID_13489; Location=1343..2503; Strand=+
  SCN-specific regions: Sequence locations=1-439,469-522,544-547,571 -852,874-1161
atggagactggtagattattttgcaacctcctcagaaaggggtacataattggagaccggcagtttaatggagactggcacataaaaagagcaaatacggtaagtcaatgacttttttttctgctgattcgaaatgccataaattatttaaaaatctacactttgtttaaagcttctaactattatgcattttttttttctacttttaagaatttttttgcaactttttgattttttcgtgaatttttagttgacttttgatgttttttcgcatttaaatttctatccctacttttcgttccggcctaaaaatacacagcacagttaccagaattggtcgtccaaatttgaccttttttccgagttcgggttgcgcatggggtcgaaatgggtctaaatggatgacggatttatgatcagtggccttgaaaacctatgcatttttaatttaaattaaaatgaaaaattgttttgagttaaactgcataagagctgccaaatcgaaatcgaaaaaagagagtgaagaaatgagaatgaataaattggtactttactgttatgtgactaaagccaaatttcaaaaaatcaacaaaagggcgcgcaaaattcacacgataagctgatccatttgataaactttatcagcgatttttacattttttcctcccaagtgatgctgctgtctgctgtgcgattttcgcgcccttttgttgattttttaatttcgagttgtgaaagtccgggctttttgtttatgatggaaaatctctttgctgatgaaatgctataaggaatcactcggaaaaacaaagtcaattatataaaaaagcttagaatttgcggatattataaagcaaaattatattaaatttacgcctaattcctcccttttatcttttgggaaaacgagcaaaatttcaaaagaatgaaaattaaattctatttatacctacttcgatggattatttttttaaatgacaggtctttgaccacgatgttaaccggcaaagggtcagccgtgcgcaattgcccgcggtgattgacgagatcatgaacgaagcaaatgaaggcgccagggcattcattttggcgaatttagagaatgtccgaaaggttaatatggggttaaacggtcgggaaggctcggtcaaaaagaattag

SEQ ID NO: 77378 - DNA, 1477 bp, Heterodera glycines
  Genomic contig location: Contig_ID=SeqID_13490; Location=217..1693; Strand=+
  SCN-specific regions: Sequence locations=1-405,442-739,781-1006,1035 -1171,1211-1317,1340-1417,1461-1477
atgcattttattttattctggtctgcgcaaaactctgagagtagtacaaccgagactgaattaatttcggggtttttagcgccatgtacaaatcacattttaacgaaaaggaacctgaatttttgcacaacgttttggaagtctaaggtaggggatacgaaaaccccaaaaagttaaaagtcgagttccaaaacctaggaagtctgaattaaaaatgacctctgatagagactggagacgggctattttgatgaaaatctgttaacaagtcacaacaaattcttcaaaatttcgcggagggaatttggacatttgtatgaaattggtttcggcagccccccccctccactagcagttatcgtcgttctaaatgcgaacgagaaaggcggtaatttgcgttttcccaaaaaaaaaaaaatttttttttgtaaaatttttattgttatatctaagagaaaaaaagatgaaaagctaagaatcttgtaaatttttaagaactgatagtagttagcaggaaaaattggtatcttcggcacaattaataataattttgaaacaaatgtctatttgcctataaatatataaggtttcgtaatccaatttttgaaagtagaactgagcgggaccgggaattttcgggttgaaaaaccaagacatttctgggtggtaaaaacggaaaaaaacttggactagtccggtcccggtcaaaatcattaagttctagagtttcggtttatttaaagaaaaaatgtagaaacaaaaacagacagcaaaacacaattatttgtttatttttaggtggcgattgagctgaacgcgatgaaggtgatcagaagggcgaagatggaggagtaagttactatttttttaaatcacacaggcccaaaatgtgcctatataaaatacgaggctttttaggccaaaaaaataacaaaagtgtgggtcagtcgatgccgacaaataccgccggttacaaattatgaaaatctgtggcccatttctttgcatatttttactaaaatttaaaaatttttgtatgaatcggatccgtgccaaaattactttttggtttttttatttgtattttctcttctaaaatgatttttatatcaatatttagtcattctcgagatttattttaaaattatcgaagaagttttgagaagttttaccattaatttggaaaaattaatgtgcatatttcacttttatgtgcatatattgaaatttggtagtttatattttatgcacatatttgcgctttaatacatataattccgaaaccgattctaaaatgaaaaccgagaatttaatccgaaaaactggttttaattaaaagcctgtggatatttttttaattatagctttctcttatttgtttatcagattgttgggaccgcaggtggcagggggccagctgaacgatgatggtgatgatgaagaaggagaggaggaagaggggtcggatgatgaatga

SEQ ID NO: 77379 - DNA, 876 bp, Heterodera glycines
  Genomic contig location: Contig_ID=SeqID_13492; Location=1160..2035; Strand=-
  SCN-specific regions: Sequence locations=1-484,507-676,698-736,759-876
atgcccgaccgggcccagacccggggatacccggctttttcaagaccggacctaaaattaattatctattatttcggtactttttctttttcactgtgccatattttttgagttggttaatttatgcgaaaatgaattgtttaatgagacgagtcgtcgttgtgggtgaccagaattggggcgctcaaaaaattctgtgactcatttgtcagtttgaaaattcctaaaatgtcagtttctttaaacgtatattcaaagcaaaatttatgacaaaattaagcattcacttaatatttgtcttaaatgttttttcataaattctttctaggtaattagaaaatctttttgatcaattccaaatatcggatcaggattcgagaaaaatccagacaggatccgatccagttgcggtaataattggcattttgcttctaatttaaagtttccaatttcttcaaatgattttttaggttacttgtgaataaaattcaaattttaaatcatttcgtcggttcttttctggggtcttctctgaatagaaagaaagtttcgttaaaattccaaaaaaaatgaaaccattagctggcgcattaagattgacttgaaattttgcagagagaacttaatattaggctatctgctgcaagctaaatttaatagattagaatttttttttacaaaaattctcatatttttagaacttgaaagtttctcgggagtgtcgtgaatttgattattatttttcatgttttacaaacatgccggtttttgtaaaaaaaaaatttgtacttgggcgaaaaattctgaaatttttcaggccgatgtatttatataaataattaaactgtaaaatttcatgtcatttaaacaaataaa

SEQ ID NO: 77380 - DNA, 860 bp, Heterodera glycines
  misc_feature (122)..(122): n is a, c, g, or t
  Genomic contig location: Contig_ID=SeqID_13493; Location=15..874; Strand=+
  SCN-specific regions: Sequence locations=1-98,120-140,171-215,240 -286,308-335,451-739,763-801,848-860
atgaaaaaagaactcagtgtgaatggggataagcgacgtatgggcgagaaatataaagaaatatgcgcgaaacttggcgcaagttcacgttcaatttataaatggaaaaggaaatttggctntagtaagttgaaaaattagggccttaattttattaaataaaaagtcataaaaatgcgtataaaataggaaaatcttatgaattttaatttgaattcaaatcatgcagaggaaccaacaaaattaattcactgaccagtcatttttcattcctacacatcctctccttacaaattagtcaaaataggtccttatttttgtcattctgtgcctccatttatacaaaaaataaaaaaaaataataataataatattttcgtaaacaaatttttttcaatacttttatttttaatatttcctaggttaaattttttttattaattttaattagatctttttggctccaataaaaacgcatagattttaaaatttacgaaagttcgggttttcttgaaagtttttgttcttatatagccaaaaatgcctaaaatgtgaattcttcgtaaataatttatgagaaatatgtccaaaactcgaataaaaaataaattttcatgaaattgagtacaattaaaatcaaatgttcaaaaattttagaggcaaaaggacactcaaaaaaagaaaaaattgaaataatgaaaaggtatcaaaagctaaaaaaagaaggcaagaaattggatgaaattgcaaaggaattaaaaatcagcaaatcgaatttgagacgatggcaaaaggaattgaattttgaaattggaagtaattaaaaataagtcaaaacataaaattactaattaaaaaaa

SEQ ID NO: 77381 - DNA, 714 bp, Heterodera glycines
  Genomic contig location: Contig_ID=SeqID_13493; Location=1177..1890; Strand=+
  SCN-specific regions: Sequence locations=1-186,210-312,336-404,426 -514,537-685
atgaaaaatgattatccgcaaatgacgaataaacaaatcttgagagaattacaagtgggcacaactctgtatcggtggcaaagcaaattcaaaattggaaatggaaatggaggtgaatttattaaatacttattcaaatcttcagaaaattgttacgatgattttgtttgggacaggaaaagcaccaaatatttttaaaaattggaaacgattctttggaaaataatatcttttagttttttactgttttaccaaagtgaatgtcatcgaaaatttaaaaaaaatcgttggtataaacaaaaaatagctaatttttgaggtgatttaaatgtaaaagtacaaataggtgatgtgccgtcgtgcagatagtcagcgcagtttttatgaaaccataaaatcacgaaaaattgctttacaacaaaaaacgaatttttctttcttttcgcgaacctagctaggagcttgataaaaactgaatttttattatcttgaaattaaactccgtttttcattgataaaaataataaatttttttagaaaaaactatcctttctgataaagaaaaaattaaaataattcacaaatttgataaaatgaaaaactcatatggaaaagacattacacaaaaagatgcaaaacaaattgcacaacaattgggctattgcatcagaacaatttataattggaagaaaaaattttagaaaaaatggtaaa

SEQ ID NO: 77382 - DNA, 98 bp, Heterodera glycines
  Genomic contig location: Contig_ID=SeqID_13494; Location=809..906; Strand=+
  SCN-specific regions: Sequence locations=1-98
ctccaacctggaattgctggttgatggactacgtgttcacgtcaatgccgctcagccagcagccgtagccgggtgggactggtaccagccgaccacct

SEQ ID NO: 77383 - DNA, 1143 bp, Heterodera glycines
  Genomic contig location: Contig_ID=SeqID_13496; Location=1090..2232; Strand=+
  SCN-specific regions: Sequence locations=1-309,360-641,723-1143
atgacatcttctgaggacggcgatgaagcagtgggagaaacgaaacatgggaaatcggcacgaaaaatggccaaaaaccatctgccaaaggacgagttcaaacaggtcataggaaggaaaatattgaagcaccagaaaatgggttaaagtttttgggctagaaaaatgaacacccaaaaaaatttacctgaaatagaatttaaaaatgaggctaaattactttttgttttactttttgaaaattaagcataaaattgacaaaacccatgggaaaggaaagggttaaaaaattaatagattttgaaatgcattaaaaataaatagatttatttccttttttttatatttttctaatttttcactcttcttttgattctcaattttctgattactctaattttaacgtacaccgttcaatggagttattacagtaaggttattttcgtttttaccctttatcttttaatggattaattttaatattgttctcatctttatctaatttattgtcatcttcttcaggctttttcgccattggtgcccatcgaacttgcgcagaagaagtttgagcgccgcattgatcagatggagaagcagctttcagaagtgatcgccaatgtgcgcgaggacaattgtggggggaagaaaagagaagaagaagacgaagaagaaaagtgaagaagaaaaggaagaaaagtgcagaagaaaatggaaaagaaaaaaggaacaaaaaacggatcaaaaatgcgcaatttcttaacatcaattcactgcctatttaatgtatttgctgaagcatctttttaatgatttcataaatagctttggaaaaattagcaaatgtgcaaaaacctaatcaaagcaagcaaaaaatgaagccaaaaaaagaagtaacaaatgttggcatacggcaaagggtgtcatggcaactcgtacaattgcttaggtatgcctaaactttaggcctgcttgggcctaggctttgttttgtaaaatatgagtcgccttttgtacaagttgcaaatgacccaccgcaaattgccttatttcatgaaattgcttgagcttaaagcatgttgaaaccgttctggtaaaatccgccagttgtctttttattatcattgcatgaatagaaaatacaaa

SEQ ID NO: 77384 - DNA, 2327 bp, Heterodera glycines
  Genomic contig location: Contig_ID=SeqID_13497; Location=1..2327; Strand=-
  SCN-specific regions: Sequence locations=1-246,314-505,527-551,598 -739,774-958,991-1192,1241-1366,1425-1511,1533-1612,1637-1710,1732 -1733,1762-1930,1953-2068,2090-2126,2148-2165,2189-2327
  Gene Ontology: Mol. function=protein binding
gataatcatttgtccatactttaaggacgaacttaaagcaagcatacacttgtttatttatgtttccatccaaaatcaaatctttgacctttgaatttcaacccttcacccatgccatttgtaccttatcggctcaaaaccatggtatacgatttttggtagtgtaaccatttttctgtttatgtgtgaaattctaccaaaaaaggaggagcaacaacctctggcactgttctactaatgtccgggacaacatcagcaacaagcagcgctaataacactattaatactaataataacaacaacaacggtaacagtacctgtgtgaaagggtcgtcaacaacgcatacggtaacggcgcctccatcggacatcagtttgacggagcggatgaagcatttgctgaacacgggcaatgacgcggatgtgcactttttggttggcagcgatgacaaaaaagaggtgaggaaaatgccaaaaagaagagttataaattaggcatcagagattacgattaatttggcactgaaaacgaattattggaaaatcattggaaataaataaaattatattatttataataaaaatataaaaattttacttcctatgatttgattccctttgccccaaaattaaagcttcttcctgcgcataaactgattttgaagacggcctccaatgtgttcgaggcaatgtttcgatttgacacggaaaacttgaaggcttcaggaaagggtgaattgaaaaatttattttatttaaacttaatcaaatttgaagacccgcagagtgagataaagcctgtcgaagtgccggatgtggaagttggagctttcaaactgatgttgaacttcatttatgccgaagatttacgggagctgaatggggacaaccttttcgccgttctttatgcgggttgggaaattatcaattttctataaacattatataagtattatggtatttgttaatttattattttttatgaatcatttttgttttggtgtccgattcaaaaaatgtataacttttctcgaaaacactaaaattaagcatttttatatgtattattcatctattcaatgttaattaaaaaggctatgatcaaaaaagcaattttattttttttcgaactgaatatgttctacacaaaagtgattttagaaacgatttgtacactcactgttcaaatatgtataaattttaaaatatgactattaattctaaaataaaaaatataattcagctaaaaaatatggcgttgttgggctcgtgaaggcgtgtgttaactacccaaaattggacccgaccaatgtgttccttgtgctagcacaagctcgcttttatgaggaggaggttaggacaagagaaataataaaaaataaaattttaattttgcttttaaatttatatttattttaattttaggacctttcacggcgttgttgggaatacattgaccggaatgtgggcgctgtgcttttctccaaagaatttttgcaaatggagcataaattgttgtgtgaaattttggaccgtgatcagctgatcatcagcggtgaaattgtcatttggaatgcggtaaattaattgggcacaaatttttgaaattctaatttaaaaacaaagaaaagaaataatttgtgttattggttttattaacaattaatttaatctttttaattctctagatcttttgtagcttaataaacaaagaaaatatttcctttccaaagcatttaaatgttttaaaaattaaattttgattgttttgataattaggtacttcgttggtccgatgaacaacttcgccaaaagggcaaagaatgttcggtggaaaatcgtcgcaaaatgctcggcccagcattctttaaagttcgaattccgctcatcccaatgcaggactttgcggaaaaacttggtaaatatttaattaaaaggaatatttactggaaaaactattagcaattaagggggttccgacggtgccgaaggcgccgccggggaaaattcgaacttttgtataaatgtgtttacggactttatccaaaaacacagagtttttatatcaataaaaagataataaaattttgggcccagcggtgatgacaagcgccgctggcaaattttaaaatttaaattacattagttctgagtttttttttgatacaaagaaaagttttaaaatttttagagcttaattttggaaatttgagaatgattacgagtcctgtcgcaactacaggtggtgttcgatcaacattgtcgaattcgagtctggactcgagaaaaatttggatttaaggcctagtctaagggttgaaaatttt

SEQ ID NO: 77385 - DNA, 619 bp, Heterodera glycines
  Genomic contig location: Contig_ID=SeqID_202; Location=1705..2323; Strand=+
  SCN-specific regions: Sequence locations=1-336,465-619
atgaacgaacggcttgaggcgaattatgacgtcgaactgtgggagaacgcggaattctgtcgtaattacattaaggtgtctgtcgtttactatatgatatgtcggccaattcattcgctttcacccccccccccccccaattttattccttttcagtttttcgagtcctttcgtcgtttccgtgcgcgatgcgatcgcgaccataagggcgtttcgatcactgggaattggcgcaaagctaccgaagccgaaccattgcaggaattcttcgatgccgattacattttgcacgatcgtcttgtctatgcggttaaaggcgctgagggaattccacgggaaaacggtgaagaagcaaacggagaagagaaagaggaaaacaaggagggaaaagaagcaaacagagaagagaaagaggaaaacaaagaaggaaaagaagcgaatggagaggaaaaataagaggaaaagattttattctgtgactgcatgttatgtatgttaattttggcgctagttaaaaagttaccgattttgaattctatcaaaaacaaaacttcatgattgccaaacaaaagggggtaatactttggtttgttccccccccccctttttttttgagaaa

SEQ ID NO: 77386 - DNA, 1158 bp, Heterodera glycines
  Genomic contig location: Contig_ID=SeqID_202; Location=2991..4148; Strand=-
  SCN-specific regions: Sequence locations=1-159,181-455,478-568,593 -619,641-669,691-765,787-1027,1050-1158
atgcgaaaattgtcatcttcaaaatcacttaaagcttctacaacgcataacaacgagaaaaaagtggcatttttgacaaaaccaattaaaaagttgacagatgaagcccaacaaaatagagcagagaaacaacaaatggatgaggtgaagttgatcaaactgtaataaatagggctgggatttttatgtttttacatattttttctgcggcttagttatggcgagagaagcccaaaaataacattttctccgaacaattttcgaattagagcgacttataaaaacataaaaacacatattttggcgttttcgcacataaaaacatatcgcacatatttcggagtttcgcacatattttgcacatattttggcatttttgaaaaaaatatctaagaaaaacacaaaaaattcaaaaatgcacccctaaaaatcaactttcttgacatttttataggctctttcaaaattttctttatttatttcgtgtaccgaaaatcggattctccattaattcgttactggatatcgaagtttcttgctggaacttactcaactgatggaaaaataatctttaaaacaatttatcaaaaaaggactaattttacccccaaacacctccaaatgttttttatttgcaattgtgcgggcgaaaatgaaaagaatgagttttttggaatttttatgcaaaaatacacttgatttttccaattttgagcacatattttcgcacatattttggcatttttttttgcttacttatagcacatatttcagcattttttagcacatattttattacatatttcaggatttttagcacataaaaatcccagccctactcattatattgtatcgtgccgatgacgctgatctatttgctcattatattgtatataattcaccatttgtcctttcacccccacgcattcatttcggcacttattgtatactgaacacactcccaatttcctcctgattaatatgtatgtatttattgtgcttatgttcaaaactgcaaaaatctatgcttttcatcatataattttatcgatgaaaagctaaaatggatttatttttaaaaaaatacggaaatatgaataggatttataaaaaaaatccaaaaaaagccctcttagcgagcatgggatgataaataaa

SEQ ID NO: 77387 - DNA, 1574 bp, Heterodera glycines
  Genomic contig location: Contig_ID=SeqID_204; Location=10..1583; Strand=-
  SCN-specific regions: Sequence locations=1-268,304-439,464-687,712 -874,896-1055,1080-1242,1278-1413,1438-1494,1519-1574
  Gene Ontology: Biological process=gametogenesis
atgccaccgccaccgatgggagccccacagccgcaacagcaggcgcccggaccggcaatgactccaagtgaaatgaaaaagctgaaatcttcaattaattgccttttccccccatttcagcgactgatccgaactacgggaccctcaagaacttggacgccgacatcttcacgaagaacgcgccagcaaaaccggcagcggcaccaaaggcgggacaggcgccacatggaggaggcggaccggcacagacaccaagtgaaaaaatggcgaaattttaaaattttaattctttttcatccccttttcagcgactgattcgaactacgtgaccctcaagaacttggacgccgacatcttcacgaagaacgcgccagcaaaaccggcagctggaggagccgcgtcgcagaagtcagccgccggaggagccatgtcgcagaagtcagcagcgcctgctggaggagcctcggcactgagcaccgcatcgcagaagaccgcagcggcaccggctggaggaacatcggcactgggcaccgcatcgcagaatttgacatatgattttcctctggattacctgaacatgagttcgcagtggggaggcggacggccggtaaagccggcagcggcaccaaaggcgggacaggcaccacatggaggaggcggaccggcacagacaccaagtgaaaaaatgccgaaattttaaaattttaattcttcatcccctttcagctactgattcgaactacgggaccctcaagaacttggacgccgacatcttcacgaagaacgcgccagcaaaaccggcagcggcaccaaaggcgggacaggcgccacatggaggaggcggactggcacagacaccaagtgaaaaaatggcgaaattttaaaattttaattcttcatcccctttcagctactgattcgaactacgggaccctcaagaacttggacgccgacatcttcacgaagaacgcgccagcaaaaccggcagcggcaccaaaggcgggacaggcgccacatggaggaggcggaccggcacagacaccaagtgaaaaaatgccgaaattttaaaattttaattcttcatcccctttcagctactgattcgaactacgggaccctcaagaacttggacgccgacatcttcacgaagaacgcgccagcaaaaccggcagaggcaccaaaggcgggacaggcgccacatggaggaggcggaccggcacagacaccaagtgaaaaaatggcgaaattttaaaattttaattctttttcatccccttttcagcgactgattcgaactacgtgaccctcaagaacttggacgccgacatcttcacgaagaacgcgccagcaaaaccggcagctggaggagccgcgtcgcagaagtcagccgccggaggagccatgtcgcagaagtcagcagcgcctgctggaggagcctcggcactgagcaccgcgtcgcagaagtcagccgccggaggagccatgtcgcagaagtcagcagcgcctgctggaggagcctcggcactgagcaccgcgtcgcagaagtcagccgccggaggagacatgtcgcagaa

SEQ ID NO: 77388 - DNA, 72 bp, Heterodera glycines
  Genomic contig location: Contig_ID=SeqID_205; Location=597..668; Strand=+
  SCN-specific regions: Sequence locations=1-72
atcggatttttggccataatcggaatcggcgatttaatcggaatcggattttgtctggctcggcacatccct

SEQ ID NO: 77389 - DNA, 2367 bp, Heterodera glycines
  Genomic contig location: Contig_ID=SeqID_2026; Location=2653..5019; Strand=-
  SCN-specific regions: Sequence locations=1-411,433-783,808-912,934 -1191,1214-1413,1435-2087,2117-2367
aaataatgttccaagaagttaacactaagccgacaatcatccaaaaggaagcaatgccaaaggccaaaacctgatgacatttatgcggcactcaacggagcagcatacttttcaaatttggatttaagcgacgcttatttacaaatggaacttgacgaacaatcaaaacagctctgcgctctgaacacgcatcgaggattgttccaatgtcaacgtattccattcggagtcaaatcggcaccatcgatttttcaacatttgatggaccaaatatgcagtggcattccaggcgtttttgcttatcttgatgatgggctcattgcatcaaagacaatggaggaacatgtgtcagcgctttaccaacttttcgcgcgattcaatgaatatggcctccacattcaactggaaaaatgcaaatttcttcaaaaggaattgcttttcttgggccacatcatttcttcagaaggaattcgccctgacccaaaacgatcagaagccatttgcaaaatgccgccaccgcatgagaagacgaccctccgatcattccttggagcattaaattattatggtcgtttcatcaaggaaatatgccaaattcgtgcgccattggaccaactgctcaaaaaggatgaaaattggaaatgggaggcagaacaacagaaagccttcgaaaaggcaaaggagattatgacgtcggaattgctactcacgcattacgacccgtcattgccaattgtcgtcgcagcagacgcttccaaagatggaatcggcgcgacaattagccacattttccccaacaaaagagaaaaagtgatcgaacacgcatcgtgcacactgtcgagcgcacaacgcaattacagccaaatcgagaaagaggctttggcactcgtttttgcagtgcaaaaatttcacaaaatggtgtttggcagaaaattcactctgctcaccgatcacaaaccgctgctggccatctttggttccaagaagggcataccaatttatgccgcgagccgactgcaaagatgggccttaattttgtcaaattacgagttcgacatcaaatatgtcaacacagaagcatttggccaagccgacgtcctttcccggctaattgcaaattacccaaggccagaagaagacattttgattgcaaacatttgcacagaaacggaatgcttcatcaatagtgtattccaagtccaaattgatcaattgccattgacagcggctgagattgcggatgcaacagctaaagacgaaattctctcagaaatttcgagactgtcaaagaatggttggccaaacaaatgcagcaacccgaacatcgctccattcattccgaaacgagacgaaatcgtggaagtggaaggttgtttgctgtaccaacagcgcgtcatcatcccaggaattctacgggatcgagcattgaaggctttacatttgtcacatccaggaattgtgcgaatgaaagcgctcggacgccgtcacatttattggccaggattggattcggaaattgagaaaaccgtcaaatcctgtgaagaatgccaaaacgcacagaaaaatccgacaaaaaacacactcggtcaatggacgccaacaagcaaagtcttagaaagagttcacattgattttgctggtccatgcgacgacggatttatgtattttattatggtggactcctactcaaaatggcccgaagtctgccaaatgaagagcataaattctcaggccacggttggtttcctccgatcgatcatttacagactgggagtcccggaagaaattgtgtcagacaatggaacataatttagatccgccgattttgccaaattttgcacagaattcggcatcaaacacactttcaccccgccataccatccacaatcgaacggacaggcagaaagattcgtcgacacgttcaagcgggcaatgaagaagtgttcgataaatgacaaagattgggccgagaaagcgctcctttcttatcggacgactcccaatgcgacatccaacggctactcgcctgatcaattattctttggacggaagctccgtaccaaaatgtcgcttgttcacccgaggggagagccaattgaacacattgatcatgaacagatcaaacaggcaaaaagagaatatgcttcaaagatgtctgatcaatttgacaagaagcatggagcaaaacacacggaatttggtccgggtgaccccgttttactcctcaattaccggaacaacaaatcccactggctacagggcacaattttggaaagggttaagaattccccaacttttcgagtcaatgtaccgatcttgggaggaagaactgtccaccggcacacaaaccagctgcgccgacgtctc

SEQ ID NO: 77390 - DNA, 1218 bp, Heterodera glycines
  Genomic contig location: Contig_ID=SeqID_2027; Location=627..1844; Strand=-
  SCN-specific regions: Sequence locations=1-176,198-791,814-1023,1045 -1218
atgaacgcggcacaattggaacaaattttgaacgctgtgcttacgcaatccgaaacaaggatgcagcaactgcttggaaatgcagtgccagcgaacaacaacctcaacaatgccaatttggcgagttcaattgacgcccgaatttcgaaattttattacgacgcggagagcggaaacacatttgaacaatggttcaaacgttttcgcacactaatcgaggacgatggaaaagacttacctgaagcgacaaaagtccgtcttctattggggaaattatcggacgaggactacaacaaataccgagacagcgtaagtccgacccaacccgatcaaatttcatgggcggacactctcgacaaattgaaaagtttgtacgccgaaacacgatcgctatttgtcagacgctatgagtgcttcaaaatcagacaacagccaaatcaggacatcacttcattgatcgcacaaatcaatgcgtcctgtgaaaatgcgaatttgagcctcacaaaggagcaactcaaatgcattattttggtcattgctcttcgagatgagcatcacgacctgcggcaaaagtgcttgaaaatgttggaggatggccagaaaaacggcaccgacatcacactgaagcaaattgaagaagagttgcggaccatccaaatggtaaaagaaagcgcactctcgctaatggcacaacccgccgcaacaaacgcaattcacacacgtcctcaacagtggaaggactcaaaaggaaagtcaaaaccttttgtcaaaactgaacaacggagtcacaaccaacagaattgttctaaaaatgtggacaaaggcaaacaccgacagccgactgacccatgtccagcatgtgggtttttaggccattggcgatcggaatgcaaattcaatgatgcaatttgccacaagtgtcagaagaaatgacacatcgacaaagtttgcccactaaagaacagccagccattcatcagaaaaggccgatcagttctcacaattgaagtgaacacaacctgcacagaggttggaactgctgatcactggtattggcgaattttgatcgcagtcaacggcgttaaatacggattaatgtcgacactggtgctcaagccaccatcatcaccagcaaaacgtggtgcaaaattggcaaaccgaaattgtcgcctgccgacattgaagcaaggaactgcaatggagaagcagtaccgataa

SEQ ID NO: 77391 - DNA, 1476 bp, Heterodera glycines
  misc_feature (1476)..(1476): n is a, c, g, or t
  Genomic contig location: Contig_ID=SeqID_2028; Location=13..1488; Strand=-
  SCN-specific regions: Sequence locations=1-588,610-759,781-1080,1103 -1107,1129-1383,1442-1476
atggcaatgccgccaagttgtcttaagcgttctccatcagtgtcaaattatgggccagcaaaaagagttaaatttaatgacatattgcaaatggaagtttatatccgaaacccagaggaatggacagcatttgatggtattgttaaagtaatacatatccaatttgatgttaaatttaagttcaagttgaatcacaaccgaaccttatcagtggcgaattttttcatgccgaggaaatgcgacgcgaaagttaccccaagggagagaaggtcagaaaatttatatgaatcaattgttgaattttgatttaaagtggttcctttacactgtcgacgacgcttttcagcgtgttcaacaggcgggcggaaacagcacagccaaaattattgaagaagaccgaattagcaaactgaaagagaagcgttgttccactgaagcgggtccgagcgggtaaaatgatttgttgggctttgttcagtccacaaatgtttcgcatttcagcacttctgtccatgacaatgagttggagcttctcgaagagaaggaaaatatcgagtccgttgacaaagaattgccaatggaaattccacttggttggtctacagatttattccttactaaattttcattgctttagaatttgatgacagtgagcaaatgcaaccatcggctgactatttggaaggcaacgaagacgaacaaatggcgggcccatcaaacggagagggcgaggaaaacaatcggttagaacgttttttattgagttttaaaataaaataactcaataattccaattaagaaaaaacatatcgacgaattctgacaagaagaggcagctcatgtccgaaatatcgtccattcttgtgtccctccaatgactgccgataaatgtgctgaagtgttggaccgatctggcaccaaccaaagttcacggtgaaagcattggaacttcaattagcattatacccattttattacggcatttttaactgtgaatgttgcagcgaacttatcgctgaaatgctcggcttgctgcagtcgccgattccgtccaacgaaaagagcgaaactgaacacatcagagaagaggaggaagagagggcgacggaaaggaaggaggcgagggaggacactctaaccgacaaaaagtcagtgcaatttgttaaagggaacctgaaaaccttttttccctaattaaagcgattttctgaatcaatcttccgagccggaggacagtgaagacagcaatttggttgaacctgccggacaagtcgttaaggaaaggcaaaaagaaacgcagcaccaaccgacaagcgaaagcttatttgcgaacggactgaacatcacgcaaagaagggacagcggaacggacgaattgcaaatggaggaggaagaacagagagagaaggagcaaaaagggagggaagaggaggaggaagagactgacgatgacgaaataattgtgattgagcagan

SEQ ID NO: 77392 - DNA, 417 bp, Heterodera glycines
  Genomic contig location: Contig_ID=SeqID_2028; Location=2113..2529; Strand=+
  SCN-specific regions: Sequence locations=1-205,228-417
atggaagcaattctaacaaaaaagaaccgtaccaagcttcaacacaacggtcattcatacatttttcacaagccgagtgccgatggtgaagttcacttttgggcctgtgaacaccatcacgcaaaagacatcactttcaaagggcgccttcacactaacctcaacaacaacgttttgcgtgaagttggaaaccaccagtgtgaaccaagtgcagctcgaatggaagcacaacgagtgatcactggaatcaaacgccgtgcggaacaaacaatggaaccaccagcgacaattcgctcattggcactgcagaatgtggccacgccagtccttgcgcaactccctaccaagaatgcgatcaaaagtttttttttgttatgatatttttatgcttaggtaatcaagcgtgtacgtcatgaa

SEQ ID NO: 77393 - DNA, 251 bp, Heterodera glycines
  Genomic contig location: Contig_ID=SeqID_2028; Location=1586..1836; Strand=+
  SCN-specific regions: Sequence locations=1-251
ctatggcacccccacaaagtgtccaagccacgaaatgtccaaaagagtaaaaacccacgaaatgtccaaaatttttcaaaatttataaaaacaaaatgagtctaatttaggatttttaaggttttcggggtcgctgaatacgaatataccctttatattaccccttgcctaaccttaggcccatctgaataataaaaaactcaaattcgagacttggacatttcgtgggctggacattttgtgggtcagcg

SEQ ID NO: 77394 - DNA, 643 bp, Heterodera glycines
  Genomic contig location: Contig_ID=SeqID_13498; Location=388..1030; Strand=-
  SCN-specific regions: Sequence locations=1-411,446-643
atgttagcgggtcgccgaaattctgctacttctattactatcccttttaccgtaaccgatatccgtcctaccaatacaatcggtgtcgagtaagttgttgcgatataagaatcaagtggtaaaacatttttcatatttactttttttttaacaatatttattctcgcatcaattaattctcgttaaattaatcggtatgtgcattaggtaggtaattagtttaattacttaccgtaatttcttggacaaaacaatccatccattccatgcatccttgcttattattaaactatgctttatcatttagaaccaaccccacaatgattgtcttatcatttttagacttatgcttctccctacgacaaacactcctcaaattggcccgagcatcatttcaagtcatttttacacatttttatttgtatttttttatatttatttttttctcagttaccctttttcgttgagtgggtataagccatgctcattctatggctcttacacttatgcgccgtatcgaccgaataagtaagtttttattgcatctgagcaatttatcaacgatgaattttgtttattaaggagcccatctgggtactattatggatggtacaatggcatctcgggattctgagcaaataaa

SEQ ID NO: 77395 - DNA, 201 bp, Heterodera glycines
  Genomic contig location: Contig_ID=SeqID_13498; Location=46..246; Strand=+
  SCN-specific regions: Sequence locations=1-62,84-97,123-201
gcggcggatgggatgagcgcattttgggcggtcgtgaataataatgcatggagagaatgagtgaagaagaagaagaagaagaattcgggatggatgccaaaaaagtaaacattcattttcaattcaaactattgaacataaacaaaacaatgaatttctttcctggtcattttccaattaaataaattgaaatatttacca

SEQ ID NO: 77396 - DNA, 435 bp, Heterodera glycines
  Genomic contig location: Contig_ID=SeqID_13498; Location=2091..2525; Strand=+
  SCN-specific regions: Sequence locations=1-288,313-326,352-378,400-435
atgttccatttgcgtttcgttgtgcttcttctgctggtaattgtcggccttttcattggccccaattttgtttctgctgattgggataaaaaggtggccggttgggacgacaagaaagtgaacaaaggctgggaggaagccgaagcaccgctcaacatccgtgcccgtcgtcagttttttaatttatttaaattccaatttttaaattccaatttaaatttcattacaggcggcggatgggatgagcgcattttgggcattcgtgaacaatgaatggagagaatgagtgaagaagaagaagaagaagaagaattcgggatggatgccaaaaaagtaaacattcattttcaatttaattccccctttccgcccccatttgagcccctttttccaaatttcaattatcaaatgcataaacctgttctttctctccca

SEQ ID NO: 77397 - DNA, 283 bp, Heterodera glycines
  Genomic contig location: Contig_ID=SeqID_13499; Location=96..378; Strand=+
  SCN-specific regions: Sequence locations=1-283
ttggtacaacccgaacaatccattccgccgtgacccccaactccgtctgttcaccatcccggcactcgtttgtctgttccgtgccggtgccaatggcagttggatgaacacagcgaaagacttgtgccaaatttacgagtcagaggaccactttgccagtgtggcaacgttggagcgcattctgacaaactttttagacattgcagctgaacgccaaggaatgagtgtcagtgagggacgataaaaagcgatggaatgccaagaaattgcaaatattttcaaa

SEQ ID NO: 77398 - DNA, 1279 bp, Heterodera glycines
  Genomic contig location: Contig_ID=SeqID_13500; Location=67..1345; Strand=-
  SCN-specific regions: Sequence locations=1-173,196-1279
atgccgggattccgacaactgaaccggaatacgatgcagaaatatacatccatcaagtgcaagggttatggaacgtcaaatatcccggtgagtacaaaattttcatatttaacgattaccagatacgaccaatcaccaaatctgatgtcaccgactaccaattccccattcttctctaccacaacaacaaccactttgacggcatcaaaaccctgtccaaattcttcaataaacgttactattgcctctcttgtgaaagcgtctacgagcgcaaatctcaacattcaatgaattgctcttcactctgccatggatgtcgggaggttggcgtcgactacccatgcgagccacaacagggatacttcaaaaaatgtgagcactgcaacaacaatttctacaacaaggtctgctatgaacgtcacctacacaaggatctatgcaccaaatttcagcgatgcgaggactgtggggtaatttataatgtaaagtatcacggaaatgtaggtcaccaatgcggggaaaagttttgtcgactttgcaagcaattccatgtaaaagaggatgatgaggataatccgtgcagtagctgcttcatccaacccctaaaaccccataaacttaaaccatacaggatcatcgcttatgattttgaagcgacacaggataaaaaagtaggtaataaattcgaacacgaggtaaactttgcagcggctaccatcatttgtaccgattgcattatcaacggcgactggaacaaatcacttcagggaaaaaagtgccaaatttgcggtcttcaccgctcaatcaccttttcaccctttgactacacggagacaacagtcgaccaaaaaatcatcactcaacaaccgctacgcgaattcgttgaatggctcctttttgaccacaacaaaaagtttccaacagtcgcgtttgcacactttggggggcgctacgacatgacgatgatcatcaaggaggttttggcgcaaggaattcacaatccggacatcatcaaacaagggaaccgactctacgaactcaaaattaatcaaaatgaacatggaccgcttacaattcttcacgacagctacaaccttatgcccattaaattatctggcctcatcaaatcatttgggcttcatataaaagataaacaacattttccacacatgttcaacaaatcatcaaactatgacaacattctctcccatcttcctccacgtgaacaatactgtcctgatcaaatgaaaatccccgatcaacagaaatttgacaaatg

SEQ ID NO: 77399 - DNA, 742 bp, Heterodera glycines
  Genomic contig location: Contig_ID=SeqID_13502; Location=393..1134; Strand=+
  SCN-specific regions: Sequence locations=1-332,354-575,597-742
atgcaacaccaccaccaccaccatcatcatggcacggcaccatccgcattcacgccactccaacaacacaagcaacagtcgccagcggcaacaattgtgccacaaggtgagagaatatgcttaacgaattatcgaggctgatcattgatcagaaatttggcatttttccgtggtaatcaataacctccccgagtactcatttttctggttcccaatttcctaaaaaaaaattttcaatgcccaattttctgtgttgtatattcacatacccttttcttctattctaggtaccagaattttggcgtttaattatccgtaattcctcactttccagtgccaaatttgaagaaaatttggcactcagttttccccgtactcaattctctgggtgccaatcagttgtcaaagaatctttggttatccggcacattcaatttgtggcacccacccaatttccggcactatctctctctgctgggaactgtccggcccggctgcgaaaacttcatttctttgcacgtggcgtttggccaatatttttttatttgttggccataagtatgtccatgagcttcttttcaggattagctttttgcgttatgttgccttaagcagccccccatttgcttactcagccacataatccgcttctttgcgctgcttggccgacgatttctcgtcattttaatgccactttttctccttggcacaaaaatctttttttggaattttgataattgga

SEQ ID NO: 77400 - DNA, 557 bp, Heterodera glycines
  Genomic contig location: Contig_ID=SeqID_13503; Location=437..993; Strand=-
  SCN-specific regions: Sequence locations=1-514,536-557
tttgtggtgccattttatgatgcctggcgaaaaaaaaatttgtggtttcaagaattgagacattatcgagagagccgagggaggagagaatggcgactcaaaaaccgcgaaaagacaggtgaaggccaaaaattagtttagagaattggtcgggaatggggactcaaaaatattgaaatgacataaaaagccaaaatcatagacggattgtcgaagttagggactgaaaattcaaatattttggatttggaataccgaaaaatttgagaaaattaagagcaagggtggggagaatttcggataatttgagaaaattcagagccatttgaattgaaaactaaatcatgaaatttagaagccttagattcaattgctcgggattcaaagaaactaaatcataatgaaatatacagaaaataggactaggatttaaatgtgcctaagtttgggaacgtgaaaacctatagtgaaaggctttcgagatcgttaatcccggatttcaagaatgaagatccagaattaaaaatttggccccttgctcaagactgaaaaagcca

SEQ ID NO: 77401 - DNA, 414 bp, Heterodera glycines
  Genomic contig location: Contig_ID=SeqID_13504; Location=788..1201; Strand=-
  SCN-specific regions: Sequence locations=1-215,239-414
atgtgtcaaaaaaaaagtgccgtgagaaaagtggcggcactgactttttacgcgcgaatggtacggaaaatgttttatgaatgcacatttttaattttggcaggtttatgtgcgaaaattatgagccataatgatcaaaaccaaaatggcacggcataaataatgccaaaaaagttttaaatcctattgtaacagttactgtattattccaatttgtcaattttttgagaattttccatattttttttttttgtaaaatttccagggatatatcatatccaatgaagatatatcatatccaaagggggagagcgaatgttggcactagaaattggaaaagttgcagaaaaacggacacctccagaatattgggcaccataattatgacaacaatttatttacgggtaaaataaa

SEQ ID NO: 77402 - DNA, 2015 bp, Heterodera glycines
  Genomic contig location: Contig_ID=SeqID_13507; Location=268..2282; Strand=-
  SCN-specific regions: Sequence locations=1-384,406-670,716-754,776 -907,929-1153,1178-1241,1263-1263,1285-1303,1343-1522,1552-1720,1742 -1760,1782-2015
atgccgcccatttttgtgcccagtgaattcactttgctgctgatcatgtccctgctcatcttgatgacatcgaacaattatcacaatcattatggccccgtgttggcccaatccgacttggaaacggcggccgatttaaccattttcagtgagtttttatttttattttgaatctaccgacaaattttcaaggacataataaggacagcgatttgatcggggcagaaatcggcaaattttttcggtctctgattgtttttccgctcaaatgaagccaaaatgtcaaatattcggggatttttcgtttttttcttttctttttttttgaatttgccgacacttttcaaggacacaaaacaaaaatgacattgtgcctatcgatcaaacacaaaaaaccaaaactatcaaacccaggaccaaactagattgtcggcacattcctttgatcttcttaattacccgctgccctcattaattatccgctaattgtccatccccttttgctttcagccaatcgtcctcccagggcacgtctctttgtgggcaaatcggcactgcatcaccatcatcaacaagtattggcaccggtgatagccgcttctcctccttcgccaacaacgttggcacaaatgatgcgtgccaatccgttgttggccacactgagcatgttcaacgacaacaacaacagtgacaatgacgatatcagcatcaacaagctggagactctcgacattcggcatggtagccgatttggcacagaaacaacgacaacaacagtgccaaagacagttagcatgccgtcattattggcaaaaagccaatttaagccgacaacggcaaaagggcgtagcatggtaaggaaaatggcactgtaaaacagtcgaatattgattgatcaggactttctcgaggagttaaatttgaaattccgatcggacttccctaggaatggatttttcatgaaattttggatttactcgactttcgggcctggattttatagggtttttagcatatgcgaagcaaattttcggatataacaaaatcactaaccacaccaccgaatttcagcagatggcggcaacggcaaatgcgtcgtcctcactttcggattcaatcgccaattttggcacaacaaaaacgacggcaccgccgcaacaacaacaacagcagcagatggataattttgatctgctataccaaattttcaatgtgtcaatgttcgatttggctgatcagcaggaggaaaagccggaggtgttgacaaaatttgggggaaaaaatgaaaatgccggatttttttaaagaaaacttaaagttttgaaatttttggtctttctacaaggctatgcgagtgtctcgagtcggttcccggactcgtgaatttctcggttttttgggtcttgggttttttttttttgaatttcgctagatcaattcccgctcttgaccctctttaaagacgaaagggagcaggacaaaacgtcgccgccgaaacgtcgccgggacataacgtcgccgcaaaatttttttaattttataaaaaaaaatctagaaaaattgtgataaatttagttaactagcttaatacgaaaaaaattctagaaaaattcaaaaaaaaaatttctatcaagaaaattcaaggaaattaaaaaaaaattttcaagttttttggtttttttccgaaaattcagcaaatttagtttttattaacacttagattttcaaaaaactaaaatacttttaagttttcttgaaatctagaaaatttttatttatttttgcggcgacgtatgtcctggcgacgtttcggcggcgacgttttggggtgtatcccatttaaaatggctactatttttttctacaattatatttcttcccaaaaaaaggaagtcgatcagctgccttttttgcttccattggtaactcgcgcggaagagaggcgaagatcagaagcgtcgaaacacagaagtgggcaaaagcattaagtgatcagattgggactgaaaaataaa

SEQ ID NO: 77403 - DNA, 1334 bp, Heterodera glycines
  Genomic contig location: Contig_ID=SeqID_13508; Location=68..1401; Strand=+
  SCN-specific regions: Sequence locations=1-95,119-396,421-527,551 -761,784-806,833-1068,1090-1334
atgctccatttgccatttgaccaacactccaagcttcatgtacggccaaatgtgtcgtgccgtgaagcaatctccacaatactcaaggttggcacaaattattttatttttattttttggcccagtcggacatttttttcccattttatggtcataaaatgctgaaaatggtatacaattaacacttttgctttgaagcaattttgacaaaaaagtttttgaccaaataaaggggcctaaaagttaattaatgccacctttcgaagaatgctgccaaattctgttatgatcaacaaagaacaaattacgtggtagggcattcgcttaaaaaatgacaaatttttgccacttttcgggacaatttttcaaaacatcttggtaaaatggggtcggaaaattctttgaaattttaatgcaatatgaaaagaaaattgtgcgaaattttctaaaagtgcttcaaatatcttcgtaatgttgtgtgcccatagcatatgcaatttgtctcgaatttgccatttttcccacccaaaaaaaaaaaaaatttttttttcaactttcagaaacgtaacattgtgccggagatgtgcacagtgtgcgtgtccgaggacccgcaaagtgaacagattgacctgtccgttgagttggaggtgctcgcccgccaattggtgcgtaaagaattgtgggtgcacagcgaggtcagtaatgggtgaacgggatggacatggacattctcccctctcgccacatgagaaaattttgaaaagttttaccaaaaactaataatttttcattaatgagaacctaggaaattaaaaaaaaaatttttttttttggaaaaaaatgaaaacctgaaaaaagtaattaatttacacttaataatctctaaagatttttcttcgtttccatgattttttgggcttaccagtggatagaaaattcttgaaaaaattaacgatttcaaacaatcggaattgggggtagaaaaaaaaattttccaggtccgttgatcatgaaaaaaatttttccaagatggggtgatatccaattttgagcatttttgggttcatttttgaagcatttaattgaaaatttagtcgtcccgacgcattcgacacatttttccatgtttttcccccagtgtatggagctgttcaagagcattcaccacgaatttgtgccaaaaacatttctgtccgtcacttattgcggcgtgtgccggcgaatgatcattttccagggctaccgttgtgagaagtgccaggtttgtacaacaacacacagacagagttttggcatttttgttgaatttgccaatttcgatgttccttttaaca

SEQ ID NO: 77404 - DNA, 1521 bp, Heterodera glycines
  Genomic contig location: Contig_ID=SeqID_13509; Location=166..1686; Strand=+
  SCN-specific regions: Sequence locations=1-84,150-434,466-560,586 -910,986-1043,1093-1169,1194-1326,1348-1521
atggaggaacagttgcgcagcgtttgcgaaaaatacgacggaccgcacgaggaaattgcgaaaatactcagcaatttgttgcccacaacatcggcgacaacaaacagcaacaacaataaccacagtgccaatgccaataataatagtaattttacttattttcttggaccaaattcattaaaaattccaaaaaaaaaaaaaaaaaattcaccaagcagcgaattttattttttgaggcggaatttttggggaaaaattgcaaaaattgacaaaaataatggaaaaaatgcattttatttttatgaagttaggtattaggcatatgcaaatgttgtaaacaggtttcattgaatttattaaaaaaaactaacaataggaggtgagtctccaggttcttccgaaggagggtggaaaattttaagcatttttatgagaatttttcaaaaaaaaaaaaaaaaatttttagctccaacaacattgacaccgcgttcttccgagcggacaacaatggacagcaacgccgacattcattacacacaacagcaacaccaccacaaccatgtgcagcaacagcagcagcaccattttgggtatgatggggttttttttttgaaaaatgcgttgcaaatccaaaaaaaaattttttgaaaatttttccaacgattttttgtttttttgggagaacttgaaaaataagcattcaggaggtggcactggcacctcctactagtatttaaacaattttcaattcctctccaaaaaattcagagacaacagcgccgccgctagtttaacggctgtgcatgagccgtgcaattgcggtggtgacggtggagcagcaccagcggtggtgggcgacgatgggacgacgacggcggaaacggacaatgaacagcaaaaccggcaatgccatcatcatcatcagcattgctatcaccaccaccaacaacagtgccaatgccaacaagggcaccatcattactactttgacggccgaacgcgggaccgttcctcgtccgcgccgaacattaacagtgtgatccgtggcggtggtgtcggtggtggcattatgggccgtggcggtggtggtgggatttgcttgaagttgcacaccaactcaatgcactccggactgcacaacatcatcaacagtgagaaatggccatccgaaaaaaaatttataaatttttaaaccccacgcggactcgaaccatcagtccaatatgacagccgtcagtaccacttgaccactgtatctgaatggaaaatgcaggggaaaatttcgattttcgaggcccaaaaacaatttttttttttcacagccgctaattttccaggcatccaattcccgcccaactcggccggcatgtgccgtcgttctcagaccccgaccctgttgcatgaggtggagtgttcaacgacggttgtggcaaatgttggcggtgccggcggtggacaccatcgccatggcaagggcagaggccaaggcggcagtgccagcaccacgacgcagtggacttg

SEQ ID NO: 77405 - DNA, 384 bp, Heterodera glycines
  Genomic contig location: Contig_ID=SeqID_13510; Location=15..398; Strand=+
  SCN-specific regions: Sequence locations=1-159,181-281,303-384
atgccttcttcattgaacagcgaatacatcggagcaaaagtaaacacattgtgatgttgatgatgggagaatggcatgtcgagggggtaaatttgcatacgacggcacaaattttcgcgactttagccaatttttgagaaattttgattttaggcgacgctgggaaatgttagaaaattttacttaattttgagtcgaattttggaaatttttttgcagagttttgggaccggtgatgctgctaggcgacacgaaaggaaaaatcaggcatttttgcccatgttttaatagtttttcaacaaaaatttagccttttctatggtaggtacaggtcacacgctgcggtacaccccaaaacacagccgagacataacacagccggga

SEQ ID NO: 77406 - DNA, 1101 bp, Heterodera glycines
  Genomic contig location: Contig_ID=SeqID_13512; Location=175..1275; Strand=+
  SCN-specific regions: Sequence locations=1-336,358-657,682-745,770 -1101
atggctccattgactcaagctcaaactgagcaagggcgcattgactctttatcaagtgacacccaattggaaaatgaagcaattttggtccaagacagggatgtcgcccaacaaaacgaggaccatggtcagtcttcatattcaatctgataacttttaatttgtttttaaggaccaaaggcccggggacgcccgccaaaaaagacaaggggcccaggccgaacgaacataacaaacactgctgggaatggtggcacccctttgtttgttgacagcccgtccggtaggggcgacagtggtgtcaattcacgcagaattgtggtcagattttcggttgtttttaaaattaagcatttgtttaagctacgatccaaacatatatgccaaatcgaagagagactttacaaagtgctttccgattattctcagcgtccttggcccttaaagaaccaaggtgggttttgaatattttcagccatttttcaaattttaattgtcaattttagctaaacataattggactcgctgcaagggcgattgcgattgtacgtctgctgctcaatgtcaacagaatgcgcaggcctacattgcctctgcaaaatatgaccgtgaatttaccccaaagaagacaatgccgttgaaattgacgaagatggcaaaacagtgtcatcataaacatgcttgtgcttcttctgggacaaatcacagggtggattagattagggtacctcaattatcttttcatttcaggttgattattatgacagcggtcaattcggcgatgcaaactgtcagcattgtggtgctgttttgctagccaatgaagcatatgcaataagaaagcaggggcgtgtgtccccttgctgttccaatggccagtgtcacaccgagcaaatgaaagcggaatttgccgagctgcaaaaccctcctcaaaaattgaaagatttggtcgcggctccggatgaacgcatccgttttgagtttttggacaacacaatgccactcaataatactttttcgtttgcatctgtccatagcgagaaggcaccagcagatcaaatggcaggcagaatggataccgttaaatataatggtgattag

SEQ ID NO: 77407 - DNA, 427 bp, Heterodera glycines
  Genomic contig location: Contig_ID=SeqID_13513; Location=532..958; Strand=+
  SCN-specific regions: Sequence locations=1-33,55-375,398-427
atggcatgctccatcatccaatcaaatttggtgaatattttgatcaaaaaagaaggtaactgatctgataatccgatctgattataaccagatggatgataatttgccgatcaatgaatgccaataatgtattgtgataatgattagaacaaaaagcgcgcaatgcgttggtcaaaaggaacatataatgttgagagtggtcatggaatgtgtgcgggttgatcaatcaatacacaacacaatagcctcaggtctttttttattgatcaatcacagctaattatcacattccaacaaattaaacgcaattagtggctcaaaagagggcttatcaaaacatagaagaattttttagtcaatccccctaattagtccttaatatatatttatatttttagtaatccccctaattaggtcgtcttaatta

SEQ ID NO: 77408 - DNA, 277 bp, Heterodera glycines
  Genomic contig location: Contig_ID=SeqID_13513; Location=1790..2066; Strand=+
  SCN-specific regions: Sequence locations=1-30,52-277
atgtgcctgtccttgtccccccccgtgatatgccctctgctgctgctgtcgaatttaggccccattttcaacttttggactgagaaaactaaattttgtgggacgcgccaagccgagaccaaaaactctgacggtgagtgctaggctgattagatgattgattagttctaattaattcattaatttagctaatcatcaagtattcagcacccatcaccatcatcatccaagtaaaaagcgaccgatgctcgagactgttggggagcgggagcggtaa

SEQ ID NO: 77409 - DNA, 1129 bp, Heterodera glycines
  Genomic contig location: Contig_ID=SeqID_13515; Location=383..1511; Strand=-
  SCN-specific regions: Sequence locations=1-277,299-390,446-549,593 -906,973-1129
atgccacgcatttacaacagtgccacagtccgactcggggcaataaaagggccaaccgtacgttcggttcacaactctctcataaaagccgtaataattgcggttggacagtgtcgaaaaagtgatgtcatagtgccactgaagtgagacggtaaagcattatgccaaacaccacaaaagcagttcgtttaattgtcctacaaggcttttaaactcatctattacggcattttgttagcttcatgtgaattttttgaaaaaaaacaagatgatttcagaattttagaaaatagtttttggagttctcccccctccttggtctacaagagctcattatttgaagaagagataagactttcggtgtagaacataaaaggtaactcgcccagtgggactcgaacccacgaccccagcaatccgtgccgtgctctaaccaactgagctacgggcgcctcttgtagaggttctctcaggtcctttatcccactttctcccacactccgttccttctggcatcacatcggaaaatatttctattgtcactgtcagtaaattatttgaaagttaaaacatttttttaattatttaaaaagtaaaatcgaaaaaaggctgaatgccattgtcaaaatttgccttcatacccaaaagaataatcggccaattgcttccgcgtccgcgtctcttccgtcaagaacaatcgaattgttacttgaatgaaggcaattaaaatagtcattaaaccaaaacagttaattaaaatcataaaattacctcctttgcacccaaaagggcaacctcgacaaattgactgagagtaattaacaaaataaactaattaattatcattgctaaaaccccttacaagacaaatacaaatcattgtccggcattatgtacacatattccttaattaattttttattttatcaattataattcgtaaatttgaccactcattaattaattaattgacctttgtgtagagtccgccatcaaataaattcagtgcaaatttacgcaattggacaatgtcatcaaagcacaacacaacaacttaatttgttgatattgtattttttaatatttacattccatctttttctttatttatttatttattgtcaataaa

SEQ ID NO: 77410 - DNA, 4025 bp, Heterodera glycines
  misc_feature (3893)..(3893): n is a, c, g, or t
  misc_feature (3953)..(3953): n is a, c, g, or t
  misc_feature (3972)..(3972): n is a, c, g, or t
  Genomic contig location: Contig_ID=SeqID_13515; Location=459..4483; Strand=+
  SCN-specific regions: Sequence locations=1-81,148-461,505-608,664 -755,777-1216,1239-1980,2002-2072,2100-2114,2136-2480,2503-2643,2686 -2770,2800-3002,3024-3028,3081-3304,3327-3423,3445-3539,3570 -3682,3705-4025
  Gene Ontology: Mol. function=protein tyrosine kinase activity; Cellular component=mitochondrial inner membrane; Biological process =cGMP biosynthesis
ttgttgtgttgtgctttgatgacattgtccaattgcgtaaatttgcactgaatttatttgatggcggactctacacaaaggtcaattaattaattaatgagtggtcaaatttacgaattataattgataaaataaaaaattaattaaggaatatgtgtacataatgccggacaatgatttgtatttgtcttgtaaggggttttagcaatgataattaattagtttattttgttaattactctcagtcaatttgtcgaggttgcccttttgggtgcaaaggaggtaattttatgattttaattaactgttttggtttaatgactattttaattgccttcattcaagtaacaattcgattgttcttgacggaagagacgcggacgcggaagcaattggccgattattcttttgggtatgaaggcaaattttgacaatggcattcagccttttttcgattttactttttaaataattaaaaaaatgttttaactttcaaataatttactgacagtgacaatagaaatattttccgatgtgatgccagaaggaacggagtgtgggagaaagtgggataaaggacctgagagaacctctacaagaggcgcccgtagctcagttggttagagcacggcacggattgctggggtcgtgggttcgagtcccactgggcgagttaccttttatgttctacaccgaaagtcttatctcttcttcaaataatgagctcttgtagaccaaggaggggggagaactccaaaaactattttctaaaattctgaaatcatcttgttttttttcaaaaaattcacatgaagctaacaaaatgccgtaatagatgagtttaaaagccttgtaggacaattaaacgaactgcttttgtggtgtttggcataatgctttaccgtctcacttcagtggcactatgacatcactttttcgacactgtccaaccgcaattattacggcttttatgagagagttgtgaaccgaacgtacggttggcccttttattgccccgagtcggactgtggcactgttgtaaatgcgtggcatttgagcagatttctgatcagtttgattgatcaccacaaccctttagggatcagtatattccatccttctctacgacacaatttataattatggcattgcgttaaatgaaagttttaagcagtttggcatacgacctgaagtgtaccgtaatgggtcattgttggccagcttcagaaagccatttatgggtatgaaaactggggggggggaataataggctaagggcttttaaaatgaatttttttttttgatttgtgagtgttttttttgtcatcaggtttgagcggatatgtgattacggagtcggatcgtaatacgcgcgttttggtgctgtccaatcgaaggtcggaaggaagcaaaaatgcgtttcgcattttgatgcaattgggatggaaagatggcgaattggtgagcagcgccaactaattatcaaataattgacaaaaatgggtataggtagacattaataactaacattttttgcgcctgtcagaatgtttcaatgagtgccggcagcagcccgttcatttggtcttcccatggcggaagcgcgccgttggcggtgccccggtgcggttttgatggcaacggatgtgccgtttcagtgttcgacatgtataaagtaagaccagcagcagttcactttcactggccagggttggcattccgagtaaaaacttgggaagctgctatatccgagtcggaaggcatttccatggaagataccgaacccttaattctgatcctactcaatgattattttagggatattttttgagtggcatcgctttgtctgcgctgctcattatcgccagtgttacgataattgtctatttgatacagtaagaaagagaaacgaatggaacatttttttacaaattattttacagtgccaaaattgttgaaactcgtaaaaacaatttactgtggaaaataccatttggattgttgaagcgacagaagcaaagggtgagtggttgaaaagatttattgggatattttaaagcgtaattacatgttatatatatatatatatatatatatattataaattaattagccgaaacatttcaatttttaaagttatttaaattgctatcaaaatacaattaataagcattccataatttcatatgccagacatttttcttgcaaatttaagagacccgaacggactgccgaacgcagtcagcactctctgcgctccaaccaaacaaatctttcctcgctgaccaattcgaccaccgacagtttggcacagtccaaaacatttacgctttactcatacaacggggagaagtgcattgtgcgcatttactgctcaacctccttggcgacaatggcattttccgtcgcgcaaatggccgagtgccgaacggtggggcgaggggggcggggggcaatgaatggaggaggcatttagggggaaatcaaattttggaattaaaattcacgtagaagccgaatggggaggaaacttagcaagattcaaatttctgcccccaaacctcatcagcgactcgtcaatacattgaaaattctagaatcagcaccaactaatgctaatgaatcttccaattttaaaatccctataaattttgttttttttttattaatatacaatttttatttctgtttttataagtcgtgatttttgatggaattaatgccttttctttcatacttttgcttgctcattatttttaagtcataagagatttataattaaataaaatttatttaaatggtgtaattcctttaaatgttcagctgcgattgttcgaccatgagaatttgaatcgttttttggggctgagtttggatgggcccaatgttttggctgtgtggaatttctgtgccaggggttcgctcaaagatgtgatattgtccgaaaatgccatggtcaaggacgtggtgttcatccaatcggccatcaacgaactgtgcgaggtgaaaagtcaaaaattaaatgccgaattaaatttcatttaaatttctaaaataaatacattatataatgtttatttcaattagcaatttaaccctcctaaagttcgaaatccaaaaaccgaataagaactcattaatctgtcttttgattaatattattaaatcatttttcttgattttttaaaacgattttattaggtttttagattttccaatgaaaaaaataaatggtttttcacaaaagcttatggtcaaataaatggaagaatacagtattttcttttttttgatctcagggactgtatttcctgcacagttcgcccctccaattccacggtcggctcaaatcgtccgtttgtcttatcaatgaccgctggcaagtgaaaaatttcgtattttgggcttcgctggctcaaaaatgttcaaaaaattgaaacaaaaggtgaagcattgctccgaatgacttctcttaattgaataaatgcctttaagactttttgtggttgtcgcctgaacaattgcggaaaatgggcgacaacactaataataataataatgaccaacaaattgacggttccaaacaaccggacatttacacattggcattgattttcactgaagtataaattaaatgcattaaattttgggttcaatttcacctgcagaaggcggcaccatcggatcatttcatctttttaaaactaaaaaaacatttagatcgttttccatagaaaaattagtgtttacaaacatactttggacacttttggctgtaccatataagatggaattgtgaagcctttatagagtattaattttaattattaatcactaattaatgggtatttgtatggagaaaataaaatattattgtctaaagcaagcactanattaatttcatttataaataattgttaccttaattaactttgtgtcccaatttcgatggntgatatgtgcccgtgttgngaagagagtgacaatacgccgccatgaatacggggaaaacgagcggcgagcag

SEQ ID NO: 77411 - DNA, 929 bp, Heterodera glycines
  Genomic contig location: Contig_ID=SeqID_2030; Location=473..1401; Strand=-
  SCN-specific regions: Sequence locations=1-210,232-714,737-784,806-929
atggaatactttgtgctggatgagactgtggcgaagctggactgtgatcatatcttccaccccgactgcttgaagccgtggctggcgcgtaacaacgtgagtttcggatgagttcctttttttttgaaatttcccattttccagacttgcccaatttgtcggaagcagatcgacccgtccaagtggggcccggtgatttcggatgtggacgaattggactaagaagataaagcattgatatatgtctgtgtgtgtgtgttccttattataaattgactaaagatgaaacacaacaaatttttccttttagttcgataaaaaataacacgaaaattgctaattaatggatgtggggggcgaatccttttaatttttctgaataattaacccccaccccctatagacacaaaattgtccaacctcctcgcctgatttgtgttcaattcattcaaaagctgacgagtcaatgcaataattttgcaaatttattttctgagtttgctttgtttccccctcccctcattctccgccccatttttctaatttcaaatgcaatgaattgacatcaaattccatttgcaatttatcttttaccaaatttcatttgacatttttaaagtatccaagtttttacctttcattaacaaatgcggtgactgactttctgcattttgacttttcaaatttaattttcaatttgaatttttgccgcgcttttcccccgaggggtgggccaacggataaacgtaggaacacctgctcattgggctttgctttttatgcctttttcaatgacttcttttcgtcctttctcttctccgccccatttttgcaatgaacggacacaagataatttgcaaaagtaaatgtttttcacatttctcccaattttcaattgaccgatggcttcagggggatttaaaaataaa

SEQ ID NO: 77412 - DNA, 854 bp, Heterodera glycines
  Genomic contig location: Contig_ID=SeqID_2031; Location=1618..2471; Strand=-
  SCN-specific regions: Sequence locations=1-216,238-737,759-854
atgtccttgcagtgcctaacacaggaagaagtgaacacaatttgcaaagacgtcctcgaaagtgagtgttgtgccaaactttgattttttatgtatgaaaaattgggcactcaaattctaaaggcaccaataatttcgttttttaactcctcactctcccttttagatctgatcggtgcctcaacctatcagcataccgaagcagtacgttttgcgcttaaaattgttttgtgattggtggtcgggcacagcctttgcgaggtgtacacaaaaatgaattgccatttgggctttttgtttttgccatgaaaattttgcgtcgcttactttcacaggtttatttatgttgtcctttttgctatttcccctcatttgggtgaaatccccctcatcaaagttcgtcaattattggacaggaaaaagaatagattggcaattcttttgagttttcgatgctaaattttctgaaaagatttcgatttgagcgttttcatttactagcaatgataaaactcgcaaaggctgattgtgagtctggcaatgagaatgtgccaaataatgggtgtaaagtcataaaagtccctgttatttcaggtaaaatggaaccaaagtgtcgttgaggcgagtttgtgttttctcggggggaggaactgaacttaacggacgcaaatttagaaaatcaccgccagattggtccagcttcaaaaaccctataaatattgcgtgagttttttggcttttaactgttttcaaattttgatattcatccattttcgtttaggtgtgtgtaattttgatgcaaacggtttgttttgttttaaatgaagaaccaaaaatctgttaatgccaataaa

SEQ ID NO: 77413 - DNA, 810 bp, Heterodera glycines
  misc_feature (783)..(783): n is a, c, g, or t
  Genomic contig location: Contig_ID=SeqID_2031; Location=1..810; Strand=-
  SCN-specific regions: Sequence locations=1-209,232-396,418-558,580-810
caatgcatttttagcgtttttgactcaaattacttgtcgcgcaaaatcacaagcacactcgatgcctgcattttggtggtaagtcggacaatgcgaaagggcgatggggactaaaaggtttttgaaaaagttgattgtttttggggcattgtttttggcttggctgttgaataacttaaccgcgggcctttcgggttcaaaaaaaaaattgttgctttttgttttgaagaggggttttagctaaaataaacagttaaaattgtcaattttcgttataattttttaccaaaattccagtcacaaatgtcgcagccgatgcatagcattggagcgctatgaggacggagtgcggtgagtttcgataggcaaatcaacttacgagttgacatcatacatgaaaaaaggagggggaaagggtcaatccgaatttttgccaagtgggtttagccatcggaaaattgtgttatttagaatcaccaaattgcaattttgggcttgtaatgaaagatggtccggcgctaccgagctatgacccccccccccctcttttttcatatatgcttgacatttttctgtattacttaatttgtgtaattcaacttttcagttgtgggcgttgccacgagggatcattgaggttgttttgtggtttaaaggagggaatcgtgttttttaatttaacaattaaatttccaggaaatcgacgatattcaggaagaccattctcagcgttccgcgtccgattcaccgcagcaaacgccgccgccgctttgttttgcaggngcacgagaacccattcggcgcatttcc

SEQ ID NO: 77414 - DNA, 288 bp, Heterodera glycines
  Genomic contig location: Contig_ID=SeqID_2032; Location=1401..1688; Strand=-
  SCN-specific regions: Sequence locations=1-288
caacagacgctgtggccgcagccacctcagtcgcctcgccaacagcaatttggcgcctatggaccacagcagcagcaaccgtttggtgcgccgccgatgcaaaatcctcctcgcacgcgagggcatgttcccactgctcctctcaacactttaaacgggacgcagcagcagacacggccacttcgcaacgtgagtttcggatgaattcctccattttcttgaatttccctttttcagacatgcccaaattgtcagaagcatatcgacccgtccaagtggcgcccgtga

SEQ ID NO: 77415 - DNA, 208 bp, Heterodera glycines
  Genomic contig location: Contig_ID=SeqID_2033; Location=1592..1799; Strand=+
  SCN-specific regions: Sequence locations=1-208
atgaggcttccatttggaggttacacattttttagccaaacatttgaacgtgagtaaatttctttatgctaaaattaagaaaaaaaactaaagtaaaataaataaaacggaaaatgattaaaaaaaagtcatcaaatcttttctccacagtttcagcattaataacggcctctgaataattgggaaagcacgataaatattccacaaa

SEQ ID NO: 77416 - DNA, 914 bp, Heterodera glycines
  Genomic contig location: Contig_ID=SeqID_13517; Location=1..914; Strand=-
  SCN-specific regions: Sequence locations=1-49,71-208,230-399,421 -433,456-752,774-785,809-914
  Gene Ontology: Mol. function=transporter activity; Cellular component= integral to membrane; Biological process=transport
atgtcactgctcctcgaataccccaatctgttgaatgagcaacagagtgccaagctgttcaatggtgctttcgtcctttcccaattcttcggcatttgtgccgttcttttcgtcgccgtttggatgggtggcgagggtggctttgcgtggcgaagtgacccggacaggtgattattggacggtggttcagcccttggcattttcgggccttcaggcagttccgttaccatccgacggtctctgctttttctccttagccgtctccaaccgcaataatctctccttcccgtcccttgctgcagttcatggccatgggcatacttttcctacagggcgaggccattctcgtctaccgcgtttttagaaatgaacgcaaacgcttcaccaaggtcggcttggccaaaaaattctgtgccaattgcaacgccaatgatggcattcccacccccctttttccattggacttgttaagctcctgcacatgagcatccattcggttgctctattattggctgttgtctctctaaaggcggtctgggactctcatggcaagtgaacgcattgacaaagtgccaaaacattagccatcggactcctaattactcctcatccctccgttagacttccatcgttcccccaacggcgagttacagccacagcccaatttgtactcgttgcacagttggttcggcatttcggccgtctccttttacttcattcaggtccacccctccccaccttttggtgtccaaattctcattttctcctttttcagttcatcatcggctttctcacctttctcttccccggcgcttcgctttccctgcgaaaatttgtgctgcctttccaccaactgttcggcctgatcatttttctttgctgtaccggtgccgctttccttggcatttcggagt

SEQ ID NO: 77417 - DNA, 1413 bp, Heterodera glycines
  Genomic contig location: Contig_ID=SeqID_13518; Location=217..1629; Strand=-
  SCN-specific regions: Sequence locations=1-29,53-162,193-945,967-1413
ctacaatacaaatggaacagcccaatcaggaaataaagacaaagcgaaacaaggagaagctggaacatgagggttcactttatgttcttcacaaactcagtgacgatggacttcggaagtattggcgatgcgagtttttcggagctaacgacaaatgcaaaggtaaatgcataaaataaaataaaaactatttttcaaatacagggcgccttcacactgacattaatggtaatgtcctcaaaataattggaagccacacatgcgacatgagcgccgcacatgtggagtgtcagcgacatataacccagctcaagcggcgtgcagttgagacgtgcgaagcgccggctacaatccgtgcgcaagtattgcagaacactgcaacccccgtgttggttccgaccaaagctgcgacaaaaaggtcaacgtttgcaaatttttatgccaaagtttgattttttcctttgatttaggttataaaacgtgttcgtcatgacgaagatgtaccacctgctgcaccactcagtttggacgcattggaattgccgccctcgtacagaatgtacaatcgaacagagaatgacgaggagaattttttgttggcagataccggcgtttttcaaattcagggacaggctggaccgcaaaggtgaaaaaataaaaaccattaaatttcacaaatttccatattaagaattttgatatttactcgttcttcgacttcggaatggagcggtattatgaaaaattgctgtccgtacaatgttgccactctgtcgtgtgcagttctgctttttccatttagtgggaaatatgaagaaacgaattgctgccgagggtttaactcaggtattgcatttttgtatttttccaatagaattgttcatattaagacttacaacaacaatgccgtctttgctgaaaagagcaaaatgatcacctctatggcttttcttcctgtccatcatctctctgctggcctcactgttttgcaggcacaacttcctcaacaacttatgggcgtcttcaattggtgaattttttgaaacgttaactcaatttttttaattacaccgggagaccgtggttcaacggtgctttgacagatcgaaaacttcaacgggcatttgattgtacccatcctactgtcttccacttcatcaacacaattcgatgtgagcaaaagtcaattgatgcagacatctcacgatgcatcgctggtgaagtccctcctctaaagaagcccaaatatcgtgccgccgatgaaagaattcttcgacttttgcagggctacaatgccatcaacaataacccggctatccaaaatgaccacaattaccatgccaatgtcaatgttaatcccgataacatcaatcatttgctcgttggtgtttctcgcaattatgaaatgcgccc

SEQ ID NO: 77418 - DNA, 803 bp, Heterodera glycines
  Genomic contig location: Contig_ID=SeqID_13519; Location=516..1318; Strand=-
  SCN-specific regions: Sequence locations=1-40,62-427,449-683,717-803
atgatcaatcgtggtgaagacattgacgaacggactgtccaaaaagcaggcgaaagaagcatcaaggcggaggtaaaatgcattatataaatttacgacctttttattgcttttcaaaaccgcttaaatcctcacaagttcccattcattttatgtactaattgattttttttacaggaaccgaaacggaaagccggacgcggtaattctccatttttgttgttttcagtgtttatagtgactgatgcttaattgtttatttgtgattcgtcaaatatgcccattttgaatttttggccttaaatttgggaattagagtccgtcagcgcctatataggccagaaaaaaaaatcgaactgggccaccacattcattcctatagagattcattcctatagagaaatctgtttttttttaatttacgcatttaatggtgtttatttttgttaggccacaagtccaaacaattttgtaaaataaacacttcatatatcaatttgcttggcagttgagcaacagtccccgatcaatttcgagctatcggcactgaaacgccgtgctgtcaccatcggcggcgaccacacgctgtcatcgaaattgccagacaacaacagccaagaagtgtcatcatcatcaaacatggatcatcccgcgtcgccttttctccgttatcaggggtaaacttgccaaaacaattgtcttttttaattcaaaacgattaaagctccttaacgacccatccgtacactgaaggcgtcacgtggacaatgttcaccgaccctcttgtcatcacggacgagcaa

SEQ ID NO: 77419 - DNA, 144 bp, Heterodera glycines
  Genomic contig location: Contig_ID=SeqID_13520; Location=2411..2554; Strand=+
  SCN-specific regions: Sequence locations=1-81,124-144
atgtcttttaaacgcgtgaactccttccaacccgacgtgccaatggccaaaaaatgggatttccgatcaatcgggtaagtgattttaataaataaataaaaaatatttctaaacaatataatacattatagatataccccttga

SEQ ID NO: 77420 - DNA, 389 bp, Heterodera glycines
  Genomic contig location: Contig_ID=SeqID_13520; Location=1220..1608; Strand=+
  SCN-specific regions: Sequence locations=1-231,255-389
aaaggttgcgggttggttgcgggtgtttcccgcacgagcccgtgcctatgggaggggtgcagccctttgaagttgccgccccatcaaaaatccacgatgggggggtgtttcaaaaccaaaacctattggaccactttgaagttgccgcctgaccaaatccgatttcccaaattgttgcgggtgtttttttcccgcgccgcgcagcgccgcgggaaggtcatcaatcatccacctgtcaccaaagtgacaggtggaggaaattcaatttaacttttgcaaattttaatcttttgtttcaaaaccttttagcgttttattttctcaatcctgaaattttttttatgatgattttttgatcctgaaattaaaaattctttttgaaaattagc

SEQ ID NO: 77421 - DNA, 780 bp, Heterodera glycines
  Genomic contig location: Contig_ID=SeqID_13521; Location=790..1569; Strand=+
  SCN-specific regions: Sequence locations=1-282,331-588,610-690,712-780
atggttgagatgggaaccgaaattcaaacatcccgaaatgaacttaaatcttttcaagaagaagtagataaagccaaaaacataacattggagcatgtggaaaagaatgacttgaaaaaagcaaagaaatcagccgacgtcgcaaagggaatcgccagacaggcaaagaccaaatatacatcaactctcgaggaatataatgataaatcggaaaagggttttagcgggatggtggttaggcttaacgaggcgctcggtgagcattttaaacataaggaaattgaaaataaagaagtttcagaagctgaaaaagggccgcaaaaaagagagagattagccaatgaggatgttcaatttaactacgacagtattgatcaaaaatttattgtctatctttcctctgccgtcacccatatagatttgtcaaaacacctcgcatatgttctggggtttaagaatacaaggctatttcacgcggaagaggcgacttatatgccggatttgacgggaggtgtaaggcagctatacatttatgcaccaaatttaatcgaaaacacaattatcggcaaccagatggccccactcttaagaatagttaacgtcgtcgatgacccgggatcaattagtgaagttatatatagcaccgagtattttcatcgtctacagtcgaaacgaatttcagaaattacaattgaaattcacacaccatttggtgaattcgttaaatttcactggggaagttgtattcttacattacattttaagaaaagtatattttaa

SEQ ID NO: 77422 - DNA, 334 bp, Heterodera glycines
  Genomic contig location: Contig_ID=SeqID_13522; Location=469..802; Strand=+
  SCN-specific regions: Sequence locations=1-334
atggcacagcaaatgggcgaagcgacaaattcgttggcattggcactgagcaaaggtgcgacgaagacaatgaagagggcattctgaaaaggaatgatgggaaatgccaaagcaagccacggactaccccaatgtagcagaagaagccaatggacatgatcacactcagttaaagcatcagacgccgtccattttcagacactgaacttgccgactcaattagtaccactaattacctaattagagactaattaggtgcagtgccccactcactctgcgctttgcgccaccaactgatcacccaaatcagcacatagcagcaaaactccccgaa

SEQ ID NO: 77423 - DNA, 887 bp, Heterodera glycines
  Genomic contig location: Contig_ID=SeqID_13523; Location=116..1002; Strand=-
  SCN-specific regions: Sequence locations=1-70,92-422,444-565,607 -708,732-887
atgcctaaagcagccaaatcaaacgctgtgttaaatcgtcactggatttcaaagttcccggaaggaacttattcaactgatggaaaaattaatccgggactttacaagttgattgatatcgccaaaattttgactggcggtcgggcgaaaattgataaagactgatattaaatatgattttttttttgcgtaaatacacttggtttttccaatttttagcacatatttttgcatttttaacacatatttaggccttttttttggtttttagcacatattttgggtttttttggcacatattttattacatatttcaggatttttagcacataaaaatcccagccctatttatgacacaaaactttaaaaaaaatttaaaaacctattttggcgttttgcccaaaattattaacaaaaaatgcaataaaaacgataaataaactcctaagaatcgaccagccaaaattcctgaaaatacacccctaaaaatcatatccctagtgatgcaaatttgttaagctaaaaaccttacagttttgaaacaattgccaccattgatgaagccaatatttattgaacaatatttttattgtagtttaattgatgttgtcacaatgctgaatgatatttgcaaattttggcaaaatgatcaaaataaatttttgtttaccagtgttatttgggagatggatttggtaaatgaagaggaattaaattatgaaattaaagagaacaaaagtggtgaaaatgcatcaacaaatggaacggaaacaaaaattgctaaacttcgaattgaatttgaacgaaaaatgaaaaatttttgcgaaaatgccaagcaaaatgccatggtagcaacggatcaattggaaaaggcagcaaaaatctga

SEQ ID NO: 77424 - DNA, 2076 bp, Heterodera glycines
  Genomic contig location: Contig_ID=SeqID_13525; Location=866..2941; Strand=-
  SCN-specific regions: Sequence locations=1-322,344-556,595-775,797 -1117,1144-1657,1679-2076
atgttaattgcttttatgaaatgtcatcaacaaacacaaattagtaaatattccacgcaaaaatatgaagcttaccttggcactgtgtattttatgggaaagaatttgcaatgtgccaaaatagggaagagatttgaacaatatgaacggacagaatgccaaaaatatcgcaaatatttggggattttgtacgaatatttgtttagagaattcgccggtcacaacacagtgaagccaaaattcatgcttaaaagataccaatttgaaatggaagaaccatcaattatttacgttttgcattcgttggccaaagttttgcgcttttatttaaatccatttattagcaatctttatcaatacaaattaaacaatttgttcagtaacaaacattttattaatgaatttgaaccaaaattgttgaacgcatttggtaatgataatgagcaggaagaaatgccaattaacgaacccattttaaagttggcaatttacacagcgaatgatggccaatcggatgaaattgtggaagaaattattaaccgaataatttttgatcgaaatttaaagaaaatgtttaaaaaggcggaacaaagggccaaagaaaacggtccatggagtgcaaatgaaataagtgaagacgcacataaaataatttggagatcaaaatttgatgactcattgatttgggtgagaagaaagcatttaatgatttgggtaatttaattaagtcaaatttagcaggatgacgatgacgtgttatttgcgggatttgtaaagggacagacaacaaattttggcaaattttatcgttgtcccgtcatcggctgctgctgagagagatgccaacttaaaccgggacaagggcagatgtaggcaaaaatttgaaaatgtttccgagaatttcagaactctgcggcgctcgaatgcacttccaagaaaacaatacaatcgaaaattgttttatttttcctacattttatgattccaatcaactgtgaacatcctcagattcttggaccataaccttttttgatgctcgaaaaagaacagattttggtatcaattcgaaaaaacgatgaaaatgaaaattatggtccaagaaagtgaggatgtttaaaagacaattgaatgggggagaggggataaagcatttaattggtcatcaaaatttgtgaattttcggccaccactgatcggatgtaatatggccacctttaagggagagaaattcagttgcattttctgtgttccgctttagggggggggggggggcacgaattacagtttttcgtatttttgattgtttttcatttgatttataaaaagttacttccatttggattttcaagtcaataaacatatgatttgaacgattttcggcacgggggaatccgaattaatgcgattagacgagcaaaaagtctacccatttcgggtccgattttgtagcgctaaaaaacgaatttttctgtcttggttgttcgaattcttcggaaattgggggggggggggtgacaccaaaatccataattagaaagagcaagacaatttcaaagtttattgcccgatacatcatatgtatatacaataattggtggctgatgacaatacacataaaacatacagacagtgaacaaaagtatggcaaaggggggacccttttgttttgcaaaattttctttgataaaaactcgtgaatatacttttattcgccataattgtgctgttaatgcttaatgttcatcattctgtatcaaaataaacaaaaaaaattttagaccaaaaaaagtgaaaaaaattttcaaaacagtagctttgcaactagcgccaaaaatgccaattttaaattctttttttcttttttcagctttatctccgccgagttggctttctgtgttcgatttttctgccgcctcgtcagcttggactcggaatttcgctgattagccaccgatttgacttttacgtcgacgaacatttcaaggaggaccgggttaaattggacaccagaaaattggacaccggaagactggacaccatcctaaaataaacccaggaattgagttgaaaaataaa

SEQ ID NO: 77425 - DNA, 79 bp, Heterodera glycines
  Genomic contig location: Contig_ID=SeqID_13526; Location=117..195; Strand=-
  SCN-specific regions: Sequence locations=1-79
atggacactgtcaattcgccgtcagtcagtgatcaacagctgaaaagcattggggagcaaaagcgcattgcacagcttg

SEQ ID NO: 77426 - DNA, 804 bp, Heterodera glycines
  Genomic contig location: Contig_ID=SeqID_13528; Location=1659..2462; Strand=+
  SCN-specific regions: Sequence locations=1-143,165-255,277-299,321 -583,606-608,674-804
  Gene Ontology: Mol. function=ligand-dependent nuclear receptor activity
atgaacatttattcggcccaaacttattacaacaacacatcgccagcagaagtgaaaaaggcaatccaaatggaattggattttgttcatcgccttttgctcggcatacaaaatgacaatttgtgggcaatcgaagcgaggcgaattcaaaattttgtaatttttgtgaaagcgccatattatccagttgcaaaaaagttattgccagatatgcacaaaaaagcgactttggaaaacttttacggacaagtttaatcttgattttcagtttggaaagagagaacatttagtggtatcgaatatatcaagattttcaaattgggttggttatgaaaaaatagacactgttaaagtcaaaatgggtcaaaatatgaagctaattttaaagcagaagtcaatcgaatcaatggaaaattggcagcagaacagaactcattatacggagataattgacgaaagctcagagcaacagaacaataattatggacaagggcgatcaaaacgccaattggcaaattgtaaaatatgcggacgacaatgtcagtacattttctacggtgtcaaaagctgtgaaagtgagcagatttgtttcaaaaatgagaaaatgcaataaaatttttaattaatttttttattgttatattaatttaccagattaaatattaattaaattggaattgtcggatattgtaaaatattctttttgaaattgcaggttgtaagcaattctttcgtcgtgtcgtcacaaaacaaattttgttcacttgtccaagacgaaatggagttggaagttgggacaattaa

SEQ ID NO: 77427 - DNA, 604 bp, Heterodera glycines
  Genomic contig location: Contig_ID=SeqID_13528; Location=2503..3106; Strand=-
  SCN-specific regions: Sequence locations=1-446,469-508,530-604
atggagtttggaaaacgtccttctacacatctttctaccctatcagacaacgcctcaaagaagcccacttcagactatcactacaccattctcaatgaccaacttgaggcgatttcccaacaaatggtcaacaactgtgccgattcgatcaccaaacaacttcttcaaatctgtgtggaccttgtgcagcaggttcagcaataccagtgcgtaattccggagccaatgacgactgggtcatctaagcgggaaacaagacaacgaacggcgccgcagtgtcgcggtgcaaagcatgccggaacggccggggacaaacatcggggcgagtcgccaccaaccggacttaactattgcatgtactcgacgagcttggcgccgagtgcccgatttctaattacagaattgggcctccataccaagctggacaaggccaccgcccgctatacggttattttttggaaaaaattcttcgtaaaaagtgaaataggcaataaattcaaataaatataattaactgatttttatagtaaaagtaaaaaaaaatccgttccgcttttttccataaaacaaaaattattgtgatttgcagtaccagcggtattag

SEQ ID NO: 77428 - DNA, 2075 bp, Heterodera glycines
  Genomic contig location: Contig_ID=SeqID_13530; Location=1..2075; Strand=-
  SCN-specific regions: Sequence locations=1-178,200-448,470-556,578 -954,984-1427,1470-1938,1961-1984,2006-2075
  Gene Ontology: Mol. function=nicotinic acetylcholine receptor -associated protein activity; Cellular component=integral to membrane; Biological process=synaptic transmission, cholinergic
aattttaatttgcttacgcaaaaattgaagtattggcaagacgaattccttcgctgggaaccgtcaaaattcggcgacatccgccagcttcacgttcccgccgaaatgatctggcggcccgatctgctcgtatacaacaagttcagcttcccctttcattggttgattgttaattgggtctttataaaattgctcagtcggatcggcatcaattcagaccgacgactgaccagattagcccattaactaatcaccttccatagggacccggttcaatccgagtccaatctaattcatagactaattgcccacttaccttggtgattactcgcattttggtttttttgaattgtaattctcacttgcacaaagtgccaacatgaacgtgcgcgagagtgagatgatgaccaatgcgctggtgcagcacgacggccgcgtgtcgcttttccgtgccattatcaccgacatcacttgccacctgaacttggtctgggtcaatcaccgccatatggtccggacaaacaaacccatctgtccttaagcatcggtttccatttgatcagcagatctgccatctgatgctggcctcgtggagttacgacggctctcaggtggagggggggggggggggaatgggcagggggtgacaggaccccgccgcaaaattggtcatggacaccatggaatataaaagacaccgatagataaatttagtattatgccaaaataatcagttcgttatgacaaaatctttaaaatttcttttattcacacgaaatttccaggccccttcaaatttttgtcaaaatttttcccgatttcatgatcattttttgaagtagacctgtccaggttgatgaaatgtcttttttgatcagcataaaaagttatgcaattgggaatttattaacattgaaaatgggtttttgagtaaaagtgtttcattggaaagcctaggaaaattaaaacaaatattttaacaatttaaagtcaaattgatcggtaacccaaatcaaaggaggggaatagcgaaaactgatcactcgcaggtgatgctccgcccggcggaggaggacccgggcctttggatgggcctcaatcggagcagcatgaacacatcggtggtcgagcggaagttcaacaaagtgcagcgcgcttcttcccccgccggcggaccaaaaagcacaaggcgaccgtcattcatgcaaagcacctcactgacccattacattccgaacatggaatggactctgatcgacttccggacacggtccaacctcaagtcaggcaaaaaagagcaatcgatgcttaattagttagcgataatttatttatgcaaaaaaaagaaaaaagtccacaaaagggagtaatccacttactctgcggacatgtcatagattaagtcgacctcgagtatcgttaaggagtttaattttagttttaaattgatttaaagaatttattttaatgatttctttatcaagttgattccacaattttgtagccctccccgcaaagggaataaattttttgcctaatttatattttgtgttaaacctataaaaggggacattaaagcgttcagaaggtttgaaaattttacaaatcttatcattttgattggaattgccacgttttgagatggtacgattgttgccccaacccttacccggacatttgctattacttctccatcaaacgaaacccttcctactacctgttcacgctgatcatgccgtcggcactgatcaccaccattacggtggtcggctttttcacgccccattcgaccactggagaaaatacggagaaggcatgccagaaagaattgtcagttgattaaattatttgagtttaggtcagtcttggagtgacgtcacttttgtcattggcactcattcgtaaatcactcggcaaaagggaaaatggcatttgaatacatcaaatttgatgaaatcaatcataattttgttaattgaattcaatgccattttcccacccattaaacccagtcatcaatcccttaaatggcattaagtggggatggtatcggacaaattgcccgccacttccaa

SEQ ID NO: 77429 - DNA, 920 bp, Heterodera glycines
  Genomic contig location: Contig_ID=SeqID_13531; Location=2..921; Strand=-
  SCN-specific regions: Sequence locations=1-127,149-538,560-618,668 -691,714-802,824-866,888-895,918-920
atggccctcgtgtcatttggctggtggaaatgggcgaaattgtgttgatgatcgtcctttggttgttcttctaccgtcgacttgtccctctgaaaatgccgccggcggacgacgcgttgacagaccgggagagcacagagtcagaggggagacaaagcaatcgttaacaggaaacgtcacttaataagagaaattctgatcatgttcgagacaaaaagattattgctcatttcgtctgttcatacagtgtcacaatcaaattgtaaaaatcggaaaaaacaaagaaaaatagttctattatttattccttcccttttgagtggaagttcgattgactttttcagaagaaaaccagaaaacatggctaaagtatggtttgcatagcattggtcagtctcgcgaagccaaactcattggcacgtttttaattttcatatttatttgcttgccaaccgcagagttaagcagttccccccccccccccccccagttcgccaactcggaaatggcattttttcaaatccattaacaagttttcttttattaattatttaaaaatgccaatagtttgagtgtgccatgacatttttggcaccgttgtgagaaagtggcggacggcacacaaaaaagggagggggacacagaacagacggtggagggcggggagggggtagaaccagaagacatttttcacagcaattcaaaaatattttcagtaataggtatgactggcatggtcactcttttttgggccggtcgagaaacggaggtcaaacaaataaattatttgttattgataagaaaaccattcatgagaactccaaaaatgcagtgcaataaactaaaatgccttcttaaaccccgctaaattaagatattttataaaccagtaatttataagcatatattttttaattaaa

SEQ ID NO: 77430 - DNA, 322 bp, Heterodera glycines
  Genomic contig location: Contig_ID=SeqID_13532; Location=1396..1717; Strand=-
  SCN-specific regions: Sequence locations=1-240,264-322
ccgaacattccgacgctggctccttcagtcgatgacggactgttcttccgcaatgggcgtggaacttccgcagacgataaccgagcgactgagcactctgaaggtgccgaaattggggacgaaatggaaaacagagacaaatcatagagcgatcgggtagtaattcgacattgcagaaggatgtgatcgatgctttgctggacaaaaacgcggtgccccccgacctgatcacttcgctgatggccggcgtcggcggctcggctttcagcaaagcgctcgaattggtaccgtcgtacaaccaaagctcgcagaagatggccaa

SEQ ID NO: 77431 - DNA, 1692 bp, Heterodera glycines
  Genomic contig location: Contig_ID=SeqID_13533; Location=462..2153; Strand=-
  SCN-specific regions: Sequence locations=1-147,185-302,324-340,363 -401,423-551,575-600,622-701,750-826,849-926,974-1061,1096-1252,1285 -1366,1389-1412,1469-1574,1597-1692
atgagtgttctaattgccagaattgctgagctgaatcgagctaacacaattgaaccatcaatcgcaagttctgctgatttgtttggacaagacggaaacggtaggaaattgaaggatacagtatcaaaattatactgttaaatagtcataaatatttttaaataaagcataaaatttttattaacgctttttaggtaaaaaaaaaacatgtaaaacttaaatatttcaattgtaacgaaattagttaaatattttaaagttttcgaataagaaaaatttttaaccaaaaatttttaccaagaaaaacctttggggtgaactttttaaagaatgtcaaaaacttaatattttaaaatattttcaggatcagatgataatgagtttcatctggacgacgaatgtgggcaaaagaaagaagaaagtgaaatgccaacaaacgaaggtaagcatcaaaccctgacaaaaatttggggcaactaagcacaaactttcgaatgataccaactggaaaactattttttcatgcttatttgttagttcctcgagagtcattcatttaaaataaataatttgactttttaagctgctgctgaggaacgattctcacaattacaaaatgatcagaagaaacttttggaaaaagtcaatgaattggaaaaaaagcaaaaagaacagtcaaaaggcgaggagaaattaaaacgaaaataaaatttgtcaatattaaataattatatttaaatttaaaaattgattcgatttttaagctactaagaatcaattgtcaaaaatgttggaaaaaataagtgaatttgagaagaagcaaaaacagcagtagaacaaaaacatgaacaacaaaggtgagtgaatgtaacgacgaagaaatttcaattttaaagaattttttagaggatattattatagtagtgaatttttatttaattaaattatccttttaaattttaaaattaatttagcaactttggaccaattatcaatggtgcaaattgatcaaatgactcgattggaaaacgtcaatgaattagagaaagtaaattaaggggtaaaaatatatttatttttatattttcattaattgggtatttatgcatttaatcaaaataattttgtttgaattttttaaggcacttttaaatttccgacaaaattattgggctaccaatgtttgttatggtaatctcaaaatcattggcgaaaaaaatttgactgtccatcataagggaaatgaatatggtatttttttataatttacttaatattatatttctctttaaaaggttgttgttccgtcttcgctaaatatccgattttcctcaacaataattcgtccgacattttttactatgaaatttcaattaaaaataagaaattgtaagatttttaaactttttcagtaaaatttaaaaatataattattattttaataattattcctttattatttatttttcagttgggtcgtctttggattcgccgtcaaacagcagacaaaattggaattgatgattaaaaagggcacttattatgcatatgactgttatggcgatatttggattaacgaagaagtaaaggaaagaaatgcccaatattcatacggtgctggtgataccgtaggaattggcttcaattcgtccaatcggcaaatctttttcaccaaaaatggacttcgtttgg

SEQ ID NO: 77432 - DNA, 708 bp, Heterodera glycines
  Genomic contig location: Contig_ID=SeqID_2035; Location =10210..10917; Strand=-
  SCN-specific regions: Sequence locations=1-339,364-571,599-662,691-708
atgctgtactgcgacaccgactccgtgtactttgtacgcgcgcggcgaccacccggcccgcaacagcaacaattcctacgctccgagggcgacgcgttcgggcagctgatgcgcgagtggcccggccggcgcattgtccaattcttcagcgccggccctaagaactacggtttccggcaccggtgcgccgcgagcggcggggacgaacgtgcggagcgcaaggtgcgcgggctggagctcacctgcaccgccagccaactgctcccgttcgagcgcatgcgtcagtgctcaacttcttcggccggtgagcacgagggggtgggtgggataacaatggaatgtgtgtgtgtgtgtgtgtgtatgctacccccgaacaggatgcctgacgcggagcagcgagtggccgtcccctgcacccgcttcgtgcgtacgaagcgtgccgaggtgttcacgcgccgcggcaccaagctgtaccagcccgtgtacaccaaagggctggtcgttgcgcttgacgcccgggaggctggcggcggcgccggaaatgcctacttcaccagaccgtttggctggtacgacgacgacgacgacgacgacgacgctgaccgtgacgatgctgaggaggaggaagccgaagatggggaactctcggacgaaagcgacactgatgatgatgatgatgatgatgttgattttttggtacttggataa

SEQ ID NO: 77433 - DNA, 2312 bp, Heterodera glycines
  Genomic contig location: Contig_ID=SeqID_2035; Location=4420..6731; Strand=-
  SCN-specific regions: Sequence locations=1-450,478-706,737-851,873 -1833,1855-2098,2126-2312
atgacgttgaagcacactgtacgcatgctactcatccccgaggatgtttatcgacgtctgatggacaaccccagtgcagcggcggcgacgtcttctaccacgtgcatgaacaagttgcccacgcccgcaactcccattgagcacacggcacgcaaaatggtggcggcatcgagcaagcacacgaacgacgacgaacgcctcatccactaccaacaggagttcaaacgctaccagaaattgctggaagaggaggcggaacgaccgctcaacgtacagctatcgcaacggacaacaaacgcactgcgtgacactgtgctgcagaaggcttcgccggcaacagcgacgccgccgccagctcgcccccaacggaccacacctctgtccagacgacggggcttacagcatcaaaaccaagcgccgagcgcgtcttcctcttcttcgacaaggccaacaaaaagtagcagcagcagcagtaacgagcaacaacaaccgctcccccagcagactgctgctccacaaaaaattggcgatctgcctaagcaagctgagccgcgtatacatgccgcgatggcgtacgcgcaacagaacccaggcttgcttggcgtcggcggtgaagacggtaagcaaattttgcaccttgcccagggcgcttatcgccccatccggggcagcaaccttgacacgctgctccgctaccactttgtgggtcgtcatcagcagcagcagcagccgcggtcctccactaccacccccaccgccagtgtcgctaaggcaccaccgggctacaaaaccttcgtcaacaatgcgcgtgacgatcttcaaatgtggcgtctgctgtttccggatgaaagggcggcggcggcgggcagtgattcagcgtcaacagtgggcggacaacctcggcgccaccaacctctgcgcggacaaaagaaaactggcgcgggccgcttttccctgagccgcctactacagcctaatcatcatgcacataaatcggttcaaaaaagtgcgacgagcaagaggaagcccaacactgtggagcattccactgccaaacgttttaagcctcaattatggtgattggaagcaacgccgtccgctcactgacggtggaaagtcttttggacccgatttacaaggacgaacggtcgccagcttgcttcaccagcgtagagcccctgctgcgggaggcgaagcgccggcacccggacgcccgtcttacgcgcgctgagatcagccgctacttggcgggccaacgtgtctacaccctgcaccgacaagtgcgacgacgcttccgccgtctgccgactctggcctccggtctacacaccgactggcaggccgacctggccgatttccaacgtctccgcgcgcaaaaccgcgggtacgcctacctgttggtgtgcatagacacgctgagcaggcaagtgtatgtgcagccggtcaagagcaagcgctcggacgacatgatcgcagcgctcaagcgcacctttgcccgctgtggctacacgccgtggcgtctgttgacggacaagggccgtgagttcaccgcctccgctgtccaacgctacttgcgcgacgaagcggaggtgcgtcaccactgcatggaaacatcgccactgtggcacgctgggatggcggagcgtgcaaaccgcagcatcaaagagcgcctgtaccgttacttcacgcaccgtggcacccaatgctggacgcgggtgatccaacgcattgtcagctccctgaacgcgtcgccgaacagcagcatctttggcatgcgccctaatgaagtgtgcttcgacaatgcggagtcgctgcgccagcggatcgccgaccgtgcggaggcggagcgcggtggacgtgcctctcaacatgcgcggttccgccccggtgaccatgtgcgtattgagcgtgcgaggggcgcctttcgcaaaggctacctgcctcggttcactgacgaggtgttcaccgtggatcgggtgtgcacaggcagacgacccatcacctacaagctacgggacatgaacggtgaacccatcaccggcttgttctacgccaacgacatgtgtctggtactggttgttccaccctcgctggacgacagcagcatcagaagcagaggcagcattgataagcgtaaaacgcggaagcgtctacctgatggcatcgacaacaacaacaacaacaaggtgtacgccattgaacgcattctggagcgacggtaccggaaggacggcaccgagtgctgcctcgtcaaatggaaaggctacagcacgcgtcacaacagctggattccggcccacacaatcatataa

SEQ ID NO: 77434 - DNA, 1219 bp, Heterodera glycines
  Genomic contig location: Contig_ID=SeqID_2035; Location=8118..9336; Strand=+
  SCN-specific regions: Sequence locations=1-115,137-218,240-254,279 -1219
atggattcattcggaactgtcgcctggattctgcgaccaacggctcagacgacaggcactgctgtgggctcaatggagtacgaagaggaggaaaacgggacaggaaagttggtccacagtgtcacagctactgtcaccacacctaccaccgccgagtttagactggaaaaagaagccccctcctccgagaaggacggtgctgaagagggcagcggcggccacggcacactgctgttcatcgaatccgatgatggggaggaggaggaggaggatgaggacattgaagacacccccgtcgccacagactccccctcggctgcgacggcaaccgttgtggatgactcctccgacactgttaaaggggtggagcagcagcgctccagtgagcacagcgacgtgacggacggagcgggcggtggcggtggaagcgaaggcgcaaaactgctcggcggaggagaggaagaggaggtaggtggaggccagctaattttctacctcccccccccccctactgtttgtagcctgttcgaatgccgctgctcaactacctgtgcgcgttcaacgactgttcaatgaaggagcttcaactcctcttccacagtgtccacgcgcgacagcgtatggtgtcgcacctgcaacaacactgccgacttcatactgcgcatctgaaaccggcggagcgtaacattgcgctccactgtcacgacctcagcgtgcaaaacgcgaaccggacgttcgcctgcggtggctatctggagcttaccgtaattcgatgactgtgtagaccaataatggtgcggccttctgtccaggttcgacaatacttcttcgccaaacacgggctaaagctgaagcacccgtacatgccgtgcatgatcgagttcgggggcggcacgcacgcctcctactatccgtaagcggggggtacgcaaaaatgggggaagtgagcgtaaacgccttcagcctggagctcgtccatgtcgtgctggagcgtacgaagcgcgccaaacaggagacggtgaagcaagaagagccataccgtcgtgaatccggcgacgtggctccgacaaagtcgatggcaatgccggaacgacattgttgccgctgttgctgtcgatgcgctaacaactagctttttgagagacatggtcattgtagatttgcgcgcgtgatcacgtgacttattgtgctgttatagtgtttgtgcacttttttttaa

SEQ ID NO: 77435 - DNA, 930 bp, Heterodera glycines
  Genomic contig location: Contig_ID=SeqID_13534; Location=1291..2220; Strand=+
  SCN-specific regions: Sequence locations=1-114,136-142,175-210,288 -408,433-753,797-817,856-930
atgaattcgtttaacacaacgatttttattaatgataatgtaaatttatttattgctaaaacattcagctccaaatattttatgataaataaattcctaatatcagaaccatgcaaattttttcttaaaccatttagtttccaaaatgcattttgttttttatcttcaaaaaaccgtggtaaggaggtggcacttttcattgatttaatatatttttattttgtttttttctctcaatattttcttttaactataaattattattttcattttattattttttctttctagtttaaagatttgatgaataattttgagggttaaattattttaattgttagatatgacgagactttttttaatggttaggaaaatagattttggtagtttttggcacatatcttggagatttttaagaaaattttttaaagattggccataaacgatcataaattttcctaaattctttcaattcggattaatcataaaagaaagtagttagagactccattttcaccggattacggtagccccccataggtgtgggaggggtgcatggccaactgagcgccagccatttgagcgccgccaagtgagcgcgggccatttgagcgccagacttttcagtactgaagccaaaacctattgcgcgacttttttttgaaacccaaacctattgcgcgacttttttcttgcaaacccaaacctattgcaggggggtgcgcgacttttttttggtgcgcgactttatgcaaattattttaattaaatttatttaattttaaattattttaaacgtcttaaaggtcaaagacgttgaatttaaattcatttaaaattctccaaaaattccccgcaccaagcggatccgaaccccaggggggcggccagactgacgcactaaccactcggccacattggcaatggata

SEQ ID NO: 77436 - DNA, 120 bp, Heterodera glycines
  Genomic contig location: Contig_ID=SeqID_13534; Location=2929..3048; Strand=+
  SCN-specific regions: Sequence locations=1-64,87-120
atggacagcgataacaaggaccgccgggcagtcgttggggttgtataaatagtcaaatatttccattaataataaaattaaataatgtgattaatgaatttacagatgtcatcacattaa

SEQ ID NO: 77437 - DNA, 1242 bp, Heterodera glycines
  misc_feature (16)..(16): n is a, c, g, or t
  Genomic contig location: Contig_ID=SeqID_13536; Location=88..1329; Strand=+
  SCN-specific regions: Sequence locations=1-174,196-342,374-496,553 -630,692-711,756-805,828-895,933-984,1034-1058,1083-1242
atgtattttagtccanccaccgcttttgtggccgaatctttgctgggccccgttggttataaattcttcgccggcacattcattatttcattttgtagcacttgctgttatgtgtcaatttttgtgatcattcgatgcaaaaatggcggtaaattttggcattcatttgtttggcattttattttgtgccaaaattcaattcaaaatatttttacagtaatccaacagacgaacacacgagttttacggtcaatggtcataattttgtcgattaacattggcggatatctgaccaatttggccatatatcagttgctgtatgcatttggctcacttttggggtattttaaattaattttaattttaaatttttcaaagttcttaaggcccccaattcgagcttggcaagttggttttatttctggcattctgttaaacgctgctgcgggatcaaatgcgattgttctttattttaacaggtcattatcattatcggattattatttttttttcatttaattaattttaatttattactttattaataattaacttttagcactgaatatcgccgcgtgttcaaaaaagaatttcgcattttattcaatcgtttttgcaacacaaatggtcatttttaataaataaaattttataaaaatattaatctatttgtatttaacttttaattttagcacttgttgttctactatcaaaaaatattgaatacaatttttttaaacaaatatttaaaatttgtttttagctgttcaaactattggcacaaatcaagtgcgaagtgccaacccaaacaataaaatgaacaaaatccgatcaagccaacagagaaatgttcatacgatcaatctgaatcgctaatgatacggaattttcgttgatatttttaacattttttatttaattgaaaaaataatggaatttgattggaattttgtattatgcaagataataattttgtaaaactagaaaaatttattttaaattaaattttaaaataattatttgttttaaaaatgcctcataaacattgctataaactgaaaaaagttaaaataatttgtattatgtttcaaaaaatttatggtcaaaaaggtttcaaaactcaactttttgtgagtacttttgaacataactttttttttgaaagttaattaattttttgaagaaaaaatgcatgccaatacaaagaacatttagcactaatgtagaaaagcctttcaaaaa

SEQ ID NO: 77438 - DNA, 1891 bp, Heterodera glycines
  misc_feature (311)..(311): n is a, c, g, or t
  Genomic contig location: Contig_ID=SeqID_13537; Location=10..1900; Strand=+
  SCN-specific regions: Sequence locations=1-69,91-243,265-499,521 -629,655-662,684-697,723-728,750-826,943-944,1000-1073,1098-1234,1256- 1324,1356-1478,1535-1612,1724-1847
atgccgcctaaaagaaaaacagtcattatcatcgaatgcgtttggaaagccgccaacacgggccgatttgcccattttcagcatggaggaagtgcgacgccatgggaaagacgctgacagaatttgggtcattttccaccaggtagaacaaatatcaattacaaaaaaagtagacacaaaaattatgtatagcaaattttttagggggtttacgatgtaacagaattcattgcaaatcatcccggtggcgacagaattctgctggcggcggggggctcaattgtaattcccatttgcgtatttaatccggnattagcattccggaaccttttttggacagtttatccctcacctaaaaagggacaaagggatgggaaattttgggagggaaatggcaaatttgaatcgtttaaagctttaaaaattccccaggaaatttgaacccccacaaaaaaggttcccccccatttcaatttcccaataaaaaaaaattttttaaggggggcccccccggggggggatcctttttttggtgcggcccccccccaaaaaaatccccccctttttggccccccacacggggaaaaaaccctttttttggcgggaaaaacccccccccccccgtgttgttttaaaaaaaaaatttttttttaacaccccccaaaaaaaaattttttttttttccaaaaaaaaaacacggggggggggcccccccgggggggagaaaattttttattggttgggggaaagggggggggggaaaaaaaaaaaaaaaaaattgggggggttccctccccccaaaaaaaaaaaaaaacccgcggtattgtttttttttttttttttttttttaaaaaaaaaaaaaaaaaaaaaaaaaacccccccccccccccccccccccccggggggggggggggggggggggggggggaaaaaaaaaaaaaatattttttttttttttttttttttttcttccccccccccccggggggggggggggggtttttgtggccgccccgtgtttaaatttttgggggcgcccccccctttttttagtggggggggcccccccggggttttttttttctttttttttttttcccccaagaaaaaaaaggggggaggatttttttccccctcttttttttttgtgattttttttgtggggcccaaaaattctttctaaaaaatattttttacagtaacccaacagacgaacacacgagttttacggtcattgatcatcattttgtccattaacattggcggatatctgaccaatttggccatatatcagttgctgtatgcatttggctcaattttggggtattttaaattaattttaattttaaatttttcaaatttcttaaggcccccaattcgagcttggcaagttggttttatttctggcattctgttaaacgctgctgcgggatcaaatgcgattgttctttattttaacaggtcattatctttatcggattattatttttttttcatttaattaattttaatttattactttattaataattaacttttagcactgaatatcgccgcgtgttcaaaaaagaatttcgcattttattcaatcgtttttgcaacacaaatggtcatttttaataaataaaattttataaaaatattaatctatttgtatttaacttttggaaaataaaacagtttttaaatatttttaaacaaattttaaattaaaaattttttagctgtccaaactattgacacaatccaagtgcgaagtgccaacacaaacaacaacatgaacaacatccgattaagccaacagatgaatgtgcattcgatcaatttgaatcgctattgaaatggacttatatatttttttattttcttttatagtttttttcttaaaaaa

SEQ ID NO: 77439 - DNA, 1223 bp, Heterodera glycines
  Genomic contig location: Contig_ID=SeqID_13539; Location=1686..2908; Strand=-
  SCN-specific regions: Sequence locations=1-60,82-109,131-179,209 -256,278-461,495-692,714-863,885-1223
agaagaaactcaattaggagaagacggttatgcattgtataaacgagcaaataatggagattttgaatacgttaaaggaattaaattaacaaatcaaaatattgcaccttataatccatatttgttattaagatttcaatcgcatattaatgtagaagtttgttctgaaattaatgcggtaaaatatatatataaatatatttataaaggctatgatgctgcaattgtccaatgtgtaaaagaggggccaaatggcgaacaaattcttttaaaatatgatgaagttggacaatatcttgaagcaagatatttgagtccggttgaagcgtgttatcgattatttaagtatgaattacaaggaaagtcgcataaaattgaacgtcttgatgttcatttggaaaatgaacaagtaatttattttgatgaaaatgctaacgatgataatttagaagaagcaatgcaaaaaagaagcaaattaattgcatattttgacttttttaaagactgtccaaatgcgcctaaatttaaatacgtagaaatgccaacttactgtacatttgacaataagaatagaaaatggaaatggccgagaaaaggaacacataaagtaattggaagaatttatacagtaaacccaaaaaataaagaattatattatcttcggtacatgttattgcataaacatgcaacaagttttgaggatttaaaaactgtaaatggtattaaatttaaaacttatgctgaagcatgtttagctatgggtttaacacgagatgatatggaatgggataagtgtttaaacgaagcaagtcaatttaaatttccaaagggattacgagcactttttgcaaatattcttattaattgcgaacccaaatatccaagtttattatgggagaagtataaagatgctttaagtaatgatcttaagaaattatatccagaaaatatagcttaccaaatagctttatctcttttaaatcaaaatctattaaaacaagaaaaaagcttggagtcttttagcgatatgcctaaaataaatgaaaactataataatttttcagaggatcatataatcaatcctaaagaagagcttaatttgactttaaataaatattcaattatgaatgaggaacaaaaaaatatttttgactatataaaagatacaattgaacatcctggagaaaataaaaaaaattgtttttacattgatggtccaggag

SEQ ID NO: 77440 - DNA, 752 bp, Heterodera glycines
  Genomic contig location: Contig_ID=SeqID_13540; Location=431..1182; Strand=+
  SCN-specific regions: Sequence locations=1-43,74-183,222-476,499 -610,632-752
atggctaatttcttcatcattccccgtcgaaaaacaattcaacttttattgtttattattttatttaaaataacgcttcaacaaggtgattaattttttgtttttggcattatcatttttatcatacgacattctgtaaaattctttcaaataaaacgccaaatttttgcttaaactttgacgaaatttttttaaataattttattgaaaataaaaaaaatccaaagaaaactaaagaaaaaaataaaatggtttttttaaagacaaattttcttttatttcaaaagtttatttgatttctattttagactcgctcattgaaactaaacaattggtagatcaagcaaaaagtttgtttaaccaaataaaaaagggaaactttggtgccaattcggccattgaatggatacagaaaaatgcgattggcattttgtgtaatagcgaatttgaatcaaaaatggatgaaagtttgaacaaattgcaaaacaaattctgtgattcattggaaaatggcaattatcaaaatttgaaagaaatgttacaaacgacaaaaattgaggaaaaaacatttgacaaaagccaaatggacaaagccatagcaaaagatcaaattaacaagggcaaaaacaagcaaatgtttaaacaactatttaacaattctagcaatctttttgaaattagtgaaaaaattttatgattttgctttctaatcagaggggtgaaaaaatcaaaaaaaaaatttctataactaa

SEQ ID NO: 77441 - DNA, 812 bp, Heterodera glycines
  Genomic contig location: Contig_ID=SeqID_13541; Location=17..828; Strand=+
  SCN-specific regions: Sequence locations=1-79,102-157,182-302,338 -474,499-812
atgaaatggatacagaaaaatgcgattggcattttgtgtaatagcgaattgaaatcaaaaatggatgaaagtttgaaaaaattgcaaaacaaattctgtgattcattggaaaatggcaattatcaaaatttgaaagaaatgttacaaacgacaaaaaatgaggagaaagcatttgacaaaaggcaaatggacaaagccatagcaaaagatcaaatgctcaatgacaacaataagcggatgtttaaaaaactatttaacaattctagcaacattcttgaaattcatgaagatttaattgaaggtaaataataattaaaattttaaatataaaaaaaatccaatttatcgtactcaattgtttcgtaaatcaaaattcgttgaatatttggcacaaagtgtcaattataagttaaaatttgaaaaattcaaatattacgcttaggtaaaatggctaaaaaattcaaagatgttcaaatttttcgttttcagcagaaaggcttgccgtgcgccaacaacaaatgccaaacggttttatgggcagaagaaaaaagcgtgcccgcgacagtgcaattaagggctgtgtcactgcagtgcttttaacattaatctctgctccatatttgggttattattctaacaaatatgccaacgagggcaatgtcatggttcaagtcaatagatgtaaaaagaggtttaatgtccgacattgttaccaagtccagcagtcggttgtcacgcagatttttgagtggacaattctattagccattggactaatctgtgcactgatattttgttcttgtgtccgttga

SEQ ID NO: 77442 - DNA, 4586 bp, Heterodera glycines; identical to SEQ ID NO: 13542
  misc_feature (4513)..(4513): n is a, c, g, or t
  misc_feature (4572)..(4572): n is a, c, g, or t
  misc_feature (4577)..(4577): n is a, c, g, or t
  Genomic contig location: Contig_ID=SeqID_13542; Location=1..4586; Strand=+
  SCN-specific regions: Sequence locations=1-41,687-1031,1116-1267,1367- 1414,1437-1516,1542-2003,2046-2683,2705-3409,3432-3459,3481-3534,3557- 3669,3691-3829,3851-4138,4160-4265,4288-4586

SEQ ID NO: 77443 - DNA, 413 bp, Heterodera glycines
  Genomic contig location: Contig_ID=SeqID_13544; Location=1..413; Strand=-
  SCN-specific regions: Sequence locations=1-39,61-413
gttattttgggcgccgaatatgtgccgaccaaacatcaaagagaattcctgcaaattgtcgggaggggtcccgacttgaccattatcagccgagtgtcttccaaagtttggctgggcttccaccgtttggccattgtccaggtgagtccaatccagggctgggcgtaactggatttccaattacggaaatccgtaatccgtaattacgcccagccctggtcccaattctcctcattttccgcggatagcccggcgactctccaagcgaacagcccatttgtgcggacggtctttcggtggtgtgcaacggcgaaatttacaaccatcggacgctgaaggacaattctctgctggacaattcgtccgttcggactgtcctctccccccccccccctgttgttcgagccaatttt

SEQ ID NO: 77444 - DNA, 194 bp, Heterodera glycines
  Genomic contig location: Contig_ID=SeqID_13546; Location=630..823; Strand=-
  SCN-specific regions: Sequence locations=1-130,153-194
ggccaaaatttgcacctcccattttacaacaaagacaaagcgttggaacaggacgagcaaacgcagaagacattcatggacagctgaacagaacggacgaaaattggcggaatgaaatttaaaagtcaaagcaatttttgttttattattttgtgttataattttggcccttttgagtaaaatgagataaaaaa

SEQ ID NO: 77445 - DNA, 2918 bp, Heterodera glycines
  Genomic contig location: Contig_ID=SeqID_13547; Location=1..2918; Strand=-
  SCN-specific regions: Sequence locations=1-1726,1750-1816,1838 -1846,1875-2918
  Gene Ontology: Mol. function=structural constituent of muscle; Cellular component=sarcomere; Biological process=striated muscle contraction
cgggccaattaatcacaccaaagcctgtgtccatgctctttcacttttggtgaaatgaatgcagcggtgcctgtgcttcaacatgcgggagtcgatgtgtatgcgggagtgccatctgaagaattaatcaagcgtcttcccaagcccctattgctgatactcgatgatctgatgctgtccgtcgacgagcgatacttgtcagatctgttcaccaaaaaggctcaccatcaccagtttgctgttgtgtttgtcactcaaaatttgtttgagcgcaagatcaaagtggcccgtctgtccgcccagtacctggtactgatgcgggccccaaattcactgctgtccatccgtaacattggcgttcaactttttccgcgtcagcttgacttctttcttgacgcctatcgaaaagcgaccgcccgtccctatggctatttgttgattgatatgcatgcatcgtcggacccatcattgaggctgcgaaccaacatatttaaggatgagcaggaggaagatgaagggacagttgtgttcattcctaaaaatggagcggcataagcagcagcagcaagtaaaggttggcgaactgataaaagagaatgcggattggctctgtgcattggccagaactcgctcagcgaacaaatgcaagaaaatgctacgaaaagcaaacactgagcaactgctagcgctagtggaaatttgtttgaacatagttgcttcccgcttccgtttgtcagctcgtcagaagagacgattgatgccccatgcggacactgtacgtcgggtgagcagagcgagaagtgagcggggcgccaggcgcgtgtttgttcagaaaggcgcaggatttggcggattgttcgctgcccttttaacacccattctaattgaagtggcaaaatctgttgtgtccaccaaaaatgcataaataccacacaccattgttgttttttcatgcattcaccattcattttatggcgaataaatttttacttgtcccacaagaaatttatcgtggtctcacctccatgtcggagacgggtgacatcaatttggatgctgttcggcacgatttgaaccgtgcccgggccgaacgaacacatccatctgcaaagaatgtccactacaaccaacagcttaggcgctatttgaaaatgagaagggagctcgcggacagaccggccaaagttgagctcaccaaaggaatcagtgtactgatgaggagaggtggtgaagatgaagatggtgaagttgtggacacaccaccgcggcctcccgctccaccacccccgccgcctgaaagacgcgcttggcgtggaccaagtcctccccctccacctccgccgcccgggagacgtcctcggcccccacccattcctcccgctcccccttctccaccagggagtcctccgcctcgtcctgaacgtcctcccagaccgagtagagcttctcggagaggtggtcgtctagagcaatgggagaaaaggcgatacgatatacatcgacggcgaccggttgtgcgggaccttcttgctgaagcagctgccgctcctttacccgaaagtgatacagatgatgagtatatgttggagagcgggttcgcgctgccagcgccatcacaatactatggcgatttgcctgtgctaccagacaacgcggacgaaattgaggagatggacaccgcacagcgcaggattgcaaccagaagaaaattaaaaaaggatgaagcagaagataatgatgatgatgatgctttgcatcacaaaaaatacaggatttatcagcgttcacctccacggctcccttccccatctcgagcgaaaccaaaaccaccaccacgccaaccgaccacaaagagagagcaacagaagccaaaaaagttggaactaaaaccaccaaaaattgagccaaaatttgaacccgattcacgaccatcgacatcaaaagtcgcgcctcggtcgaaaaaagagcctgaattcccgcttgacccacggccatccacatccaggcaagccggatacattcctcctccggcacccaaaattgtaccaaaacatgagccgacaaagagacccgtgccataccgtatcccgaaaagagaacccaaaattgttgaagaaacgccacagaggcaacagcaaccacttcctgctgctgtcgtcgaagaaatgcctcctgttcctccgcctaggagggggaccaaacgccgccaccccgtaaatggtgagaatgatggtgaggtgcgcataagaaaacgcgtgaggcaagcgaggagggtgcgagtacagtactcacccgagccgggtccatcaacatctgcacaaagtgatgaacaacaacaacatcgagaactgtttaccatcccgtcaaatcagctgaccatgaatcagcgggttgaacgactgtacatcaaatgcaaccgttatgcggatcgtatgggtgtccgtggcaatacaattaacaccgcaaacggcaaaccgttggcgcatagcaatttgcgaatggccatcaggtatataattgacaggagagcgggccgccctaccattaagccacctggagcggccatatttgaagagaggcttaggcaagatccaattttgtattcatggacggctcctccaaagaaaacagcacagagcacaaccaccaggacggcaccgaaaatcaagaaggaatttcgcccgaaaaagtggagttgatcaactccacgcttgacaagctgtacaacgacccatcctccccagcggcgttcgcaggtgttacagcgctgtggaaagaggcgcgaaaaaagttgaaaaatttacggaagagggatgtgcagcattatttggaggggcaccgcacctaactctgatgcgcccccgaagggtgcgctttccaagagccaaaactgttgcggctgggttcatgaccgatgt

SEQ ID NO: 77446 - DNA, 1678 bp, Heterodera glycines
  Genomic contig location: Contig_ID=SeqID_13548; Location=1114..2791; Strand=-
  SCN-specific regions: Sequence locations=1-257,280-602,629-758,821 -918,998-1151,1173-1678
  Gene Ontology: Mol. function=phosphatidylinositol 3-kinase, class I, regulator activity; Cellular component=integral to plasma membrane; Biological process=feeding behavior
atgccttcgaatggaaccgagacaatggcactcgataataacagcgacaaaatgggctttgaaattggccaaaatgtaacgcaaatccattccaacaatggcagcaaaaatttgagcagcggaattggacagcatttgctggaacaattcggaatgatcaatgtacttgaaaaagggcaaaaattggagggggggggcgggaaattcgtcgggatttccaaagtttgctttcttattttggcattttgcccaaactcctttatcataaaatttttagcagtttttaattgagcccggcgggatcgggactcccgcgagatttttacgagattcccggtcctgctcccagcaaatttcttgcttccgccgttcccgtaatattttttaccaagctctattttttaagatccaaaatttggaatcctcgccaaaattttgattgactaattaccataattagtaaatttatccaaataatccgtcttttcaggactgcgtgtttcggccaacctttgacaattatttgatgatctttgctttctgtgtgatcttctgtctttcggttgtaggaaattcaattgttgtggtcgtcattttacaggtaattaattaattagttaattatttatcattattaaattttgtatttcatctccctattttatcctttagcaacgttcaatgcgctccgtgacaaatttatatttgcttaatttggcactcagtgacctgttgctgagcgttgtttgtatgttgtcaattttttaaaattattttagacaatttaattaaattttattttaaaatttatttaatttttcttttaaggcatgcccccaactttggtcagttcgctcgtttactgctgggtttttggcgatttgttatgcaaattgctcgcttatttgcaacgttcgcttttttattttatataaaaaataaaaatcctttttaaaaattagcttaaataaatatatattaaatatattgttatttagctgtcgtcgtaaccgcttcagcttacacattggcagcaattgccttggaacgctattacgccatttgtaagccgttgcattcacgtgtttggcacacgcccacccatgccatgttcgtcatcagtttggtttggtaagtttttctttattagcattttataataattatttttacactttatattagagtagagcgggaccgggaattttgggcaaaaccgggaccttttcgggttgaaaaaccgggaatttttggctggtaaaccgggactagtcccggtccggccaaaaccgggacttaggtattcagttgtcccgtctttttcagtaccaggtctcgttcccgttctactctacatatataaatggatttatgtaaatcacgaaaaggggacataggggtattaggattaaacttaggtaattccatttttttctggccctctgatcgggagtttttttttagtccatcagaagctcttgccggggaacagtttaaacgtcgcacttctcattaggatagcacaatgaaaatgtccgtctaattaaggcttgtctccgtcattgccaatgtgttcatgctgtttatgtatgaggagcgcacttacaaccgaaacgggctgaattgtgcaccaaaatttgagccaatcgtccattttgggtatcaggtggcattttaa

SEQ ID NO: 77447 - DNA, 1761 bp, Heterodera glycines
  Genomic contig location: Contig_ID=SeqID_2037; Location=1..1761; Strand=-
  SCN-specific regions: Sequence locations=1-336,358-865,888-1065,1087 -1377,1399-1761
  Gene Ontology: Mol. function=protein tyrosine kinase activity; Cellular component=membrane; Biological process=protein amino acid phosphorylation
cgccggccaaaggaaattccggcactttttgtccccggcggacgacgcgaaaggtcgaaaaatgaattaacattatcttattaacaatttagcagtttctgtttatacaatccctttattaatccaatggatgctaatccctcgtaaattttagttctgtttttttcgtccccattaaattttaatcttatccaacggaaggtccgctgaacctcgagactcccggcaaagtgatttttgatttgttattgtgccaatttattgtccgctgaaagttccgccccgggccaaaggattaagctgatttaggagaaggagccgagcgggggacggtcctttctgttgctgctgtttgttccattcaattagcgcttttcggattagcttctgaattggaccgctaatctctccagccttcgctttccatttgggcttagtgattggatttgtgtggaatttggcatttgggtcgcgcggtttatcccccaccccctcagcggcagtcctttcaaattccaatcattcccacccccacagtcggcacaaggaccacttaaataaagaggctttcattttggactataaaacattactcccggtgccaacccaatcattttaagtcactattttttgccaaactgaatgaaatcggaaatggttatgtttccgggagcggaaccgtcacttctctgccgggaccacccgaaggcgaattgtgccgactttgagccttctccgctggcattcctccgttccaaattcacaaaggtccttcggttgggtccctttgcgaattcgtcccaaatccgcgctttcttcgcctaatttcaccccgctcgttcgcctcactttatgtcctttcaggctcccactctccagtgcacttcctccgaggagggcaccgactcgccgctgttctcccgtacgacgagtgcccaatcgctgcccgcccccacaacggaccaatcgcagtcgctgtacgaacggacgctgtatcagctgaccaatgacccgcacttccaaaaagtgccattggcaaatgaaacacagcgagcgattaattaatgaaaggattttgaaggaaatcgccctgggcaaacgaatcggattttaccgattgggcaaagaattgggcgcgggaaacttctcaaaagtgaagttgggcgtacacgttttgaccaaaggtacggacgaagggaaggccaatcaaacgaactgagaagagaaagcaaattcagaaaaagtggccataaaagtgatggagaaaagcaaattggaccaaaaggcattggtaaaaagggaaaagggggaggaaaagccaaaggaaaagcggaggaataaataattcagagactgctgacacgcgaaatggaaaacatggaattaatgtgaggaaatcggcggaaaagcgaataaaaaaacacttttgaaggcaccacccgaacataattcgactcttcgaagtggtcacgacactgtccaaagtgatcaggggagggaatacacaagaatggaatgaaaggacacttttgaagacgtatttggtgatggaatacgccggagggggcgaactgtacacttatgtgcacgagacgggaaagctgacggaggaggtggccaagccgatattcggtcggttgggtgcacattttgggaaggcattcattcattcggccattgcagcacaaattgtttctgcggtggcccatttgcacggaaagggcatttgccacagggacataaaaggtggggggggggggg

SEQ ID NO: 77448 - DNA, 415 bp, Heterodera glycines
  Genomic contig location: Contig_ID=SeqID_2037; Location=5038..5452; Strand=-
  SCN-specific regions: Sequence locations=1-415
aagcagcgcaaatggcacagcacggaatgaaaaagaagacgactttacctgcgggggcaaaacaaaaatcaatgaagcgggcgcaaaagggggcaccgacaagaggacccaaaaaggcaccttacattgggaaaacatgaaaatttgatttaatttagggctttaaatcaattgctccaccaaaaaaggcatcggctgtcaaacaagcgaaggtaaatacggaagtcagtcggatgatcaacgagaagaacgaagaaatggtcagagaaagggccgacagagacgtcggaaaaacgacgaagcaaacaaaaaacacttgactatttttgattttgtgatgttacgggaagatttatgacaattggtacacaatttttttttgttttagtgtattaattatgcatttaatatgaaa

SEQ ID NO: 77449 - DNA, 1409 bp, Heterodera glycines
  Genomic contig location: Contig_ID=SeqID_2037; Location=3505..4913; Strand=-
  SCN-specific regions: Sequence locations=1-362,384-607,636-879,902 -1409
  Gene Ontology: Mol. function=UDP-N-acetylglucosamine transporter activity; Cellular component=membrane; Biological process=UDP-N -acetylglucosamine transport
gccgtttcctctgctaaatcttcctccgccctcaaatgggtttcactgattgtgctcattggtcaaacgacagcgctcgtgctgactttgcgttattcgcagacccaaaaatcgcatccctccgacgggcccaaatatttgtcgtcgactgccgttttgatggccgaaatagtcaagtttttcacatgtgtctccgtcttagggtatcagaacaaatggaattttggccgtttgttgcacgattttgacgggagagattcgctgaaagtcggcgtgccagcgttactttatgtgaacggttgcgcctttcgtccattgtcagccgttccctccttttcaggttgtccaaaacaatttgctgtttttggccctttccaaattggacgccgccacttaccaagtcaaaagtgatgcgtttggcgaaccgttctcccatttatttaggtcacttaccaattgaaaattctgaccacggcctttttctccgttacgatgttaaacaaaaagttggacctaatcaaatggatgtctctcattttgcttacttttggcgttgcgcttgtccaggtgagtcggaatgttcacgggcatttcgctaacggaaatgccaactctttatttttatttatttgagtcgatcattgctaaatttcatttgaaattaaagctcccaaaaagtgccgaaagtccgtccctcgctgtcgatgaaaaggcatttggggctgacaatccgccgcaaaaatcgaccggcgatggattcgtcggacttttcgccattttggccgcctgttgctcaagcggatttgccggcgtttatttggagaaaatcctaaagacttcgcaagtccaactttgggttcgcaatttgcagcttggtccgtcctcttcccaatttcccttttcactttccaatttcagcgttcttcagcatttttggtgcctttgcaatgactttgctttacgactgggctcagcttcagcagtggggctttttccacggatacaattgggcatgacttatgtttttcgtgttttcgtaattttgccaaacattcagataatttggacggttattgcactgcaggtatacggtgggtttggttacggtgtttgcctttgcttttgtaggcttacggtgggcttgtgattgcgcttgtcgtcaaatacgcggacaacattctgaaggtgtccctccccatttctgttgcctttcatttgcacttcctttccgatttctccagggtttcgccgtctctctgtccattcttttgagcagtttcgtctcgtgggcgtttctggcagacttcgttccttcgctcactttcactttgggtgcttccattgtcattttgtccacttttctttatggttacgagccaaaacgattggtacaaccggcggaaaggtcg

SEQ ID NO: 77450 - DNA, 1055 bp, Heterodera glycines
  Genomic contig location: Contig_ID=SeqID_2038; Location=83..1137; Strand=-
  SCN-specific regions: Sequence locations=1-491,514-526,548-575,597 -981,1004-1055
  Gene Ontology: Cellular component=TRAPP; Biological process =intracellular protein transport
atgatgagaagcagtgccgtgcgaacagttggcattttggacaaatcattgagcaaagggaaacatgaggtgggttggtcgttgcgatgccgtgtcactctgtgcgggtgactcggaaaagttggaattagggacattggattcggaaggggcaatttggcgacgcatatttgcgattgaacaaaaacaataacgctttaattgttacaaaagtttggctgcgccctgttgatttttagtgtttgatttaccaccaataaaacaaattcaatgcgtactcattttttgtaattgtcagataaatctttccacattcgctttgctttttgtcgaaatggttcgctacgctcagaataaagtgaccacaattcaaggactccaggaaaggttaaataaaaataatcttttgcactttaattttatccgttaactttcatagattgactggatacggaaagtttgtcggtgtccgacttttggatcttatcgcaatcagagaggcaaagagcaaaacaaacggattatgtaaatacatttgttacagaaagggtacaaaagagatgttaaactgctgcacattttgatgttcttgaaaggccctgtctggaagaaccttttcgggcaggaggcggacaaattggagaggagcaacgaggacccgaagaaatgttgtgaaaatgatatgggaacaacaacacaattgcaacttattttgcagattttctgatcgaaaaagaaccgattgtgaacacattcatttcactgcccaaggacaaaggctctttgaattgcgctgctttcattgctggaattattgaagcatttttgactgtaaaagaaacaaaaaatttaaaaatgaaccttcgtattttactttttaggagagcaatttcccgtgcaaagtcactgcccattggcacatgggcaccgcttatatgatcgaatttgaggaggaagtgattttacgggaaaaaatggaggccagcagatgaatagactctcatttttttgtgtatttgagcagttttttgtttttgttttattgtacaattaaa

SEQ ID NO: 77451 - DNA, 918 bp, Heterodera glycines
  Genomic contig location: Contig_ID=SeqID_2038; Location=1418..2335; Strand=-
  SCN-specific regions: Sequence locations=1-374,396-400,423-479,502-918
  Gene Ontology: Mol. function=sulfotransferase activity; Cellular component=integral to plasma membrane; Biological process=heparan sulfate proteoglycan biosynthesis, enzymatic modification
atgaaaaagaagaattgtcaatgtcggcaactgattgggcgcatttggctgttttcgcgctattcgaccggttgggcgtgcaatttgcacgccgattacaccgaattggtcgcttcgaattgtgtcagcaacaaactgagtgcgatagaaggtaagcaaatgcactgcagcacaacgacatgcgttttttaggaagtcgccataaacgtcgtttttttctgaccacttttttgcgcaatccgatcgaccgtttcatttctgaatttactcacgtgtccgagcggggtgcgacttggggacgagctcggcttttctgtcggggtcggtcaccgacgccggaggaattgccggcgtgttttgacccgaaagtcggatggagaaacatttcactggacgagtttgaatttgttaaattaataattctgatatttcttttaaaggttcctctcatgcccatataatttggcgtttaatcggtgctttcctttttcttattcgggtaattcgatgattcttaggcaaacacgaatgttatctgacttgaatctcataaattgctacaattcatcttcgatggattcgactgttcgggatcgcattatgctcgagagtgccaagttcaatttgcgtcattttgctttcttcggtcttaaggaaaatatgacggaaagtcaatttctctttgagaaaactttcggactaacgtgagaagaacaaattgcgattcatttatgtcttcttcagttttgacagtgacctggccttgtggaacagaagcaaatccgcccatgtaattcccaccgaccgacaattgggacaaattcggcaaaggaatttattggatttggagctctacgcgtttgctcgccgtgtttttaaacttcgcctttcaaaaaccaaaaaactgcggtaatccga

SEQ ID NO: 77452 - DNA, 159 bp, Heterodera glycines
  Genomic contig location: Contig_ID=SeqID_2039; Location=832..990; Strand=+
  SCN-specific regions: Sequence locations=1-159
atgaagagcccaaccaatgagccggtgctcgaatatcgcaagggaagcgcggaaagcgacgctttggagaaggaactgcagaaactgtgggcagagcccatggaagtgccgttggccattggcggggagaagacatttcgcaaggaaaaagcaattagc

SEQ ID NO: 77453 - DNA, 2013 bp, Heterodera glycines; identical to SEQ ID NO: 2040
  Genomic contig location: Contig_ID=SeqID_2040; Location=1..2013; Strand=+
  SCN-specific regions: Sequence locations=1-350,372-820,843-928,951 -1056,1079-1162,1202-1266,1288-1378,1401-2013
  Gene Ontology: Mol. function=gamma DNA-directed DNA polymerase activity; Cellular component=mitochondrion; Biological process=DNA dependent DNA replication

SEQ ID NO: 77454 - DNA, 1999 bp, Heterodera glycines
  Genomic contig location: Contig_ID=SeqID_13550; Location=311..2309; Strand=-
  SCN-specific regions: Sequence locations=1-144,166-244,269-349,371 -382,413-597,621-726,748-778,819-1138,1172-1287,1311-1366,1388 -1494,1516-1999
gaactgaaagacgaaattgcgatcaagtcgagagcgcgtgaaaatctgatgttcgccgtggaggaaaagccgaaggaggaacggataaagctgtcccagcaaaaggacgagctaatcctcaagtgctccttcaatcagtatgactgtgacatacaaaagtaaatgatgatcaaccgtagtaccaatagtacggtatctgtatccacctatttgacagggattttaaactgtattacgacccgacgtatggcaattgctacacattcaactgggaccgggatgctatggtgacggcacatcgcgccggtgccaactatggtgagcacggttgaggaagagggatcataatcatcattaatgatcagggaaaatttaagaaaaatttatgataaaagtatgataataataaatagatatttactgtgagactgatcggaaaattaagctaagcaatcgccgatcagtagtgttagagaagcaataatcgggcagattgaagtgatcagaataatctatagtagacaaatattgtctattggagtgcactgggatgtaatcaatcacatagtgatcaggatgggaaaaagtgatcaattttgttgattataatggagaaggggaagtaatctatagccgttctattcgggggatcataagaaatatgcacaatacccatttgtaccaaaatattataatgtgagtttttggacaaaaaattcttagaaaaaagtgaatttgaatgaacaaggctataaaaaaaggcctaaatataagtagcttaaaataatgtttaatattttttaaaaattaatttttaacatctcttttttgagaaaaatttttcaaaaaatcccaaaaacaaaatgtttttcttactatttagagcatagagagagaatcaaggaaaattttcccttctgatggtattaatggccctattaaatcccttcatttaatgtcaatcggaaaatccttttcaggcttacgagtgatgctatatgccaacgtgtcagagtatttgccaacctcggaagcagttggcttccggataactgtgcacgacaagtggacagtgccatttgcggatgcatttggctacaatgcaccgacggggttcatgtaagcattaaaattttcgtggaaaaattttatttttggctttaaggtcttcatttggagtgcgaatggtaaggggtgcgtttgattcacccaacattttcatcgaaaattttttccaaaaaattggaattgactttttgaaaaaatctttataattgtgaaaattgcttttttaaaaatttaaaaaaaaactttttgaatttcttggtgggaacctgcagctcttactgtgtaaaatatgtggatttctaggaaatttccaatttttagctaaatgttattttcacattattttttgacacgctaaaacaaaaaaggaattttttgccgtagaaaaaattttttcgcctcgagccaccgtatgggcactgcagcgaggggggcgagaactccgagtcgtacatctacaaggggtatagctactcaatcgaaggctgccatcggagttgcacccaaaatgaggtaagtgatcaacataaattgatcaattggagaatggtaaataatctcccttctgtccccttctaaaggtgatcaggatttgtgggtgtgccgacccgctctacccggtgccggaaaatgcacgatcatgtaaaggttggttgctgtactgtactgtattagaggaatgctcgaacattaaatctttttgagaccgagatccaaaatcacaaaaatatacgaaattctcgactttagactctcgaataattatatttagacttccaatgtgatcagatttttgtgagctttttgtatggcaagcaatttaagtgagtgatccagtggcacgcgattgcatcaaaaacacctcgcgaatgcttggcgatctgatcgcaactggagcattgcgcaactgcaaatgccaccaaccgtgcag

SEQ ID NO: 77455 - DNA, 1264 bp, Heterodera glycines
  Genomic contig location: Contig_ID=SeqID_13552; Location=459..1722; Strand=+
  SCN-specific regions: Sequence locations=1-94,118-336,358-414,459 -662,686-1097,1120-1146,1168-1168,1198-1199,1225-1264
atgatcagtgacgaactgaacagtgacgaaacgatcagtgacgaaatgatcggccaccagtatttcatgtcttcgtgatttcatgttttcttgcttgaatattttattttatttttcataatgccattaattttgtaatttgttaatcaactatccatccatttttaggtatactgatcattactttctctcggcacttctttattccattttccttggaccttttgcggttgatcgcgtctatttttcttcgaagcttcacttcaaaatattggtggaatatttcggtgggaacgaaatcggaggaagcggatggaaacggcagcgcattaagcgcattttgattttattaagtattatcggcacttctacggccgctttcaagttgggtggtgggagtggatctgtggtgagttaaatatcattattaaaataaaattcaacaaaaaatatttattggcactttttcgtacaatcagccgtccgagcgtccgggagatgaaaacccccgccgccggcacgataatcgcctccgttagagcgcacaaaagaagtgatcactaaaggaacggctgtccgcaaaaagatgaataccttttaggttgttttgtatgtattagtgtgtgtatttattgtattgtgcgtgtaatatgttttgatagattatatacatatgaatatgtaactgttcgtcttaaatatatgagtaagaaatgtattgttccattttttgaatttgccttcgtatttggggcacgactttttcgactatctagttttataactgattattagggacgtgaattttaggttttaactattttttttgctcaattgatttgaagaaaggagctcaaaaaacgcatttccgcataaaaatttttcgattctgatgtcattatcggtcactagaaatcactattttggcgacttcgtcactaaaatagttaaaaatcactattttggcgttttgtcactattttttcactattttgtcatttttgggcaaaattccttaacaaaaatgcaataaaaccaaaaaatacacccctaagaatcgagctaaaatttttcaaaaaaatacacccctaagaatcgagctaaaatttttcaaaatatactcctatgaaatcaaaaaaaaattttctcaaaaatttactttcttggcaaaaatttttaatttaaaaaatttttttaggtaactattttgggttttttggtcttaaaaatcccagtccaactcatttgcaactgcaaatagtga

SEQ ID NO: 77456 - DNA, 886 bp, Heterodera glycines
  Genomic contig location: Contig_ID=SeqID_13553; Location=557..1442; Strand=-
  SCN-specific regions: Sequence locations=1-13,40-108,235-489,511 -650,673-886
atgaaattgtgtctatttttatttttatttatgtttttaattgttgaaattgcaaaagttggatcagaagagaaaaagctgcaacaaaagtcatttgatgaaatatttggagaaaaatgggaagaaaaagaagaaaaacaacgaaatgagcagaaaaaaagagaaataatcagaaaatattataaaataaaagaaaaaattaagcaaaaaggaagaaaatatccaaaaaaagaatggcataaaattgatcagaaaatagcgaaaaaattggggacaaatagtaattatattcaaaaatggattaaagaatttggtgttcaaaaaaataaatgtcataaatcaaaaactgatgaagaaaaaattgaaattattcaaaaattcattaaaatgacaaatgaatataaacaaaaaagaaaatattcgttaaaagaatggaaacaaaattatgccgaaatttgcaagaaaatcggagtaagccaattcgcaattggtaaatggaagaaaaaatttggcattcgctgtagaataacggagaaagaaaaaatggaaaaaatgaaaaaatattggaaaataaaaagtgaaaatccaaaaatgagtgacaaagaaactgcaaaaatattgcaaattgatagaacgaccatttcaaaatggaagaaacagcttggaggagagattttggaggatttaaataaattttcaaacaagaaaattatttacgacataaaaactgattaattcttatattttatcgaaccattgtcaaaataactggcatataatccgtttatttttctcaattggatacgctgaatttgcttctattgtaaataatttttcttagtaacgaaccatcattgttatgatttccgactgtccatataataaa

SEQ ID NO: 77457 - DNA, 639 bp, Heterodera glycines
  Genomic contig location: Contig_ID=SeqID_13553; Location=2981..3619; Strand=+
  SCN-specific regions: Sequence locations=1-124,146-176,198-418,442 -454,482-513,536-639
atggaaataaaaaaggaagagaaagagaaaatgggaaagggtacgaaatttaaaagtgagagaaaaataaaatgggaagaagtgtccaacacattccgatcggatcaaaaattcgcctccctggtcccggagagtccgcagggaaatccccgatcattcaacggcgcatccagcggcgcctccaattctttttcttttggctgggacggcggcttggtggcggaggatggtcccgagcgcctcccccaaaacggtcttcatcatccgacgacagttctcgaggagtcccgtcgttggcgttgaacaccaaaaagcccttgcccgtgattcccggccctctgtggagggcgctcactcctttctttcctctgtcattctcgtcgctaatttttttgcgacagggacggccttcgaagaatccctccctccctcccgaggccccccgcacccgaaattttttaaggaaaaaagtttttccttgctggtacccccccccccccagacctagcctcacccaaattttccaaaacttttgctaaattttcaaaaaaccgacaattttttgatgaaaatctgctaaaaatggctcaaaagcgcgaaatttgtcacttttttggacaaaattcgttaacaaatcaa

SEQ ID NO: 77458 - DNA, 1254 bp, Heterodera glycines
  Genomic contig location: Contig_ID=SeqID_13554; Location=2214..3467; Strand=-
  SCN-specific regions: Sequence locations=1-410,432-503,525-976,1006 -1254
agtgaaaacgaaatgggacacgaaggtcaaaaagcaaaaacgggaattgaaaaatgtcatcgagaaacacaaaaatgtattttcgacccaccattatgacctcggggattgtaaaggaaaagcacctcctatcttgaccacctctgatgtacctgctaaaacgaaaccgtacccagtgccagagaaatatgaacgagaattaaaatcacagatcgaaaaaatgctgaaagcgggcgttataactgaaagctttaccccttgggcccataatgttgttttggtaaaaaaatcaaatggccaattacgtccttgcgttgattttcgaccattaaacaaaatcacgattcccgacccatatccaataccgagaatggataagacaattttacgggtcgctggtcaaacattttattcaaccttggatttggcctccggattttggcagattccattggattccgaaagttcttataaatgtggcattgttaccccttggggactttatcaaatggtaaaattgccattcggactgagaaatgcgccaagcatttttcagaggaccatggacaaagctttggagggtattcggaatgtaaccgtatacattgatgacattttggtccatacaaatacggaagaggagcatttggagactttggaaagagtattttgccgattgaatgaattcggattaaaattaaaaagagagaaatgcgaatttttgaaaaatgaatgcacatatttgggccatattttaaatgggaagggctatcggccctcattgaataatcaggaagtgattgaaggattcccagagccgaaaaatgctagggaagtaaaaagatttttgggtatgatgtctttcttccgtaaatttatccaaaattttgcggaaattgcaaatccgttacaacagttaacgaggggaaaaatccctgaatttgtatggggaaatcgcgaaaaagaggcatttgagaaattaaaaaataatttactgaatgcccaatgcctaagggcgccgaattacgaattgcctttttatcttttcaccgatgcgtctgctattgcctatgcgtgagcgcttatgcagagccaaaatggcaatgatttatactctgtcggttattggtcccgaactttgtctaccacagaatcaaacttccgcccacacacggggaattagcggcaatagtacatgccgtacaaaatttcagaccaattatttagtggcagatgcattatcgagagttgcaa

SEQ ID NO: 77459 - DNA, 1493 bp, Heterodera glycines
  Genomic contig location: Contig_ID=SeqID_13554; Location=670..2162; Strand=+
  SCN-specific regions: Sequence locations=1-87,109-140,162-297,334 -356,380-397,434-487,551-572,601-745,768-948,976-1152,1174-1493
atgaatggcgaagagtgggtgatcttggtgcgatatatctgcgacaattgccgccggtttccgaatatgatggtcagcgtactttttggagaatttggaaaagtcatgaggtaagtattttccgaaatttaggtaccaaaccccctccttacccctccttgggtcatggcaactcgtacaaaaggcaactcgtacaaaggcaactcgttcaaaaaaaagtctaagaattttcaaataaaacttagaattttttcattaaaaaaattaaatggatgttctagaaactttttaaaacacttaaattttcaaaaaatttaagaaaattaaaaaaatcagctgaaaaattagtaaaaaactttaaagaattttttaaaggtttttctaggctagaaaatccatttaaattttttttttatctaaattgtaaattttagttgaaaattctagaaatttttttgtacgaattgcctttgtacgagttgcatattcgctttctctttcctcgcctccactctctctcccgctctcttcctctcgctctcacatctctgcgaaatttaccatcaccttctaacgatgacgatgatgatgacgataacggtctctggtttggctcgatgcccacacaaaacagtgttgcggaaacaccaccttgcaaacctgctacttcttttactaaactatgcattgttgtacataaaatttgcaacttgtcacgcattcattattttaaattttaatcttccatttgttatttatgcattttaaaaaagtgcagttccgtataatcatgcctttataaagccaaaatcatgtacaatagcattcatccccacaaccctcttagttacaataggacgataacgtttcgacaactttacagaaataaccgtcccgtccttaatgttgggcctcaggaaattggggtactcaatcaaaattgaacaaatgtcgtcatcatcatcatcttcgttgacacacaaatggatacttagaatatgcgtcaacaactataaaaaaattcgtcccccaaattggacccgcgaggtctgcgtggacccgttcgaatggatatttggcctcaggccatttatattcggggtccacacgcggttcatttgacgcatttcgttgacaaatgtgacactcttccacataattttcaacttcttcagaccaattatgccaccacacgaaatctctggctcgggctttgcatctcacaatgccaaaatgtgcccgatgaatcatttttaaaaccctttttctcatttcctgcggaattattatttgtctccccaactttttccgaattattttcccatcgaggtataatttatctctctctctaaagtacggcatcaactcatcatcatcgatcggttccacccagcttgcctttatctgtgacagtactcgggacagtatactatcttcaaatgtctctttttctatagtttttcgatgtaaacctatttcatcatcaactgtca

SEQ ID NO: 77460 - DNA, 2130 bp, Heterodera glycines
  Genomic contig location: Contig_ID=SeqID_13556; Location=231..2360; Strand=+
  SCN-specific regions: Sequence locations=1-206,230-481,503-857,880 -935,958-962,984-1204,1227-1633,1671-2130
  Gene Ontology: Mol. function=transcription cofactor activity; Cellular component=cytoplasm; Biological process=SMAD protein heteromerization
cagttcatatgagctgttgtgcttcgacaggccgacatcaacagaatgacgcacaaaatgcggttgacccgtgtgctcacgtggtccacgtgctcatgtgctaccaaatggttagaaaattgcgaattaaattcgggaaagtttttatggcattttgcattgccatttaaggcggggaggacgaagaatttgtgcgcaaggcaatcgaaagtttggtgaagaaattgaaggtggtcgagaacggcgctttgttggtttcaaggttttgacctctcgttttaaggatcgtcgtgagcaattgtccgttcgtttttcattcccctcctattttttgtgtccatttcggtccctcccaattttttagggaatcgcttatttccgcggtcacttccggcggcaaacaatcaaccagttgtgttacaattccggtcactaattgcctcaatcacattaattgtcccatttcttttctcagcgttcattggatggccgactgcaagtggccggcagaaaagggctgccccacgttgtctacgcgcgcatttggcggtggccaaatgtcagtaattggccattcgtttgcccatttttccggtgcctttgactcccatccgtccttttctgcttcctcttctcaccatttgccttccgtcccaattgaccaccaaagtgccaattccaatgctttcgatgcgccattccctcccattccgtcgttcgttccccaaccacaacaaaatcagcagcggtgtccactgatcgttcactgtttaggcgagggacaacaacagcaaatcgggccgtttcagcagcaggtaaagtttcaatggcatggctttttaaatgctctttctaaattaatttgtccatcttttttcagatgtgtccccaaaatacgactgaccaaagtcaaacgcatcggttcactcattgtattttctgaccaatgattcctttgccgttaaacaattctttcattgaagacaatttcgaactgcttcaactcccttcagttcggagtatcttttaattgtgcctttgagaacatttcactgtcaacggatggttctttttcagaattgcccgaccattggtgttccatcgcttattttgagttagatactcagtcgggcgagctgttcaaagtgccatggcaaatcaaagaggtgccattgcataaatgttaatttgtttcatcggacaatatttaattctttcaatttcaggttgcaattgacggcggaatggacccttccggcgctttgtccgctcgcttttgtttgggcgcacttgcgaatgttcaccggaggttttaccactttgtaatgaaagaaaatggcactttaagtgaagcatcggaacgggcacgaatgcacattggcaaaggggtgggcacacaaagggacagaaaaggggcaaattggcactgccaacgactgatcagttggattttggggaatgaatgacctaaaagtgatcaaaatccgttgacaattggatcaaaggaggaaagatttgtacaacagttaaatcttatcttacaatgatttacactttcataatttataggtttcgttgaaatttgctgacaattgcgaggccgtttttctcaagtccgtcgggtcaaaattaaaaaatgtactgaatttgttttctgttctctttttctcagatgtctctcccaaaaaagcgttttcgtacgaaggtttatgaattttgtagttattggtcaaattttggtaaactttcagccattttatggactttgagtttggcggaggatccggcgggtatgcctttttttaattgtcataaatacgaccacatgtttgcattacatacctcaatgcttttgtaactataaaaaacctcaagcttccaaaaaccaaaaaattttaagattttttatcggaatttttttaaagaaattagaaagtaaaaaattaaaaaaatcggggaaacgatggggggagggaaatagtgtaccatcagagacttgtatacctttttccccttttagaggcgactcgattgttcacaaaatttgtcccggcgtcgagcgaaaagtgttcgaccttcgctgggcgtacgtcgaaatgtgccgtcgacgtgaaaatgcccaactctccg

SEQ ID NO: 77461 - DNA, 242 bp, Heterodera glycines
  Genomic contig location: Contig_ID=SeqID_13557; Location=69..310; Strand=+
  SCN-specific regions: Sequence locations=1-103,126-242
atgcgtacgccgtcgccggctttccctcgcaaatgccctcgtcttcgctgtgcagtgaacgcagtgccgaaacgggggtcgaccatctgcgaagggtccggtcaaaacagtggcaattgttgttgtgcatttgttactttgcttctgttcagatgtgctgcaccgtttcgcttagttttgtcaaaggatggggcgaagggtacggacggaggacaatcaaagagacgccatgttggattgag

SEQ ID NO: 77462 - DNA, 261 bp, Heterodera glycines
  Genomic contig location: Contig_ID=SeqID_13558; Location=710..970; Strand=+
  SCN-specific regions: Sequence locations=1-205,227-261
gaattgagcaaattgttggagattgccgactacggcatgcagtacagggcggtcagccacgtgggcgccgttctcggctcttcacgcgacacgggcaccaaatcggccgaccccaatgacccaaccgtgccgaaggagcaggtgccaccacgatggttggagaattggcggaatcgacgggcaaaagcggcacagaaaagggaaagcaatgagaaagggaaagagagcgaagtgattttggacggaaatcgggacaattaa

SEQ ID NO: 77463 - DNA, 1402 bp, Heterodera glycines
  Genomic contig location: Contig_ID=SeqID_13558; Location=1086..2487; Strand=-
  SCN-specific regions: Sequence locations=1-132,160-525,547-610,651 -1402
atgctggaaaatgtgatggcaaatgccgacaatcagtttgggacggggaaaccgagacaaacgatcaacggacgatggacaattggacaaatggtagaaaaacaaaggcaattacatcaacaaatgatcagccaacagcagcagcagcagcagcagcaggtaataaaagaaaaagtgaggataattgccaatgaatcgcggtcactccccccccccctccccttagacattttgtccacgctcccccccccccccctcgattagacactttgtcactcccccctttagacgagtatgtccacccctccccctttagacactttctcgacccgtccgcccaattgttacggtccaatcgttttcccaccgacggccccgcgaggggcgccctccccgaatttcgtcaccaatttgtcgcgctttgcctcagccccagccgccgccaacaacctgaattgtactcccgccaatttttgtagaaagaattcgcaacgatggctatgcaaatccatgggaagagaagcgaacaaaacaaaagaaaactgacgaacgaacggaggaaaagccaaaagagggaaattacggaggttgctaaagcacgagactctcgagcagttttgtggaaaatatcaataaaaatctctcaaaaattattagccaatggaatcgaacggccaaagacattaattttgacgaatgaacggattgccaaattgcctgacctcccaaatggacaaaagtcgaataatttaacattgaaaggtgggggagggggggggggggaatgaaataaattttcataaaattaaatccaatggtcagaaaacgaacccatccctttgtccgaattcctacacgaagacatccgaccggccgttgacggcgaacggatggggcctcaggcgaaatatgcgggacaaacgaacgaatacaaagaagactggggaaaacagttcacgaagacaaacggacgaagttaagaagagtaacaaagcgagagagaaagtaaaaaacaattccaggatattatggcccattaaaagccatcgacagagaaaacgaacagacaaatggaagggaagacacgggtaaaatgggacaaacggaaagagcataaaaagcatggaatggaaggcaaaaaatgcttaaaacaattgcagacattaatccaccgccggaagggacgcgcattaaaatggacggacgaaacgatggaaaagcgaatgaaagggaaaggcaatggcacagaaaagacggcacaatcagtccgtatgtgaacgcaccggaagaaataacggggagccgattccgaaacatcgacgaacaatttaatgcgatgaacggaggaaatgggggacgaggccaaaaccgatatgtgaagatggatttgctgaacgaatga

SEQ ID NO: 77464 - DNA, 1681 bp, Heterodera glycines
  Genomic contig location: Contig_ID=SeqID_13561; Location=1759..3439; Strand=-
  SCN-specific regions: Sequence locations=1-182,254-307,350-378,495 -535,557-736,758-944,990-1122,1148-1187,1211-1389,1411-1552,1574-1681
tgccgaattaaatttttaacagaaaaactccgaatttcatacgggaatgaatatgtttcaagccaaccgtataaatctgcagttgtttccatacaattgtatccaaatgcgaaatattatcgaatttatgataattttggcgatgaaacatcaagggcagatttaattttgcatgacattgcaataattaaagtaattgattaattaaatatttatgaataaattaatcattcaaatttatttagattaaaaacccaattaaatttacatcaaatgttcgaccaatttgtttatttggtattggtggtaatttttaataagtttaattcaattaaattaatattttttacccaataagtcttaacacaataaactcccaaaataattttatatttaaaaaaaaaaatattttgttagtttttgtaaaaaaaaatgtttaattgatgttaatatatttttgtaatatttttacaaaatgatttttaataatatttggttttcaatgaaaaaacaaaactttaagattcaacgcgcgcaaaatttctgatgagaaattcaaaatcagaaactaccaaatttattattgccggttggggaatgactcggccacagtgcgcgaaggaccaaaataagactcgaaatgatcaattgaattatggcaaaatgcgaatgatttcgacacaaaaatgccgagaaatggccaatgaaaaaaaaaattgtaaattgttagatttacttcatttttaattttaaattattgaatttagcgtttcaatggtctgctagcgatgacgctgaaattgaatcgatgctaaatgaatttgaaacatacgggttggacacaacattttgtgtggtgcccgatccgagcattggcgaaccggtacggtagaattaatactgtacaaacttactgtatacaattagtaggggaaaatgcatagaaaataaaaataattaggtaatatgaattatttaatatttttttactgtagggtgatagcggtagtccattgatgctgaaaattggcacaaacaattggatccaattgggcgtcgcaaccaaaacgagctgcaattccaaagacccaacaagcaccgaagaactctttggtaaatgcatttaaaaataattgtatttatttttacaaaaaacaatcgtcaatgtctttttttatatctataaaaattttgtttttagcatcatttaattgtagggttccatgtgattgggattttggaataatttgcggggagacacatataggtaatcaaaaagcgactatagagcccaaaattttgaaattgccgggaccggggccgggacttggaaaataaagcgggtcgggatcccaggaatgggactcccgtttttccgggactcccggtctcggtggtttgtccaaaaaacgggaccggggctggaagtcccggcaaaatcgcgacggctccagtcccgtccgggctctagaaattaatatacatttctttttttaattcttcttttctctccaacgctcgattaattttcggcgttcgggttttcctcttctttttaaaaattagaataattagcatcaattgacaaaaaacatttattattcatttagctcaatacactccgattgattgcgcatggattgccaacggaacacatggcgaagtgaaatgcataggatgg

SEQ ID NO: 77465 - DNA, 1055 bp, Heterodera glycines
  Genomic contig location: Contig_ID=SeqID_13562; Location=99..1153; Strand=-
  SCN-specific regions: Sequence locations=1-795,818-1028,1050-1055
  Gene Ontology: Cellular component=mitochondrion
atgctttccacaatttgctatttaagcattgttcttggttcgtcttcggtttttttcgttgctctctacccgttggctaagcgttacaccaattggccacaactcattcttggtattcaaaatcgtcacttccaaacaaattagaaaaagtgtttttatagcatcagtcgactacctcggtctgtaaaataggaatccgaaataatttttcgacaactactctatcaaaagttaaaaacccgggactgggatggcaaaatatctttggtactgaataagtatacatatagaaaagattttacttttcggttttttgtaaaaaataataaaaatgataattcgaagatttttgcctaataaataataattaaattgaccatttaattcaaaatctgttaataaacttcccccttcttatgctaaaggtatcactttcaattggggtgctctactcggatttacggctgtaaccggcacattctcttccgctgtgtgtgtgccgctttacttggcttgcgtttgttggacgatcatttacgacacgatttatgctcaacaggcaaatccattaaacgccaatcaaatacgcatttaacctgattaaggataaaaaagacgatcttttgattggcattgggtccaccgctgtccaatttggtgaccatagcaatttgtggcttacttttgcctcacttggaatgcttagcaatttgctatttctgggatttgtttcagagcagttatggccctattttctttctttattcggtttgtcctttttgagtcacttatctcaattcttttcagcttctgggtctcatttggcttggcaattgggcactttacatgttgatgatccaagtgattgttggcaaaagtttcttgcaaatcaatggttaggcactgtgattttttgtggtatcttgctgagcaatttgttgaagaaaggcgaaacgaatgatgggaactcggaggaagaattggaaatggatgaacaggaaaaatttatgatgtactttgttcagagaaacatgaatgttaatttttacacataa

SEQ ID NO: 77466 - DNA, 436 bp, Heterodera glycines
  Genomic contig location: Contig_ID=SeqID_13563; Location=359..794; Strand=+
  SCN-specific regions: Sequence locations=1-209,231-436
atgctccgcctccgaagagagccaaaaaatatggacttggaagacaacccggaggagcagcgaatgcaattgaccaggcacatggccaatagagtagccaagtacctaaacttggaagaagtggtaattaatatattacagatgcaaattttttaaattgattgatccctaggaaattgaaccgaccaatcggcttgtctgcacgtatcaatttcaaataagaatgaatacgcgacccattgaacagagggaccacggaataactgcggtcactctcgaatctgcgtgaaaattgaagcaaattccacaccggacttggttagcacccacctcggttcatacaaatcatctggttttggcgcattagcagaggaacggagagttgggtagtgccgacaagacgggagattttcataaccgacaaagaaccgattga

SEQ ID NO: 77467 - DNA, 483 bp, Heterodera glycines
  Genomic contig location: Contig_ID=SeqID_13563; Location=913..1395; Strand=-
  SCN-specific regions: Sequence locations=1-123,205-483
atggaaatagatgatttcataaagaaattcacggaaaaacgcgttattggccatacgaggtaaacatttttccgaaaggagtttgcttttcccgtgaggtctgctcatctatgttttatttttataaaattaagttaataaatatatgattaaaaataaaataagctatagaaaaataaaaaaaacaaattataaagaggtaaatattttcagaaggctaaaggccgaaaagcttgccgaattgcttcgccaacaatgccaataccaaccgcagcacccgtctccttctgcacttggaatgaccactcaaactcagtattcgtctcaaggggtggcagcctcaatgtatcctgtccttggccaggcttatacgagcccagccaattttcggcattcttatatgagttaggagaacggttcaaccggagattacttggacacgcacttattattttctatcaattttttgccccgacaaataaa

SEQ ID NO: 77468 - DNA, 876 bp, Heterodera glycines
  Genomic contig location: Contig_ID=SeqID_13566; Location=24..899; Strand=-
  SCN-specific regions: Sequence locations=1-249,271-305,328-349,385 -393,426-876
atgctaattgcatttatgaaaggtcaccaagaaattcaattcagtgagtattcaagacaaaaatatgaagcacaccttggcatcatgcattttatgagaatgaattggcaatgtgacaaaattgcggtggagtttgaagaatatgaacggacagaatgccaaaaatatcgcaaatatttggacattttgcacgaatatttgtgcagagaatacgttgggattcacacaaagaagccaaaatttgtgcttaaaaataaaattgaaattgaaggaccaataatttatgcggtgaattgtttggccacaatttttcaattttattttaattcggaagagagtgagtttaatgaatataaattaaacagattatttaattataattatgaaccaaaattattgaataatgagaagagattggattatgaacaaaaattgtcaattaatgaaatgattttgcaattggcaattgacacagcgaatgaatggcaaacaaatgaaagtttagacggaataattcgacaaaattgtggagataaatttgacaaaaagttagagaaaatgttcaaaaaagcggaaaaaaggacaaaagaatacggtccttggggtgccaatgaaataaatgatgacaagcatctgataattgcgtattcggaatttgatgatcaatggaaatgggtaagacttaacgttcaatgtaaattaaataaattcaaaatttagattgatgatgctctattttcggaatttgtcaaaggattagcgacaaatttggagaatttttttaagatggctaaagaatattcaaattatttacgtctaaagaaagagaaaggatattatattatctttaatgaaaaacgaatgatattcttttgg

SEQ ID NO: 77469 - DNA, 1444 bp, Heterodera glycines
  Genomic contig location: Contig_ID=SeqID_13567; Location=1111..2554; Strand=+
  SCN-specific regions: Sequence locations=1-1,43-49,77-180,202-233,257- 304,342-425,447-539,574-622,644-724,751-1010,1032-1156,1196-1339,1371- 1444
atgccagttgttgctgctgttggtaagaggaaattttttaaattctctgaaatttttttatattttttaattattacagtaagccttgctgttgtggctgtacctgtgtcgggccgtgccaatgttgtaacccaccactgctgatcaaattgccaaggtccaggcaatcgatgttttgaaaattttttcctaatttttcccgaattttcaggacttgcccctgctgttgcaaatgctgtggctgttgctgttgcaggccatgtaaaatccaaaaagtttttaattttttaaccaaaaaagttttaggctgttgctgctgcggttgcggcggcggtggcggacgtaagaagcgctcaattgtcctccgctcggccattgaagcggccaaaaccggaaaacgtgagaattttcaaaatatattaccgtattttccaaaaaatatacacggcatttcaaaaaacgcatacatgataccttaaaaattcgccggtgaatttagtaatttaaggcctttatttttgatctccctcaagtatgggaattaatgttaataaatatttttaaaaaaaattagggacttacggtgctttattttaggaacactaaatagggtaatcaggacgacatataggttgaagtaatacggtacttgtttttttttgtcacggtacaccaaccccaagcctaattccaattttgacggtaccaacctgctcttactcagaaaatttaaaaaaaatttaatttttagctgctccaccagccaccaaaatgccaatgtcatcacagccatgcccaccagcagaagatataaactgcaaacccacaacagcgcgcagcggcgccactgagtgccaaaagtgtggagctgcagcaattagtgccaataaaagtcgcgcaagacgaatggcatttggcgccacatttttattcgcttgatttttcaaaatttgtcattattatatttatttttgtgagctcttttttgggggtttattttatttatacaaatgctggcggtggtggtggaataaaattggattttgccattcaaaatttgtccgattttaagcaaaatttaaaattaatcaaaattatttgtcttttaatttcgcaaatttatttaaaatacctgcaaattattttaattttcagcaattaattttaaatttctttgttttttatttaaaaattactacgcactgcctcagaagtatctatgagaatgtttaattgtgtcaacaaattaattgtcttcagaaattaattttgtcatcattggccgtcgtaattgggcaattattactaattaaaatttgaagtggagccaagcggaatcgaaccagcaaaagaaagaagaaagcagaacacactacccacttgactttatgcacaaacactctcgccttgttaaaagtaaaaatgaaaacaaaaaatttaatta

SEQ ID NO: 77470 - DNA, 1713 bp, Heterodera glycines
  Genomic contig location: Contig_ID=SeqID_13568; Location=588..2300; Strand=-
  SCN-specific regions: Sequence locations=1-799,852-1205,1227 -1270,1292-1668,1691-1713
atgccatccctgatagggaccgccggaccctctgttcctagttttttgaaaaattgcaccgcaaaaaagtgggtttgaaaagaaaaaaatagtcaatttatgaaccgttaataatttgatttccgatcaactttttaccgtcggatccaatcgaaaaatcttagtcgacccatcaaccccttttaatgcatcccgccagcccctaaaaatttatttttcagcattttttgatttttggaaattttttgaatttaattgaaattttttcgaattttccaaaatcccgcaatcccgcgcgggatcccgcaaattttaaatgcgggatttgcgggatttgcgggattaatcccgcgggatcccgtcccgcaaagaattttcagtaccaatcccgcagcgggatccgcaaatttgaaatttccgggctctagtgttgataggctttttatgcattttattcaaatttgcccacctgtgtgtccacaaatcgtactcgcgtgtgcaccggatcgcgcaccctcgtggttactgtacgcacaattcggcgctgttcttgatcatctcccccgtgtacagtagtggcgtatactgtatgctcatcgtagccctcgtcatcggccgatgcactaacattgcttaaacaaaatagttgattaaatctttaactaaaaaaatttatggtataattattaacccatttccaccgcccatggaaaatgcagcgaaatgatgttgaggagatgctaaaaataaaaacaaattaccaaatgcatttataattttgttgaagattaattttgtctaaaaatatttaaaaaaaacaaataaataattagctaattattatattaataggtagggatgcaacttttagtgatttaactattttttttttgctcgattgttttgaagaaaggagctcaaaaaacgcatttctgcgttgaaatttttcgatttggatctcactatcgatcactagaaatcactattttcacgcttcgtcactaaaatagtgaaaattcactattttggcgttttatcactattttttaactatttcgacatttttcagagattttattagcaaaaatgcaataaaatcaaaaaatacacccctaagaatcgatctaaaaaaatttcaaaaaatacactcctaagaatcgaccaaaatttttttttaaatacaccactaagaattggaaaattttttcaaaaattctcccccaaaattttttttcttgacaaaatttttgatttaaaaaatatcattatttgctaagagaattttataaaggaaatgtagctcatttgcaactgcaaccagtgaataaaaattatttttgcttaatttttggctgaaaattaggtcactatttgtcactatttcggactttttgccactatttggtcactattttggcatttttactcactattttagttaactatttcgagatttttcgtcactaaaagttgcatcattaataggaattaatgttgactaatttaaagcgaatcaaaagtatttttcaggtgtcagccttgttttgtaataaaagttgcacgagaatgtgagatcggaatgatcgggaatagaaaagtcagggtgatcgggatcacgatttttacccgggatgaaggatttacgggaatgacaaaatcaaaattcatttgtggaagaattaattttcattaaaaattcctttatcaaataaa

SEQ ID NO: 77471 - DNA, 1500 bp, Heterodera glycines
  Genomic contig location: Contig_ID=SeqID_13570; Location=51..1550; Strand=-
  SCN-specific regions: Sequence locations=1-1328,1350-1500
atgccttcaaagcaacaaaataaaaggaagaaggaactggagcgctatcgacggcggacggagcaatctgtcagcccggttcgctcacccgtccctgacgggagtgcagatgggaatggagcggcatcgcccaggggcttcaacaccccaaacattagtgctctgcaattgagcacgccggcttcttccactggaagtaaaagaaggggtagaccccagaaagccggagcgaagccaatcttggctacccaagaaagggtgtctctcattgacacacctcgaactgcggtcactcaaagtgaccagggttcgccgtgcaaaaaaaggggaaaggtcgccgagtgtggccaacccatgtttgccaatgaagctattgctttgacgcctctttcgactcaaagtcgtggagggcgaccagttaagcaactgggagggcatgccggtaaaggaagaggcaaaaccaacgagtgtatgagcaaatgctctgaaatggaccaaactgtggaaaacgctctaagtccggcaccctcgcacattgtgtttgaaaaaattgatttcagctctgtgcaaattaatttcgccacatcgcgaaattttgcctgtaaaatttggaaatgggcagcaatcggcctttacgaacgtgatggcgaaacaccgattgccccaagatctggcccaagatacattgagacctgttggaatgatatgacccagtttctcaatgacggctttgctgccacatacttggcatacttggcaaccatatcacaacgaaaagtggtcgttgttgacccaatggtatggagcaatggcctggacagagtcatgccttacaaaaatatgacatttgggtacgaccctaatgttccggcagaagttatacttttgccagtacatttccctggacattggactctcattgtccatgatgtgcaatttggcactcattttgccgattctttgcctaccacatatggcaggttggatccgcaactgacggataaaattaaaaatatcatttcggatattttgccgtcagcagtgttgacagggattgttgatgtcgaaaatctgacggtccaacacgatggtaatagttgtgggtacttcgtgtgcctgtatgctgagtcatggcttatgaacaatcgcacatttgttctgcctgatttatccatcaattatgaaaaaaagcgcattttatggcacattaacgagctgtatggctctgataatgtgccatatcatccaagggaaggggtgccaactccttgcccaattgtctatcggcatacggatgaagcgcagtcgacatccaaggccgctgagctaatggaagttgatgaatatgatgatataatgatcatcgaaccacatacaagtggacaggcagttgatgccattctcacccaggcccaagtggccggtgaaaaccaagctgacacgcttggtttggtgtcggagtcttgcatcccgcaagagccaattgcgcaggctgatgat

SEQ ID NO: 77472 - DNA, 1166 bp, Heterodera glycines
  Genomic contig location: Contig_ID=SeqID_13571; Location=167..1332; Strand=+
  SCN-specific regions: Sequence locations=1-324,346-387,410-572,594 -764,786-1166
atggcgttcccattaggcggcccagccacatgcatggcaaaggccagtgcaagtctgggcgttatttccatatcatggtcgcaaagcagaccgatatgggtgccctggtcgcaaagcagaccggcactgtgtcatggtcgcaaagcagaccgacacggttggctatggtcgcaaagcagaccagcctcgccatggtcgcaaagcagaccggcgtgtgcactacatatcatggtcgctaagctgaccgatatgttgccatggtcgcaaagcagaccggcacgtgcacaaatctcatcatggtcgcaaagcagaccgataagatttgaaaacaaataaaaatgtgagtctcaaaagggtcataaggacagaaatctttacaattgactgaataatatttttaaaaatttaagaacattttttttctgtcaagtgtaaagacttcttaattctattttggagcttatgcgtgacaaagtgtacgaaacttaattcctaactaacctcagatttgggttagtaaaactattggcttagtgtacaccttgccataatttttgtatatatgagcatctaaaaattttttcttattttattcatttcatggtcaaatcgatgaattttaaagatttaaaccggccaaacatagcaattgcttcagaacatttttttatttcacaacttatttacgggatggaattggtataagcccacaatgttgagcgattttggtttttcaaaaagttacaataattgattttcatatgctttaaaattacaatttttaagattttttcaacaaagaaaattgtttccgttttcaatttatgaattgccgaatgcaatcaaaaattttgagctcagaaacatttgaccggctatttcatatggttgaaaagtataaattttttaaaataagttttttcaacaaagaaaattttttccttttttcaatttttgaactgccgaatgcaatcacaattttagagcttattaaacatttgaccggttactttgagaaaaattgaaacttgccagcaatccgctttgccattgaaatgtttgtccaccagagcatttaaacggggcgaaagcaatgccaatttgggccgagttgaagatggtcagaaatgcccatccaaagtgttgcaaaaaatcagctgaaaaaa

SEQ ID NO: 77473 - DNA, 396 bp, Heterodera glycines
  Genomic contig location: Contig_ID=SeqID_13572; Location=304..699; Strand=-
  SCN-specific regions: Sequence locations=1-87,109-125,147-203,250 -359,381-396
atgtcaatgatccaaactgaattagtttccatgtacacagaaacaaatgtgagttttatagatagattatttattttatgcttttgtaaaattataattattcaaagatagcatgcttaaaaagttaacaatttgaaaacaatggaacttctttgaaaagtattaatctaataacttatttagcatagcctataaacagattgaaaaatttaatataatattatatattgaaaaaattcatatttttaacaacattaaagcaaaccatcgaagtaattttggcggtttcccgtcgttctgcaaaagtgttttgcctaagtttacgggcagacatgctcagatattgttcagagtacgatgattcccaatcttgtgagttttaaaaagaataataaa

SEQ ID NO: 77474 - DNA, 2162 bp, Heterodera glycines
  Genomic contig location: Contig_ID=SeqID_13572; Location=1295..3456; Strand=-
  SCN-specific regions: Sequence locations=1-103,125-394,416-628,651 -707,768-1236,1258-1443,1466-1523,1545-1555,1582-2057,2086-2162
  Gene Ontology: Mol. function=structural constituent of cytoskeleton; Cellular component=cytoskeleton; Biological process=protein targeting
atggccagtaatccaaatgcacaactgttggatgcatgcgaaaaaggggcggccttgaatcacagttcgtttgtgaatttatcatgaaatttcggttaaaattggcaattcaaaataaatttttaatatgctttaaagtgacaaatcattttgtttttattcctttttagtcaaatccctaattgagcgcggggcgaatgtgaactttgccgatgaaaacggtctttcccctttgatgggggcatgtgtcttcggtcacattaggattgtgtcctatcttatcgagttgggcgcgacaattgagcaaaaggatgtcaagggtcagttaccgtatttatctgcccaataggcctccggcacttttttagatggagagacaatgcttttaattggggacatatttttatgtagaaaaattgggaccaaattccatttaaaataagaatggtcaagtacccggtaattgtaccggtggcagctcccctttttcgaaaaaaatttcaatgcgaaactcgaaaattttaaatttcgactttttgtttcaaatcgcgtcacattacggaattgaatcgaaatgcgtgtaaaaatcgaattcgcagacccagaaaaccaaaatggctttagcttgaaaaatttttttttaaatttttctccaaaagtaggttacaaatttttttcagttttttattcctttgttcgtgtgtaccttataaaattattaaaaatttataaaaatatttttcaatgcttaaataatataaataaatcattttaggtttgaccgccctgggacatgctgtcaatgaaaatcagattgaatccgtcaaaatgttaaccggaaaaaacgcgaactgtttggtgtttgccaacgacaatcgctcgccgttggtcatcgcctgtcaggaaggccgcatggaaatccgtcagtgacttccgaaatatggcaaaattgcatttcaaaacgaatttcacagtttgagttcatcttttttgttagtgaaaatttgtcacttttttcggtgccattcgcgtgatttttttaaaaattatattgctaattcccctttcacagtgagccatttgaatttgaatcactgtgacgagcacggaattactccgcttatggtcgcaacccaagaagaaaagttggacgttgtctgtttcttgttgcaaaacggagccgacaaaagtcagactgatgcaaaaggtcagttttttgatggcatttaattagccaataaaaaacaatttaagggagaaccgcgctcgcatttgccgatgacctgtgcgattcgaaagaacgtaaccagcttttgaagttgttgagtgaccgctaattgtgagaggaaagggacggtgatcagaaaattctttgtcagtgattagaaaatgttttgccgttgttgattttgaccgtttaatgtgttcatttctaaattcgttggtgcttctttttactcatccataaagcgccttttaaacaaatcaaatggaagccaaatttggcccaagctttcagttgacaaattgtcaaaacattttgccgttctctcattttcgtctctcttctctctgtctgtttctcctatgccattttctcattgatttatccgtccgttttttggcgtcctttttccgcccagtgaatgttctccagtgcagccacttgcgcacttttgcctctatttcccttcgggcgttttatattcaatgaaaataattcatgatttttgtttcatcactaaattaaaatctccagcatcaccaacagattattttgggcagatttggtgccataataataatggcaccgaccgcagaaaacaaaactttgaattgggccactaaacgactcaagcgacgacaagctttgaaaataggcggtggtttacgccgaaaagtcaaaaggcgaaagtgctacacaaaggaaggtcttgaggtgtccgtggagtttcggaatgaaatttggtgggtgcatagagcacccatgggttcttaagaaaagtgattttattttctgcgaaatgaatactagtgccgagatatgacgtgtcaattatttaattgtgaaaatattattttattacggtgcgcctattgtgaaatgtatctctgtttccatcatttttataatgactaccatatgtgcgaaaacgaataaa

SEQ ID NO: 77475 - DNA, 142 bp, Heterodera glycines
  Genomic contig location: Contig_ID=SeqID_13572; Location=1401..1542; Strand=+
  SCN-specific regions: Sequence locations=1-142
ttgacacgtcatatctcggcactagtattcatttcgcagaaaataaaatcacttttcttaagaacccatgggtgctctatgcacccaccaaatttcattccgaaactccacggacacctcaagaccttcctttgtgtagcac

SEQ ID NO: 77476 - DNA, 511 bp, Heterodera glycines
  Genomic contig location: Contig_ID=SeqID_13572; Location=3640..4150; Strand=-
  SCN-specific regions: Sequence locations=1-38,60-156,180-235,262-511
atgatacactcacgttggggcgatcaagacatctcgatcaccctagaaaattataataatgagtatatgttccatcagattggccatctcccccccccccccctccacattctcatttatgggatctgttttttttttgttcccacccgatttaatctgctacagaagtgactaatgggagcgttgaaaaggcaattatccaccgattaacacttttctttccatctcgtgtacagctacataaaaatcatttttaaatttagttgtattcttttttcgcattcgtatcctatttttcacactcttgcaacacaaaaatttcctcggctaatctaaaacctattaactctagagatcgtctacggaccagagtcgtatacggatttttacggactacggatttttatccttaatccgtatgagtgcctaatccgtaatcctgatccgtattttctaaaaatgccgatctctaattaaaaccatcttttattctaatttttgtgacattaaa

SEQ ID NO: 77477 - DNA, 284 bp, Heterodera glycines
  Genomic contig location: Contig_ID=SeqID_13573; Location=571..854; Strand=-
  SCN-specific regions: Sequence locations=1-25,57-284
atggggttatcccagttttagtatcctttttgaaaaacaaaaattttaataaattattcggtagctcaactagcgccaaatttatttgtatgatttttgatccaaaatgtttcagtcagttgcccattgaattgctcactgaacactctgaggaaattgagcatttgattctggacgagaacgagcttgacgagcaggccttggaggacatccctcgcctggacaagctggagacgctgagtttgaatgggtcggtcgatcggcaatttaacaggcgaaaataa

SEQ ID NO: 77478 - DNA, 329 bp, Heterodera glycines
  Genomic contig location: Contig_ID=SeqID_13574; Location=344..672; Strand=-
  SCN-specific regions: Sequence locations=1-329
atgctacacccttcaacccattgcgcgcgcaaaatctcacgcaagcagtacagcaacgcgccggacggagcggaagagtgtggcggcaacgcggacgcgcttttgcgcaaagcgagccgaaagctgtcacaactaagcgggctgggcgacttccagcagcgctgcaataccgccaccagtcgccgtcgctgttcatcgacggaatccttgctggcggcgctgaatggtcacggctctgtggtgtccgcaggcgccgactcgtccaccgccagccatcgttcatctacggacgacctgaccgtgctcgactgctccaaccttagccttgg

SEQ ID NO: 77479 - DNA, 702 bp, Heterodera glycines
  Genomic contig location: Contig_ID=SeqID_13577; Location=69..770; Strand=-
  SCN-specific regions: Sequence locations=1-71,95-227,265-293,572-702
  Gene Ontology: Biological process=N-linked glycosylation
atgattgccgaagtggaacggctgttgacacgaaaaaggtccgcaccggtgcatgcaagttttgggaacattgacgacgacgatgaggaggagggcgagattcttgacgtctcgtttgttgaggaggaagaagacaatacgggcgaagcgcccttaaacccactttcatatttgaccaagcaatcagcggctcaacaagaaacgttgcggcatgaaaaatgggcacaagaagagagaaagcgaagggaagaggagcagagaaagcagcgagaaaatgaacgtagacggcgagaagaagaggagaggcgtcgtaagacagaagaagatagaaggaagactgcagagaaagcagccaaggaaaagaaggcaaaggaagagaaagaggcaagtgaaaagaaggcaagggaggaaaaactggcacgggaaaagaaggaagagcaaagaatagcaaaggaaaagaaaggcgagaaagagaccaaggataaaaaggctgaggaggagagagtagcaaaggaaagaaaggcagaggatgagagagtggcaaaagaaagaaaggcagaggaagagagagtggcaatggtaacaaaggcagaagaggaaagagcggcaaaggcggaagcggagagagtggcaatggtaacaaacgcagaagaggaaagagcggcaaaggcggaagcggagagagcggaaaacgagacctag

SEQ ID NO: 77480 - DNA, 741 bp, Heterodera glycines
  Genomic contig location: Contig_ID=SeqID_13577; Location=1039..1779; Strand=-
  SCN-specific regions: Sequence locations=1-34,56-325,348-485,507 -554,577-741
atggatgagtcgaaacgggaaaatttttcccctcaaaatgatgatgacgtcatcacaattggagacaacaacaacactcaaacactgcttgacctgcaaccggggccctcaaaaaggggacgcaagcctcgcttggacaaaatccatgaggaaattgcttccgcaatgaagaaagcaaaagccatggaagctgaaggtttggctttttctgcaaatttctttaaattagccaaattttagtggatgaatcgcccaaaaaacaaccgaccaatgtgtttgagtacccgaccatattttggaaattggcccgcccaaaggttttggctaatatttaatttgaaaaaataggaaaatttcttaagtatggagtgttcacgttcatgtgcaaagagtgtcgtgatgacaatttccggcaggggaacagccgattcaaactcatcaatcagaatggcgagcagcaacgccttgagttcacccaatcgttttgccaagactgtgcaaagctgaactttgattgcaccgatctgatcatgaagcacctaaagaaggatgaaccggcaacgacgacgacgacgatggcaaagagtttccgctggatcaaagatgggggaaagtgaaccgagatggcacaccacgatataaggacgatctcattttgaagaatttatacttgttgatcaaatgacaaactctttctttgtaattttgccgagcaatacgccaggctttgttggaaataaa

SEQ ID NO: 77481 - DNA, 1285 bp, Heterodera glycines
  Genomic contig location: Contig_ID=SeqID_13582; Location=347..1631; Strand=-
  SCN-specific regions: Sequence locations=1-158,181-376,401-559,597 -734,756-1011,1041-1041,1063-1285
aaattgaaagcaagtttattttaaatagcaatacattagtttatcatttcatctattttggttatgaattattgcatgcaccaacatatccatcttggacttcagtttcaattctaaagtatgtcataagtttaaaaatcgccgccgtcactttttgcgggattacagagacctcattttctcttcatccctatacagtgcggcggtgacacagcaattggtgcactgttgttactatctggctacgcttctaaaaaaacagcggatacaaaatgcactagtaccaaaaagaaattagaatttgttttaatgcatttttttgtatattttaaatttaatgtttatgaacggatgggtatttcaaattttttttaccataattaatttttttttttaaattccatttttaaggaaaacgcaaaacaattccaatttgtggacgtccgcttggcattcgtcgattcaattcacaacaattcattgttgctgacgccgtgcttggcttactgctcatcaattttgaagaaggtgctgctcattgctagaaattctgagaaacaattaaaaaaaaattattattaaaaattgttaattaacaaacaatattgaacgcaattaattagggaaaaaatcattaataacaattaattcgttaacaaagaaaatgagaagtggtaaatgtcgttaattaaaaaccaattaattctatgtttagaatttaatagacattaatgcttattaaattaattatttatggtcaaatggtaaaaaacaaggacttcctaattaggcacacacaaaaaaatatgaaaaattgggcaatttcaggccaatttagaaaatttgaagataattagacacactaataattttgataaagcaccgccaggaaaccttagaaaaatttttgcgaattttgttggaaaatttgataatactgcttaaaaaagaaacataaaataagcaaaatgctgaaaaataggcaaacccccctttcttttaaggcacatgaaaaaaaatttaaaaaaaaattttattttccaacattttttccagagacaaaagaagtgctgttgccaagtataactgttgtggacaagaaacgctttgggcttcccagacgatttggacattgtggacaatgacacaattttgttcaccgattttgtccgcaaaatatggctacagtgattgtgatttggcattttttgagcacgtccgggacggacggtgtgccaattggattttaatcaaaaccaattatttgcttaattaaaaaattaaa

SEQ ID NO: 77482 - DNA, 1114 bp, Heterodera glycines
  Genomic contig location: Contig_ID=SeqID_13583; Location=1254..2367; Strand=+
  SCN-specific regions: Sequence locations=1-1114
atgttttctgtaattccattgaatgatttgtgtcaattagcaaataattcatgcttattgagtaaacattttaataattcgccaattctcaatggaatcttaaaaaatgctgaaataattgaccacctatcgaagaaattacaattcgatgaatcagaaaaaggtagggatatccaattcatcgcagtttggagatcatcccttcttttagcacttctttccattgtcaagcgcaatgttgaccgtcttcatcaattatgcaatgaatggataaataccggacacttctcatctattcccgaccattaccggttattgtacgcattttgctgtgccgttcgtgccaaactcagttatttacttaaggattatttcgtaagtttttagaatgaattataaaataacagttcgatcagttgtctctccgacattgtgacgatgggttgctgaagggcaatgatttggaggatgaaagtctgtccaaattcgcttctttcttgtgccgcaaatttcttcctccgccctcagaagtgccggaacatcagaccgatgtgttttatccagaataacaattaaatcaacatttaaactaagatttagtcaaaaaaagcgcctaatttactgccaaattctgtccaaatttcgtcttcagaattgccttcgctcgaatatttcttcaacaatttttataagcttcaagtccccgtcatcattcgtggaatggtctttttttcatttataaagtttatatacatataattaaacatttatttaggtgaatgggtggccggcatttgaaaaatggagcttttcttatttgaactcgatttgtgggcatcgtttggtccctgttgaattgggtagtaaatacacggtccgtatggaatatttttggcctttttaacgaaaatttttgttcaaaaattaggatgacgactggcgccagcagatgatgagtttcaaccaatatttggacgattttgtttttcccactaccaatgtgagttataatcaaagcatttttttgcaaattctttttcctttttgtttgatttttcaagaaaaatgggtaaatttttttgaaaattatgcacagttttcttaacatatttta

SEQ ID NO: 77483 - DNA, 246 bp, Heterodera glycines
  Genomic contig location: Contig_ID=SeqID_13585; Location=701..946; Strand=+
  SCN-specific regions: Sequence locations=1-246
atgtgcgccgcaactgattggtcgtcgtggaggtaaatggccaaaggccgtcgatgttcagcgccacccgcgggcgagtcgaacgcctcggcaatggcatcctgcagagatccatggaagaacggcgcatgctgggccccgtatctgtacaaatgatagtgaaattataaaattaatattcctcaatttcaggaccccaaacgagttaaatgacgattgaattccatttttgcaaatgtcttcaaa

SEQ ID NO: 77484 - DNA, 1215 bp, Heterodera glycines
  Genomic contig location: Contig_ID=SeqID_13585; Location=286..1500; Strand=-
  SCN-specific regions: Sequence locations=1-438,460-1215
atggacggagacggcgacgaaagctattgcgactcggacttggagttggagcggagctcgtcggcgaacaatgtcaaccaactgccgttggtgcccaccgaattcacttccattccggaggccatgcagaattttaatgccgtttttgactcgaggtttgtcagttgtggcttcaacattttgagccggtttgtcattgtgagatatggtgcctagtttaaagttacaacttttgaatttcactaaaatccaaataggagacccttttactctttatggactattgtctagtcctgcaaaattgccgttggttacgaacctgacctccatttcgacgagttctgggttgattcgaaaaagaatttgtggtctatctttcgattgttggctatggattaggaattcatccaaatggatgtcagattcgttatcatcgacccctaaaaccccaaaaacaaatgggtcctccctccattttggtatttagtaaaattcaaaagttgccatttttaaactagcgcccacatcaatcaccgatgagaagaaggctttattttgaagacatttgcaaaaatggaattcaatcgtcatttaactcgtttggggtcctgaaattgaggaatattaattttataatttcactatcatttgtacagatacggggcccagcatgcgccgttcttccatggatctctgcaggatgccattgccgaggcgttcgactcgcccgcgggtggcgctgaacatcgacggcctttggccatttacctccacgacgaccaatcagttgcggcgcacatcttcgctcaaacggttttcacaccttttttgcttgattcttgctatattctcgaaaatgaatgggttacactgattaaacacgtggaaacatccgattcgggtgtaatgcaaaaattgagacgaaaactaaaatttttcgggttttttcccatttttttgctgtgattaatttttatttgcttaatcaggtgatgtccaatgtgaatgtgagcaacctgctcaagtgtcagttcattttgtgggcttgggacgtttcgttggcggacaacaaaaagcatttgttcgattggttggagttggccaacctgaccgaagtgtccaactacatcaaaatggtgccgcgttccaaatttccgatgcttattgtgctgatcaaggagcgtgccgtgatctcgcgcgcctccgccattcagg

SEQ ID NO: 77485 - DNA, 875 bp, Heterodera glycines
  Genomic contig location: Contig_ID=SeqID_13586; Location=403..1277; Strand=+
  SCN-specific regions: Sequence locations=1-299,342-482,504-875
atggctttgagtttggaagctaagagacatatttaccgccgcgagtttaattcgttaataagggtgggtcgtcgtagggtcggggggggaggggtcgtaacggaggggcaaaaaatttttattgagaaatttccttagcgaaattcaattaaggtggccgtctccttttgttcgactatttccaacactttgcattttcttccgacgaaattcgatcgcaaatgggcgaatccatttctcagaatgagcacccttttctgggcattgccttctacaatttgcacccttgcaaagtcgagaatttaattcttttttatattttagtattaatgatttttaaagcctttaattttcggtaatttaagggcaatgtgcgagagagtctctgttttttgtgcccaaagcaaaaattgtcattttttgatgaaactctgttaacaaattgcattaaaaattccaaaatgttttaagtactctcgaaatttaatttcatattttttcaagtattcccgaattatttgtagattctcgaaatttttaaaaatgttttcaatttttgaagaattttttaaattggaggatggcaattttaaaaaacgagccaacacggttgaaaaacattgattcttttggttatattttgggaaatttcttttgaacagcaaatgcttttgatcaaaatgttttcttataaatttgccttttttcagacttccgaactgatgcgatcgcttaagccacgcaattttgtcctcaggtcgtcgtttatcgatcatttaaagcaattatcaaattatttatcctctccctttcagtttcctttcaacgatcggttcgctgttcaaaacgaattggccattagcactttttactaa

SEQ ID NO: 77486 - DNA, 2410 bp, Heterodera glycines
  Genomic contig location: Contig_ID=SeqID_2043; Location=976..3385; Strand=-
  SCN-specific regions: Sequence locations=1-85,108-583,608-867,889 -1231,1253-1701,1723-1801,1823-1846,1868-1880,1902-2410
atgcaatcgatcgtggttgccagccctggcctccacccttatcaacgacttttcaaacgacaattcggggcagaattcgatgaggaaattcagccaggcatggtggtcatggtaggcaaagtccaactcacacgcccttcaaatttcaaagtttcacaactttacattttgccagagaaaagtccatttttttctggtgacgaaagatcggtctttaatccaattgtggccgttgaactcaacaaagcaccatttaattatgaatttccctttcccccgtcccttcccaatatccgtttcagcgaaggcgttttggcagcagcaatttcagcgtgcaccgatcgtttggaagccgattatcccatttcacaattagtacagtgccagaagtgactcattctaccacgaactcgttcactgcatggatttaccaatggctggagacaaagaagcaactggttgattatgccaaacgatgggaagaggatcaaccactgcagatgaagctctcaaaagcggataaagccaagccctgcgggcatggttttatcattgagaattggcgcgagaaattggaaaccggattttatttaaaaattaaaattttcatgtcttatcaggatgccaaaaaatacgacgcgtatgaggactttctgcgcatccgagacggaggagacgaaggcgaattccggcccatgcagtcgttggactcattaaacaaaagggagtttcgatttgttggccgcacgttttcagattgggcctcaggcgacatggacgatgcccgaattggacaagcactgctcggccttggcgaaaaactgcctgttcaaggactcacttgggacagcttgacgcaacggcacccggcgctctcatctctatgcgaaggacaacaacaaaccgcactgtttatgatggaccccatccgacgattggtcttcatgcaggcgccgccagggaccggaaaaacgtattgttcagctacaattgcggcggccatactttctgaggatccggacgccacagttctgtgtgttgcgcccttgaacatcgcaactgctcgtctctgcgaagaaatgcaaaaagcattgcaaaaggcaggttctgaaattccccttttggcacttttcagcggaaacggaaaatatcggtatgctgtgcacctccaaaaaatttcaaagcatttgttggcaaccgcagtgagtggcccagatcttcaagaagctcttaaagatgggctcgaaaagaagaaagtgtcacggtatttggagcaatgtgccgcaaatccccgacagactgacgaaggaacggttgccaaaatttttcttggaattgaaaaaggcgtgcactcttttgcaccctttcacttggcgaacaaattgcgcccatttttgaaaatgtcagccacataattttagatgaagccggacagcgccctattcccaacttttgtctttcctctccttatttagatcaatcaaaaaggtcctggtcaccggcgacaagtaccaattgcacgtaaacatgatggaattgccaccagcagtgcaccacggattcggacttgacaccgccatcatcaactttgacaattcgctcccggttgactcaacaaccctcacaacttcattcagatcgcacccattcatcacaaaatgcattgaggccgggacatatgccgataaaggggaaaaaatcgctgcaggacgaacggaggacgaaatgacccttttaaccaagaacagcaacttcaaattgcccgtaaaaaattcgccgctgctgttcatgcacatcactgatcagatggagcaggaggaaacatcattctcgtcaacgaatccacgacagactgatgccacaattgctcttttacacattttggttccaaatttacaaggcacaattcgcgtggtgtgtttgtacgccggacaaacgctgacattgctcagcggtgcaacgaggaaagcattgaggaagtgatcgtcaccactgccgactctacacagggatacgaggccgatttgacaattgtgacaacaacattctcgttggaccaaatgggcagccgctcacggcatttggattttatatgggaaataagttgccatacttcactcaaaaaacttcgggacccattaatcagccaaatcaatccccctctccctcccattttcaagcatttccagcacagaacacatatgcttcagcagccggccgaaacagcggacgaacattttacgcgcgaggtgccaatgcccaacaaatacaaggcgtttgcttccgatgtcaaaagaaaggccacactgtgcgaaactgccccaatcgattcgtcggcgagcgctaaaaacaatcacattaccggcacaccaattgcttcctcgcttaattcttttcaaattttaataaa

SEQ ID NO: 77487 - DNA, 661 bp, Heterodera glycines
  Genomic contig location: Contig_ID=SeqID_2044; Location=1384..2044; Strand=+
  SCN-specific regions: Sequence locations=1-284,307-313,335-583,643-661
atgcctatgacacggaatagccctttccacggtaagtggtattttttggatgttccaattttggcgcaataatttttgaaaagtacccgatcaccaattttaatatccaatcctctgacatttttgtcatactgtattttcatgcgtagttgagcctcgtggctttgttctgctgcacttttccaagcctttctcaaacaacttatcaatcgttgtttgaattcagactcgtctgttattgcaatcggatttgggactctagagtccaaaatttggtctactgcaaaaattggatcccttccaaaaacaagaaagaaaggactttccccggttgattcatgaactgaggtattataacagaaattagcaaagtctaaaaaatcatcaaaatgtgggtcctgaggtgaaatgtatttggccattatattatggaaggttctaaaggtccgttcagttatggcattgccttgtgagtaatgtggagtggcaaatttttggtttatgtaaagaagtgaacaaaattctttaaagaattcagaagtgaaagaagttgcctggtccgaaattaattcagtacatccgccgaattttaaataacaaaaaccagtgacctgagggaaatgggaatgtaaatgcgtgggggcgaattttgaattttaaa

SEQ ID NO: 77488 - DNA, 1404 bp, Heterodera glycines
  Genomic contig location: Contig_ID=SeqID_2044; Location=822..2225; Strand=-
  SCN-specific regions: Sequence locations=1-200,260-508,530-536,559 -980,1002-1160,1183-1290,1312-1404
acacactgatggcaacacttacgaagtgaacttggtggatgaacaaagagacgatcccgaagccgccacatatattgactttctttcaactggcgaatttcctcctgattttactgacgaagagaaggacaatttggcagcacagtccgtaaatttatatttaaattcaggaattctttattttaaaattcaaaattcgcccccacgcatttacattcccatttccctcaggtcactggtttttgttatttaaaattcggcggatgtactgaattaatttcggaccaggcaacttctttcacttctgaattctttaaagaattttgttcacttctttacataaaccaaaaatttgccactccacattactcacaaggcaatgccataactgaacggacctttagaaccttccataatataatggccaaatacatttcacctcaggacccacattttgatgattttttagactttgctaatttctgttataatacctcagttcatgaatcaaccggggaaagtcctttctttcttgtttttggaagggatccaatttttgcagtagaccaaattttggactctagagtcccaaatccgattgcaataacagacgagtctgaattcaaacaacgattgataagttgtttgagaaaggcttggaaaagtgcagcagaacaaagccacgaggctcaactacgcatgaaaatacagtatgacaaaaatgtcagaggattggatattaaaattggtgatcgggtacttttcaaaaattattgcgccaaaattggaacatccaaaaaataccacttaccgtggaaagggctattccgtgtcataggcatagaagggatgcatgcaacaattgttagctgtttaatccctcaatcaaaaccaaaaagagttcatattaatcaattaaaaaagtgctttgatataacaggtccggcatgcacccttcctgcacttccgaaagacgaacaggaaactcttcaaaaagcagatgcggaggagatgaacgacctgcccggctacgatcatccgcagcaagcattggaggcaaaacaaactgatgaaccggtcaatctggggttaaacgaggaaactcctcttacaaattcggaaaccatttctttaaaaacaaatccgaacgattttccagttaatgaaaatgagaattttaatggccgtgcccttagggaccgaaacaaaataacaataccaaaaagatttaggtcagatttttaatcaattacaaatcaggacttttgataatgattttaatcaatttaattaattttaatgtttcattttccctctttcaggatgcaccgacggcgccaaacatcgatgaatcaatttccagctaatcaattcctaatgcttattacgtttttccgaccataa

SEQ ID NO: 77489 - DNA, 3213 bp, Heterodera glycines
  misc_feature (39)..(39): n is a, c, g, or t
  Genomic contig location: Contig_ID=SeqID_2045; Location=1..3213; Strand=-
  SCN-specific regions: Sequence locations=1-595,617-1326,1360 -1366,1388-1768,1790-2582,2605-3213
agcacaagtctaggccattctgaaaattcaccaaacctnaaaagcaaagccaaaacaacaaattgggaaggcattggacccaaattaaccaaatttctttgtctgatcacaattttcttgcctttggtgtcatcaaattcaccaaaaattccttcaaaatctcctatggcattattgccgattaatccgatggtatgccagacttcccaaatgggaatgttatggtctattcctccaacccgaggatgtcctcagatttcactgaatcactcacaagtcccaatatttcggacctattggatttactatccaaacgttttcgaacatttaactaaggcatgggcatgccgaaaaataagaaaaacggttcaaaaatatacgactctcactggtgttcctatttctaagacccgtgacccaattgttctggaaatgtcttataatgagtgtgtccaaatggtcaaacaaaaaacatgtaaaataggccctctaatccatgagtcaggattatggcacacaaatcaaaaaattgatctcaccccacggggatggttcgtcggttcatggaattggaaaaatgaatccaatgaaaattgttatttatttgaaactgaaatcacttccaaatttggtgaatcatttattcacactcctttaggggattcatcggattgccctcatcagaaagggaaatgtcttctagaagacaacacactgataatttgggagccctcagataccaaaaattgtgagtacctttcgtggggacctaaaaaaggtcacattatggacaatatttggatagcaatggacgacccacttttactggaatttgcaccaaacccaaaacaaatcaataattgcgataaaattttaaccctttctctccaaggttttgcggttggatatcaagaggaacccgagaatcaccgaacaattcaaaacagtggaattaaaacttcacgaagtaaaagggcttttgagggactgatcacggactcacaattgcagtccgaactttcatttttaagttggaatatttctaaaacattccaattttcttttgagcacgccctttcctccttatgtcaaaaattggaagagattaattgttcctctcgaggatatcaatttccaggccaatgaatgttttgaacatattccattgaaatttaaggttgggggaaccgaaaaatatgcatttttgaataccataacgatgattattgttcctgactcaagaaaagccccttgcgtagaatttagaaacaaattctgcacattggcaacgaatattattctattgatcaagtcacagcagtcatgaaacatattaaaaatattaatacaattaaaagtctaaattttgaaattgctgaaattccaaaaattccccattattcgtttcatcacctggtaattgcaaatgttactgacattttggcccactcttatgccaataatttagttaaagtaagccaaatttcttaccaaatccacaaggaagaaacaattaccaagattatgcctgccaaggaatggatagacatcaaaaagaaattaaccgaaacattccttggtgatttttctgattggttttggaaaattgctacagtattaataataattttgtttgtcgattttgttttacgatggtactttgtgatcaaaaatcaatattcttctaatggtaacgcaccaccttcgcactttagaaaaggcccaaattcctcaaaacgccttagtgttcataatgaactgatctttacccaaattaagccattaaataacccttccgatcattccaacactttaacaaataactcagacaataatccgaatcttttacaatgtacaaataaaccagtcaggtgcctaatggactcaggatcgagcatcactgttggcccacgttcgatcgcacatcagctcaaatgcaaagtggaaccgacatttcttgaagcaattagcgcatccggacatctgatggtatgccgagaaaaagcagacgttgaatttgaattggtaggtatcagaaccaaaataacattatattttttgaatgattccgaatttaactacattcgtaattaccaaattttaatcggattggacacctttgaaaaattacctgtaatttcttttgacgttgcagcgcgtaaacttattattaatggaaaaagcactccattggggaaatcctataataatttagttgagaatttaagaattgcagctctcaaaaattgcactttaggaccaaacagccaaaacttaattgatgcacaaattgaggccataattccatcaatcaatacaataacagttaccaatcccgagtctaaacttattcaagcgaatgtaggcctaattccatctgtctcgtgccctcacgagggtaaaatacgcattgccctcattaatccgaccagcgaaccaattttattatacaagggcatgcacttagcttttgttaatgagttacaagaaaatgatggcattttaacagaacgtccgatggaacaaattttgtcgctcgataaaaatacaaaactcaaaattgatcctacttttaaagtcgatttttcaaaatcgaatttaaaaggagatgaccttaatgcgttaaaatcgcttataaatgagtttgatgacatcttttcgaagagccaatacgacttgggttcttttacaggcggggaacataattttcttaccacaactgagtaacctatttcttctccccctcttagaatgccttataaatatagggaggaactcaaaaaacacattgatcagcttttagcctcagaaattatggttgaatcagatacaccatgggtgacccctttcgtagtagttcaaaaaaaggatggtgggatccgtccttgcttagattttagaaaacttaatgacgttacagtacccgacagatacccattaccaagattggatgccatcatggaaaaaaaggaaattgtagtttttatagttctattgacctcgcctcgggctatttacaaattaaattaggcgatgaaacgtcttataaatgcggggtaataacagaggataatgtttatcagatgaaatatctccctttcggcttaaaaaacgccacagctgccttctcgagggcaatggcagttgtgcttagtggcttagatgatagctccttagcatatgtagatggcatcttagactgttccaaaaatg

SEQ ID NO: 77490 - DNA, 429 bp, Heterodera glycines
  Genomic contig location: Contig_ID=SeqID_2046; Location=119..547; Strand=-
  SCN-specific regions: Sequence locations=1-429
atgagcggcggagaccaaaatgacctaagcatttcggtcattgatcggaatttttgggttggcaaaacccaagtgaaagtgaatgacgttgaaagagcccatctggatgtcttaaggttagaagacggaatgaaccgagcagttaggacattaaataggcgcactaatcaaaacactgaggcaattaataataatgcagctgatattaatttaaatatttcaactttacaggcacaaatcacgactttgacggatcaaattgtgaatccaacaacggggacaaccaaaggcactggcgtgagcaaagcatcgacacagtcagtcggctcacaacgcaccaacacgatggcaccgcaactgaacgttcctccacagaatacacctgcattggccgaagatgaactccaagggattttcgcactcacttca

SEQ ID NO: 77491 - DNA, 246 bp, Heterodera glycines
  Genomic contig location: Contig_ID=SeqID_13591; Location=362..607; Strand=+
  SCN-specific regions: Sequence locations=1-122,146-165,192-246
cgctgacccacaaaatgtccagcccacgaaatgtccaagtctcgaatttgagtttttattattcagatgggcctaaggttaggcaaggggtaatataaagggtatattcgtattcagcgaccccgaaaaccctaaaaatcctaaattagactcattttgtttttataaattttgaaaaattttggacatttcgtgggtttttactcttttggacatttcgtggcttggacactttgtgggggtgcc

SEQ ID NO: 77492 - DNA, 730 bp, Heterodera glycines
  Genomic contig location: Contig_ID=SeqID_13592; Location=1151..1880; Strand=-
  SCN-specific regions: Sequence locations=1-223,245-366,388-730
atgtctgaagccgacccgaattttgtcaaaagtgaggcgatcagcaacggatcaagcatttgtgccatgagttccaacaatgcgttgactgaaatgatgcggcgtgagaagaaaaaattgttgggaaacgtcgatgtccacgggagcagattgttcaatattcgttgagcccgctatcgacttcgatagcgccttcaggcaaattctttaatcaattcatccgttttaatttaataaaaaaattcagttccagcgtgggaggacgaaatctttcgggcgccccacttcccaatcccattttggaacatgcactctcaggccacgtctgccctcgctcgtacaaacaacggactggaagcaactcatcttcattttatggtctttaattttttaaaagcaaattgaaaagaaacatttagaaaggcctctgtcaccaccccgccctctcggacttcatttgtggggttaatgaaagcatcgacagacaggtggacgctgcccgatctgctcgccatttcattcacaagcgacacaaacgatacatcctccaggatgctgtcattttgcgaattttggcggacgcgtcgtacaacaacaacggtgacatccatgatcttatgacggcgctcggtttacaaattgagggatatgcaggaaaattgaaggatttcgagaattttgatgattcaattgtccacgtcgtaaagaattttattgaatgtttaataaa

SEQ ID NO: 77493 - DNA, 129 bp, Heterodera glycines
  Genomic contig location: Contig_ID=SeqID_13592; Location=67..195; Strand=+
  SCN-specific regions: Sequence locations=1-28,51-129
aaattgtacaaaacttactagttttttgaaaaaaaaaatttaaaaaaattccgacttttcatcaaaaatttcggaagtcggaattccgaccccaaaaatgtcggaaaccggaagtctttccgtgccata

SEQ ID NO: 77494 - DNA, 639 bp, Heterodera glycines
  Genomic contig location: Contig_ID=SeqID_13593; Location=384..1022; Strand=-
  SCN-specific regions: Sequence locations=1-422,444-639
atggaattgcctaattcaacattcgattttgtcggtggcattggtcatagattaacgcatttaaaccttcagattgacttcagctcctcagcatatcctcggacacaacgggtaagctctatcattggcatcatgacagaagcattggcattttgactaccaataagccgacattggtcaatcgacaatgattttgatcaccaccaattttcagttctgatcactctatccctaatttgttcgattacagacctttgaacttttcaagttccaaatgtcggacatgcttcagccggcccgggcggtcgagctggagcagaactttcaccgctttttggccacaacacctgagcttggcgagctgttcgcgcgtttgccctcaagagttgtttactatccgttgatcgccgattgctataataggcaaattgatcaatttgtttacctatttctgatcagaatctatttgttgccctcaggatcttctatggacgatcgaagcatccgatcaattgcccgggcccggtccgctgcgaattgccctcattgcctggactcaaatgtgccgtgggcagacgtcgctatgaacattttgccataaaccgaaatttggtagggggcctataagcagaaaataaa

SEQ ID NO: 77495 - DNA, 150 bp, Heterodera glycines
  Genomic contig location: Contig_ID=SeqID_13594; Location=181..330; Strand=-
  SCN-specific regions: Sequence locations=1-150
atgggaagaccccaaatatgtggtgaagccgggcaatgtgcaaagcgtttggctgcattggcccggaatcatcagccgaggccgaatgtacactgtgccggcggagcagaatttcatgctccactttcgcaactggagcatggtactacc

SEQ ID NO: 77496 - DNA, 858 bp, Heterodera glycines
  Genomic contig location: Contig_ID=SeqID_13595; Location=167..1024; Strand=-
  SCN-specific regions: Sequence locations=1-858
atgaagcacacaaagaaaatggtcatggttccggaaaccgaatacattgcgcttatgaacatagtgaagagtatgggtagccgaggcgatcctatacaagatgaaaaaacatcattagactcaaatatacataaaaatttgaatgataaaacaatcggagctgatattaaaatgaaacgacactcttggctgtacaaacggagacgtcaactcaaagagctgatggaaaataaaccacagaaagtgatcatagaaggaaacccgagttctgcaataccaaacgttgctccatatatgggaattcataaaataccaaaaatagaaacagccgtagaacaagagaataagcgtcagccgttacgattaataagagcatcacgtaaaaagaaaagtgaaaacgtgtttgaatcctcggcagattattcttcggctacagaatgtagcagtagtacgccaatacgttcccaagacgtaaaattaagtcagaaaaatttttcaaaaattatgaatattattggaaaaaatccggacaaatttggaatcgatatgcaatcaggacaggttttgactaattttaataagccagtcaccggatcgaattatactgaatcactgaaattattatcaggtgaagatatttctctgcctagaggtcatacattttttgttcaacgtttgaagagggaaccggaaattgcaaaatacttatttaatttacaacagggtaaaggaaagaagagaagaactaaaagaaaactagtccttgtccaggttaaccctataaaaacccaaggattaaatagagaaaaaccgccatttaaaccagattatgggcaaaactatagaaagtcaacttga

SEQ ID NO: 77497 - DNA, 357 bp, Heterodera glycines
  Genomic contig location: Contig_ID=SeqID_13595; Location=2339..2695; Strand=-
  SCN-specific regions: Sequence locations=1-195,218-276,298-357
atggagaaaaatatacaattatcggttgataaagaattggagcgtgaacctttaccaccgccggaccaacaaatggaacgcgaacaaccactcatacaaccaaaaatcgaaccgcctgatgaagatttcccacaagaaaaatcgtcatcgtttataccaacagcccctcaaacttttgaaaacgatttgtcatgtgagaaatttccaccacttgccaaaatatccgagtccgacccgcagactctttttaaaacagccaaattgacaacagagtggtcgcagaaggaaacagtagaattatctggcagttcggcagatttaacacaatggctcgaatacatcatgaaacccgaataa

SEQ ID NO: 77498 - DNA, 744 bp, Heterodera glycines
  Genomic contig location: Contig_ID=SeqID_13597; Location=1118..1861; Strand=+
  SCN-specific regions: Sequence locations=1-744
atgctttcgaatttggcatttattttgtgcctttttaccggtgacgaagcgaatgtcgacgcgattagcggagaagaagaaaatgccatcggcgagcaccgacaaaagcatggcgatgaacagagaaatggcgaaacagaaggtggacggggcaaaacaaggcgcacaaacgccggtgcaaacggcgacaaacgcagccaattgggagagaaggatcagcgaaaggacgaccttatgccatcccctggggacgaatgggatgatcagagacggcacaagcaaatgtcatccccggcaaagacatagcaaaagagctaacaaacaaagggtggaccacatagccccccccccccaggcaacgtcattgatcccctgggggcaaatggaaagaccagcagagatggccaatgcttttcctaccagaatcggtggtgctcagcttctccagctgccccgtcctcgtcgacatggttctgaaagtgaatgccatgccgttttttgctttgttttgccgtgccctctcccacccgaccagcgctctttcgatgactaatgccgcggactcgtcgaatttgtacatgcaatggagcggcgcttcctcgtaaaagtcgcccaccgccaccacatgctgaaaaagaatggcaaacgaacatcgaaaggcaatttgatcagctaaaacggagccaaccttttcggcacgaatgcaatcccaccaaaggccgtgctaaagcaaaaaatggggga

SEQ ID NO: 77499 - DNA, 637 bp, Heterodera glycines
  Genomic contig location: Contig_ID=SeqID_13598; Location=134..770; Strand=-
  SCN-specific regions: Sequence locations=1-128,158-209,232-637
atgaagagaagcgcgactaaaaacaactcatttcacttttcaattatcttttatctggcattaattggaacagccagcggagcaggagaaacttcgaaaagcacaaagcaaaaaagtaatttaacagaatattttattcaaaaatagtttttctaatcattatcaattaatatgtgaatatttttgatcagatgagacgaatttgccggtggaaattgaaaacgaactcatcacactcacccaaattgtccaagagtcaaaagatgatcgaattgccgatttattttcatgggcccttaaaactcaaccaagcataagagctaggacttttgaaaaattttgtgatgaacgaaaaatcactgagggaaaaacgacggaagaacgcgtcaaaaattgcgttatgcaatgcattttggaaaaatcaattccgttttcattccacaatgccgaaaacattgccgatttgctgaaaatgttgctgatggagcgcaaaaatttgttagcccatttaatgcacaaggaactaatggggccggaaatgaaggtaaacgatggcggaatagcctatttattgaatttgaggccccttattaaataaagtcagccctctctcttcccgagagggttcgaaaataaa

SEQ ID NO: 77500 - DNA, 1387 bp, Heterodera glycines
  Genomic contig location: Contig_ID=SeqID_13600; Location=437..1823; Strand=-
  SCN-specific regions: Sequence locations=1-60,82-477,511-550,591 -781,805-836,858-1004,1026-1040,1072-1104,1161-1180,1203-1207,1229 -1387
atgtgtgtgtgtgtatggaattgttcaattggaggattttttgtgcgcagaagaaagcggtcgttgggtgtactgcttgaatcggaaaagtgaattcggtcaatcaccgattttcgctgattaacgattagacatgaaaaaaaatgatcaaaaaattgtcgttttatgcaatcaattctttattttagtttttttatttttgatgaaagcttcggattttccgaaatttttttggacgctaggactaaagcgccgctataaatcaaagccatgggaggttcatttttaaaattcttgtatttaaaaaaaacttttatattgccacggtttaaaaataaaacagcaaaatccgggttaaacatttatttaaaatccccgaatttatcgataaaaaacaaaaatacatatgcaattttctggaaaatgaatgaaataaaattgccaaattctaaaaaaaaacaaaaataagttcataacaattaaatataaattttataattattttttattccattgaataaaaactgatcatttccacgacttgaatctgaagcaaaacacaaatattattattatcattattcattgatcaaatcattggtcgggaacaggaagaagcatctgatcaagctttccgcgcgcattgttttttaacattgggaggcccttaaatgcgcccaaaaatcgcgcaataatttttcattgataaggctaattggggggggggggggtgatttatttgttgcccaaggcaaatgaagcggaaaaagccttttttatgaataaataattaatgtttttattcgcaaatcaaatcatcacaacacaataggggctgtgctgtgtttgggtgcgcgttttgtgtgctttttttgcatggcgagattaatgatcaagctgatcaacacagggagagatctcctaaaaatgtgtatttgtgatcgtgagttattgtgcagaatgatcagagaactcaaaaccagattttttttaattgaatgaaaaaagggaaaaactcatttttcataaatttttgatcgaaattttaaaaaatatcaatttaaaaaattagctattttagtggaagaaccgccaaaatgaaagaaaaaaaagataaatttattttaatcaaaatttttattaatttatattaataaaaaggtgtaattataaaggaaaactgcagcttctgcagaaaacggttgaatgcttctttgtattttgtgaatggatctcggttaacgggtcaattcatctccgaaaaatgcgacagcagcccattcattgttcacccaacggatcattaatgaaatgtttttcaattaattggttttatttaattgctttgaaacagatttatctaacgggcaatgaaaagccgaataaa

SEQ ID NO: 77501 - DNA, 565 bp, Heterodera glycines
  Genomic contig location: Contig_ID=SeqID_13600; Location=1911..2475; Strand=+
  SCN-specific regions: Sequence locations=1-88,110-243,265-269,304-565
atgtatcatacagtaattttactgatcatttgccatctacttcatacagtaatctcgctggcttctgtgctcgtttcatcgccgtttgataatttccgaattgagtgcccacagtcatcgggcgcacaacggttgtcaattcgtatggtcgaatcgcaaggccagaagcgccaggacactgtattcgtgctcagttgtcagcacattgttgaggtaatgtgtagtacggtatacggtagtttacagtgagaatgggtggcagcttttccaaaataattaattattttaaatttcttaataattgcaaatctctgtgaaatgtgcaaatcaggagtgggtttgaggcttactgcaccactcttcttacaaattaacacaattttttaaaattaatcattttgctaaaaaatttagaaataaaagaggaaaagtgcaaataattttaattgctaatgattaagtcccgctttacatttgaaatcatttaattcttaatgtcatcattttcaaatctattaaaccaaaaagtaattagccgattatacaatattttaaattcatgaaa

SEQ ID NO: 77502 - DNA, 258 bp, Heterodera glycines
  Genomic contig location: Contig_ID=SeqID_2047; Location=97..354; Strand=-
  SCN-specific regions: Sequence locations=1-258
atgtcggtccgcaaaagtcggtccgcaaatgtcggtccgcaaaagtcggtccgcaaaagtcggtccgcaaaagtcggtccgcaaaagtcggtccgcaaaagtcggtccgcaaaagtcggtccgcaaaagtcggtccgcaaatgtcggtccgcaaaagtcggtccgcaaaagtcggtccgcaaatgtcggtccgcaaaagtcggtccgcaaaagtcggtccgcaaatgtcggtccgcaaaagtcggtccgcaaaagtcg

SEQ ID NO: 77503 - DNA, 1612 bp, Heterodera glycines
  Genomic contig location: Contig_ID=SeqID_2047; Location=1600..3211; Strand=+
  SCN-specific regions: Sequence locations=1-340,370-464,496-649,672 -893,916-1612
atggcacctcccgccgaaaaaaagaaaaagcattcctccgccgaccgccgtctcatttcttcaactaatgcaaatcaacagaaacagccgttgggttcgcttgtgacatcgtatggaaaacggcgaagtgttcgcgtggccgtgaaaaagaaccgacggtaatgaaattttgaaaattaccaatttgaaatttaattggttttccgcatttttagctgggtttgcaacgacattttgatggacattttccccctttttgatcgtctccaactcggcctcaaattggcactgatttctccacgtttcgatgcgctggtggacaaacattttgatggcacaaacgaattgacactttcgagaacaatcagaattttgaaaacgggagtaaaaaccaaactaactgtacttatggatagcaatctcaacaattttgtgcgatttccgttccccaacaagccgatgcccatcaaaattcgttttcatttacttcgaattgagtaagtcaaagaattattatttattggttttcagtgtcgcagagcccgattctgacatccatttcgacccaatttgaattctgaaaccagattcggacaaaaattcaacaacaatgatgaaacaaaatgcacgaaataaacggagaaaatgatttttaattttcatacttttgaacagcttttgtcgagaattacatttttgtccgaatccggatttgaattgagtaattgggtcgaaatggtgtcagaatctggttcgccgaccctaaaaaacttcaaaaaaaatttttttcgagacctgaggggggggggggggaccaccattactcttatcaaaaacattccttttcaggcacatagaccattttgtcgtcaccttccttcgttccaaccagcaaatttttgacaaaggcacagctttccgtttgtatgtgccattatcctataaacccagtgtgcagccaatttgggatgtttttgtgcgtgaaatttggcccatctttgcgaccaacattcgccatttgcacatttgcgatggccatcatttggacaattttcgtcgtctcatttcgcccacaattctcaccgatctcaatcaattgaattcaatcgattccgaatcggtctttcccgaagcgattattggtgattttgatggaccaaatgcaactgctggtcaaattctgtccaaatggttgcacactccgacaaatgatggccagccgaagcaattgaattgccgaaattattatcacgcatcaatgaccgtccacgaatggctccgcaatttcaaagaggtcaaaagaacactaatctgtttttaatctgccatattttcaattgtttaggcatttctccgtgccaccgcttctgcttgctaccaaattcgtcttgaactttctaagtcaacgcaaattgagcaatttgaactgaagaacgaacggatcggcgaaaagctgacagtggagaaaaagggcgaaaatggacatacttatagtgttgattggctgttaaagcgatgccaaattgggaagacggttcagtgggaggaagaaaagacgacgaacaatttgaacaatggtccactttatactttttggagcttcatccattgg

SEQ ID NO: 77504 - DNA, 866 bp, Heterodera glycines
  Genomic contig location: Contig_ID=SeqID_2048; Location=3270..4135; Strand=-
  SCN-specific regions: Sequence locations=1-13,35-44,66-68,94-379,401 -553,575-866
atgatgcctttttatttccatatttttccatatttcagggttttaaaattttggactcccttaaatcgaaaaattttggaaagaatacaaaaattgtgcaaaaattcttgatgagcaaaattcgcgtaatgtttttttttacaaaatttagttttttgctttttctaagttcaattttttcagtaaataataaataaataggaggtctcaattatgacattctatactcatcagggctgcacgcaattgcggattgcggattacggaaattgcgggatttttggacccccgtaattgcggattgcgggttgcggatttttgggatttatccgcaattttgatccgtaatttgactattggattatttttcgagacgatttcttgtaagattattttttataaaatgaatttttttctaatactgaatactgtaaataaactttatatacccctcataataattaatttaaggcaacatcccccagtccatctgccttggagacaagacaaaaagccgaagttgaagtaaatgaatatttgcgggatccaaaaattaaatccagggtcgatccagcattatactgggaagttaattcacaaaaatggccaatgattggtgccgttgtacggaaatttctttctccgcctgcaacaagttcagaaagtgagaggcttttctcaacggccggtctaatttcagatgacttgcgaaagagtttattaccagaaaatcttgcaaaacttttgtttcttcatcacaatttgcttttaaccggtttctcaattgaatgattttgttttataaatttgctttttaatatgcttttaaattgctttaaaagatttataggattttttaaaataaa

SEQ ID NO: 77505 - DNA, 60 bp, Heterodera glycines
  Genomic contig location: Contig_ID=SeqID_2048; Location=1215..1274; Strand=-
  SCN-specific regions: Sequence locations=1-60
ggcttttttgcttgccaaatgaggcttttgaaaattttcatctgcgagccctggtcatat

SEQ ID NO: 77506 - DNA, 350 bp, Heterodera glycines
  Genomic contig location: Contig_ID=SeqID_2050; Location=150..499; Strand=-
  SCN-specific regions: Sequence locations=1-162,254-350
aagaaaagaacttagcagaagcacgtgccaagtttgaaaaaatcatgaagaaaatgtataataaagcaaaagaaaatgcgacaaaaatggaacaaaatgaaatggagcagaaaatatttctgactggcaatggacagttatttggcatggatatggcacaaacatcatcatcattatcatcatcatcattatcctcattgaccttagcaccatcaccatcaccatcattttcatcatcatcatcatcatcatcgaaatcggcatcaaaaaatgccgatgctaacaaaaattatggcgagaaaaaggacgaactcattttgcatttgctaaactacgaagtggaaagcgtg

SEQ ID NO: 77507 - DNA, 298 bp, Heterodera glycines
  Genomic contig location: Contig_ID=SeqID_13603; Location=1581..1878; Strand=-
  SCN-specific regions: Sequence locations=1-204,226-298
atgatcatttgggcaagggtattttgatttagcaccgtatgatacgaccaaaacccataaaaagcgcaataacttatttaaaaaactcatcgaaaaaaaatcacaataaattgaaaattaagaaattgatggatccggatgagggattttacgacaaaaatgaggacaatgtgacgctggccattgattttacggtggaagaagaaaaagggacaaaaaagcggaaattggccgatggttaagcccacccaatcgctcattttctgttgattactttgattaccatttacaaaataaa

SEQ ID NO: 77508 - DNA, 1115 bp, Heterodera glycines
  Genomic contig location: Contig_ID=SeqID_13604; Location=331..1445; Strand=-
  SCN-specific regions: Sequence locations=1-553,575-597,619-792,817 -1021,1043-1115
atgctaaattcgaaaatttggactttcgagtttttgttcgaattcgcgtccggggttcagaattggccgaaatggataccagattcgtggtaagtgcccccgaaaacgcaaggaacttgttttatgacaataaaacattcactgacgcattttccactgacgcattttctactgacgcattttccactgacgcattttccgggcgccatccagtgttctgagcattgaagaaatgttcggcatttatcagttccattgccatccgaattttcgcggtgtgccaggactttacccgttgaaatttcccactcaaacccgaattcctgacttgaacatttccgtgggaaatagaggcacactcacacttgaaattgagaaattttctgaatttgcacgagagaaagtgaggagcaaccgttacagtgcggccgtgcaaatgaagggatttgagtggaaaatattggcaatacgaacaaaaacggaaaaaaatcaaaaatgtttgggcttttatcttcagtgcgtcccttcgacgaatggtgaaaaatggagaatttttaattgcattaattaattttgattaccaaagatggaaattggagttgcaaatgttctatcacttatcgaattgtttcacaaaagagcggaacggaggatttgtcgcgaaaaatgaccatacttttaacaaggaagagaacgactggggattcaaatatttcattacttttacggtgagtggcagaaaagaattttttttcaaatttgctaaatgttttgtcaaaaaatgatcattttatgtcaattttcaataaaattcaagggcaagggtattttgatttagcaccgtatggtacgaccaaaaaccataaaaaacgcaataatttatttaaaaaaacccatcgacaaaacgaaaaaaaatcatgcaataaattgaaaattaagaaattgatggatccggatgagggattttacgacaaaaatgaggacaaagtgacgctggccattgattttacggtggaagaagaaaaagggacaaaaaagcggaaattggccgatggttaagcccacccaatcactcattttctgttcattactttgattaccatttacaaaataaa

SEQ ID NO: 77509 - DNA, 819 bp, Heterodera glycines
  Genomic contig location: Contig_ID=SeqID_13604; Location=1657..2475; Strand=-
  SCN-specific regions: Sequence locations=1-5,27-205,227-510,552 -767,789-795
atgcaaattccaattccaaatttgtccaatgttttcttggcccttgttcagacgcgtcttttcgactttgaggtgggaaatacgacgaaccatcttcttaatttaacagagttcctaagttttttgaaattcagcaaaaaagaactggaattcattttcaaaagctgagcctgagttgctacatgggaaaaagttaaatttttaatgaaatttggtgttacaatttgattcctttaaaaaaaatttccagccctcaaaattcaaaaaatcagaaaaattgggagaaactgaatataagcaattattgtactttaatgtgtatttacaatattatacattcttaggattttgctcaccaaagtttgcgttacatttgtcaaaatgccggccaattgttcgaatctaaggaatttttacaaattgatcagaatttgctctgtgaattattcgagaatgatcagttggtgatcggcaaggaatttgaaatttggaaagctgtaatttgaattcaaaatatttatataaatactcatttaattaaaatattttttcgtttaggcactccgttgggccgacgaaaagtgccgtcaagatgccatcgaatgttcagcagagaatcgtcgatcagtgcttggcccggcactgctcaaaattcgattccctctcatctcaacggaggatttttcagaaagcatcggtcgaatgaaatctttgaaaagggagagcaaataattattcttttttgcagttccatccagtgcgtgaccggaaaatcggtcagtggaaaatgcgtcagtgataaaaatactttaaaataaa

SEQ ID NO: 77510 - DNA, 521 bp, Heterodera glycines
  Genomic contig location: Contig_ID=SeqID_13606; Location=747..1267; Strand=-
  SCN-specific regions: Sequence locations=1-268,290-348,371-411,435 -439,461-470,514-521
atgaaaatgaatttttatgaggaaaaaaagaaagaattcattgaacgatttgatgaatttaaaagtttatatggccaaggcaaacagaaagaatttgtgaaggaattgggcattggtgaaaagacatttcgaaaatggaaaaaagaattagcgccaaagtaccataaaagtaagtgaactttctgggttttattataagtttttaaattttaagcacaaaataaatattccaatgaggacaaattgagaaaggtcaaacaatatttggaaataaaagaaagaaatcctaaaatcaacaacgaaataattgccaagaaattgggacttggaatttcaacattaaacagatggaaaaggaaatttgcttaattttttgaattatgtgatttttttgataattgtttttgtctctgttattatttcaaagaaagaaaggtgctcaaaaaagaaaattatgaaggcatataaatgcaaatgacaaaattcaaaatttggcataaaaattaattgttattaataaa

SEQ ID NO: 77511 - DNA, 320 bp, Heterodera glycines
  Genomic contig location: Contig_ID=SeqID_13606; Location=1364..1683; Strand=-
  SCN-specific regions: Sequence locations=1-22,44-269
atggcaaaaataaatttgtggcttttaatatttattatattttgcttattttacgaaattaaatccggcaaaattcgacaaaattttgacgaaatatttggcgacagatgggacaaaaataaaagtgaagaaaatgttataaaaaaggaacaaaatgatcaaaacgagcaaaatgaaaactcagcaacagttgatcaaatgggtggaaaaatggaaattgtccaaatgatcaacaaaaaagagaaaccattcagaaatttgatgcaattaaagaaaagttaaaagaaaaaggaaaatatgaaaatgaaaaaagaaataaa

SEQ ID NO: 77512 - DNA, 1067 bp, Heterodera glycines
  Genomic contig location: Contig_ID=SeqID_13606; Location=2182..3248; Strand=-
  SCN-specific regions: Sequence locations=1-109,131-142,164-272,329 -332,355-452,494-516,566-978,1028-1030,1052-1067
agggataaattaattgacataaagataaagattttgcctatttttacaaatgcaattgaaaccaatgctgatctcaagaataatcaggatattcaaatcgcaatccaagttttttttaaaatttattttacagtattttgtcctactccacctcattcacaatgtgatcatcgcgatttcggtgccatcaatctatttgctgtttacattcgcattttggcacaaacagtgctaccaccaagcacacatttcacaagccaagaaaatggttcaaaaatttatataaatttatttttttgaaaaagatttaattttaaatatattttatcaattaggcatttctccaagtgttcattttatcttctatgaattcattggccagtttcatctatgtgcttatgcaagtaatggagctcaaccaatggatgatcacttttacccattttgattggttaataattttaattaaatataattagtaatttctttttttcaattaaggctcagcgttcacggtaatttatcattaaatgaaattaattaaataaatttttaaaaaatttaaggggctccatcaatcgttttccttttgctgaacaaaacaattcgaaatgattgccgtaaaattatcaaaaatattttcggtccgacgaaaattgctggaagaatttttgtgtcgatcaaaaagattttccatctaaatcatgtgtatcctcagcaaaatgctgttatcgttcttccaactcctccaaatcgttactgataaactggcatatttttgggaattttgcaatttttcgtttttcataatccattgccgatgataaaagttttttttatatataattttgtttgttttttgatttaattgaggaagtaaagctttttacaaattttccatattttttttatttttaaccggttttgttttattaggcctttactgtttgtcggtaatgttggacaatgatttaacaaattctcaaatattgtttttcaactaaaattttttaattctaatcaaaataattaaagaaaagttgaatgaaaagggtaaatataataaa

SEQ ID NO: 77513 - DNA, 1408 bp, Heterodera glycines
  Genomic contig location: Contig_ID=SeqID_13607; Location=787..2194; Strand=+
  SCN-specific regions: Sequence locations=1-394,420-1023,1046 -1304,1327-1408
  Gene Ontology: Mol. function=structural constituent of cytoskeleton; Cellular component=microtubule; Biological process=nuclear migration (sensu Saccharomyces)
atgcgacggcaaattcgaattgagaggcctccgtttgccatttcagtccagcctgaccaaaatcgaagagatggcctcgggcgcggcctattgccaactgacggactttctcttcccgacccaagtgccgctcaaaaaagtgaaatggaccagccgatcggacgtggattgggtgcccaattggcgcgtgttgcagcaatcgtggaaacccatcggaattgccaaagtttgaatcaaaatgcaacaaatttggagttaatttgcaggggaggaccaattcatttgggaagttggaaaattggggtgaggggatgcctaaacgaataaaagaattcaaacggatgtcaaatcccattgcatttcagcctgtgcccgtgcagagtcttatccgggccaagtttcaggacaactttgagtttttgcaatggtcagtctcgttcccattcattcgatcgttccttttccctttaggttcaaaaagttcttcgacgcaaattacgatggtcataaatacgactctttggcggcacggaatttcgaagtccgttttgagggatttgggctcaaatgctttaaaatcacttttccattgtcacttcacacacaaagatgggtctcggaaatatattttttatccctaaaatccgtaccattttttcttcccatgtccatcccccctttttttcattcattcatttccaatttcttaggagtttcccgccgctttgcctggtggtagtaaacagcgtgcgcctccgcccattgcgtctgccgttgcggcgcgtcgcgctccgtcgatgtccgccacaaacactgcgcaaaaatacggcggctccgctttgccggcaccttctcagagccgtgcccaaactgccaccaaaggttttttaatttggagataggaaatgatgtcaaataactttttaccccacattacagcagccaaaccgcctgctgctcaacctctcgtcggaccgtcgcccgccgctccgcgccgtgccagcccccgctttatgggctcctcccagcgcccgccctccgccgtgggacgtcatccaccgcaacaaacaaacggcggtagaacgggtggaagcaccggcggaaggccaaaaacggcgagtgcatttgccagcaaagcgacaccgaaggcggcgtcgacggcgacggaagtgaacaatttgaaacagcaagtccaaacactggagacacaggtaagaaacgggggagtacaacgctttgtaaatcttaccatcgtttaatttgcttttagaattccgaagtcactgctaatctggcgattgagcgcgaacgtgcgcagctgatggaacgcgagcggaacttttatttcgacaaattgcgcagcattgaaatcctttgcggcgcctgcgcactgtccgacggcgaataa

SEQ ID NO: 77514 - DNA, 760 bp, Heterodera glycines
  Genomic contig location: Contig_ID=SeqID_13608; Location=514..1273; Strand=+
  SCN-specific regions: Sequence locations=1-50,72-138,160-760
atgggcacaccgatcaaaggggaagagggtcagttggtgctggtggcatgtttcctgggactgtttgtgagtgtctgtctcctcggatttagtgtctcgaatcttggaaaatggctcgagtagcaataaagtttcacaaacagtgtctgattgattatctaaatacaactgttttaataggtccttttaatttcgcctctctttgctcaggttgttccgcttcctgctcaacttcgtccaacaattcaatggccgccgattgtccgttggattcgcatgaccgcggcagcggtggccaaatcccagagaaattggttggtacagaaggcgtcggcagagagcacacatcggtggccaatggccatcgttcgttgttggccagcgcgacactgaccccggcgatggtttcgtcgtcgcaccattccgccacaaattcgccggtccgtcgtttagccgttctttgaccaaagacggagttagcaatttccaacagacatatgtacctattaacagttcaatcaaaatattttcctatgtaatttttcactgttttctaaaagaatttgcttttcttttaaggtgtccgccaatttgatgcccatttttcaccattcggccgccccacaacagcaaatgcttcaacaacatcagtcattcaacgcctttgtcccaccaattccgctgcttaacactcatcagccaaatgcttctcaaattagtaaaccatgattacctttcaacgatattaatcactggaata

SEQ ID NO: 77515 - DNA, 2209 bp, Heterodera glycines
  misc_feature (535)..(535): n is a, c, g, or t
  Genomic contig location: Contig_ID=SeqID_13608; Location=2266..4474; Strand=+
  SCN-specific regions: Sequence locations=1-57,79-255,278-629,651 -2084,2106-2209
atgaatttgtttttcccagcgtcgtctcgtgaacaaaaagataaaaacgatggaggcggcacaacaacaaacaacaacggttcttccggaagcgatcaactgaccggaaatgacccagcaaatgccggggacgcaacagctaatttgcccccgggcgttcctcccgaaatcgctgcggcaataagtggtggcaacgatctctttgtaagtgagggaaaacagcggctaaagtgtttttcaggacagccaattcaccccatttcaatttactctttttgcaggttcacattcaccttggagatgccattgccctggcggtgggcaatgatgttcagcacatccacgggccggcaacgatcagaatggtctcccaatcgacgacgccgcaatcggcgattccgatgaatgttccggaaggacatattgtacagcagattttggatagacaggtgaatgacttcattttcaagtaaataatgactcttttgcatcaattttttccctgcagggcaatctgtcccacattatcatgtcncaagagccccccgccggcgttgggccaatgctcggccaacatgtcattaccgcaacgacagtaatgtcccaaattccgtccgctccatcgacgacggcggcacagcagcgacaaatgggttaccaagtgaggagggcgtcaatgaatttgccaatgacaatttccagtctgttcagctccatccttcggctgccaccgtaccactaaaacatttccgttccaacaattcgccaccgcgttcgacagatgtttcgccgctgaacgatgcggtgactttgtcacggcagaagcaacaccagggaatggccacggattcgggcgctgtttacccaagcggagttgttccattactcaaatggagtgatcttcaacagcaccaccaacagcaacgcgagcactaccaaagccaaagtggaccattcggaaggcagcatcaacagggtcgagggcaccataccgtgccttccccgttcaacgtatacaatttggctgattcggaaaccgtctcttcggccccgcggcattcgcccggtttttatgtgcatggctcgacaactatgggcgggatggacaatgtacgttttttaaaatttttttccctttatttaccatttgaattcattttcagcgtgttggtccttcggaaacccttccaactgttgcatatcaccaaaaccaccagcaacaacactcccaacatcaacattctgctcccggtggtgccgacactttcgattcggtcaatttcccaacacaaatttcgtcagtgattgatgatgatgagaaggaacggctcagagacactctttcctccattcagccaccgattctctcaaaaggtgtgaatattcagatgaattttcttaactaataattttgtacgaatttcagtgactgaccgtgatgccgaagtgatatggcaagtaatcgacacttctgaggctgctgcttccggtggtccgttcccgcaaattgacacctccgaattcgtctacaaattgactctgtttgaccctgtcaaacattcacaaacattccacaaaaccgaggcgggagtgaatgtgttgcatttgcagcaattgaatcccggcactgaatatatggtggggttggcttggctgcgcttcgcttcgtttttcaattttcttttctttttaggtcgctgttcgtgccgaattgcccgaacgcggcatcaacggacacccttcgacctttacttcctttcgcactttgtccacttctcccgaaacgccttcgctgccaaaattggtcggccgacaacagaattgtttttcaattcagtggaagtcacccaattgcaacggagcgccaattctcagttactgtcttcaaatggctaaggttgaaaaagcaatttccaagcagcacatggagtctgaacgattcagggaaagatggcctcatttgagacggtttacgacggtgcccacgagcaaacggtggtctccgggatggacagtggcgcgttgtatcgtttccgtgtgttcgcgcgcaacgaaatgggccaatctgagagttcgcccgttctgacggtgtaccccgagaggagtgacactggcggacgaatgccgccagcctatcaccaccaccatgttcagcaccattaccatgctcaacaacaacaacagcatggcggaatagtacaacgtggcg

SEQ ID NO: 77516 - DNA, 1318 bp, Heterodera glycines
  Genomic contig location: Contig_ID=SeqID_13609; Location=210..1527; Strand=+
  SCN-specific regions: Sequence locations=1-306,417-470,503-589,611 -691,713-1113,1135-1318
atgtcgagaattggtccgcctttgcgcccgacttctccgagttggaggagaactccaaatacgtggagaaggagggcgaatttgatgcgcatgacgaggacgcaagtgagggggacgagaagatggaaattgcggcggtgtgttttgtcattttaatgaaattttagtttttttcttttttttactgtaatctaacgttttaatccaaaggttaacaccgtcttttttgctttttttaaaaatcattaagagagttttttggaaaattacaaaatttattagagaaagatggaagtcgaaactctcataaaaattaaaaaaaaaatttttttttgattatttgtaaattttcaaaaattttcgctcatgtttctaacaaaaaataatatagaaaattaaaaaaaaaaattttttttgttccaaaaatgtggtcatctacactaatatattattaatccacgagtttttcgtaaaaaaaatttaaaatttgtttaaaaaaatacaccaaaaattttccgaagcacctcaacaatcagttaaatgataagaaattttaaaaatacaaaaaaaaatttgccaaaaattatcccgcaggacgaggaggaggacgtgttggacgtggtgcacatcacggtgtccgtccaactttgctcgtccgacgaatcggagccggaagacttttgcaccgacttggaggtgggcaggtcgctgtggtttgtgccggtcggccctgagttggaagtcgctgacgaaggtgggcctttgtgtttgtttgttttttcgagtttttatagcatttagtgctctcgattataattagggggccgttgggcgaaaaaaccacaaattagatgggtcgaattgaggcaaaaaaaaaaaaatcaaattgactcacactggaacttttcgaattgtaaatgtcaaaatcaattttcgatttgctattgtaaaattttcggcttttttgtctctggcccacaaactgatcagaaaaattcgataaaatgaaaaatactaataaaaaatacgttaatttatttgcgatttttcctcttacattttaatgcccatttggtcatggggttcgagccagctcgacagatggtgaattatttttgaatttcttaaaatattatttcagttgactttttttttattcagatcacttttttattcaatttggtgtgtgagtcagggccaaacagccgaattttttgtttaaaagtgatttcaacactttctgttcgaaatgttcctttgtaaagtgaatgacatggcattttttggcatttcatcctccctcatataatggccgtta

SEQ ID NO: 77517 - DNA, 761 bp, Heterodera glycines
  Genomic contig location: Contig_ID=SeqID_13610; Location=158..918; Strand=-
  SCN-specific regions: Sequence locations=1-45,113-179,224-261,283 -349,372-480,740-761
atgattaaaaaggagaaggctgttgctacattttacatacataagtaaaatatttataaacaaatttttttaagaaaattacaagaaaaaaaataattttttaaaattttttcagcgatttttttaaaaactttatgatgaattattgtatttcaaaaaagattccaaaaaaactgctgtaaattaacaattttttttttaaattttcttataaaaaaaatttctaggtgcgaaagcccgggagggggacgactggggtaaaaaatttgtaaaaatattccttaatattccttttttttcttatatttgaaattgcttattaattcaaaaaaataacaacaaaacaacgaaaaaataattaaaaaataattgaagacgaatgccaaacagaagatgtgacaacaaaaaatgtcgtcaatctgtgcataatcattttgattttttttaatttttaagttcatagtgaaatgcttttgcgctttcttattaatttttttaaaattgttttagtatcaattttgattgagttattatattatttttatcattttgatttttttatatttacagttcatttgcaatttttgtgcttccgtattgttttatttttaattatttttattgttgaactttaattcggattttcttatttttattttacctatattttccttcatttcttacacttcattctgtttcatttattattataattattattattttaattatattattactcagttttatataataataaa

SEQ ID NO: 77518 - DNA, 364 bp, Heterodera glycines
  Genomic contig location: Contig_ID=SeqID_13610; Location=1029..1392; Strand=-
  SCN-specific regions: Sequence locations=1-136,173-320,358-364
atgcaaatgcggatgggggaactggtcgccgtcatctgctggcatcaacatgagcaacggcaaaatactgtgaaaaatgcctgcctacgcgtgggatgtgttgtggataaggtcaagcgtacaaaggaaaagccagtttaaataaaaatatttattttaaatatttaatttagcatccatacgaattcaaatgttgtcagcaaaagcaaagtgaatgggagaagggatgcgcatgctttggcatttatatgaaggcacttttggagacaataactgctgtaaagcctgggctatggattaatggaaatgttggctaaacgtaaaatattttaaaacttaatttaaaatcatatttatgaataaa

SEQ ID NO: 77519 - DNA, 660 bp, Heterodera glycines
  Genomic contig location: Contig_ID=SeqID_13615; Location=464..1123; Strand=+
  SCN-specific regions: Sequence locations=1-38,75-126,148-186,209-660
atggcagccgatttgcacattatcaatcagactttttcaatcaaaaagtcaaatttgaaagttgggccaaaattggcctcaatttcgtcgccagggttgagaaaagaaaccgctggttggaggccgtcaattgagtcgacaaagaaagtgggagagcctaaattcattcattaattaacccaaatgattttataattaattaattaaagtttaatgattggcaatttcccactggtcaatctgacgccgttcttcgtgaaaatgatttgtttgctggccaaatcgatgccgcagccgacgatgtcgccaatttggaatttggcatccgaattgaacgatactttgaaaacattttcttttgccaattggccataaaaatggccatcgttgaaataggcaaaagtgccagggaattttccgggcatttgatggcacaacggagtgttttttgtcacaaagccaatgccaatgccaaagtcacaatgggaatcactgtaaaaacatgggcataaaacataaatgaaactacaaaaatatgcataaaatattctccacaaattcaacccaaattttcaaatggtttaaactaagttttcaaaagtgtttctcgcccttttgggcgttttgtaaattcaggaaaggttaagaaaaatgagataa

SEQ ID NO: 77520 - DNA, 1089 bp, Heterodera glycines
  Genomic contig location: Contig_ID=SeqID_13615; Location=1788..2876; Strand=-
  SCN-specific regions: Sequence locations=1-88,110-136,158-582,604 -639,663-702,724-798,824-929,977-1089
atgaaaatttggcgttcttttatttttttatttttgtggttacaaaaagcaatatcaattgctgcagctgatattcaggcgaatggtatgttttaaatttttcagcttttagtgtcgttctcagtcttttcacgaaaaacccccaaaatatggatttatatggactaaaaacagaataaacccaactcatccatacccaattttcttgtgtaaattccaaaaaaggaccaaaacatggacccaaaaagcaaaaattgcaaatatggatttattcctgaaaacccctaaaatatggatttatattgctaaaaaactaatagtatttgatttatcagtgccaaaagaaaatttgataatttttaatatgaaaaatttttgtccaaaagtgtaaattttactgcgtttttccaattttttgtgccttttttgtagtttttgttcatttttttatgtcttttaccttttttgtgcttatttttcgtgcttattttatgtgcctattttaaaaatttcgtgcctaaaagtctggtctcaatttattagattctttgtccaaattatcattttttggattgtcaggatgaattttaaaaaataaagttagttttgtggacaagaggcgctttatttttaacgctaaaaattgaaatagaatttaaaatgttaattcctttagtaacttactattatataaactcaccatttttcagaatcaaatatggattcaattataaggcaactgattgagaaaaatcgtgacaaaattgatcaaatttttgcggatttggtaatttaaaatgttttttgttatatctttttcattggacagaaaaaagagaaagaaaaaagaaaggagcaaatgctttctgaagaagaaccgctgcaaattgtaagtcaatgaatacgacgtttaacttattgacaaatcgaaatttaaaaaaaattaatttctttttatcattttcatttttatttagattagagatacaataacaattgactaccaatggaacacttcggactgtcaaagtgatcgtatgattttgattccaacaattattaaagtcaaacattatggaaaaaagaaag

SEQ ID NO: 77521 - DNA, 1132 bp, Heterodera glycines
  Genomic contig location: Contig_ID=SeqID_13616; Location=646..1777; Strand=-
  SCN-specific regions: Sequence locations=1-105,130-250,343-408,432 -631,653-722,747-752,781-982,1004-1007,1038-1132
atgagcagcgaatatttggcgtcgagggcacagattgtgaccaaaattgccaaatatccgtacgtggaggactaccggtgggcctccaaatttttttggctttataccaaatttttggcacattttctagccgtgcaattctcaacatggacgaggtacgtgtttagtaaaattatattccatttttttgaaagctaatttgtcaccattttcagaagcagttcatcaacatcaggtgagtgtgccagccaaaaatttcttaaattaaatggaaaatttaaaatgaatgaaatttaattaatgataatttatttattttttcaaaattctgaaaaacacttagtcaagcgtttttaaactttcgccagcaatttcgagttccgccacccaaaagggagcaatttaacccaacatcgtttttcccactgaaatttaaaaaaaagtcaaaaatttattagatttttaactatcctgaacggttttctgggaaaaataaaatcaatttcttttccaattttttaaaatttttcagcaaatttgaaaatttatataaaaaatgtttaatgatttatggtcttactaatccattatggaatgtttgaatttgagattatgcatttcaaggatttcaattgacaaaatgctgcaaaaaacactcgcacttttttttggacattaaatttctctcgccccccacagattggtcattatcgaaatgcgcaaccactttgccacgctgtacgacatgctgatgaagaacattgacaagatcaagaagccgcgctcgtcccacgcggagcacatgatgtactaattggacattgggcccccgttaattgattgttggagcggcggcggcggatgggacggaatggtgcgaaaattggcgggtgtttaattgcttgattgatcgacgattttataattgatgaatgatgttttgaaatgatcattatcaatcattattaactaattgtttcttattttccctttcttgacaaatcacacattcattcatccattcatttctcctttctgctgattttctactgtttctatcgtctcccatattttttttgtcaattatttttgttgcacgaagcgccaaaaaaatttgattgttcgtaataaa

SEQ ID NO: 77522 - DNA, 3048 bp, Heterodera glycines
  misc_feature (643)..(643): n is a, c, g, or t
  Genomic contig location: Contig_ID=SeqID_13617; Location=280..3327; Strand=-
  SCN-specific regions: Sequence locations=1-124,146-148,189-220,242 -533,555-767,807-843,890-890,912-1245,1285-1368,1402-1440,1463 -1581,1609-1677,1699-2377,2399-3019,3041-3048
atgggccgaggttggcattttttagcatctgccaaagtccaatttattgccgttggcacacattgtcagggttggacatctacaaaaatgtggacaagttctcgatcggatcccatgtgactggtttttgactcttgaatttattttcgaaaaaaccggttttttaaacctttttggggaaaggaaccaaagccgcgctgatacgaatagcatgtttttcagtcccagctatctgacctgaatttttttttttatgcttggatcctgaatgtcaaacaaaaaaatcatttgcgtacacacggactcgaaccaccggttgatttcgttgtgtggtggtccctgctttgtgggccgtgtgtggcctgctaggggtacgagtccgcgtgcctgcaaatggttattttttgttcgactcaaaaatgactcattgttagaattcggatttgaattcgaattttgccttaccataaaaaattttttaaccggtccatttaaaagggtacaatttttaggaaaagggcaaaaaaatccgaaaaatttgttgaaataattttcttttttttctagaggggtacctccaagcctcgaaactctcaaaccctaaaactctcgttttttcaaggactaccatctgaggccgtgncaagcaacactgatcgaaatcttcaagatggtcaccacaaatgctcctccatcttcataattttttcattttttcccaccattttttatgtgtaatattttaactttgaaaaaaaaagcttaacataaaaatttttataaataaaaataaagtttttaattttgttaaatccgctgatgtttttatgttgcattttctacattattttatttatttattttttttataattcaatgattttttaaacacagaaatattatttaaaagattgtgtgtgccctccaattaaccgcgacaacagcacaaaatgagtgtccccaacaacaataaatcggcatcatcatcgacacacaaaaaggtgccatagaaattatgccaccaccatttaccataattagtgtaaattgagtttttgtttttcagaagattgaggactacaaacaggagctactgaaggtacattattttgaatggtcaagttacaaaaaaaaacattacaaaatttttgaaaactacaaaaattttccgattattgaattcgagacatttcaagatattttaactggggttttgatggctctgcttttccaacagatctcttgaatttttttaaattttatatattcaatgaaattaaaattcgacctgaatctcggtttttcatggatccggatacctttttcggcaattcggattttaaatttgaaactttaacaaaaatgaattgtttaaaatacaatttgttttcccaccttttcaggaagcggagatcatcgttgagcaaaagtaaaccaattttggaatttttggcccatttttccaatttttctctgccccacagattcccctccaaagtggtcgagttcaacgaactgctcaagaaccccaaataccagtacgcgcgtctggccgaaatcaccgcgttgaccgatgtcaattcaatgtaaataaaattgttttttgactaaattaggccttccaaattatgccgaattcacggattaaccctctagggattccatttttttcaaaaattcaattttcatttgccattttatacggacttatgctatatataatcgtgtccagacatttgcatgtccaaaatcgggtttaaatttgagttttttcaatccctgatagcctaaacagcattaaacttaagaaaacattgtcattttggttcattaggactaaaatttggtgaaccctaggcccaaatgtggggtaaccacttacaaaattgtacaaattttaatgaaaagattacatttgaaaaattccccattttttcagtttgccagtgccatgtggaggtgagcaaacgagcggcgatgaggtaagttgatttttggttaaactatactgagattcagttggttcattaaaatttcgaaaatttcaacataaaggtcgaaaaactcggaaaattttttaaaacttttgaaattttgggtattttttccaaattcctcccactcaaattgagaatttttctcttaaatttctaccctttaccccatttgtaggtggccaaaaagttgcaaaaattggactgccaacgtgacacagccgcactgctgaacggaacgccagtttacggatttgcaaaagggtctgtgaattgcaatgagaaattggccgaactcattgacgaactgcgcccactgttgcgtaagttttcgatgttgaatttttgaaaattatgcccatggtttctgtcccaacaatgatgtttttcatatggaaacattttcgggattttgttttttgcggtttgcttagattttccgtccagaaaatttttttaaaagtcgctttttaatttggttcccagatgaatttttccctttttcccgttgcttttttccgcttttccttgggcttcgtcttaattttaaattcccaaatggaacatttttcacaaattcattttgttaaaatttgcaggcgatgccatcgaagatgtcaacaagttggattttggattaaatttttatgcgaaaattggctatttttaagggtcaaagtgtggattcagttcctgatccccaaaattgaggtcagtttgccaagttttttgtgtcatgtcaccctcttcaaatttaaaaattcgattatatccatttcaggacggcaacaatttcggcgtgtccattcaggtgggtttggaaaaaacggaaaattcattgaaaataaattttaaaaaaccgctttttccaggaggaatgtctgaacgaaacgcgcaacgtggagtcggaagtggccggtttccttgaccaggtcagccccagcatcaagtgaaaaaatggggaaatgagttgggactcaaattaatttttcccatgcctccagcatatgtttttattcatgtttaaaattttttgaaaactttttccaataaa

SEQ ID NO: 77523 - DNA, 3047 bp, Heterodera glycines
  Genomic contig location: Contig_ID=SeqID_13618; Location=61..3107; Strand=+
  SCN-specific regions: Sequence locations=1-39,66-178,216-344,370 -455,477-548,586-642,664-842,865-2467,2490-2614,2636-3047
  Gene Ontology: Mol. function=oxidoreductase activity; Cellular component=microsome; Biological process=epoxygenase P450 pathway
atggacgaattaaaggcacgcaaaaagctgagggaaagcggagaacaacagcagcagcagagagcgaaagtcgacttcattgacctgtttttggagacggaacagaacgaacagcagcagctgacggagcaatgccaaaacgagggcgaagcaatgctaagcaaaacggcacttcaggtggggagagagaggaagggggaaggggttggtggcggtagtgaagtcgagagtcttagtctcgaacctctttgactcgagcaaaatacttttcgggatgagcgtttcaattctaaattcgatacagaaaagttcggctctattgcactttatgagtccaatcgaccaaacaacaattaattaattaatcaaatctttttggcaattgcctaaacgctgagattttatatatttttgcttctttcctttgtgctttcgaatgataccaaaaacatagggtttgttcgaacatcaacaaagttattgtataaaaagaaggtattaatgccaaaacgagggtgaagcaatgctaagcaaaacggcacttcaggtggggagagagaggaagggggaaggggttggtggcggtagtgaagtcgagagtcttagtctcgaacctctttgactcgagcaaaatactggggcttccaaggatccgggtttcaattctctaatttgatatagaaaggcgctaacagaaaagtacaattgaatcgtttggtatttaatagtaatgctcgagacgaaaatttctcccgagacagagacttgacttcgagaccgagacccacaaaacccgagacttttctcgagtcgagaccgagatttttaaaaaatcttcttgttaaattaaaagtggattaaaactttttacaaaatttaatcgatttttgaggcttttctaataaacttcttttttgaattttgatgattcaattacatttttatcaattcaccgttaaactaaaagccttttttaaattcataattgaattttcactattgcttatttaaaaaaatgaagaaaggcgccgccggagaaaaaatgaaaaaaagtgcaatggaataattgggtatttaccacgaaaacatttgaaaatagagagtctcgagggtaatttggtgcagaatatcactaattggtgttaatcaaagcagtctatgagaaatgcaacaagcattttcagagagtagcaaagcggtgcactttggaagagattacgtcgcagcttttgatgtttctgcttgccgggtttgtggtattacgaaggcccaaaaaattcccaaattcacggcctcttaaatttcttgaaccaaaaattggttaccgccgtattttctctaattgtctcccaatctccattaatccaccaattacgctaaacgtgaactgtacagcttcgacacaagcgcaaatacgctgagtttggtttgccacgcgttggcccttcacgcggaagtgcaagcgaaagtccaagaggaaattgactcggtgtgcttcgacgaggtgtcgtccttgagaagagaggaatttgaagaaataaattcccgttttcaaggacccaacttatgagcagctgagccaattgaaatacaccgaagcggtggtcaaagaaacgctgcgccttttgcccattgcgacgaagtgaaaccaattagcataatgaggcttaacatatgaagaccttgagaagcctttgagggaaaactatggggcgggccggctttgaaccggcgtctctggctttccgggccagtgggtaaaattgaagaatactagtgcctcaccaaattatcgatcattcgatgcctatcggtctgtaatgcacgaatccgaaagaattttttggcggaaaccactttgggccgagttatggacccgggaccgaagtggccaaatggctgtaggactgaaccatccaaagccttaaaacgcacaaaaatgcaataaaattcgtggaatttgatgaggtactaagtaagtattcttcagtttccgaccagtgttctaccagccgaacgaccgaccctaccctctacagtaccctattgtacttgatagttagtatattgtcaccttaatggtccattaatcttctctcgggtaaacttcattctctatctcgagcttaatgagtcagttcccctgaaaattgggtgcaagcgaaaatggcaccaaaagaagcggattaggataaattaaatagttaagaaaaaaatgtgaaatgttccactttatattagtgattgaaaggttttctcaggcttaaaaattcgagttcaaactttagattttcattgatcgatcaaatttttgaaaatccgatgatcgatcgatcgatcagtttgtatttaaatgaccaattgttaagtgttctgaatcggacgtgctgccacacgacgacattgggcgacataaccgtggagaagggcaccgccgtggtgtgcgatttgctttcgctgcaccacgacaaaaccgtgtggggagaggacgcggacgaatttcgaccagaaaggcacaaaaaaacccaacaaaataatcataataatgggccaaatggaattgaaatggcaaatttgtgcacctttgttcaaacagggggacacattaggcattttggttttggagaataaatttttgcaatttcttaatcaaattcactgagactgaagccaggcaaaagccattaaaattggaagtcgtttaaatccaaaaattgtaatccaattgaaactgttttcaggtggctcgaagcagggcatcaattgccgccgttttacgcgttcggcggcggtccgcgcatttgcattggcatgcgattcgcaatgattgaggagaaattggcattggtccgaattttgcgcaaatattccattgtccaaactgcggacactgaggtgatcaaatggacaatcaaagcggtggtacaatcatttcaaatcgcttacagaaagagttggcattctccggacaattggtgatagcgccaaaatcggtcactgttgggcttaaactgagggacgaagaacggcacggcacatttgagtaa

SEQ ID NO: 77524 - DNA, 973 bp, Heterodera glycines
  Genomic contig location: Contig_ID=SeqID_2052; Location=119..1091; Strand=+
  SCN-specific regions: Sequence locations=1-567,589-897,924-973
gcgcatgcagccttgaggaagagcaccgattggtgaacactgttcgctcgttgatccgcattaagaatccgaatgatcgactttgtttggccagagctgtgttgtttggtcttcacgattggcgttcacggtcaccaggcggaggcggaccgacagcattcaaaagtttcgcaaatcgccagcacacccacgggcctgatgcacgtaacttattgagacgtgccgcaattccccgcaataaacataagtacacaattgatgacgtccaaaaagtacaagattggattgatcaacaatacgggccaggagaaattcgaattgcagtttttgagaaggaacgtgagtaccgaattgtgttcaaggcagcatccggcgaggcagccaagttcaacttgtgtcttttgttcgaaaatcaacacttcaactacattggtcgaattgagcaactgtttcgtgtgcaaggatattgtattgattgtgaacgtcgcgtgacacgctggtaccacccgcaggaatgcaaagtcgtctgccgtctgtgtttacgttttggcgcagggtatccatgtaaacaacaacaataacagcaaccctagcagatgggtcaactggcaatcgtctttgccgtgattgtcaattcgtttttccaaatgacgactgcttcgcctatcatctgagcaatcaggcacccgcaagcatgtataatcagggaggacgcacttttcgcccaatatgtgaatggagaagagcatgccgacaatgtggagccataacctatgcgaattatccacataaatgtccagcccaaattggccaaacggaatgggtgcgctgtgtacgatgctctggaccccatcaaagtggagacccttgttttattcagctctcaaagatgatcctatgaggaggaaaaggagaagaagagggcaacagcatatagctttctaggcaaattctatatgctgtgcgtattgca

SEQ ID NO: 77525 - DNA, 1545 bp, Heterodera glycines
  Genomic contig location: Contig_ID=SeqID_2052; Location=1496..3040; Strand=+
  SCN-specific regions: Sequence locations=1-363,388-868,890-1545
atgtattcctcatcttccgaagaaggcgaaattcacgagcatccacagccaaatcccccagttcaagaatttcatccaaatccacaagcccatgaccccctcccgaaccttcaaccaaatgaaaaaatgttttttgttgctgaaacaacacagcaccgagttgttcttttggcggacggctttgagtacaactttgaagccgatagtcgaatggcggatggtgagattctttggcttttctggcaattttggcttagggattgagatttatcgctgtgtacaccgaaatccctactgtcctgggcgtatacatgtacgtggggctgtacatcataatgccgctggacgaccatacaaaattggaattgtaaaaaatggcaatcacaatcatccggcttctcatgaaactgttcgagtggcacaaatgactttgaggacatcggctgaagcagcaaatccaatgtcaacgcgtcaagctgttgacaataccagagcaagcataccagaaggggtacgagctgcgcttgcaccatcttcttccgcaatggggcggtcctatcgtcgtgaagttgccaggcaacgagcagacgcaggtgacaatttgttggatgcgcaggatcccgacgcaattgtcattggacaaattcttcaaccaattacaatttttgatggatatgttgagggccagagggtaattgtgtttatgtcggaatttggccgaaacatggttcaacaatatggacagcacttgtcgattgatggcacgtttaaagttggtatcccggtttaaaaatttggtccacgttttttaaaaataggtggcacctactccgttttcgcagctttataacgtttcggttattattgattttgctgctgtcccatgtgcatatgctttactaaattccaaaacggcacagcattatcgaagcgtaaacttaagtttagttattttattccatataattttaggtttttgcggccatcaaaaataccatcccgggttgggctcccgtctccatcatgtcagactttgaacagtctgctattgcggcagtaagaggggaattccctcaggcaacacacagtggctgcctgtttcattttgctcaatccctttacaaaaaagttcaaacattaccgcatttgaacacactttttttggcggcaaaccaagagggccatcagacaaaaactcttatcaaaagtcttataagcttggcattcacacccccgggagagccactatacaattatttttgtgcggttattcaccagtttgatcatcatcctgacgtcgaaggtcctaaaagttaatgaaattcctcattgttcgtttatagcattggtccagtattttgttatgaattggattgggtgtaaccgtgtttggcaacttgaacccattccaattgaagaagacccggatttgggtgcttatgggcatgttgacgagtgggtgcgaaatcggatccaaaaccatggcttacaagcaaggaatgcaacttttccacaggaaatgtggaatatgagtgaaaggtcgaa

SEQ ID NO: 77526 - DNA, 300 bp, Heterodera glycines
  Genomic contig location: Contig_ID=SeqID_2052; Location=3100..3399; Strand=+
  SCN-specific regions: Sequence locations=1-265,288-300
atgaggacaaataacagcatagaaggatggcatcaatctttcaacagccaatttcgttttcttcatccaccattaagctattttgtcaaaaagatgaaagcagaagatagtcattggaatttggttgttcaagatttcaacaataacccgcagaacggcattcgtgggcggggaatggcaagaaagaatgtttatgttcaacaagacgaagcgatccgtgctatttttttagaccgagccaaccgtccctttttggcctacctacgcgcaatcgcttacagaatgcctgacccaaactaa

SEQ ID NO: 77527 - DNA, 1014 bp, Heterodera glycines
  Genomic contig location: Contig_ID=SeqID_2052; Location=3475..4488; Strand=-
  SCN-specific regions: Sequence locations=1-553,575-823,846-1014
atgccaaaattggaaactggcccactaattttttccgagtttttatggtcaaaaaccaaatctgatataacaaaaaggaacaagtagaatctgaatatcgccttaaatctgacttatcttttcaacctgagcttgtactgcttcaacttcatgcatgaagttggagctgtacaggctcattgagaacccatagcataaatctaagaccatagttggactcagcgtgcttgatttactcaatattatgaaatcagaattgcaaaacagcgatttccacatgggcttgagctatgctatgcttcgtttgctaggttggcatttctctaatcctgtgtttaatctcactgataataagggttgcacaaattacagatgtgccgctaaaagtagccttagtaacagcataagcatgtaattggaacatccctcataccattatttcatatttctctcatatggcacaaagctacatattctagcgatcagacttttcagttgatcgggtgttttacgaaagaattttgtggtactgtagtggtgctaatatttctataattttgtaaattgtctatttcatcataaacaaaattggaaatattttcgaaacaaaaacatggtacagaaaggaaggttgactttctgcacacgtagatgggctgaattttggcatcgaatgcgtctacaatgcatcagtatttctatttgttacgatgacatactagaaaatgtagaaatcaactattttcagaagattgcgaggcttcctccgatctagtttggcaacattgagttcatgcttctaggtattgcaatacccacagcatttagaatttgccaagaaaggctatattagtgtaaacggataaaaatatctacaaaggttgtcaccgtgactggacaatcggacagtggacaatcggacagtggacaatcggacagttggacaatcggacagtgaggacaatcggacagaggtggacaatcggacagtggacaatcggacagtaaattaaa

SEQ ID NO: 77528 - DNA, 1592 bp, Heterodera glycines
  Genomic contig location: Contig_ID=SeqID_2052; Location=4662..6253; Strand=-
  SCN-specific regions: Sequence locations=1-38,64-281,312-595,618 -998,1023-1592
atggccaaatcgcatggaataacaaaaaatggtgcgatgggaaggaatggaggagagaaagtggcaaatggattggttggtcgggggactataattaggactaattagttcaatttagtttgaacaaaattcgaagaccaagatggtctggtgtgggtaacattttgacacgaaagcgtacttgaaacttatgatttaaaccaaggaattgataaactcttttttccaagggtgtccttgaaaatttttatgggaaatttattaaatctattatcaatcgataggaaagaattttgaaaataaaaaatggacaattttgtgccaaaacttactcatctctaattagtccgtatcggcatgttcttgaaccaaatgacaatgttagagtttgggtaaataattaatcatttcgcattcgcgagcataaacattaactgtccacacatttcagcagcagcagagagatacgatcagtgttttgcatgagcatgttgatgagcagcataataatgaggcgggtggtggaccaacagcaaacgaacaaaacgtgggaatggtaatggacgaacggttggacgggtcgcaggagcacaacggcggccgggacggcactctgccggcgccgaaaaacgatgattggtctgtctcagtcgtccctgggtttttgccagtctcgtatttcccgacccaacctcatcataggcatgagcctcatcagttagctagcaaccgcaaaattcagagagtttatgtgctcgaaaattttccgagattcgcttctaaaaccagctccgctttttgcaaatgccgcggttgcgctcatggatttttatcggaaaaaatggaattttctcggtgaaaatattcaaaattcctcttgctttcctcttttacaataagactccttaacgagttcgtcccctattcttgccgtttcagtgcttttgttgccaccccattgctgcagcaaaggcggcgtatgccgatgacaccttccgccacaacttcaaacaacaacaacatgtactgctccaacttgtcggcaccgccgcctgctcccatgaataatacgtcatctcctccgacaaatgatcaacaaaatggcacttatgagagggtaaacaaatttttaaacgattttctgatcataggggcgaatgtgggggaatatggggcccccgaaaaatgagggtttttaaaacggaaccctcgcatttttccaaaatttcgaaaatttgttaaaggcttttccaagagtggaagtgagggaagagaaggggacgggataaagtaaatattgggctttcaacagagtttataacccgcaaatgccttgtaaatatttcagcagaaaccaccgacaattcgtgtgcaaatggccaacggtgccaatgcgtctttgcctattgctgttgctcccccgggcgaagccaaaccgttggtatggcgccaaaaacactgccaacggcaaaatgatcagccaaatcgttggccgagtgccccaatcgcaccaaaagacgaactttgaacagatgaaaaacatttatttgaccatttattaccaaaaggaacaattttcaaaatcaaataaa

SEQ ID NO: 77529 - DNA, 1556 bp, Heterodera glycines
  Genomic contig location: Contig_ID=SeqID_13620; Location=53..1608; Strand=+
  SCN-specific regions: Sequence locations=1-271,308-787,809-1051,1116 -1322,1344-1387,1428-1556
atgcagacaaaattggagaagaaggaggagcagcacatgaacaagtttgagcaactgcagaaagacgtaattttcaaaatagaaaactcaaaatttatggactcaaatccgaaatttcacactctaaaaactaataaggagcggataacggatagaatactgaattcttagaattttaagcgtcctttatcttaaaggacatccattgaaattggcattaattttggagtcaaagtctgtaacagagctatcgaattaaaaattttaacccaaaaataataaataaaaaattgattatttttataaaccctatcaacgaaaatttcagattttcatagcacatcaacagcaaaatggtaagggaaaatgaataaagaatattgttcctaccgcaacattattattgttattatggcgatttgtaaaaaataaaaaacggctaaaaagacattttttatagaaattattgggcagcgatttatgtaattttaatattaccgtttttatagtttatttgttcgtttggtaatatattcaaattaaagagtttttcatgttttagaattggttggccaaatcaaacaattgaaagacgaacaaaagaattatttggcgagggtcgacgaattggaggaggaacagaaacatctgcagcaggaaaagaacggtaataatatcgaaccatttaatttattctcttggctctaattttatttcttttttttctctaattttgctatttgaacaaaaagaactgaaaaatgctcacaaagaaatgcaagaaaatatgaacaaattggaggaggagatattgtgcacaaaattggacgcggtgggctcaaattatgaagcacttacaaaaatttggccctaataatttaaagctttattaacatatttcaaaaaaatagtaaaatttcaacagaaagcattccaagaagggcttgagaaaaagcaactccttgaacaaattgtgacggttcaggcgaaggttggcaaaatcgaaatggaaaaccaacagcaaaagggtaagggaaaatgaatcaaagtctttaaaaatatgaattaataatttatgttatttaaatacaaattatgaaataatcttttttaaaggcattagataatttctcgagatggtcaaataattaaactattaagtaactagaaatgttaagaatctataaaaacaatcatttttgcaatatttttgatcattgttcaaaaaacatttgctgacgaattgtccactgacgaattatccactaacggattgtccataactgacggattttacttcactgacggattgtccggactccttttattattactgtcaaatattatttttgcttaacaaaatgcaaagaaatatattacataatcctatataataaattaattacaataaataattaatatttttagtttctatcgaccaaatcgaaaagttgcaaaatgaacagaatagaaaaatcaatgcattggaaaaggaacggaaagagaagcatatggaaatggtgaatgaatataatggaaataaatattaaaaatta

SEQ ID NO: 77530 - DNA, 2511 bp, Heterodera glycines
  misc_feature (4)..(4): n is a, c, g, or t
  Genomic contig location: Contig_ID=SeqID_13623; Location=43..2553; Strand=-
  SCN-specific regions: Sequence locations=1-33,78-142,216-360,382 -384,406-1079,1113-1162,1234-1268,1308-1346,1368-1912,1944-2013,2035 -2511
  Gene Ontology: Cellular component=adherens junction; Biological process=regulation of JNK cascade
atgnacgaggaccggcgggaagaagcaaaagcacatcctcatcatcatcatcatcatcatcattgtgatcatcatcaaaaagatcaaaagaaacaacgggtcaattgccgccgttgtttggcttcggctggtgggggtggtgatcatcatcatcttcatcatcataattattgtcgcttcaacaacaccgacaatcaccatcagcagcagcagcaggaagagggggaagagggacagcaagattatttcaaccatcgccgctacaacaacaaaaacgccggcggcagcgatttgtttttcgacggatttgtattgccactaccaccaccgccacttgaagcggcttcatcatttgaacaacagcagcagatgatgatgatggcgaatgggaagaatgattgtgctgctccggatgaacaaattgttgctggagaaggtggagtaggagggcaaaacaattcggcatcggcattgttgtcgccactgtcctctgctgttggccatgatcagcagcaacataaattgggcggcacggatcggcggcacaacatcaatcagaatgccgccgatgctaacagcgacggcacaaaatttgacaatgacgatgcaattgcaatgataacaagcactaagaaggcgaagaagaaagtgaaggacaagctgccacaatcgaaaagcaatgctactaatggtagtgccaaaaatggtggcggcggcaacatcaaaggaaacaaatccccgggtgtggaaaagtcgcgcagcaaatttggccaactgctgcgcgcaatgctttcttcttcttccgcatctcccgcagctgttgggcgagaaaaatttttggcatcgtcaccaacagttgacgacgtgaaaattgatgggaagaagcagccaattggagcggaggcgaatggcacttcaacaaaaagtgccattccgtcctcaaattgtggtggacaaatttgtgaagggggacggcatgggacagagaaggtgttgttgttgctgttgtttgtttgtatttgttaagtattttttgtgtgcacaaatacctttaattcggcaattaacggagaaatacctaattaaaaatttatatatttttttaaataaaacaattgagtagcgaaattggccgcaaaatgttggcactgaaagtgtatacaaataaaatttctttatatactttttaattaaaaaaaaataataattttttattaacaaattgttttttttcattgtgattggggagagtaatttttagaattagaaaatttagacaattttttaaatttcttcaggggacacccatttaatttttaaataaacaaatctagttgaattggcccgaataattaatttaataaatgtttatgttttctcctcagggcactcccgagcacggcagtggcatttacgtgaagaatatcattgagggctctccggcggatgttgacggacgtctggcacccggtgatcagttgttgagcgtgaacggcaacagtttgatcggtgttgggcaggatttgtgagtttttgttctatctctctaatcacaaatcaggccaaggggattcaagaaaaaagggcaaattttgggaattattgttttcttaacaaatttcattaaaatttctgaaaaaaaaattccccggcggcgcttcggcacagccggacccattttagcaaacaaaaattttttttacaaaatttgaactcaaaatgcttcggattctgcatccaaaattttttcttgttattggcctgtatttaaatatttagaaaattaatttcctattttttcagggcagcacaaaagatagtttcggccggccccgttgtgcattttgaggttgccaagcatgcggcgcaagccaacgggttgggcccctactttcatcagcctcatccgaagcaacaacaacaacaacaacaaaacaaccacagttctgctgttgatggtgccgccatgatgacacaaccacttcaaagccaacaacggctcaacgggaatggagcagcagcagctggagtacaaccacaaccacgaatcgcttcttcggtttccagacagtccatgaacggcaactacaccaacaacagcaaaggtggcgtcgtgccggtgccattgtccgtccatccggtggttgtgccgaaacagcaaaagcgttccatgtcagcgtctgagttgctcaacacggccgggggcagcagtagtagcagcaattgtgccatcgctggagccgttgttgtgccaccaccatcgtcgtcgccaaccggtgcccccgttgctgcgtcctcgccttccttttccggcggcactccgtttccgcttgtccgccactcccagcaacagtcgtcctcctccgcgttgtcctctgctgcttcgctggcatcatcgtccgcctcgcggttgcccgcccactaccgtccgtccgtcaaccgtcctcaggtggtggtcatgcagccggcacgccgttcctccgctgccgccgccacatcgccgtcgggcac

SEQ ID NO: 77531 - DNA, 619 bp, Heterodera glycines
  Genomic contig location: Contig_ID=SeqID_13624; Location=58..676; Strand=-
  SCN-specific regions: Sequence locations=1-19,42-66,88-208,338 -547,585-619
atgccattttggttcagcttcagacgaaaaccttctctgctccatgccgttcgatcttcatttgacacaaaaatttgtgaaaaatatttcttcgtaagggacgacgattgggaaagtgttgaggcaacaccacttttacgcaaactcatacggtacctttacatgggattgggctacggtcatttgtggcaaagagttacaacagaagtttattttaattattacaaatcctatttaataaatttaaattaataaattatctgatgttatattttaatttctcaaaaattgaaaaaaatctattttttatttgtttaaatttaaaatgaaaaaaattgcattattttttttcagcattactcggcattttttatggccaaatttatggttcaaatcaagtccccaagggttgttaaaatatagtcactcacgatcactctgaagtagtgttctgatcagggtgcaacagacttttttgatcaacatcagaaagttatacgagcttgaatttttgcagtttttttcgtgctctacaaaaaaagtcgcctgtcttcaaaattttgagtttataattttattaacagcaaatttgagattttacggaaaaaaattaattaaa

SEQ ID NO: 77532 - DNA, 438 bp, Heterodera glycines
  Genomic contig location: Contig_ID=SeqID_13624; Location=853..1290; Strand=+
  SCN-specific regions: Sequence locations=1-80,126-167,314-331,362 -368,390-438
atggtggaagaatgttctgtttgttgtgaattgatcataaatgatcaattaccaatgcaattaaaagaatgcgaggtaggaatttaaagttaaattattttttattttcatttttttaatatttagcattttttccaccctagctgcatttcacagtggttagtttcttaataaaaaaaatattaaatttctaaaataaattttaaaataaattcattataatttcaatttaataaaaatcgaacatatttattataaattgtaaacataattaaaactataaatttatttattaatttaatttaaaaaatttccagctgcaatgttcttgttttaatttaatgaattttaatttaattttgtgaatttgaaaaaagaattaatccagcgatatttaaagttaattaaatcaaaatattataaagaataagtttttca

SEQ ID NO: 77533 - DNA, 1461 bp, Heterodera glycines
  Genomic contig location: Contig_ID=SeqID_13625; Location=4..1464; Strand=-
  SCN-specific regions: Sequence locations=1-59,83-271,297-499,523 -596,652-745,767-777,829-997,1024-1154,1177-1329,1352-1461
atgccaattgttcaatttgaaagtgaaattgccaaaatgttgggcacaaatcgtgccaaaatttataaattaaagaaaaaattaggacaaacacggaagtacagagtaaataaggacataaataaggacacaatgattcgaatgatcagaaaatttgatgaaatgaaaaaggaaaaaatttatggatttaaatatgataagaacaaaatatgcaaaattgaatgtgaaattgcgaaggaattgggaattactcggcaaaaaatttatcaatggaagaagaaaattggtaagaacaaatggaataagcgaattttaataattgtctcattttaagatttatctaaaaaattttcaacgccacaaaatattgaaaaaatagagcaatttgaaaaaatcaaacaagaatttaccaaaaaattcaatttgaaaccaaattgggaaattgaaataaaaatcgcgacaaaactgaaaaattgggaatcgaaacaatgaacctaagaaaatggaagaagaaattcgacaccaaacagaaccgttagcattcataaaataaaaatttggattctcgaattcttttcttaatcttaaaatccttgttttttttaaaattattttttattcaaaaaatttaatttcaaatcttattataatcattgtttatcaaagatatatcttctgtccattcacattcattgggtttgtttaattagtttttcatatgttgaaaagtatgccgtaaaccgaggcacatacatgatgatgcacagctgttcaaacattttaatagaattattagaatttttaattagttttaaaatttgtaaatttccaaatgaatgctttaaccttgtttttttttacctgtcgtcatcgctagcaattcattgatttaaatattaatggaaccttttaaaattaataatccgtcataagtggtaacattgtaatgcttaactgataaattgttcaataaaacaaagatgaatttgaattatcatgatttttcaaaacaattttttaaatcacattgttccaatttctgattacgattatgaatgctgttgttaaaagccttttctcagaaaatactcatttatttttttgtgccttttaggaatataatgaattttattctgtcatttttggttaatttagaagtttgtgtgggtttttgccaaacaattcaaataaattcagcatatttcatcaagaattgctttttttagtgtctcttttgaggttaaaattttcacatcggaacccctgttttttaaagcaaattttacccttccttggtccaccactttcagtgactgagcatggatatgctttgtcttcattttgcccctccggggcagccaaaattcgtatgaaaaacggagaccgccttggccattttggaggacgggttgtctgatgacaaaacgacgaaatttggccatttttggcttttgaaataaa

SEQ ID NO: 77534 - DNA, 2118 bp, Heterodera glycines
  Genomic contig location: Contig_ID=SeqID_13627; Location=85..2202; Strand=-
  SCN-specific regions: Sequence locations=1-114,136-211,242-251,273 -534,562-1117,1144-1269,1291-2078,2101-2118
atggaaaagcaacttattgttgcggaaacatctcgacaaattgcttatgtatcaatttgtaaggaaatttactgggaaattaaaaaaacgaaggaattcttttgggtttgatttaaaataaatttaaatgacaaaaaaggtactactacatatacccatctcttgtctaatctcagcttctgatcactgtttttcttttcagacagcagttccgatgacgaagaagaagaaaagaaaacgatggacagcggaacggccgaagaaaacgatggaagtggcagagaaggggaaaaaggacagaaaatgggcaatggggacgaagcaaacgcaaattgtgttgatgggaggagaggaaggatggcggaagaggcaattaaaaaagtgattaggggacgatgaattggcgggggtgggggtaattagctaatggggagaaagactttaactgtcagagaatccccccattctttgatttgactaaataggagcttaatgcatatttactgttaaaacccagtacagtaaacgatccaattgtaaggacaaacaaaacattttaaatgctcccgctgactatatttattagttagtacagttcctttaatgtcaacaattactgttattatctaaaaaatctccgcgggtctttgcccagctgggggggggggatgataaaaggataaacggaggaagaattggctgctaattgtgtgggataatgcggggaaatcctttccgtgacttccaatttctctcatccattcctttgtttggtcaaatgatccagtccccgtttcagcgatcagaaacagagcaacagaatcggcacgactcacccgcagcagcgaatgcgtcgctttccgtcggctcggccgcggcgggtggcaaagatgggcctgacaaaagggacggacaacagaaacaacaaactttggcagcggaacggacggacagcggacgaccgaccaatggcaacggaggggaaaattgtgcaaaaatgcgacaaaagcatcgccagccgtcaaaagttgttccgaacaacaacaatgccgcttcatcctcaaatgagtgctgtcctccccatccgatggccaatcgaacttcggtctgacaaaagcccttttttatttgttttgttccttttacgggcagagaggggcgattaataaaatcaacaatttttccaatttgtttttatccgttcctttgcatcttttttcaggtgctcgtcctcgaggatcggccactccctccgttgccccccgtgaccgacgacgaggaggaggacgaaattggggacggaacaacggcagtgtatgtgaactcgacaggcgactccggaattggcggttcatcaaaagcgccgcaggactacgcgaatacgaacattcgtaagacaaaagaggcgcggggggacccctcgaagtttttgtcttacaaaacgcatttaattgcattaaaatagagacaatttcagcagttcaaccgacgcgcgtttctcggaaaatccaacaggttctccagtcccttcaggtgggcaatttttcatttaattacgaacagcatatatttaattgggagcctaaataattcgcaaaactcgcggcgcgattaaaaatgtgtaaaaactgtcggttttccaaattattgttttacttttccaacaaaacaattttgtttcttttttctttttgatgatcagtaaagagaaatttgaaactgatggcgagtgattgggggaattgtttattattgcggcgaaagtgtgaagaattcgcgtgcctttgatgtttctgagtgattgcttttgctgccgtccctccccccccccctcgggggctgatcaaatatcatctcaaattcatcatcgaaatgcttcgcccgttttcatttgatcgtctaacaataagagggaaaagcaatttagggaatgtggcgcttcgtttgatcgcattcattcactttacgacgaatgattttttggaacattttgaagagcgtcgagcataaaatcattgggagaatgggggaggggggaagagaacggacgggcggtcggacagaacgaagtcaaagcaagcaaaagccaaaagcacacaaatgcccaccccaaataaa

SEQ ID NO: 77535 - DNA, 1021 bp, Heterodera glycines
  Genomic contig location: Contig_ID=SeqID_13631; Location=53..1073; Strand=-
  SCN-specific regions: Sequence locations=1-101,124-254,276-560,582 -855,878-1021
atgagtgattgtgggaatgaagcaaagcgaaagcgcaaggaatggcgccaggagcacggtcgcagggttggttcaaccccaaaaagtgatgaaaattgaccaaaattaattttattttaaaaacactgcattttttaggtctaaagcagaccgaagccgacacaacagcagatggagaggggacatcgacccaagccgccgaaagtggaccatcaacgtcaactttggacctttgtaagtcaaaaaagtcactattttagaagcaaaaattaaactaaggcccgcgttcaagcccaaggccattgtcagcaactccgatcaggcgccatgtgcgtgtccatcaaaaaactgccgacaaagcaacgaacatggacttcacaactaccgacagtgcaacagaagtggatttgacaacggtggacaaggcaacggacgtggatttggcttatgaggacgccgcgacacaaaccgaccaattggacaaacagttgaaggagcaggaacaagtgatcagctttcttcgacagcaggtccgcaacagagacgcaatgatcactgcgcttcggcggcagttggaggaaaagatggcaccaccgatggagacaccgaccaccagcaaaagtgagtgaaactaaaatcccctttttatctttttcaaataattttctcttttttaattttagcaactccaacaggacgaccaaagatgaatgtcgatcatttgcagcgcacctcacgtcgcaaattggcagatcaaattgcggatgtaataaaccgcgacagatcacgttccgccagccgggcgtccctcgaaggaatcagtcgggaagttcggcacaaatttgctcattacacgccacagaagaagaaacaacaactgtcaagacaaaaaaagtcagttgatccagaggatgctcttctgatcctcgggcttgtcggtacacagaaggcttacagacgactaaaaagcactattcgcctgatcaatgccaaatttgatgtgatgccgccactcgaaaaa

SEQ ID NO: 77536 - DNA, 81 bp, Heterodera glycines
  Genomic contig location: Contig_ID=SeqID_13631; Location=2337..2417; Strand=-
  SCN-specific regions: Sequence locations=1-81
aggccaacaaaatttgaaaaacgggcgcgaagcgcccgtcttgagcctcgatgtggactaaaaacccataataatttttta

SEQ ID NO: 77537 - DNA, 1129 bp, Heterodera glycines
  Genomic contig location: Contig_ID=SeqID_13633; Location=1625..2753; Strand=+
  SCN-specific regions: Sequence locations=1-103,125-308,330-607,630 -920,942-1129
atgaaccgacggtaagaaaggatttaaaaaattgcaagttttcatttacccaattttcttatgtttcagttggatttgtggcgacgtttggatggacattctgccatcgtttgaccatgctcaactcggcctcaaaatggcattgctttccgaccggttcgacatcttagtggacagacatttggatggaaaaagcgaattcacaatttggagagcaatcgaaattcgcaagaaagaaggaccaaaaacgaaactgtctgaatggatcgatggcaaaagtgtggcatttccgttccccgaccgtccgctgcccaacaaaattcgttttaagaaccttcggatttagtaatttcaaacttttgggcgctagtttaaagaagccctcttttgaaaatttgttcactttttttgcataattttttttatgcaaaatttgtttttttaacatggaacgtattgcatactatttaataaattgaaaaaaacattttaaaagataatttagcgctagttaaaaattttctgtataaaaatacaaaaaaaaaattttctaaaaaagtgaaaaaattttcaaaagagggcttctttaaactagcaccaacttttgtgtttattaaagcattttttatatttcttcagctacattgaccattccgtcattgaatttctccgttcaaacaagcacatttgggacagaagaggcaccaatttggaagtgtttgtggatgcaattgatatgggtgttcaaccgatttgggatgtttttatccgtcaaatttggcctatttttgcgacaaacattcaccatttgggctttcgcaatgccgatgctttgaacaacttgcgcagtcgcacttcaccaacgattctcactgatcttgatcaattggtttcaatcgattccggttttctgttccccgatggaattgctgatgatgggccaaatgcaactgctggccaagcgttgaccaaatggctgcacactccgacaaaaaatgggcaaccgaagcaattacgtttccgtgcttatgtggttccaccaaatctcgaatggctcaacagcttcaaagaggtcgtctcgccagaattttcgtcaatttgtttttgttttaccaatttttgtgtttag

SEQ ID NO: 77538 - DNA, 1585 bp, Heterodera glycines
  Genomic contig location: Contig_ID=SeqID_13636; Location=198..1782; Strand=+
  SCN-specific regions: Sequence locations=1-204,250-323,345-425,465 -516,561-627,651-1585
cgagacgaggtggaaaaactgtgcaacgaaattgaacaattgcgagcgatgagtgtgaaggccggcgtaacaccgtattggaacacggaaggagcccagggtacggtagcgaaggggggcaaagaggaggagcaaccgcaacagaacggacggggcagcaaaaagagttgggtgagtaacaaagggcaaaaggcttaggggtgcaatttaaatttgaaatttaattctaaaatattgaaaataaaatttgcaactttaatgagaattaactcttaattaaattgcaacaaattaagaaaaacaatgtggacactcaggttagcaaaagaaaaagcaaaagttagtgtggtaaataaagtggaaatgtgccgtgtttggtgctaattggtgtacataattgagcagttaattttgataattagaccataaaaaacaacacaacaattagaagtttttattttaaactgcatccaatttattattaatttttttgttgtcactttggtgtttagtccgataaataaatgaatacttaattaattaattgttaataataaattctgttctgctaccgttcagattcgaagttcattcagccgcgcctttcacaaaggcaacaaaaagagcaagcagcaacagcagaaggagaacaacgacgccgcggacaacaactcgctcaattcgttctcctccttcgcccattccaatcccagcaaaagtgccaatgccatcagttcgtcttcgtccgtttcggtgacctccaaaaaatggacaccggccaacacagacggcaattgggcgagctgagtcaggtggaaatggcacttttgcagcgcgagttggacaacagagaagttggcattgaccgatgtgcaattggacgcactggacaaggccaaagagattgacattctgcgggagactgtcaacagactccaggtgggttacggtgtctcaatgtacgataattttatttttacagtaacccaaacggcacataagttaattcttggttttatgccttttctgtttagcatgaaaacaaactgctcaagtacaactactccctcttggagcgcaaagtccgctcggagtcgcggacgagttcgcacctgtcattgaacaccaccggcatcgccgggggcggcgcgttggagtttgacgcggtcgtgcaggacgaggtgccttgctattattgttgctctaaaaggtgcctttttgttgaaggtgctcgctgaggctagcgaacagcttgcgcccccctacgaattcgccgcctcgtcgccctccagcggcgatatttctgtcaacacgacgaccaccggcagcaacaactccgccggcggtaccacaccgttcattcccccacccgccgatctcgcggccacaaaatcggtgaaccgttgcagcttcgcctcctccacgacgacttcgtccaaacgtatgccatttggccattttcctattttctgaccctttcccatctcggcgttttcaggctcttcccacggcgctttgtccacggcactgccctcagccaaggtcgtcctctgcgttgacttgagcgggcgtgtcgactcgctca

SEQ ID NO: 77539 - DNA, 257 bp, Heterodera glycines
  Genomic contig location: Contig_ID=SeqID_13637; Location=1202..1458; Strand=+
  SCN-specific regions: Sequence locations=1-32,54-257
atggctagtatgtaaaatttgcggtcacaaataaaataaaaattggctaatatgtaaaattggcgtccagaaatttttagactaatccgaaaagcacgatgtaaagagtcgaaagaattcacagtatcgtttctaatagagaaatatgcttacatgatactcataaaaactacaatgatcatttttcccacctttttatgaccacatttgaaaaaattcggaaggacgaggaaagatatgcttgatgcctcattaaa

SEQ ID NO: 77540 - DNA, 100 bp, Heterodera glycines; identical to SEQ ID NO: 51845
  Genomic contig location: Contig_ID=SeqID_13637; Location=995..1094; Strand=+
  SCN-specific regions: Sequence locations=1-100

SEQ ID NO: 77541 - DNA, 1809 bp, Heterodera glycines
  Genomic contig location: Contig_ID=SeqID_2053; Location=192..2000; Strand=+
  SCN-specific regions: Sequence locations=1-379,401-677,699-775,806 -1012,1034-1809
atgccgtatcggaagccacaaaaagtgaagaaggcctacagatgtgccatcaaacgaacgaaggagtatttttatactaaccttctgggggatcagttcgttcgtacggagaaagaattcttgccagtacaaaagagaatctgcatggccatgatcgaacagcacaaatgccaatacgaagataagccaatgactccgattgaaggaggaggatggagcagcaacaacccactgaacgacgaatttccgggaaggttctcaagtctaatttcgggggagcgagagagcgtaacgctgaattgttttgtcgagaaggcgtcgctgttttaccgccctcacaattttgagttgatcagcccgctctacttacacttggaggattgcaactatttgaccggaaactgcaacatggcagacaacacaaccctaaattgggaaacggagtgcaacgagagctgtaagtcatgcgactaccatttcgtcgaaagtatggacggagagcacacgggatcaacggattgggcaggcggaacatggatatccaaaagcaaggaacaggcgctaacgtttagcaaagaggcgaaaatggaaacagcatgcaacggaaaaccgattcgcttgtcggaccaatcgtttggaatcctggaggatgagtacctgaagatcgtcaacgatcgtggattgggaaaaagagccatccaggaggaacaactcgcagcacaattaaccgcaggacaactcgccacaagccgatcaatcgcgcagcttttttccaaggaatgccgaagaagttccagaggaggaaatccgaccattcaggccagacgacttttacgacgcaaggatgtttggctaaacgaggacacgatgcaaatcttctcgtgcgctgagttttcaatgcaaaatgtggaatatcaagcagtcaataactgttaccgctacattccggtccaaatccgcattgacaagaagacgctcaacgcattcctggatccggagcttcacatcctcacagcgtcatcaccattcgcagattgtggaaattttcgctaccattatctgcaactgagccagagcaattggatcaaaatcgacacacgcaccgctacgatccagaaaatcgactccagcagcatctctgagatccacgaagcctctggagacaaatcgttgttggaaatcacgccgctagtttttcatcgatggacgatcgacaacgaaacaggcgaagggctattcgcgcacttggatgaatggctgcgtttggatcaatggaagtcgaaggagaaggagcacaaaacggcgcgtgcgctcacactgggagctctcccgaacggagtgattggcctcaccgaagaatggttcatggacaaacttcggctgctcgtctcctactggacaacggcatgctgcatttacgtcacattcatttttgggcgcgatgtcctgatacccttggtatgggtctacttaatggggcccgtcatcgttaccatccgcaatttggtgacgggaaatcagtggacgcagcggaacagagttactcgaggcacacggcgagcaccggcaatttcaaggattgaagcaattgagctggtaccgccttcaatgccccaggaaatgagagcgaacgaaacgtcaagttcacatcaagaggaccccgagccgtcaccgctggtgatggagctgaaacgacaaatggtcgcattccgttcgaagcgacgttttcaaagccgtgggaatgtcgcggctgaacgacagccgcgaatgtccgttgagcggacaaatgaggaggacggggaggagtga

SEQ ID NO: 77542 - DNA, 2637 bp, Heterodera glycines
  Genomic contig location: Contig_ID=SeqID_2055; Location=1225..3861; Strand=+
  SCN-specific regions: Sequence locations=1-104,127-370,395-828,850 -1093,1115-2044,2066-2637
atggacaaggacgaaagaaaaagtgagcagacagcgtatgaacaatttcaaacaacggagaaactgaacacaaaaatggaagcagccaacacaaagctaacagagctgaaggacctggagatgaaggtggaagcaggagcaaagctgcaacgctccaaagcagacagagacgcgcgagtggagcaaagagaacatgcaaaagcaatgtcgaagtcgaatgcagaagcagacaaagggaataaccgtgcgagaggcaatgaaatgactgccgcattgtaccaattgccaacactaagaattaagccgtttgggggagacaaacgggaatggcccatgtttgaagaagcatttaaagtggctgtggaccaaaagccaggaagcaaaacggagaagctaaatttgctgaaatcgctggttgagcgagaggccgcattgctcatcggaggcctacgcttggaagagaaaaattacgaaattgccatgaagctgttaaaggacacctatggagacaaaggcgaatatgtaaggaggttacacacggagttgtcgaacctcaaacgatgttactcggtggaagacacaaagcaattttgcatggaattggaacgcctagcaagagaattggaagcagcggaagaagacattgaagggccgccaatttatttaatgcttgagaagaagctatacaagcctttcctgcgtgaaattctggaagagaaagcaaaaaatccagacttttgggacacgtcatccctccgaaaggccttaggaagtgcattgagcaaagagctagcaatcaaagaagtcatgagggagtatggcttcgaaggcaaagaggcaaatccagagcatggattcaaacgacaattaaggcggaacagattcggaggctcagtcaatgtagccacaacacatttcgggaaacccaatggagagcgaagaaaaatcccggaacaaaaaatgccaagtccgaggcaaggccaacgaagttttcagcagactccacaaaattccgcattccgagaacgtaagggacaaggaagaagcccaaaaattcagcggaatccaacagcagttaacacacaaggtgaactgtttctgtgtgttttctgtggagggaagcacagacatgacagttgcgaaaaagcaaggacggtgcaacaacgatttgcagtcctccaagagaagggcttatgctacaaatgcctgaagggcaatcatatcggaagaaattgcccatgcccaatgaaatgtttcaagtgccagcaagcacacccaacggcattatgccatcaggcaaacccacaaagggcaacagagtggagaaacatggcaaacaaagtcatgaacgtccggaaagaagagaaaccggacaaacgggacgaattcaaagaagtttcgttcacgccctcacaatgcaattcagtgcaaggaaattcgcgagtcctgctgagaacagcagaggtgaccatcttcaatccatccaatccaaaaagaagcatggtcgcatcagtttttgtggatgacggaagtgaacgctcattcatccgtgccaatgtggcaaaacaattaggccttccggtgattgaaacggaagagtgccatttgactggttttggcgagaaagaagccaaacgctacgtgagcaatgttgtacgcgtaggatttctgggagtcaacggagacccatatatatgcgcactcaatgaaatggaattcattgtgaaagcgatgcccatcgtaacgctgaattcgatggatgaagcggaattaagcaagaaaaaactttcccttccatcgcggccaagacagccagacattctgttgggaatggatgtcagacatgacctgaaaataagagacgaaacagaaaagttgccaagtggattcacattgtcaacgtctcgagtcgggcggatgataagtggttatggccaagtccagggcccaatggacatgagtgtgcaagtgacgtacactggagcactcataagtgccttacaatgtgccagtagcagaagagatgctgacgaagaaatggaagaacagataaaaacatttttcgggctgaacataatcggattgagcgacaatcctgaagaagaggacaaggaagaagtgatgagaacgttcagaaaaggcttgacattcaaagaaggaagatatgaatgtggcctaccatggaacgaaagagtaaaggatttgccgacaaattttcaacaagcgagggcaagactttgtggcacagtgaaaaaattgcgagaattaaatttggtggatgaataccaaaaaattttcaatgagtgggagaggaacgggataatcgaaagagtgccggatccaacacaaataactggaccggtacattatctcccacatcggcccgtgataaaaatggacaaggccacgacaaaaataagaattgtgatggatgcatccgcgaagccagcaaaccgcaaaggagccccatcgttgaacgaatgcttgcacacagggccgttgttgttaaatgaattgaccgggatccttctaagatggagaagaatgaaggatctaatcctggcggacatcgaaaaggccttcctccaattatcagtgagagaggaggacagagacgcgaccagatttctgtggtag

SEQ ID NO: 77543 - DNA, 1201 bp, Heterodera glycines
  Genomic contig location: Contig_ID=SeqID_13640; Location=62..1262; Strand=-
  SCN-specific regions: Sequence locations=1-148,189-678,701-706,728 -1201
atgtcgactcatcttccaagtcggccaaacagcggactcttcaccgctctccgatctcttccaaattccttccgtccgccgcttctcgcggaaactcttccgactgaactcactgaaaatgtcactttccgtgcgtttctttcctccttttttgcttcttcgccgatcaccgtggaaaaactggacaaatttttgaaacaaatgcaacaattcccgaatttggacgcgttggtcttccgttctccggcgagtgttcgcttcccgccaaagagtgaatggttcagggcacttctgaagcgactaattgccagggcatgatccatccgttgaataaccaacaaattgacgcatttttcagatgaatgagttccaatttgatccgagtgatgttctttatgagtcgctttgtgcttcgatggcttccgactcagaagatggccaagacgaatgtttcttccgcattttccccaatctcttcgactcggatttgtccaaagctccttacattttgctcaaacagagagtgcaacacatttcgcatgggacgacgggactcagttgttggggggtcagtagccaattggcaaaatgtctttaacacacttttggcttttcccttaaggcatcgttcgcttttgccaattttttcgcgaattcgccccattctgtcgccttttcaaatgtttctcatgccttggaattgggcgccggctgtggcctcgctggcatttccttcgctgcttcgaatgcctcggcaaaagtcactctctccgacgcacatccggccgttctccgacaattgcgagagaatgtggcactgaatttcgactgttcccggagctcacgatcagcggtttccgttgagcgattggattggacggacttcgaacggcggacactgccgagggacgccgaattaataatcgctgcgggtaaacaaacggagaagggatgggatttattgaagaccaacacataaattttatgttttcactgcattttattaccatgtttttttaaatttatttgcccatttctcccccattttcagatgtgactttcgacccgtctcttttccctccttttgctcaacttctccgacttttgctctgtgtggaaagtgtccccggcggcgttgtcgcgcttatttgctgtaccgtccgtgacaaaagcacagaggaccattttcttcagataatcg

SEQ ID NO: 77544 - DNA, 954 bp, Heterodera glycines
  Genomic contig location: Contig_ID=SeqID_13641; Location=20..973; Strand=+
  SCN-specific regions: Sequence locations=1-93,122-189,216-280,335 -335,393-614,670-680,702-720,742-775,799-836,859-875,897-954
atggacacggaattggatgggttaatctggcaaattgatgcaaggttatagtcaactattaatagaatgaggaaatccttgctaatcgttttcataaatttaaaattcttttattaaaattggataaaagaaaaagcaccccacccctccataaatttaccttattagaatctcagaaaatgcacgtttgaataaatgaatttatgtaataatgggataaatttttaatatttcatttttgtaggtgtttctcgttaattgaatattctcaataactaacattttttaagttaattaatttttcaaaattttgtacaaatattttatattttttgtcaatttatttgaatgaattgaattgaatttattttatttattttaaaatttaatttttttgaagaaatcctctgcaaaattcgcgtccgtttgggcttatcattgtaaatttacagatttgcgagaaaataaaaataatagccgagaaaacattttggaccttttactaatcgaagaccgaaacgaatttttgcgacaaatatttggtgaaaaggaaaaatttgatacaaaaaataatgaaacaaaaattgaggaaacattggaagaattgttaaatgaagaaaagaaaaagaagaaaaacaaaagaaacaaaaagaaaaatggaaaagaaaaaatcgataaatcaataaaaaacacaacaaacacagagacgaaaaacagtggggagggcagagaaggagaagagggcagagaccgagaggaagaaaaaaatgttattgaaaagagaaaaggggaagaaattggaaattgtgaaagtgataattattcaaaattggatggaaacaaaaatggaaatacaacggacgaacaaatgacggcgaaaatgccaacaaatgatgcaattcaggctaaagaattggacaaatttggcacatttagaggttgttaaaaagttta

SEQ ID NO: 77545 - DNA, 892 bp, Heterodera glycines
  Genomic contig location: Contig_ID=SeqID_13642; Location=388..1279; Strand=-
  SCN-specific regions: Sequence locations=1-123,145-290,312-343,436 -506,528-892
atgagtgaaagagttggcctcgtcagtaccagggctggccgtgatcacggatcacggctcacggatcacggaaatcacggggtttttggggtgccgtgatctcggatcacgggtcacggattttttcaaattttccgtgattttgatccgtgattggcattttatatagggaatttttattgagacgaaaataggaaagtggtgtgaagaattttttgagaaaaataaataaactcttttctgcttacaaattagaaaataaacatatatatgtagtctggtggttaagccttctgtctttcgttgtctgtcccttgggttcaattccccattgggataggacaatttatataatttgttttgataattttaattgaaatttaattaacaagaaatttcataacattgaaaattatttttctttattttttaaaacgtccatagaccaataaattaaccaatgattggacatattttggaaaaaaactgttaacaaattcactcaaaatttcaaaatttttcccggcggcgcctgtcggcaccaccggcagacggacccccattttaccgtatttttgaaattttgacaccaaaatggcagaaaaattaccatttttggcatataaactgctaaaaaccctatttttctctccgtcgcttaaatttaaaacgacaggcctaatcaaaattttcagaaaattttcccaaccctctaagaattttttctaaaattttcccgactttcagtatcttttggggtgttcagatcgtcatgaaggactgagcatgttggtccaaaagattttttcagcatcaaaagttagcttagagaaatttttttctctacataaatagatttttggttaaatttaagaaaaattttcttaataaa

SEQ ID NO: 77546 - DNA, 1159 bp, Heterodera glycines
  Genomic contig location: Contig_ID=SeqID_13644; Location=32..1190; Strand=-
  SCN-specific regions: Sequence locations=1-153,175-414,437-737,759 -1159
atgccgccggtggtcggactgttgcgcgagaattacctgtacatgttgctctaccaaaacgtggccacaatgctgtcacagtttctggtgccgctttgtgtgctttgtgcattgaattttcaggtgggaaagaaggcaatggcaaaaggcggcgaaatgaatgagaaaattaaaaaactaaaatttcgaattaaaaatgccaattttttttaaattgtttctttaaggtggcgagaacaattttggtggcggtggagcaaaggcgagaaatgtgggccgaactgagcgcggcggaacggagagagcacaaaacggccaaaatgatgctaatggttgtgttgggtgagctggcaattatttgtttgtgtctaattgggcaggatttcttagtttttttcttcaaaataagagcaattattggggcattattttgttaattgctcgcatttgtgccgcttaatcaaatgcctaatgaatgaccttgacaattatcgtgactaattaggcggaatgatcaaaggctttccctgccactcactaatcactcgtaatgtttcgcctccctttcagtgtttctcttctgctattcgctgtccttttgccttaacgtgttggaaatcgttctgcccgcccttttccgttctcaaattggttatttgctcaacgatgtcaacaacattttaatcgttctcaacgcctcctcctccttcgtattttatgcccaattctcttcaaggttttttaaaaatgccaatgccaaacccaacgaaaatgccaatctttttaaattcgcaccccctaaaatggaaaacggcatgactttgtcagagccatttatagcaaacatacatcccaactttcaattgtggtattttacccttccaccgtataccctttacgtctcccattccccacagtatccccacctttaccgcacattttaaggtaccgtgcccaattggtttatttgctgcggcggtgccgttgcctggaccttctgttccgttgggcttatggcaaaagtacggcacccctcgagggcggcagtccctccggcgctttgtccgccggcgcttgcctcctgggcaaacagcgattgtctaccaccgttctatccaaagggagccaacgcgcaccgtcgccatttttggtgcccggg

SEQ ID NO: 77547 - DNA, 80 bp, Heterodera glycines
  Genomic contig location: Contig_ID=SeqID_13647; Location=1..80; Strand=-
  SCN-specific regions: Sequence locations=1-80
aaacatttttttacccgaatggcatttgccattgcgtcgatgactatttcagtgctcagcccactgctgctccgtcgatg

SEQ ID NO: 77548 - DNA, 552 bp, Heterodera glycines
  Genomic contig location: Contig_ID=SeqID_13648; Location=31..582; Strand=-
  SCN-specific regions: Sequence locations=1-413,435-462,486-552
atggacccgagcaaaggcttgtacaacaaagacgaggataaagtcaccttggccattgattttacatgtgaatagcgtaatcattttgagaagaattgaaaagtgttgaaaatcgaagagaaataaacaagaattccgaataaaaacattttttgatttctattataaaccaaaaaaatttttatgatatcgaacgaaaaaaaattacaggttttctgaattcttttcggcacaatcactctcccgtggatcatttcgctcaaattattaataaaaaatgataattagagagcaattagaacatatttttctcttccatcaatcaaatgcccaaagtttttcgttgcccactgattgatgagtttctgctaaaaaaaattgactttaattgctaattgaattttgttaattatccagtgatttttcaaaatgaactgacggaatcttgcattttaattagcacaaaaagcggaaacaaaacttgtctaatggatatcgattttgtcttgcctgttaaatggaaggaaaatgcctatttttgaggatattaaa

SEQ ID NO: 77549 - DNA, 55 bp, Heterodera glycines
  Genomic contig location: Contig_ID=SeqID_13649; Location=890..944; Strand=+
  SCN-specific regions: Sequence locations=1-55
aattggagattgggggattaatggagattgggggataattagagcaaatacggta

SEQ ID NO: 77550 - DNA, 58 bp, Heterodera glycines
  Genomic contig location: Contig_ID=SeqID_13649; Location=1039..1096; Strand=-
  SCN-specific regions: Sequence locations=1-28,50-58
tttttttactgtgcccccttttctcattttttactattacattttaaaacgtccaaaa

SEQ ID NO: 77551 - DNA, 64 bp, Heterodera glycines; identical to SEQ ID NO: 51065
  Genomic contig location: Contig_ID=SeqID_13651; Location=3572..3635; Strand=-
  SCN-specific regions: Sequence locations=55-64

SEQ ID NO: 77552 - DNA, 369 bp, Heterodera glycines
  Genomic contig location: Contig_ID=SeqID_13652; Location=157..525; Strand=-
  SCN-specific regions: Sequence locations=1-218,240-369
atggttatggtgccagagagtgagtatttggcactcattaatttactgaaaggaagcagcggcgtatatcctcctcttgccgacccgttacagggcgagaaaacgctgcttgatgtacagattcaaaagaatttggctgatccaaaaaggaacgcagaaataaaaatgaagcgtcactcatggttgtacaaacgtagacaccagctaaaagatattattgataataaacctcaaaaagtaattgttgagagtggctcagttacagcaccaaacgttgcgccgtatatgggcattcaaaaacaacaaacaccgtcgcatgtgagcacaccacaccgcaattcggcttcaattcaatcaattggtgcagca

SEQ ID NO: 77553 - DNA, 345 bp, Heterodera glycines
  Genomic contig location: Contig_ID=SeqID_13653; Location=63..407; Strand=-
  SCN-specific regions: Sequence locations=1-345
atggcattccaatctctgggactcaacccaccagcatttcaatctctgggactcaactctccggcattccaatctctgggactcaattctccggcattccaatcactgggactcaacccaccagcatttcaatctctgggactcaaatctccggcattccaatcactgggactcaacccaccaactttcaatggcattccaaaacactgggactcaaatctgcggcattctaaacattgggactcaacccaccaactttcaatgacattccaatcactgaaactcaacccaccagcattccaatactgggactcaattctccggcattctaatctctgggactaa

SEQ ID NO: 77554 - DNA, 267 bp, Heterodera glycines
  Genomic contig location: Contig_ID=SeqID_13654; Location=154..420; Strand=-
  SCN-specific regions: Sequence locations=1-114,144-267
gcaactcgtatcggccgttttgtgaacgacgtgcggaagcagactgcccagcaatggcccgacttctccaaacgttgtcgtgcgctgataaagcaatggcagaaggtggcagagtacaggcccagctcctcctgcgaaggctcttccaatggcggcactcctcagcttgtctcgccggctttgaagcgcgggctgacaccacgggcgggggccgtgacgacgcccggcaaacgcacaacaccacatcaaccgcaacaacaactacgg

SEQ ID NO: 77555 - DNA, 1380 bp, Heterodera glycines
  Genomic contig location: Contig_ID=SeqID_13655; Location=976..2355; Strand=-
  SCN-specific regions: Sequence locations=1-339,366-518,548-626,649 -1380
  Gene Ontology: Mol. function=mitochondrial processing peptidase activity; Cellular component=mitochondrial processing peptidase complex; Biological process=mitochondrial processing
atgctctctgacattttgttgaacagtgtgtacggggagaatgagatttggcgcgaacgacaggtgatcatccgtgaggcggaagaagttgcgcagaatatgcaggaggtggtctttgaccatttgcatgccggtgcttacgccggctgttctttgtcccggacaatcctcggcacagatgaaaacattcggtgggccgtaagcagtaaaaggcgaattgtatcatgcatttttcagtcgtatgcatcgcgaacaactgatcgcttacattgggaaatattacaaaggtagaacaattaacggttatttttccaacaagggcaaaattgtttcggatgattttgtttaaagttatgaagaaaaaatttcaatttctttttcggacaagaaaacattgactaccgaatgatatatgactatcgaatcataatagtttgactcaattcggacaatctgaaaggaatttataaaaaccaggctgtcgcccagtctaccatcgcctttttcgcaacgatttcaaaaattaaaattatttattaataaatttcattttccattaaattttaaggtccgcgaatgctattggccgctgctggtggtgtcgaccattcgcatttggtcgaacttgccaagaaatattttggcaaaattgagcacggagatgaacatgtgctcgattatgagcctggaattttcacagagtcacatgtacacagcaaaaaataattcgaaatgttaagacgttcttttttagcaactcattgaggacaaacagatggagatggtctacggttcgttggcagtcgaaggcacgagttggacaagtgaggacaacattcctgtgcaagttgtgaacacggtgggtgacgtcaatgctcccacaaagtttctcttacacgtcaaaattctcttcagctaatcggccaattcgacagaactcactgtcggaatagttcacgattggctagaacattgagcccaaattccggcgttagttcattcatgtcatatacggtatgatttgggagacaattattaagatctttattgaaatttaatctttttgaaaataagttatacgaatgatcaggaacgacccctttttatacataaattgtcgtgattctgattaatagatggatctacgcccaaagtataaattattgtttagacttcctataaagacacgggcctgactgggttatttttctgtgccgagccggacgcattgttcaatttggcccagtccgtatgcaaggaatggcggcaactttgtgaagaggtggacgtggacgagttggaacgtgccaaacggtctcttctcaccaattctcttctgatgttggatggttctacgcctatttgcgaggatattggaag

SEQ ID NO: 77556 - DNA, 344 bp, Heterodera glycines
  Genomic contig location: Contig_ID=SeqID_13656; Location=1417..1760; Strand=+
  SCN-specific regions: Sequence locations=1-149,200-344
atgagcctaaaccgtgacgaaaactcgcagtcccctgtactcgatggaccgtacccgcgggctcaagatgacattgagtttgtggaagatgaagcaccggtgctgcttgaagtgttggatcgtctgtcacgagagtgtgtttttgtttctatttttaaaaatattttaaaattacacatttaaaattaattgttttattgtttagggaattcgtgaagtcaggcctgtgggcccggggcggtcgggttgtctctatgcctatgcaaaattgttatcgaccatttgtgggcaagggaattgttggtccaaacttcaaagttttgaattttggtcacactttgtaa

SEQ ID NO: 77557 - DNA, 1168 bp, Heterodera glycines
  Genomic contig location: Contig_ID=SeqID_13657; Location=41..1208; Strand=+
  SCN-specific regions: Sequence locations=1-170,215-342,365-408,432 -1135,1164-1168
atgaagaaatccgttaccatctctgtccctgagcaaaaagaaattaaccagcctaatgcagaagcggagccaccaaagacggacactacaaaaaagcgcaaggtggaggaccgggagctatggaaactggcaaaaggaaagttcatgctagcgacatatttgtgcgcaggtaaaaatgaaaataattttaaattttgtgaaataaaatttttaagacgactgggaccgactgttccataaccaacagaaagttgcgcgcttgggtgatggccgttttgcggtcagctttgagctctgtgaagaatgcgcgtgggccaattgtcgcgcaaccgacatcattgcccctgtgaagaaaaagctgaacaatgcatgcgagacgaattttttgagtgatcgatcaacaatcaataaaatttttgaaatatttcttattgttgtcatcatcatcatcatcagcaagttcaagcaactccatcgggtagtggcggtcctcccctccttctcccaaaaatcgttcaattatgcatggcaaataggggaagtgaagccttatgcggtggcgtgcataaaaatgcgcggtaatattgatgttaaatgaaacgcgcagctgtccatatgctggaataaatgccgcccctttactcgaaatgccgccgacgaaaaatgttttggtcattccgttccgatcgttgtaggttgtgcgcacttttcggccaataagatgctttagaacaaggctccgatcctttggatgatttaaccgatcgcgcagcgacttgggttaacaattgagcagtttagagcaaaagacagtgacaagcaccatttcagaagaatgacaaatttgcaaaataggacacaaatttatactctaaaattttagccacgttcattaaattcaaatttgacaccgcccattttagcgaaattgaaacaaccggccaaaacccaaattcattttcgtcaaaatgaagaaatccgttaccatctctgtccctgagcaaaaagaaattaaccagcctaatgcagaagcggagccaccaaagacggacactacaaaaaagcgcaaggtggaggaccgggagctatggaaactgacaaaaggaagttcatgctagcgacatatttgtgcgcaggtaaaaatgaaaataattttaaattttgtgaa

SEQ ID NO: 77558 - DNA, 485 bp, Heterodera glycines
  Genomic contig location: Contig_ID=SeqID_2056; Location=866..1350; Strand=-
  SCN-specific regions: Sequence locations=1-61,83-172,368-485
atgactgtaaaagagataggacaaaatgggagagcggaaagggttagagaggaaatagacaacaggaagggcactgggaaaagatacagtgcgcaaaaggatagagaaacgataatgtgagaaaggatagagggaaagtgacagctggaacggacagagcgaaatggacagtgggaaaaggacaccgggaaagggacagtgggagagtgacactggggaaagagacagcgggaaagggacaacgggaaaaggacaattggagagggacactggggaaagagacaacgggaaagggacagttggagagggacactgaggaaagggacagagggaaagggacaacgggaaagggacagttggagagggacactggggaaagagacagctgaaaagggacagcggaaaaggacacgacaagggtaggatgatgggatttgcgcgagaagcaatagagcgtgtgtatgtgaagaacgaatgttattaaa

SEQ ID NO: 77559 - DNA, 1423 bp, Heterodera glycines
  Genomic contig location: Contig_ID=SeqID_2056; Location=763..2185; Strand=+
  SCN-specific regions: Sequence locations=1-221,417-506,528-584,606 -667,712-732,835-841,880-939,961-1039,1061-1423
  Gene Ontology: Mol. function=general RNA polymerase II transcription factor activity; Cellular component=transcription factor TFIID complex; Biological process=transcription from Pol I promoter
ttcatgtgtagtaaatatttccgctttaccaaaaatgtcaacaaccaaaacaacgaccaaaatcttgatgacttactactatgaaatgattctgttgggtacatttaataacattcgttcttcacatacacacgctctattgcttctcgcgcaaatcccatcatcctacccttgtcgtgtccttttccgctgtcccttttcagctgtctctttccccagtgtccctctccaactgtccctttcccgttgtccctttccctctgtccctttcctcagtgtccctctccaactgtccctttcccgttgtctctttccccagtgtccctctccaattgtccttttcccgttgtccctttcccgctgtctctttccccagtgtcactctcccactgtccctttcccggtgtccttttcccactgtccatttcgctctgtccgttccagctgtcactttccctctatcctttctcacattatcgtttctctatccttttgcgcactgtatcttttcccagtgcccttcctgttgtctatttcctctctaaccctttccgctctcccattttgtcctatctcttttacagtcatttattatacttttactctcctcatcatcgaatattattaatgttcgcaaaacaattaaaaaattgttattaaacaaataaaaaataaaaataaaaataaaattcaaaataaaaataaaattaattaaagagattaaaatcataataaaataaattaaagtaaattaaattaaaaataaattaatattaaagttaaattaaataaaaataaattataaaattaaataaattataactaaattcaatttgttcgactataaataggaaaaattttctcccattattcatttaaaatgttttttccaacaatcaaaaattgcgttgctgttgtagacaccaaaacaactctcgatattgaaaaaatttatttaatatcaccctccactaaatataatccacgtaaaattcatgctgtaatcatgaaagtctataatccaaatgctaccgccataattttctcaactggaaaattcgtatgtacaggggcagctaatgagaaagaatgtaggcaagctgctgagcatgtcacggaacgaattaggcaatgtggctaccaagaggcactaatccataaatttgatgtgaaaaatttgattgcgactgctgatgtagggttccatataagattaggagaactttcagactttcttggtgtaaaatgctgttcatttacccccgaacttttccctggactcgcctacagaaacataaatcccaaaatgtccataattgtcttctcaagtggaaagctaaattttacaggaaacaactcgattgatgatatcaaaattgcatttaatcagttttatccgattttgtacaaatttatacattca

SEQ ID NO: 77560 - DNA, 1443 bp, Heterodera glycines
  Genomic contig location: Contig_ID=SeqID_2056; Location=1713..3155; Strand=-
  SCN-specific regions: Sequence locations=1-307,329-362,394-398,420 -429,451-626,666-920,943-1333,1355-1443
atggacacagcgacgataaatcggattctaacaatgaacgaaaaaacaaaagaacattatttaggatgtttcccatgcaacaaaatacccctaaatatcaacaaattcccatcagtattagtggcgaacaacgacccatcaaataaggaaggaacgcattgggtttcaatttttatcaaagattataagaccgtgtactactttgacagttttggacgtacacctaacaaatgtattgaaaaatttttaagtcaatttaagactgtggaaggtaataaaactcctatacaatcaattattagtgagaattgtggatatttttgtatttattttgtatattgtatgtgttcaggaagtgttaattttaaaagtacttttttaaatctattaaaaaagttaatgatacaatatgatcccgacttctttgttgtaaattttgttaagaaaatgataaaaagtatttaaggaatttttcattaactcatttataaaaatggaccgattagacacaataattgcttctcttctgaattgcagtgcacgtaatttgtgcgatcgtctaaatcatcctgatgaaattcaaaaggttgaaaattttctcaaagataaaactctacaaacaacttataaaaatcaaattggagaacataaagaatttatttatggcggaattacgaaggataatgctcgcaagcaaatggcgtacaacggattcaagaatgtgaccgtcgaccagcacttttatgtacggcatagaatttgtctccgttatgcaaacaatccgtgtgtaatagagaagaataagaatgggcacgatcgattctatccgcttgagcttgtgcgaatgattgaaaatgatcaagctgatatttatttgggtcaaaattttcctaaagttgtcccttcagcgcaagaaagttcaaataatgcacattttatcaaaaattattatgactcataccctttgtggtgaatgtataaatttgtacaaaatcggataaaactgattaaatgcaattttgatatcatcaatcgagttgtttcctgtaaaatttagctttccacttgagaagacaattatggacattttgggatttatgtttctgtaggcgagtccagggaaaagttcgggggtaaatgaacagcattttacaccaagaaagtctgaaagttctcctaatcttatatggaaccctacatcagcagtcgcaatcaaatttttcacatcaaatttatggattagtgcctcttggtagccacattgcctaattcgttccgtgacatgctcagcagcttgcctacattctttctcattagctgcccctgtacatacgaattttccagttgagaaaattatggcggtagcatttggattatagactttcatgattacagcatgaattttacgtggattatatttagtggagggtgatattaaataaa

SEQ ID NO: 77561 - DNA, 467 bp, Heterodera glycines
  Genomic contig location: Contig_ID=SeqID_2057; Location=2681..3147; Strand=+
  SCN-specific regions: Sequence locations=1-467
aagttgatcaatttcatcctgaattgactgttttttctgttcatcagtcaaaaattgttgttgttctcttaattcgcgaatttttttgtaatcgtcttgaagcccttcatattttttatgaatatgttcccagtaatctgttggatgactatcaaaaaatggctcaacgtaatccttattttgttcatagctcgtcctctcatattcttcagctgatatttgtaaatcttttttcaatacagccttgttaaaagcattcaaattttttcttctgtgtttcattgctgttctcattcttaatgcttcctcattcagagcctgaattgttctaccatctgttactccttggtattttttcatatggtcttgaatgttgaataaatctcttattaattctaatcgaacttcatttaatttctccactatagtgaacagaatacatttcgaggaattcttgaccagttctc

SEQ ID NO: 77562 - DNA, 1106 bp, Heterodera glycines
  Genomic contig location: Contig_ID=SeqID_2058; Location=41..1146; Strand=-
  SCN-specific regions: Sequence locations=1-78,101-179,217-373,395 -401,423-576,603-1106
atgtcaaatttattttacgttcttttacctagtgactctcctggttatgacaataagcctaataaatttagggttcatttgcctaggaccctaacttttggaggtcaatggttgtgtgggttgcacagtataatttatacaaattcttggcccgccattggtaccacagagaaccaatggattaaagtgcatttaaaaaatggtgataaaataaaaattgatattcccgctgggtcataccaaaatgagcaagaattggaaaatgctataaatgagtcgataaaaaatggtataaaacaaccggctacaagagttaaaagacaaacggaatatggagtggatttgttttttcattataatccagatgattactgggaaaaaattgaggaagaaaggcaaagatataaagaattgttaaaattgatagtgacaaagtcaagagaacgtgatgatgagacggacacgcataggaagagaaaaatagaggatgaggaaattgaccctctccaaaatcaatcattgactaagaaagcaagaatagaggcgcttgaagaagcagcaaggcaaagagatgacgggaaggaggaaaaggaggagagaactggtcaagaattcctcgaaatgtattctgttaactatagggagaaattaaatgaagttcgattagaattaataagagatttattcaacattcaagaccatatgaaaaaataccaaggagtaacagatggtagaacaattcaagaactaaatgaaacagcactaaagatgagaacagcaatgaaacacagaagaaaaaatttgaatgcttttaacaaggctgtattgaaaaaagatttacgaacaacagctgaagaatatgagaggacgagctatgaacaaaataaggattacgttgagccattttttgatagtcatccaacagattactgggaacatattcataaaaaatatgaagggcttcaagacgattacaaaaaaattcgcgaattaagagaacaacaacaatttttgactgatgaacagaaaaaacagtcaattcaggatgaaattgatcaacttcgtcgtcttgtcgattataggaaaaaaagatttgcagcgttaga

SEQ ID NO: 77563 - DNA, 623 bp, Heterodera glycines
  Genomic contig location: Contig_ID=SeqID_2058; Location=85..707; Strand=+
  SCN-specific regions: Sequence locations=1-460,487-623
aagttgatcaatttcatcctgaattgactgttttttctgttcatcagtcaaaaattgttgttgttctcttaattcgcgaatttttttgtaatcgtcttgaagcccttcatattttttatgaatatgttcccagtaatctgttggatgactatcaaaaaatggctcaacgtaatccttattttgttcatagctcgtcctctcatattcttcagctgttgttcgtaaatcttttttcaatacagccttgttaaaagcattcaaattttttcttctgtgtttcattgctgttctcatctttagtgctgtttcatttagttcttgaattgttctaccatctgttactccttggtattttttcatatggtcttgaatgttgaataaatctcttattaattctaatcgaacttcatttaatttctccctatagttaacagaatacatttcgaggaattcttgaccagttctctcctccttttcctccttcccgtcatctctttgccttgctgcttcttcaagcgcctctattcttgctttcttagtcaatgattgattttggagagggtcaatttcctcatcctctatttttctcttcctatgcgtgtccgtctcatcatcacgttctc

SEQ ID NO: 77564 - DNA, 337 bp, Heterodera glycines
  Genomic contig location: Contig_ID=SeqID_13658; Location=132..468; Strand=-
  SCN-specific regions: Sequence locations=1-337
tttcttaggagtgctttttgaaattttttttgtcgattcttaggggtgtattttttgaaaaaatttttaggtcgattcttaggagtgtattttttggttttattgcatttttgttaaagaatttttcaaaaaatgtcgaaatagtgaaaaaatagtgacaaaacgccaaaatagtgatttttaactattttagtgacgaagtcgccaaaatagtgatttttaactattttagtgacgaagtcgccaaaatagtgatttctagtgcccgataatgacatcagaatcgaaaatttttaatgcagaaatgcgttttttgagctcctttcttcaaatcaat

SEQ ID NO: 77565 - DNA, 120 bp, Heterodera glycines
  Genomic contig location: Contig_ID=SeqID_13658; Location=1541..1660; Strand=+
  SCN-specific regions: Sequence locations=1-120
acacaccgtttcaaaaaacgagagatgaaccaataaatagagagtgcggagaaaaaaacatctctctttttggcgtactattttttatctctgttaatagagaaaaaccgaatttacttc

SEQ ID NO: 77566 - DNA, 59 bp, Heterodera glycines; identical to SEQ ID NO: 55001
  Genomic contig location: Contig_ID=SeqID_13660; Location=2408..2466; Strand=-
  SCN-specific regions: Sequence locations=1-59

SEQ ID NO: 77567 - DNA, 1078 bp, Heterodera glycines
  Genomic contig location: Contig_ID=SeqID_13660; Location=1184..2261; Strand=+
  SCN-specific regions: Sequence locations=1-235,257-823,846-1078
atgttttggaacagatggcacaatgaatatttagcagtcttttgggaccgaacacaatggcaacataaaggaccaaaatcacaagaaaaacgagtacctaaagaaggagaagtggttttaattaaagatgattttcaccctcgaaacacatggaaaattggaaaaataattagtttaaatggccaaaaaggagcaatcagaagtgcacaaattaaattagcaccaaaaggtaaagaacaaaatggaagaattatagaaagaccaataaataaactttattcgttagaggtgaataaaactttaaaagagagtgaggaagaagagaaaataagacaaatttagaaattaaggataaaatcagtgaaatgaataaagaaaaagaaaattatgaaataaagaataatatgcatccaatgatgacgagagctaaaacgagagactttttgacaaaaggaaacattggattaatcatggtattattattaatcagtaatgcgaaccgatagaagaatgcaaattaattaattgttggttttgcttagagaaatttgcaaatcccgactgcatgatcgtggaaacacgaattttaatgggcattggcctagcatgtattttgtcacttataatatgcataattggaaatatagcaaaattaataataagttaatggttgattttaaaaatagccctttatgggccttattctgcaattaaatttttatggaaattaaaagacaataaaaataacgctaatgagttggaaaagggcttattaaatgaaataagtaaaaaggaaaaattgcaaaaaagaagaaatcggagattatttaaattagccaatatcacattggttttaatttatctgaatacaatcacaaaaatagtaaatggagcagcagaagttgtgtccatacaatcaaattcagaagattgtgaaagaaaatctaacggttcagtatgtcgaattcgtgggacaacagaactaacaattttgccagctggccaaaaagtgaccctcgctttaaaagatgataaaggcaaattagccgggtcattggatttgttcgacattgggtaa

SEQ ID NO: 77568 - DNA, 405 bp, Heterodera glycines
  Genomic contig location: Contig_ID=SeqID_13661; Location=212..616; Strand=+
  SCN-specific regions: Sequence locations=1-50,72-113,149-198,220 -254,276-286,309-405
atggcattcgaaagaggaaaattgctcacatgccaattgaggtggaaaataaaactttttcatatgtgcatttaactccaaatttaggttcaattattaatttatggggcgagaaattataaaaaataaaaaacattaaaattttattcatattacacattttgtgcttttagtgcaaaaaatccactttttcttccgaatttattggcattatttattgcgaagcataagaccaacaatttatttttggcacaacaataaattcatttgaatgttttggcattgtctcaacattcacttaattgaatattctcgtcgcatgcaaaaacggcacaattggccaaacattggccataattattattatcattcaaatgcaaatgggaaaaaaagctgcagcagaca

SEQ ID NO: 77569 - DNA, 801 bp, Heterodera glycines
  Genomic contig location: Contig_ID=SeqID_13661; Location=857..1657; Strand=+
  SCN-specific regions: Sequence locations=1-19,42-184,206-624,646-801
atgttttccacaaaattttcatcctttttgcttctttccctgcttgtttgcattgtttacccaacaaaatcttttgcttatcgtggcgatggttcttttgtgggagaagcaaaacacgaaaaaatggcacgtaaattggtcaaaagtgggctgacacaggacgaattcgagcaggtcaattggggaacgaaataaaataatttaaacgaataaattaaagctttttttggacaatggggtatcaaaaaagaaaacggtgcccaaaacctttatgataaagccgttttttgttttttttttatttttaaatcttttttggtattagatcttcaattttgctttcactaagtttgtccgtgtaccttttaagaaacgaaggaatgaatgctcgttccaaatgtttaattaatccgatcctttatcagttggcaaatttaattgcccattcatttgccattcgatttttttacaattttaattgtcctttcttcagacttttttgccattattgccaattgaacttgagcagaagaaatttgagcgacgcattgatcaaatggaaaagcaactgatcaaagtgatctcctccgttcacgatggcaattgtatgacgaagaaaagtgcaaaagaagaagaagaacagtgaatgaatggaaaaagaagacaaacaaaaaacgaaaaaatttgatcgaaaaaatctaaaaattttctcagtattttatggcaaaatttttgtagcaaaacatttatctcccaatgcttaacgccaattatttgtatcgtgcgaaagatagacgcaaa

SEQ ID NO: 77570 - DNA, 995 bp, Heterodera glycines
  Genomic contig location: Contig_ID=SeqID_13661; Location=1748..2742; Strand=-
  SCN-specific regions: Sequence locations=1-155,177-950,972-995
atgatttcaaagaaggtgtggttgaacaaacggaccaacgaaatactgacattggagaaagaagaggactatgatgaaaacacggagaaagataaatatacttatggcgattggctgttgaagcgatgccaaattgggggcacggcgacggttcagtgggaggaagaaaatccgagcattttgagcaatgtcaactttaaattttatagtggcacgaattgcattgggtgagtggcatcaacttttgctataataatcaaatttaaattgcaattcattcaggccattgtctgcatcaaaggcgggcaattgtatgggcgaaaaatgataaaaaaaaatgagatttttgggaatttttatgcaaaaagacacttaatttttccaatttttaacacatattttagcacatattttggcatttttggggtttttagtagagtgccacgggaaagggaccgggatcgaaaaaaaatcgaggtcccggtcccggcttctcaggtcccggcaagtcccggtcccggttttggcaaaaattcccggtcccgtggcactctagtttttattacatatttcagcattttttagcacatattttattacatatttcagcattttttagcacatattttattacatatttcagcattttttagcacatattttattacatatttcagcattttttagcacatattttattacatatttcagcattttttagcacatattttattacatatttcagcattttttagcacatattttattacatatttcagcattttttagcacatattttattacatatttcagcattttttagcacatattttattacatatttcagcattttttagcacatattttattacatatttcagcatttttagcacataaaaatcccatccctatttattaaggcgttttagggatcaaaacacgtaaaacttaatctaaaaacttagttttggtcatttaaatgattattaaataaa

SEQ ID NO: 77571 - DNA, 1240 bp, Heterodera glycines
  Genomic contig location: Contig_ID=SeqID_13661; Location=2971..4210; Strand=+
  SCN-specific regions: Sequence locations=1-486,508-720,750-1240
atgattaaaattcaaatagcgaatgtttgtcgcaaaaattggccaaatttcaagtgcaaaatcatcccaaattggctggatatttttggctttataggggtatggcatatacaactccaaattggtgtctttgccaaaaatttgttgattggcacggagaaatttgatgacggaatggtcaatgtacctggtaagggtatgcttttattagttaattattcgttgatttgtttgatttactcaatatgaaggtcctcaaagcggattttgttgggcagctgatagtctggcaaaggaaattgcacagatttgaaaggaaattgcatagatttgcgatcaatccatacagataattttggttctggtccagcaccttttgaattctgatttgtctccaaagcgtcaattggcttttgccatcgaaatgtttgttgaccaacacattgaaacgtggcgaaattagtgccaattttaagccgagttgagcatggtcaaaaagtgggagaatgtccatcaaaatgtcgttgcacacccaactgaaatccgatttttgaggccctgtaactctcgaaggaagcaaaatgcaccgctaaaattaaaaatcacatagaagtcgaccctgctctatccaatggtatatcgtttataggcattttctgactgacagctcgtaatgttccctgttagcgataagacaattaccaaaaaagttataacatgaaataacaaaaaacccaaaattttggaagttttttcttaataacttttttacaagctaaaacttgggcgctggcaccgaaacgtccttttccggttcacccccccccccgccattttagaaaaatcttagcgattttttggaaatttttttttataaaaatgaaaaatcagtaattcatatttagaaaatcttagcgatttaactaagattttttcttgtaaaaaattctaacaataagttggtaaatcttttggcattcctgacttatatggattgttttaaaattgattagcttatagcgtggacaaatatggtaccattcgaaagattgttgccaatttgtggtgtttatttccaaatttgtttagcaatttcgccgtgccaccaatgccgccagctacaaaattcagtttactgctcatgcgccgtcaacgtcaaccatggtgccatttgaattggtgaatgaaagaacccgggaaaagctgacattgaccaaagcagcatacgaccgatggataa

SEQ ID NO: 77572 - DNA, 2455 bp, Heterodera glycines
  Genomic contig location: Contig_ID=SeqID_13662; Location=315..2769; Strand=-
  SCN-specific regions: Sequence locations=1-54,76-130,152-186,208 -299,325-517,545-615,638-734,756-892,914-1302,1324-1567,1589 -1765,1787-1882,1904-2424
  Gene Ontology: Mol. function=chaperone activity; Cellular component =nucleolus; Biological process=nucleolus organization and biogenesis
atgtgtgatgatcaaatggaaaagtaagccggaaaagtgtttcttttatacaatggaggatagagaagaagaaaatcatactcctttttttgctaaattttttgtttcttttttggttgtcatcattataaaaggaatgcattttatcagtttcgaccattccattcctcattcaacaacaacagataatgttattcttattccctttgccccttattttgcttttgctcgtggccattgttttgctcagccagtgctgcggttgtgtgaaaaaggtgtttaggaagaactttcgttttatcaaattaaaaatcccttttccctttttgcagaaaggcgacaacaaaacggacagaggcgcagaagcttcacccgaaggcgacagcaaagaagaacagccaactgacaagggaggaaaagcaacaacaggccgcagcagcaaaccagagacgaggccgagggaaacgccgaccagcacaaacaacaggcgtcagcaacaagaacaggcagaaggctcagggaggaggaacaaagttggtctaaaaaattcttgtcttaccattcaataatttgcactcttaggcactatggaagcccgacaacatcacgacgtccaaaacaaacatcaggaagcagcaaaacggacaatccaaaggacaaaaaagaagggacatcaaaaggcggcggcagtaccaagaacgagccgaatgccatggtagatgaagcaacttcaaaaggcggcagcagcagcaccaagaacgcgccaaaggctcaggtagatgaagcaacttgaaaaaccggcagagcatcaataacccaacaaattcccaggtcggcccgacagcacatcgacgtccaaaacaaacatcaggcggcagccaaatggacaagcagaaggcccaggaagaaggaacttcaaaaggcggcagcatcaacaccaagaacgcgccaaacgctcaggtagatgaagcaacttgaaaaaccggcagggcatcaataacccaacaaattcccaggtcggcccgacagcacctcgatgtccaaaacaaacatcaagcgacagccaaatggacaagctgaaggcccaggaagaaggaacttcaaaaggcggcagcatcaacaccaagaacgcgccaaacgctcaggtagatgaagcaacttcaaaaggcggcagagcatcaataacccaacaaattcccaggtcacaacgaacgcgccgagtattgaccaaaggaggaggaacgacttccaaaggcgacagcaaaacggacatgccaaaggacaagaaagaagcaacatcaaaaggcggcagcagcagcaccaagaacgcgccaaaggctcaggtagatgaagcaacttcaaaaggcggcagagcatcaataaccaacaaattcccaagtcacaacgaacgcgccgagtattgaccaaaggaaccggcagagcatcaataaccaacaaattcccaggtcacaacgaacgcgccgagtattgaccaaaggaggaggaacgacttccaaaggcgacagcaaaacggacaagccaaaggacaagaaagaagcaacatcaaaaggcggcagcagcagcaccaagaacgcgccaaacgctcaggtagatgaagcaacttgaaaaaccggcagagcatcaataacccaacaaattcccaggtcacaacgaacgcgccgagtattgaccaaaggaggaggaacgacttccaaaggcgacagcaaaacggacaagccaaaggacaagaaagaagcaacatcaaaaggcggcagcagcagcaccaagaacgcgccgaatgcgatggtagatgaagcaacttcaaaaggcggcagagcatcaataacccaacagaacgcgcctgcccaaggagaaggaccatcttctgaaggcggcagcaccaagaagccaatcacagacaaaccagattatatgaggcaaccataaactttcttggaaaatgatcctgtatttatgttatttgttgtgataagttataattgatcccgtattatgttattgttgatcatttatgattgatccgtattatgtatttattgttcattgtgattgatcccgtattatgtatgttttattcactcatatacgaattataaaacccaaacccagggttgccagatctgaggatttatcctcattttgtggcttattgatatgtcaatgaggattttttttgaaaatgaggatttttgtggctttttgaggcctttgggaaaaatcctcagaatcttttaaattttgataaattggcataatgaaccaaaagactgtattttattaatttgaatgctgtttgggtatttgggattgaaaaattgaagattgaacccgattttggacataggcgccaatgtcgggacgcaaatgtgggataacctttaaaatataacatttcatgttcgcttaaaaaatttatcaattttttaaaaataaa

SEQ ID NO: 77573 - DNA, 91 bp, Heterodera glycines
  Genomic contig location: Contig_ID=SeqID_13662; Location=4016..4106; Strand=+
  SCN-specific regions: Sequence locations=1-91
ggattatttttcaaaacacctcgtagactgggggataattggagactgcgggattaatatagactgggctataattagagcatatacggta

SEQ ID NO: 77574 - DNA, 1647 bp, Heterodera glycines
  Genomic contig location: Contig_ID=SeqID_13666; Location=732..2378; Strand=+
  SCN-specific regions: Sequence locations=1-616,639-1048,1073 -1125,1148-1243,1266-1402,1424-1572,1602-1647
atggttcgcaaaaagcaaagtttctcttcggaaacaaaagataccaatgtatcttcattgaataaaggggttcaaagctcccctgaaaaaaagcggtctgaaggggttcaaagctcccccgaaaaaaagcggatagattatgaagaaggggttccaagctcccagcaaaagcggatagtttttgacaatgttcgaacatatgaaaagcaaagcaaagacaatgttattttgatcaatttggatgatgaagattttgaaccgtgtacaagtaaacgaactatatgcaatgtagtgtccgaacaaaaaattgatcaattacggagagatagagaaaaacgtgtgagatatagagaaaatgaagcagaagcagaaagggataaaagaaccaaacaacatcgcttgcatatgcaaaatgttagggaaaatgaaatggaagttgaaaaaaatgaaagacaagaagctgataaattacgtaagagaaacattaaagaaaacgattctcatttgcaccaatataaggctaaaaatactaaacaaataagcaaggtttcttttggttttatgaatattgcatgtacgttttgtggtgctttacattgggcttaccaaaaagtacaaggaaaaaacagttttgatgattgttgtaatcatggaaacatttttttgagtgaaattccagaaccacctcaaatacttcgtaattttttgataggaaaggacaaaaaaagtcgaaatttttttgatgggattagatatttaaattcgagcttggcatttgctactatgaatccaatgcgtgtaaaacttccgaattatggtccgtattgtttccgtattcacggacaaatttatcacagaattaacattgctttacatccagacgatgatgaatcgccatctcatggtcatttatttatacttgatccagaagatgcaattaattccatgaaacaaaacaatcttaatgtggatacggatgttttggatcttttatataaaactataaaagaaagtagtccatttgttgacggtttagaaatgatgattgaagaagaaaatgttcaaaaagaaattgctctcaaagaaaatcgaaaaccttatgaggtccaattattattatcggataacaaaaatcttgacaaaagaagatacaatcttcctagagcaaacgaagttgctgcagtttttgtctgtgattctgaaggtataattcctgaacctcgcatagttattaaagaaaggggaaaatctttaaaaatattaaattgtaattgtgctgaagcagatccacttctttatccgattttcttaccttatggtaacaaacaatggagtcctgatattcaaaataaaaaggaaaaaaggatttcaagaagtcaatttattagatggcaattagctattaaagaaaatagatttaactcatttcttcatggtcgaaaattgtttcaacaatattgtgtagatcagtatgttcgaatagaaaatgatagaatgaaatatataagagagcaccaaaaagaattatgcgcggaaagttattttgaattagcagaatggttggaagatgaggatcaaagagaaaacaaaaaattgacaaaagtaattttaccatcaagagtaactggatcacccaagatatattga

SEQ ID NO: 77575 - DNA, 193 bp, Heterodera glycines
  Genomic contig location: Contig_ID=SeqID_13668; Location=63..255; Strand=-
  SCN-specific regions: Sequence locations=1-85,108-125,155-160,182-193
atgacaaaggacacccacggcgattcgttggtcgaagaaatcggagacatttcaccgccgcgagggctttcaaaatttgcctacggcaagaaagagaaaatagaagaggacgctgaacaaaaagaacgacatcaacaacaacaacaaaggaggacaaatggaaagacaaagacaaaggaaaacgatttggcag

SEQ ID NO: 77576 - DNA, 1210 bp, Heterodera glycines
  Genomic contig location: Contig_ID=SeqID_13669; Location=365..1574; Strand=-
  SCN-specific regions: Sequence locations=1-129,151-190,212-384,419 -461,484-545,567-593,616-622,644-680,702-789,811-878,900-1210
ctcttctatgtgttggtgaatgtgaattcgcatttttcactgcgacaaaattcaaaaatgcacaattggacaatgcacggaaagggaaatgctgggattggaagcgaatggcatttggaacattttatgattggattttaagtgctaaaatacttaacgaggaaaagaaggacgagtccacttgcaaaagcaaaaaggtggaagaaaggacgaaaataatctcattgtcagtaatattttttacagctctttttaacctttcattttgccaataattggatcaaaacgatggaattgcctgagggagaaattggtgtaaatgtttcatcgcctgcggaagttttctctgttcgtttgggatgtcaagcacttgtgtaagcaaacattttatttatttcttttattttattttaaataagctattcgaagcgccgcattttcactgagtctctaaacgacttaatctcgaaaaagtgccaaaaacttgtttgaaaacatacatcgctacttgcctttccttcttggccttaggtttttaaatttgtgtataaaaataattttacgattaagttaccatattctttgaaaaatacatgtaatttattagtgcaatttcaggtgctttttacattatcttttaataccaatttcagaaggggacctatcagaagaatttggcattgtcttaaattcctcccataattttaaagaaactaaggacctcctcctttcttcatggaaattattggccatcgctgtgcgttttttccggcacttcgttcggtgccattcatttctttcaacccgcaattgggcctcaaattttgcgtacttttgcgggaaacgaagttcaattaatcgctttttccgcctttaactttctttttagggaatgccttttgccattcgttgcgattccaatttccgttggcttttttccgtcggcgacgatcgctcacttcgcatttggaacattcaaaagggtgcccaagtcagaatgagtgtgccaatttctttttttacttttccttctctttagcttttcagcaaatttggacatggggccaggccatttgcattggaaatttgtgagggcgagcgaatgattttcaccgctggggtggacaattacatatgcatttggcgttggtcgatggatgagaaaaaaggtgccatcaaaaacattttctgctctaaaattgaaaaataa

SEQ ID NO: 77577 - DNA, 195 bp, Heterodera glycines
  Genomic contig location: Contig_ID=SeqID_13670; Location=501..695; Strand=+
  SCN-specific regions: Sequence locations=1-151,173-195
ttaaaattgtttatttttttcatcaacacaaacataacatttgggaaaagtccgagtcagcgcatccaattgatcatgtaaaaataccaatgcttttgcatcaagcaaaattgtctgctttcctccatctgttgtatttatttccatgagaatttcgtatttgttattcaaatgcgactcgtcacgagttgagac

SEQ ID NO: 77578 - DNA, 1608 bp, Heterodera glycines
  Genomic contig location: Contig_ID=SeqID_13674; Location=49..1656; Strand=+
  SCN-specific regions: Sequence locations=1-4,38-125,149-906,928-1608
  Gene Ontology: Mol. function=ligand-dependent thyroid hormone receptor interactor activity; Cellular component=cytoplasm; Biological process=protein ubiquitination
atgccagcagcaccaccagcagcagtagcaacaacagtgtcaactagagtagagcgggaccgggaattttgggcaaacccgggaccgggaccttttcgggttgaaaaaccgggaatttttggcttggaaaaccggggaaaaacccgggactggtcccggtcaaaaccgggacctcggtactcagttgtccgtgttttggtcccggtcccgctctactctagtgtcaacgacactgatgatgacgacactgatgctgctgctgatgaggagggctccgatggagaggaggaaacgacggatgaaatcgaggacaacggcgagcagcaaccgaacgcggcgccgacgccatccgccgcttcgtctggtgagcaaagctttggaaatgtgaacaccagttctcggacctaattccgtaaaaacgaagcatccctacccttcccctttcttccaacaccaacaattaaattccatccaattttcttcctcattatcctaatattgttcatgttttcagcctctacgcatcgtcgacgctccaaatcaactcacaaaaaacagaaaaaggcatcaaccgctgggcgtggttaatgtggccactacagcaggcacatcttcttcatcgtcgacggcggcgtcttcgtcaaaaataggtccaatgaatgataattaaaaaataaactctttaatcatttcccaatttggtctttttcatgcgctttcattttcagtcgacacaaagtctgggcccattccatcgccgctggaagcgtttttgaaaccgcagctgaacaacgcgatgtccgacccgtctcagaactgtctgattctgctgcaagtgctctacgggctgaacacattttggtggcgaatttttgatgcaaatgatgccgacactgatgaggacggcaatgatgctgctgctgatgaggaggagggctccgatggagaggaggaaacgacggatgaagtcgaggacaacgagcagaaacaaccgcaaacaaatttaccaccaatcacacacagaccgatcatcgccccgaggtttgatttttttaatgccatttttatttttcattggttttctgcgaattattttaaaattatggctgacaaaacagcaataaaagtctcataattttcagtttcttctactcaccaaagctgaattccaaagtgacgcgtcaactgtctgactttttgacggttgcaacccaacaaataccgaaatgttagtttgtcttttttttaatttagtgtcattttttatttttttttagggacattggacttggttcgagcggtgtaagtttcctaattcttttttaaactgttaatcccatggaattttcctggtgttttttttccaaacttttttcaaatttcgtccaatgtatccttttcagtccgttcatcttcaacttctcctcccgccattccttcctgttttgcactgcgtttggccgtgatcgggcactgatgcatttggtgaacgagacgagcaacgacgagcaggacggcgccgggcatgacaccgcctcgcggctgatcactcggctggagcgccgcaaagtgcattttgtgccaagtttggttcaaatgcttatctaa

SEQ ID NO: 77579 - DNA, 621 bp, Heterodera glycines
  Genomic contig location: Contig_ID=SeqID_206; Location=2349..2969; Strand=-
  SCN-specific regions: Sequence locations=1-539,565-621
atggacaacagtgaatgcaaaactgaaaaggaaatggatctgaaaccggaggaaaaaggacatggagaggaaaagggcgaagaagaaattgtttttctcggcatgacgataaacgaaacgcccaaggatgaaaagaaggagctaccgccttccacgagcagtggtgatagccgaaaacgacgtcattcatttgatgggtccgctacctcaatgttgggcgcaatgatcaaggcacagggcgaagcacgtgccgaatggtaaattgtgaaagtggcataacatagatgcctcctattaaaaacaggctggatgcgttggaaaaaaaatactccaaactggaggaagaaatgggtgtggacgacaatgcctcggacgtggtcgattttggggaagactctttggacaccatactaaaaaagtattagcaaaaataaactgcgttgactcgatcaaccaattttttttttttttttgtgtagggttgaacgttctgaggaaaaggttcgtgattgggaggccgcgcattgttccaatggtaatcagatgatgatgatgattattacaaaattaaaaaatagctatcgactctcatcgagaaggggcccagagttcttcaactga

SEQ ID NO: 77580 - DNA, 898 bp, Heterodera glycines
  Genomic contig location: Contig_ID=SeqID_206; Location=3137..4034; Strand=-
  SCN-specific regions: Sequence locations=1-79,103-898
atgcgcaatgagttgggcgcaaatcgtgtgatcacaaagcctcaggaattttacaagctcatccttgaccataaagtcgtaagtagtagtagtagtatttgaatgctcgccttaatttattatggaaattttccaacgcaggaaatttatgccataattcccctttccgatgaagtcattcgtgtttcgtacaggaccaaaaaaattttatcgatgaacattcgtccagcaatatcgtgctcagtctgtggaccactagttagttttgtcaacactagcattgctcccattattattttaaggtcgtgcaaggttgaagttactcgattatatgcagcaagtgtacaacaccgaaggagcagaattgctttatacggtagtttgtcttgtgttttgtaacacaattagcaccccgttgtttaggacactgacagtgtcattgtgaagcatagtcgtgatttggcgccacttcaaaccggcgaattccttgtccaaatgtcagaagaatacaccggattttccataaaaaacttcgtttgtggaggtacatagcggcgtatagatttgtaatagacatatttctttccgcttaggagcaaaacaatatgcactaaaaatggttgatgagcgaactggcgaaatccgatatgtgcaaaaaattagaggaataacttttgacgtgcaaaacagtcagaccctacagtttgagcattttcgtcagaaagtgttgaactatggacgtcaaggagaggagccagccgtgttccattatgataaaattcaaccgactcgtgcgagtcagattgtgacacgtgagcagcgcaagcgatatctgcccgtctgccagaagggaattatcactgatgagcttgatgttcttccttttggttatcaatga

SEQ ID NO: 77581 - DNA, 519 bp, Heterodera glycines
  Genomic contig location: Contig_ID=SeqID_207; Location=2712..3230; Strand=-
  SCN-specific regions: Sequence locations=1-356,380-519
atggctgagctggacaagcttggccaaagtgatggtgaagacggaggaattggtgttggagagaatagtggtgaagcgctcgacaaacgatcattgctactcagcgaaccggtgcaaatcactgtgacctgtttaactccacctaccggggcgggccgaccgcgcttctacccgtatcagcattggggctacaatgaggcgcatcgcataaggatcagagattgggaagacaattattgtatgttccacgcgcttattggtgctcgagcgtaccacgaccctatgctgttcaacgactggatgttagctgatcaacagccacaacagcagaatttggcacgactgatgctgatgcaggatttttgtgaaaccaaagaagcttttcgccgtcttatcatcaatcgagagttgatgagttcctcagtgcaccgcctaatgcatgcagctggcgtacccgaaggccaacacgcatatggcatggaccatttgcaaaccgttcaacactattgggttcagtga

SEQ ID NO: 77582 - DNA, 504 bp, Heterodera glycines
  Genomic contig location: Contig_ID=SeqID_207; Location=7661..8164; Strand=-
  SCN-specific regions: Sequence locations=1-24,57-275,312-504
atggaacattgccaattctgtgacagacgttttttaaacaaaaaaggcctcggtgttcatatgcaaatacataacaggcagaagtaaaaaattcataataaattgaactttttgttctttcttattaagtgccatgtttcgttgcaatttgtgccaaaagggatttaaatcgaacaaatctcttagaaaacaccaaaaacttcatggaggtatagtaggcaactaaataaaatgaaatgattttaccctttgttttcaagaaatcgaaatcaaagaaaaatatttttgaaaaataattttaatttaattttcagaaaagcaatttgagtgccgcatttgtcataaaaaattctctgcagcaaacaatatggttgtaagtaatttaaaagttagtattagggctatgcatttgattgtctttctaggcatatgcttaaaattttagcttattagcatttctgcatcaaaattaacttttggttgaatcttttagagcctattaaa

SEQ ID NO: 77583 - DNA, 1432 bp, Heterodera glycines
  Genomic contig location: Contig_ID=SeqID_207; Location=3297..4728; Strand=-
  SCN-specific regions: Sequence locations=1-549,571-652,738-837,859 -1142,1164-1325,1347-1432
atgagcggcctctcccgatttcaactctccactgctactgctggccagcaaaagcgtaaaagcgatggcgccccagcaaaaacgaaaactctgaaggaagtgttggacttcaaaagcgccggagtttttcacgtcacggcaaaagtcgtgaatttgcaatataaaatttataaggttgagttttgtgtttttagcgcttttttttaattttgaattttcaaggcctgccccctgaaaaataggggcttcttctgccgaaaaaagttggatgacgaaatgagatgcacttcatgcgatcacattgtgaaatcgcccatgaaaagcctgttcctgcgcgtcgaaatcgccgatcgtgttcagccggagagcagtgtggtcaccacgatgttctcgtacgtgggcgaaaaatacctgggaataaatgcgcttgatgttgacgaattgagcgaaaaagagcccgaaaagctcgcagaaattttggaggcaaaattggacaaagaggtggtcgtcaaagtgcaaatcaaggtcggttgagtgtgtgccgctaaatttgtttttaaactttgtgtttaatcaggagtccaaaggccatttcgaaggccaggatttcgattggataatcatgtccatgtgcgcggacaacaaagatgtcgaaaaagaggaggaagagaaggccaagaaaaaggtgaagaaagaggatggagaactgaaggaagagtcggaggatgacgatggagatgaaattcagctggttggggagacgaaatcgaccagcaccgaggccgtgaaaaaggcaaaaaagaattgacaagagtgctgagtaatgatgaacctatcttaaatgatattgatgttgcatttagcatagaaaaaacaattgttaaaaaaatgtttgcacttgtaacagccgacaaaaaaaaaaaggcatagagaaattgccaaattatttgaaacactctgaaaaaaaaatttgtttttcaccttaaataacagcacaatgaaaaggcgctgggactttcgttcaatgagcttttttgagcagcccagcccacctgaacagtcgtcggctttgtcaacatcacaacagcaacaaacagatgacgataatgatgaacaccagcagggcgagggacgcgggactagagcggaaggcggcagccaatcgaccggaaacgacctttttcaacaggtctcacactcagtgcacagactggagcgcttttcggtgtcacgacacatcacagagtttgtgctgaatgccaacgttgaggaaccggacgaagtcttgcgcggtgcattccaaatccttatggaacgggcaatccaaaatgcagagcagcaaagtggccggaaagttctcaaaattggtgttacgctacagggaagaggtttgattggtcggctggtagcccttttattccttacctattaa

SEQ ID NO: 77584 - DNA, 332 bp, Heterodera glycines
  Genomic contig location: Contig_ID=SeqID_2059; Location=156..487; Strand=-
  SCN-specific regions: Sequence locations=1-34,56-332
atggatgagtcgaaacgggaaaagttttcccctcaaaatgatgatgacgtcatcacaattggagacaacaacactcaaacactgcttgacctgcaaccggggccctcaaaaaggggacgcaagcctcgcttggacaaaatccatgaggaaattgcttccgcaatgaagaaagcaaaagccatggaagctgaaggtttggctttttctgcaaatttctttaaattagccaaattttagtggatgaatcgcccaaaaaacaaccgaccaatgtgtttgagtacccgaccatattttggaaattggcccgcccaaaggttttggctaatatttaa

SEQ ID NO: 77585 - DNA, 3452 bp, Heterodera glycines
  Genomic contig location: Contig_ID=SeqID_2059; Location=1387..4838; Strand=+
  SCN-specific regions: Sequence locations=1-371,393-545,567-1118,1141 -1343,1365-1877,1899-2885,2907-3164,3186-3340,3362-3364,3386 -3426,3448-3452
atgaagcgtgtgcggcaatcggaaaagttgggcgaattcccggagattgagttcgccgtcaacacaatgggcgtcacggtgtactgcccgcggcacctgcaaacgcctcggtttgtgccatgggaccagcccgggcggtgctcgagctgtagaagcggaactgttgagctggactacatcatccagcccgagggggtgaccatcttttcgaatcggctaaagacagacggcgagaactttgtgccgtttgatgcaattggtaagctgcaggtgtatgtcagagtttgactcttttcttaagtggactttgccgatcgtgcgtccgcattagggcccggaataaggtgttcacgctgccgctgcgacacccggaggtgcacgccgccggcccaagcttggaagacggcgtaaaagaacaaaaggaaatgactcagatgtcataagcacttgtccatttttctttctattgttgatattctgatggactacccaagaataaatgaaagtgaactcgcttttcccatcccttcggggattattgtcagcggtccgtcctcatcgggcaagacccagctggtccttcgcctgttacggcatgcaaacgtgatgtttgacccgccgcccaaggcaataggtatgtgcaaagggggtttctgtgcagtgggctgttgctatttagtatgggcatacggtgagtactcgacgcagattcccgatctggagcggcagggagttgtcccccacgcaggtgccccgtctgacgagatgctgaaaaagctgccaaagccttgtctgattgtttacgatgacttgatgggtgacattgaggccaagaagttggccgatctgtacaccaaaaagtcccaccataacaatttttccgtgattttcctcacgcaaaacctgttcgataaatcaatgcgggtgccaaggtcgaacgcccagtacatcttcctgatgcgggctcccaacgacatgcttagcattcgtaatttggccagccaaatgttccctcgcgagcagggattcctgatggatgcctaccgacaggcatgtgctctgccgtacggttacctgttggtgactctccacgcgaacagagacaacattatacgcctaaggacaaacattttcccagacgacgaggagagaatcatttttgcccccaaaaatggttaagcgggaacagaagatcggtgagcgggttgtgcacaactacgactatttgaagaagttgggaaagacaacgtcggagaagaagcgccgtcatttgttgaacagtgccggttgtgaggaactgttaacgcttgtcgagatttgtctcaacgttttgaacgggagtttctgtctgagcaggaaacaaaagcagagacttgagccatttgccaaagacatcagacagttggcacgtgtgcgaagtgagaggggtgcgcgaaaactagtgcagcagtcaggcggatcactttttgcccctttgttggcccccattctgattgaggctgcccgatacctgctttcgcgcagcaataatggccaataaacttattctgctgccatacgaacactacaaggggctggttgcagcgagggagacaaagaatgacgacgacgacgacattgctgagcggacaaacttgggctttgtcaaacgacaggtgaccgctgcagtacagaagcggaagggaaacgtcagcgaacggaacgcaatgtacaaccagcacctgcgccggtacctgaagatgcgcaaggaacataaggagcggcccgtccgagtacagctcagcaacggcgctcaactgctaaataaaacagtggagacgggtgtgcaggtacggcctggtccggacgaaccgaaggacaagtccgtgatggttaccgacgaagatgaagaggaagagattgaagtgccaaagtttttaaccccaacaagcccgacgcagggaagcagccgatcacccaggaccaataagaaagcagcaaaacagcaaaaattgatcgagaagaaggaccacctgttggccatcattatgtctgatccgcagagattcggcgcaactgaccgtgggaaaatcattaacccaaagacgggccgagagtttatcgactcggacctggcctggtcaattgaacgcctggtggaccctcgcccggagaatgccccttcgccacgcggaaccaaagagttgaagaagaaactcgcacagaatccgctcgccagtagcctactcaatcgactgtttgttgggtctgggttcgtcggacaagtcaaacaaacgagaggatttgttccctcaaaatggacaagaaaataaacaaaatatacaccgatccggccaatccgggcgggtatgcgggtgcgagtgccctgtacgcggcggtgaaggagaagcacccgaagttgaagcgtgccgagtttgaggactttttgcaaaggaacaccacctacgcgctgttcaagccaaagagagacaagttccgacgcctacgcactgtgcctacgggtttcatgccggtgagattttgtgcggcctttttacactttattcacgggttcagatgttcaggcggacttggccgatttccaagccctttcgcgcaagaacagcggcaaccgttacttgcttttggctgtggatgtgttgtcgaggcgaatgttcggctctcctgtaaagagtaaacgaccggcggacatgaaaagggcttttgaggagcttttcgagcaaatgccaagggtgccggacacactgtacaccgatcgagggctggagtttgtggcaaaagcgttgaaggagttttacgcggagaagggcattcaaaagtttgagaccagttcaaagaagaaggccgccgttgcggagcgtgccatacgcaccctaaagactcggctgtacaaatatttttcctccaacaacacatcggtgtgggtggatgtgctgccaaagtttttgagtgccataaataactcggtgtgccgcgcgaccggacttagaccgagagaaatcagcgacaccaatgcgagggaggtctggaagagggtgtacggcgaagggcttgtacaatcgaacaagacaccaaaaatcagagcaggggaaacggtcaggattcccgagcctaagcacattttcgagaagggtactgtaattcacacattttccgatcaatttattttaattttaggttatatacccaattactctgatcacgtttacacagtagatgaggcccgctcaaccaacccccagcactatttgctcaaagactattatggcacaaagttgaagagaaaattttatttaccagaattaacaaaagtacaagtggatgaaaacacaatgtatcgaattgataagaaatacaaagaacgagtgagagatggaaaaagagaaatgttggtgaaatttattggatttccggaaaaatattgggttacaaatgaagaaatgaatgtataa

SEQ ID NO: 77586 - DNA, 717 bp, Heterodera glycines
  Genomic contig location: Contig_ID=SeqID_2059; Location=5097..5813; Strand=-
  SCN-specific regions: Sequence locations=1-540,562-717
atgcctcaactcgttgtggggccgttttgcactcagaaaccggctcacaaagacggagatcgtggaatgccatgccgagttggccaagctgctgaacaacaccaaaatagaaatcagcagcatcgaccagctgacggagaaattctggatggtctgctacaaggcctgcgatgaggatgtagtggagcacggcaccagcaatgtaaacttggaaacgtttgtttttaaatgcaaatatctcaggttgccattgccctctggacaacggcggcagcgcgggtgcacctgctcgaatcgctgcatttggtgtataagcaagaaaatggggtgcagcgatatgacacgcaccttctctatatggtaaaatcaaaacaaataataataataataattgctaaatttaaggacacggacagcatcttctacgacttcaagtcagaactcagcgaccctcttcctggcggccagcagcttggggaactcacagacgagtaccccaaccacaccattatggaatttgtgtgcggtaagaatttgcgcaaaataactttaaaatgatttgaaattttcagctggacccaaggcctatggattgtggctgcgcaacaacgccacgggggaggacgagtacaaggtcaaactgcgcggcatcaccatggactcggacgcctgcgagaggatgacgttcgagaagatgaaggacatggtgttgaataa

SEQ ID NO: 77587 - DNA, 1097 bp, Heterodera glycines
  Genomic contig location: Contig_ID=SeqID_2060; Location=587..1683; Strand=-
  SCN-specific regions: Sequence locations=1-386,409-1097
atggcaattgtgggcgggggtgagacagccggtgccattcgtgccagggatgccaaacgaacgcatgcaattgcgcgggatttcgaggtcgaagtggtgtgggagtgcgagatcgccgatcagctggaggacgacccggccatgagggcgtactttgacaactgcccggactctggacccatcgacttccacgacgccttctttggcggtgaattttcccattaaatctgtgtaaaatatgctaaattcttaggccgtaccggaccagaatggcttgcggcgacggtgatcaacccgaagaatggagaatggaaaagccgaacaataaaagtgaaggacttcaacagcctttacccatcccggtaagaaatggcacaagaaatgactttaaaaatttaaaatttttaagcaacatgttcaccaagtacccggttggccacccaaccgtggtgcaattcgacaagaaagtggattggcgctgcccggcacatattgtaggcgaggacggcgtccggcttcaggggatcatcaaatgttatgcggtgcccccacggcattgcttgtttgacatccccgtgctgccgcatcggaacagcaagcgcactctctttccgctgtgccgaacatgcgcgaagatatacccgaacggcctgattgaccccaactacaattgtccacacttttcggacgctgaaaggggtaaaatgggcaaataaagtaatttttacagagaagaattcacaggtttttccacatctgtcacgcacattgagttggaggcggcactccgatcaggctacaaagtgacgcacgtctaccgagcgtacatttggccgctggtgtgcgattggagcgatagcgtgttccattcgtacatgaacaaatttctgaagatcaaattcgagtgtaagcattttttaaaaaagtaatacaaaatttaaaaacaaaaatgcttcagcaagtggatacccagcaccgtgcagagaagtcggcattgacgaagaggagcgtgagcgtcgacagcaggactacatcaataagccgtgggagggcaacaaagtgtgcctcgatgcgagcaaaattatgccgaatcccgc

SEQ ID NO: 77588 - DNA, 2479 bp, Heterodera glycines
  Genomic contig location: Contig_ID=SeqID_2060; Location=1763..4241; Strand=-
  SCN-specific regions: Sequence locations=1-152,195-416,443-660,682 -804,828-1255,1277-1360,1382-1481,1522-1676,1700-2022,2080-2286,2309 -2479
atgaaattcgtattgcctcagcaacgtttctccgaatacaagaaggacgaaagaagacaactcgaaaatgtgcaagccctctgccgagcatgcaatattgacatggacttgcccttttattgtgttgtggaatacggcgataggatccaggcaaaatttaaaaaaaaaataaataataataattaaaaaattaaggattattatcagcgtcttcatcccgggttgttttggctttactgcttcgaaacgtccggtcggatgaagccatcatggaagtcatgtgccggcgaccgcgagcatgaactgtgtgttctttttactgaggatgtgaatggtgagaatgggcattatgacgctgtgaaatcggttggaaagctgttcggcacacaaaattattgctttggggtaacaaaaacaatttttttttttaatattaataaaagtttaagtgtgagatgccgtactttcaacacactcaacattcggccaaatgcaaatggaaatgtcacaattgccagcgcgtgggctgggcgttcagaggaaactgtgacgatcatcaaaacttctttgagtcttgtttgggatgcaataaggtcgtcttatcgattaatatttagtacctttgtttttaagactttcaaaagtctcgattgctacaaacaccatgccaaagtcacacattgtaaaatcaaacgtggcacagaaaatacaacaattgtgaaatcaatttgcaacagctcaaaaaaaatgtgttgactgcggtattatttaccaaactagggtaaaaattattttcaacaaacaattattattattattattattatgcaaaggtacataagaacaaagcacatgtatgcggccacaaattctgcaaaacctgccttgggtttcacgcaccgcgggactgctacatcacttaccagcgaaaagcgaagaaggataagcggatcatcttcttcgacttttaatgcaccacggacttcaagccggacccgcaactcgccagattcaaacaccaagtaaaaaattattttgtcaaattaaaaattaaaacttgtgaaatcacaggtcaatttttgctttgcccacgtgacctgcacgcgctgcatcgaaaaaggcgtgtgggaccaggagttggaacgggcttgcgccctttgcggccgcttccgcacctactcatgggcgccgttcgaattctggcgcacggacgtggaatgtgcaaatgtcgtcgatgatccgctggccgcttttaccaaatggctgctgaactttgaggcggaagtcctcggtatggagcttggagcgaagaagcgccgaaagcgaaaaaatgccgaaaacaacaacgacggcgaggccatggaaggggatgaggaggatgatgccgtggatctggatgccgaaaacaactggatgttgggctacgatgaagcgggggagaagccggaatcagtgacaacgtatgcctatgcacatgccggtaaattttatatttaaaaatttgttaaaatcttaaaatttgaggctctcgctacgatcacgtgctgatttatggggaaatgttgcgcatgggagtccgacctgagctgatccgccagggaaaccacctgctggagatgaaggcgcgcaaacggggtgccatcaccaccacagtatttcgtgacaggtaatcattttgaacaaattttttaaatttatccccactttagctacaagctaatcccgatcaaactggccagctttgtcaagacgttcgaccttgaaatcgagggggtggacaacaaaaagtattttccccacaaatataacaaggtgagggataaataattatgagaaattaaaaaccgataaaaaatacaggctaaaaactatggcactgtcctggacaccctgccaccgatggaagaatactaccccggcagcctttttccggcagagcgcacgaaattcgagcagtggtacgaggagaaccgggagacggagttcgacctgtgcgaggtgattgccgactactgcaagacgggtaagaattttgaaaaattaacttacagaattaaaaattttaaagatgtccaaattttggcccacggtctggtgaagatgcggcaactgtttctgtcgcagaccaagcatgacatcaccgactcgatcaccatcccatcggcgtgcatgaagttcttcgttgtgttgatgcactgcgacaatgagcggattgccatcatccctcacctgggatatgaaaagcgaggaaagcagagcaccgtcgcccgaaaatacctgaaggtgaaaaaataattttaaaaaatttcattttcttttctctcagtggcgttccgaggaggagaagcgcgagtttgaccgaacgattcgccacgtggagagcccgggaggggagttcaagtacggcaactacagcttggacggcatggttgagcgcccggaagaggagaaggacctggcaatcgaagtcaacgggtaa

SEQ ID NO: 77589 - DNA, 1804 bp, Heterodera glycines
  Genomic contig location: Contig_ID=SeqID_13675; Location=267..2070; Strand=-
  SCN-specific regions: Sequence locations=1-334,356-380,431-637,659 -1069,1101-1606,1628-1683,1713-1804
atgtcaaacttaaatcctggtaattggtggtattattttgagcgtcaaggcaaagcaactgctaaatgtaaagctgaatatttacgggaccaaaaaatcaaatccagggccgatccatcattatactgggaagttaattcacaaaaatggccaatgattggtgccgttgtacggaaatttctttctccgcctgcaacaagttcagaaagtgagaggcttttctcaacggccggtctaatttcagatgacttgcgaaagagtattaccagaaaatcttgcaaaacttttgtttcttcatcacaatttgcttttaaccggtttctcaattgaatgattttgctttttaatatgcttttaaattgctttaaaagatttataggattttttaaaataaaatttaaaattatttaaaaaaattttttttttaattgcggattgcggattacggaaattacggaaattgcggggtttttggacacccgtaattgcggattgcggatttccgcaactgagaaaatcgccgcaattgcggattgcggatttccgtaattgtaaatccacttgcgtgcagccctggtcactatcctttagtttttctttgactgggaaaagttatgacatttaaagaaacgataatgtattgagataaaatgatcaaaggaatcacagcttatgtatcgcttttatatggaggagaaaaagcaatggacgttgaaaaacaaagaaaaaatggaaaaggaattcattttgaaaggaaaaattaattcagtaaatgtcaaaagaaaaagaatgtaaatgaaaggcattggcattcgttctgatagtaaaaattgattcagcaaatgaaaagtgaaagaaatttaaaatgttgtgaatttattaagtctgtttacactaaaaatgttgtgccatttgttgaataatttcacattacaatttgctgactttcattgccattccttaccgaattaattttccatcttattttttgattttattttctttagcttcccatttctcctctctatataaaggaacagttgtggtcatatttatagtcacaaatgtcataaattaattttaaataaaaaataaaatttggacaaaaattatccaaaagcgaaactttttttcttttagcaatggctcaatccaacccttttaagcattcttttgttctttttttgttcaccgctctcgtcattgtaatcgccatcactttggcggaaaacaataccaccgatgcggagaatgtcaccgacgcggacaatgccgcagtaattgccatttttaattcatgtgtatattttcataaaaactacaaaacgatatgatgaattgactttaaaataattaaataggaaaaagtcaaaaaatcattctttgtttttcatatttctttttgttattgtatttaaatattctatctttctacatatcaaaataacctttggaacacaggtcgcagcagtaatgccaagtgcaatcaccgatgggatgacatgcgttgccaacaatttgaccaatgaggcggtagattattagtgttattgaaacaatttcaattaaaaagcagttattacaataattaaggatacgcaacgtatggaaaagttagagaaagaacaggaatatgtggatatactgaatgaagcgcaaaattattggacagttcgttggggcataaaatattttttaataatattttttaaggccgtcgtccacgaaaatttcgcacttatggacgaggaaatgcttagaaatatggttgggtcacttgaaacacctcgatacaacgctaatg

SEQ ID NO: 77590 - DNA, 235 bp, Heterodera glycines
  Genomic contig location: Contig_ID=SeqID_13675; Location=3513..3747; Strand=-
  SCN-specific regions: Sequence locations=1-28,50-81,104-131,156-235
aagaagaaaaaagtatgggaaggcacaaccaccaggccacccactctcacattggctttacattctttgaaaatgatattgaaaaggcaaaaaggaaaagcttcatatctcggccagaagcttcatttagcaaaaataaaaaaaaatttataatacaaagggggggtaatctacctaccctgaaagtttcattcggaagtcccatggtcacttgggtacctctcctttgtaaggg

SEQ ID NO: 77591 - DNA, 521 bp, Heterodera glycines
  Genomic contig location: Contig_ID=SeqID_13675; Location=2785..3305; Strand=+
  SCN-specific regions: Sequence locations=1-73,105-159,181-405,427-521
atggctgatttaaagaaaatgaaaagagatacagaggcagagaaaacgtgagtaaaaagagcaaagttaggactataaaaaattataagaaaaaaattttattacttcaaaaatgaattattggagggccgagtctaaaaatggtctccaaaaacggcatttttcaagaccatcaaataacaaaatgttttaaaagtggttttggaaattccgaatttaattaaactaagtaaattgaccacgctgagtccgaatatggctttagatttggtctctgggttctcaacaaacctgtacagctccaacttcatgcatggagttggagcagtacaagctcagggttaaaagataggtcagatttaaggccatattcggattctactggtctaatttgtacagaaaaccttcttttttgttatatcaggttacttttttgaccataaaaaaatcgagaaaaattagtgggccaattttcaatttttgcatggtcgggaaaaaatactaaaaaattgaataagcaa

SEQ ID NO: 77592 - DNA, 835 bp, Heterodera glycines
  Genomic contig location: Contig_ID=SeqID_13676; Location=40..874; Strand=-
  SCN-specific regions: Sequence locations=1-196,250-283,307-317,339 -418,440-462,484-489,550-562,584-620,642-786,808-835
atgcgtttaaagcaattagcttgcaaaagcacaggtggccgtatgccacgaaaacagacggcttacaaatgtgccggagggcgtccggcgaagcgttcatttttcatcacacagtggaaaatgaaaaagggtaacgcaaatagataaagtaaaattgggctcccatccgttaattagtttcaaattatatccttggattttatttattttttttaaatctattaataaaatggattaaatttttaaaatccagcgacatctgtcggcatattcaaatgttcccaaatttaaaataaaattaataaacgcaaaaaatttaaatgaaaaattcattattttgttttctttagttgtgaacgaggacctgagcaacggcaaagaactgaacaaactgcgcgtgctcaacacgtacaatgacgaggaaatggactcatttgaatacatcaccagcacagaaaagggagaaaatgttgtggtgagaaaattcgcttaaaaattaatttatatttttatttactgtctaaaatctaaaaataatttaatatttttcctaaactagaatcatttaatgttttccaggacattcccaacacaaatggcccaattatgcgtcccagtgggcgttatcaagtaattataagcaaccaatgcaattaatactttaattaattccaattttttactattattttcccaggtgtacttcaaggatccggaaattggctgggctcttcaaacattggaggacattgatgccgggacaccactgttcgaatatgccggaatgttggagaattccaaaagtgtgggtacaacggcagaaaatgacgactaa

SEQ ID NO: 77593 - DNA, 957 bp, Heterodera glycines
  Genomic contig location: Contig_ID=SeqID_13677; Location=106..1062; Strand=-
  SCN-specific regions: Sequence locations=1-13,35-655,678-957
atggaccgtaacaaaattgaaattctccaaaaaagtcgtaagcgtaagtttttggacaacaacgacactgctgacaggcatacccaaatttattaaacttttcatttttataattttagtccgtccctgggaagaacccgtcgtccgtcgcgcactgttcccaattccatattggaacgtgcactcacatgcagcttctgccctcgcgagaaccaacaatggcctcgaagcaacgcacctccatttcgctgtattttttcacttatgaaacctcccccaaaaacttcaattttagaagggtctttgtcaccacccggccctttccgactttatttatgaagtcagcagaagtatcgacaaaaaagtggacgcagcgagatcagctcggaacttcatacacaaacgacacaaacgctacgtgctgcaagacgcagtcatcatgcgaattttagcggacgccacatacgacaatgatgccgaaattcacgatgttatgacggctcttggtctgcaggtcgaaggatatgcaggaaaattgaaggactatgaaaattttgatgattcgaccatgcatgtcccttaaaattgttcattttgttgttattattccttcaattaattagaaaatcccattgttgattgatttttttgttgtttaattgattttgatcaatttttaatgaacttagtatttgcgaaatcaaaaattatataatcttcagttttttcactaatttttagagggggacattttgactcattttggcttgggggacattatgacgcaaggacattatgacgctgggacattatgacgcagggacattatgacgctgggacattatgacgctgggacattatgacgcggggacattatgacgctgggacattttgacgcagggacattttgacagcgcgcctatacatatagagagagagagagagaaagaaaataaa

SEQ ID NO: 77594 - DNA, 1120 bp, Heterodera glycines
  Genomic contig location: Contig_ID=SeqID_13678; Location=561..1680; Strand=+
  SCN-specific regions: Sequence locations=1-233,266-338,360-704,729 -1011,1033-1120
atggacgaacaccaaattcctgtttggtatgtcatggacgaattcggtgttcgaattggccattctcttcagccaaacgtaaaaagcaattaaaactgtctttggtttgcatttatattcctgttttaaaggtcaaaatggttccgtttctcgacttttctgaaaatatggcctacagtttgcttttccccgtccaaaatatttcagaggggggttagtttttcttcaaattattgttttaaactattttatgtgcaattcttaagacactgtgactcgcaattatgtcgatacgcaacttctcaaaactcatcccgattggttggatgtactgctccatccctggcaacccttccccaatttcgctgctttctcaatttgtcacgttcccaagcgggacgaatatttcatggtaaaaaaaagatttttacccattttctaagcaattgtccgtcttatctctcctcatttgtccctccaattcagtccggtcgtctgctcgacttaatcccttccggagaccaaagcccaacggtcaatttccaaaagtctgtggatgacccggacattttggtgtgtgcctcggatttgcaactcatcggacatttgcgccgattccgtgtgcaagaaacaaacgatccgatgaaagcgcatatcatttggcgtcgtgaccatttcaacgattttaggcactcattttcactgatttacattttcattttcccttttgatcagatcgttggcgtaccaaaatccaagcgctttgatcaaccaatttccgtttgaatccgttctgaccgtcaaagatcttttcgcagctgccgtccaatcattcgtcgaaaattgccaagatgtccaccccgaccagcaattggtggacgaattatccctccgttggtcccccgaatggtttccgctcaccttcaaccttcacattgaactgccccaatttgtcgcatattttcagagacgggcagcgaagtcagtgtttttaactttcatttcgcataaatatgcttttattttttgagaaatttggacaactgttggattgtgaagccgtggaatttggcacgggcaatggacactcacgtgacacgcaatttgaacacgatcattc

SEQ ID NO: 77595 - DNA, 131 bp, Heterodera glycines
  Genomic contig location: Contig_ID=SeqID_13682; Location=1209..1339; Strand=-
  SCN-specific regions: Sequence locations=1-131
cgtgccattttacgtacacaaattcgttggcctcaccgggtgccgatgaggaagaatggtgtgccaatgacacactggtggaaatggaaccggacaacgctatcaaaccagtaatcccattatatccatga

SEQ ID NO: 77596 - DNA, 1250 bp, Heterodera glycines; identical to SEQ ID NO: 13683
  Genomic contig location: Contig_ID=SeqID_13683; Location=1..1250; Strand=+
  SCN-specific regions: Sequence locations=1-76,101-636,661-734,758 -1096,1221-1250

SEQ ID NO: 77597 - DNA, 2105 bp, Heterodera glycines
  Genomic contig location: Contig_ID=SeqID_13685; Location=1292..3396; Strand=+
  SCN-specific regions: Sequence locations=1-609,631-645,668-1165,1187 -2047,2075-2105
atggaccccaatcagcttaaactgattttggaggctgttttgaaagcatcagcggaacaaaacaacagttctgctgcattagcgacatcaatcgatgctcgcctttcgacatttgagtatgaccctgagttagggcatacatacgacgtttggctcaagcgctatgggcagaccatcgcccaggatggacaagcactcagcgaccagtcaaaagtccaactattgattggcaaactgggcgaagtcgagtacaagcggtacatcgacagcatcgcaccaaagtcgcagaacgacttcaactgggatgagacgaccgcaaaattgaaacatttgttcggtgaaacccgatcattgtttctccgccgttttgattgcttccaaattcgtcaagacgcgcatcaggacgtgcaaagtttgatcgcattgatcaactcgtcctgcgaaaatgccgatctgtcgctgagcaaagaggagctcaaatgcatgatactgatcattgcattgcgggacgaattcaccgatctgaggcaaaaatgccttcagcgcttggaagacagtcgaacgagcggacggtcaacctcactgcaagagctaggagaagagtgccgaaaataccaaattctaaaggaaagcgcgctctccctcggctcaaatccctgcagcaccagtgccatccgagccaaaccgcagcaaatccgggacaaacagaagtccaaaacgaagccacagcaaagccacaaaggacatttccagccgaataattcaacggcaattaaaaaggaagtgggcctgcctgatcagccctgccattcatgcggaggcaaaaatcattggcaaaaagactgttggttcaaaaattcgacgtgcgaaaagtgcggacgaatcggccatatcgcaaaaagatgcaaaaacggcacagaaacccgacgtgttcgtgccgtggccacaaattctgggaatgacatgcacattcacaccgtttcacttcagccaacatgtatggctattgaaggaagtagtaacaaatggtggagaattgtcaccgaaatcaatgggatggaaaacccaatgaatgtcgacaccgctgcacaaatcacggtgatcacagctgattcgtggcaaaagcttggcaagccaaagctgggcaagaccaccatcgcagtcaaaaactgcaacgaaaaggcattcgcaattaaaggaaaattcaattgccaagtttcgtacaacggacgaacagcgaaactgattgcgtacgtcagcgacgaaatccatcaggatttgctcggcatgccttggatcgaagagttggaaatcattccgaaggaacttatgtttccaaattcttcgcaaatcaccaattcggtgccaatgaagcatcagaaaatgccggcagtcaatttcaaaaattttggtaaatttcaacagaaacaccaaaatatggaacggcaattcaacgacaaatacggcgccaagcccatcactttccaaaatggagagccagttttcatttggaatttgaaaggcaataaggcaaattggttgccggcgacgattatcgagagagttggcaactctccgacttatcgagtcgacgttccgacgctccgttgcgcagtccaccgccttgccaaccaaattcgccgccgtttcccagtggaattggagataccgcaaattggccaagcgaatggaaatgttttgatcgggaaccaaccaaatcgaacaccgattaaggagattaaaaaagccaaatctcccattggccaaagtcaaaatgcgccgcgaagatcaacacgcgccaagacggcacctcagcgattggacatggatccgtcgaagtcgaagtacgatgtcatccggccatgatctcgcgcaggagggactttactcaagaagggaggtgttggataaggaaccacaccgattattgattatattttccctttcactccctctcttattgtctctctcccgccccttgaccagccccataaatatgtctccctttccctcactcggggcattctcccattcattccaccatttcattattttattttattattatttatttcctgctgtcctcctcctcatttatttgttta

SEQ ID NO: 77598 - DNA, 872 bp, Heterodera glycines
  Genomic contig location: Contig_ID=SeqID_13685; Location=3897..4768; Strand=+
  SCN-specific regions: Sequence locations=1-208,230-609,631-645,668-872
atggacccgacgcagcttaaactaattttggaggctgtcttgaaggcatcagcggaacaaagcaacagttctgctgcattggcaacatcaatcgatgctcgcctttcaacatttgattatgaccctgagttggggcatacattcgacgtttggcttaagcgctatggggaaatcatcgcccaggacggacacgcactcagcgaccagtccaaagtgcagctattgattggcaaattgggcgaagcggagtacaagcggtacaccgacagcatcgcaccaaagtcgcaaaacgacttcaactgggatgagacgaccgcaaaattgaaacaattattcggagaaatccgatcattgtttctccgccgtttcgactgtttccaaattcgtcaagaagcgcaacaggacgttccaagtttgattgcacaaatcaactcgtcctgcgaaaacgcagatctttcgctgagcaaagaggagctcaaatgcatgattctcatcattgcattgcgcgacgaatttaccgatctgaggcaaaaatgccttcagcgcctggaagacagtcgaacgagcggacggtcaacctcactgcaagagctaggagaagagtgccgcaaataccaaattctaaaggaaagcgcgctctccctcggctcaaatccctgcagcaccagtgccatccgagccaaaccgcagcaaatccgggacaaacagaagtccaaaacgaagccacagcaaagccacaaaggacatttccagccgaataattcaacggcaattaaaaaggaagtggacctgcctgatcagccctgccattcatgcggaggcaaaaatcattggcaaaaagactgttggttcaaaaattcgacgtgcgaaaa

SEQ ID NO: 77599 - DNA, 766 bp, Heterodera glycines
  Genomic contig location: Contig_ID=SeqID_13686; Location=53..818; Strand=+
  SCN-specific regions: Sequence locations=1-393,415-714,737-766
atggaaaatgatgatacgaaagaatggcatggcaacgaacaaatggcatttggacaacaaatgggtggaggtttgcgacagttcgaaatgtttgaaaatttggagcatgcaagaggaggtcaagagcgggttgcgaataaccgcgcttttggagagcagcggccgttgttgagtcgtccacagctaccgccacaacagagcttcatccatcgccaatacattcaaagtgttcagccgcttccaccgtctttaccgtatgcgaacgaacgcatcacatctgccccgacttatccacagccaaattttgagcagcagcgttatcagccgcaacaaaattcagccaacccaaccaaaattttgatgttttgcatggcctcgaattcctctcgtactggaaaaaatttctgatttgaatggttctgaaggaatcgatgccgttaagcgcttctttaaaaagtttgacgcttatacatctgaatggagtgacaaaaagcgcatcagtgcgctggagacgaaagtgtacggctgtgctgaacgtgcgttcgaggccgcaaaagccactcagccgtttcagtacgcactgattcgccgcgacatgattaaacaacttttaaagcgaaaaaaaatgtaaaatttttgcattaataagcatatttatatatgatatttgcatttaatgcaatatattaaccgtataaactaaaattctatttcatttaaattttttaatatttttgttctgttcttaccaatgaacaaacaaaga

SEQ ID NO: 77600 - DNA, 1148 bp, Heterodera glycines
  Genomic contig location: Contig_ID=SeqID_13686; Location=829..1976; Strand=-
  SCN-specific regions: Sequence locations=1-262,284-877,899-968,990 -1088,1128-1148
atgcaactccccggaaaatttgaacgtcatccaaaaccaaatgctatcgggagaaaattcactttatttactgatcacaagcctttgtttgccattttcggttccaaaaagggaataccgaattattccgccagccgattacaacggtgagcgttgatcatggcaaattatgatttcgatatcaaatatacgaatacatcatcatttggacaggcagatgtcctttcaaggctaatagccaattacccaaagcctgaggaagatgcattaattgccaacatttgcgtcgaaacggactcttatattaacactatattacagacgcaaaccgatcatcttccagtcacggcacgataaatcgcggaatcgacaaccaaagatgacactccagaaaattgttaattttgttatttatggttggccaacgaagtgcaatgagcccaaaatttcacaatttcacccgaaaagaaatgaaatttttggaaaatggaggtgccttctgtacaaaagtcgtgtgatcattccaaaccaattgcgcggccgaattttaaaggcattgcattttgcgcacccgggaattgtgcgaatgaaggccttggcatgccagtatgtatattggccaggaatggattcggagtttgagagagttgtacggcaatgtgatgagtaccaaggtgcacagaaaagtccgattaaggcaccattggcccatggacagtcatcgacaaggccttccaacgcgtgcacatcgatttggctggaccctgccaagatggatttgtttattttattatggtggacgccttctccaaatggccagaagtctatcaaatgtcttcaattacggccaagaatggcaaaacaattcgatggacggcatggggccaaagaaaaagtgttttcccccgccgaaccagtcctccttttgaattacaggaaccaaaagacatattcgaaccaacttcgtcgaaattatgttttcaaagagaattcgaaacataatcctggtgccgatcatcaaccgattccaccagcaacccaaccctcctcattgtgtttataaggagaccattcccctcctttttgtctcttccattattcatttcgtttttattatattttcatttgtctaccgaacgatcaataaa

SEQ ID NO: 77601 - DNA, 3987 bp, Heterodera glycines
  Genomic contig location: Contig_ID=SeqID_13688; Location=697..4683; Strand=-
  SCN-specific regions: Sequence locations=1-101,303-463,492-529,565 -659,757-890,961-1073,1095-1887,1909-1986,2035-2579,2622-2985,3008 -3190,3212-3221,3243-3372,3403-3467,3489-3653,3772-3779,3801 -3862,3884-3887,3925-3987
  Gene Ontology: Mol. function=DNA helicase activity; Cellular component=mitochondrion; Biological process=DNA unwinding
ttacatatgctcacccaatttgacaatcgtgtggtgttcatacaaacgagcgggatgcactggtacatgtaatttcgattgaataattcattcttaaatcgtatttaaaaaaaaagttaattaattgggtaattaaatattaataaaaaaataatttaacattttttatatttgaaattgcagacaaaaatgttttttttactattctttatattaatttataataaaaattatttggattaatctatttgaaattttttttttaatataatttttattacaaatttttgataaattaaaatgatttccttcattaatggttaaaggctgtgtacgatgcaagcaacggaatccccgctttatccctgccgaagggtgaacgatttgatcagtcggtgttgtcatatttggaggactttgacctcgtctatctttggtaattagtaggctaattaggaaaaactaaaattgaaaattattattttttttttctaggtttcccagcattcatgaacgttttgccaaggagtaaaatttaaattttcattgataattaaattttatgttattctgttgttaagctatgcttcctacatgaatgcaacccgctgctacatcatcacgtaagcaatgtttatcagatttattttcttcataccaaaaaataataatttattttttaacatttcaaaagcaaaattattggattaaaatttcaattaaaataaaaatgaaatttaattattgataataattgttaaatgtttttctaatagcgtgaaagttgatcattaattcattaattttcattttccgtgctcctctgagaccggttgagcttttgcgcgatggtcgtgcaaaagaggtacttcacaatattcaaggtgaggatttttttttatgacaattttatatttacaattttttatgttatttttatatataaaaagtttattattactcctccctcaataagacgcggttcgcgttcgatacaaaggcttccgttccgttggcgatctcagagacgcggttcgcagtgaaattgtgcaggtgtttaaaagttttcttacaaactaacaaataattttgtggcatgagaatgggataatgaaaattgagtcctgagggatttagtactctactttttaaattttttcaacaaaaattgcattttttgattttgtaagactaattaaaaaagaaattcggtggagaaatgataaaatttttcgaaattgtttaaaatgcaaaatttttcaattttcttttgtttactgcttgtagagcaaaagccgacttggcggcattgcgcaatggcgacgctacacactgctgaacaattatttgcgcggctttcggcctggtgaaatcaccgtgatcagtggtggtcattacgggaagacaacctttctgtgcgagtactctatggatttgtacagtcagggggtacggtattatgataagaattaatagcttatgagacaataagagaaacagtaagccatggtgacgttaccacaagaaatacctttactttctgaaagcaggatacggtagaataataagtattattgtatgagagtaggagaacctgtgtaggcagtcagtatcgtatcgtaaatctcgtctactgtattcaaaagtcaaccagtggcacagttaaatgaaagtcattcattacgtatgagaccataaaatttaaatgccacatcacagatacgcacgctgttttgcaacttcgaaatgccggaagataaagtatactattattactgtaacatgcattcattacagtaccactcactatttgtccccagattctcaagtggatgatcatccaatttgccgggtaaattatgtctttaatgatagttttttttatgtaaaaaagtaaatcctgagtctataaaaaattatttacactaattacgtcaaattttttttgacgttcatacggtacaattgatctaccgtattgctagttccctttttgatatttaaatttttttttgtttgtttgtttatttgttttatgcttatgcaaaaatccattcaaatcccgtcccaaaataggccatcacatgtgcgaagccaggctcgggcacgctcacatgcattcttttccgcccgatcaaagtatgcgtaaaatgattaatgtttaaatcctacggatttttggcattctggtccaccaaaaatttattttcaaaaaatgattttttttaaagaaaattggagggatttgaatggataaagcatgtctttaaaccgaatgttttttgttttagggcgcctcttcaacgccaagaccattcatcggttgaaatgtggttggacaagtttgaacggactcagggtgacctgttgatcatgaagtcggacgaattccgggacaaaacgttgaaggagatctctgatgtgagatttttaaagaacattattagctgatttataatttgatttattgggacattttggggtaaaaaatgtgccaattcttaatttttctatgaaaaataaaaaatgctgtaaaaatattacgaattttgtgcatatactaatagctgttttgaacttggctttatgttatggttttcatttaaaattatttttcataacatagttagttacccgcagttttttttttgttgcaaaatattcggcatttttcgaaaaataaaacataaatgtcataaaaaaaaaaagcaaaatgcacctacctctaaggaccaatccaaattttttttaaattcatctcaaaaattaaaaagtttcaaaaatttatcaaaaattttttcaacacaccaaagtttataattttcgcaaaatgctcatcatcacggatcccaaaaaacccctgctgatcacaataatttttcaatcatatcacccgtttttaggcaattcgagaccaagtgatcacaagcggcatacaagtaaaaatgatttttcaataaaaaaaaagattggatgatgtattttgtaaattttgtttttaaagcatttggtgatcgacaatttggtaaggcggcactacaaaatttataatcacatcaattgttttctgtttgattagcaatcgctcgtcgatttggcaacagttagcattgacacaatgagtgccagtgaacgaatccatcaacaggtgtgccaaaaaatgccaaaattggaataaattcgctggcaatttcttcataaaatttaaaaaagccgactaattaattaaaatcattcaaattcatgaaaaaacgcctaaaaattggcactgtaaaattatcacaaaaaatcgacaaattttggcaataattcaaactatttaattgcaaaataaaaaaatatatacctatgccaaacttacaaaaattgtcgtaaatttttttttaagaattttaattttaaggacagatttgtgagcatgttacggcgattggcaaacaatcaggaacttcacataacattggtcaaaaaacatatttaaatattatcaaaaaatgtttccttttaaggtagttcaccctgtgagggaacctaatgaggttgaattccgaaaattatttttttggaaataaaaataaattttagcaaggctactatgagctccaacacattggcggagcttcagcaaaaatagcacaagaagcatgcttttgattattaaaataataaataatatattttttttatcatatataatttcttaatttttttttttgcatttttcataaatattatttaattattttgacaatttttaattaatttttaaatccatgctataatttttctattatttttaggccgacaatgtgttggtcatccagcgacgccgtgactttgatgatcgaagacgattcagaaaatttctttatgtaattaaaaattggaaatttatttatttgcttaaatttatttttaatttaagattctgaaaaatcgatatggtggacgttgtatagaagtagaccaggttgaaaaaatttttgg

SEQ ID NO: 77602 - DNA, 1071 bp, Heterodera glycines
  Genomic contig location: Contig_ID=SeqID_13689; Location=3046..4116; Strand=+
  SCN-specific regions: Sequence locations=1-123,145-154,177-1071
atgactgatgttcaagttgatttggccgatttacaatcactttcacgtcacaacaaaggctatcgctatctgcttgtagctgttgatgtgctctccaagcgattatttgtggtgccgttgcgcagcaagcgtgcagatgagatgctgctagcattcaaacaactggttgaacaaatgccaatgacacctcatcgtgtgttcacagataagggtacagagtttcgtaaccgaatgctcaaggagttctttgaagaacatgatattgcaaaacacgaacccgtccattctgctgtgaaggcatcggtagctgaaagagccataagaaacgtgaaacaacgttttgaatagcaaaacaattctgctcagctacttagtgaaaagagaatggattgaagaacacggctgttcaaatataggtaaaatattttttggtgcgtttttgttaattaaaccaaatttaaatttagtcgtgtcgctatggaccaccagtgctgctcgtctttatctattgaaactgatgccggatctgatctactgtacacggacactgacagcataattcacatacatgacgaagctgcaaaccactttcacttggaccacatttgggcgatttgaccgacgaatacccggaccacgaaattttggagttcacttgtggcggagcggtaagttttttagcttagctttacaatttcttgatatataagataaatttagaaacagtacggactgaagcttcgacgcaaggccacaggaaaaattgagcatgtgttgaagctaaggggaataacgctgaattatgatgtgaccgtcaatcagaatttacagtacacagcattccgtgaacgtgtgttgcagtatgccgagaaccgtgatgtggagcctatttcagtattcaatccatgtgctataagaccgaatatcaagaagggtgaagttacgttgataccaaccactaaaatttacagaccatatgtggggaagggaattgtcgggcccgactatcgcatacttgattttggatataccccattcacatcattcccaattgaaattttaatcattttt

SEQ ID NO: 77603 - DNA, 1467 bp, Heterodera glycines
  Genomic contig location: Contig_ID=SeqID_13690; Location=693..2159; Strand=+
  SCN-specific regions: Sequence locations=1-636,658-680,703-1467
gaagtttttcgaggacatcgtggactgtacgatttcaacattggcatgttctacgaccagcacgagcatcagcttcacccatcatttctgccgaaagtggctttggaatacgtcaacaattgccctcaagacttccttctctcgactctcctcagcgagcatttccaaaaccataaaattgttgtcattgatgtcaacagttttgggcccgacgcttcatgtcgttctgaaaccgaggcctttctggcacgtcggattgtcaacaagctatctgcagccggtgtggaaatgacagacattgctgttattacaccatacaaaagtactaatttatcattagacgaattgtatattaaaatatgtccctaatcaactgaaatacatgattatctttttttagcccagctattggaacttttcaaagtttttgtggttaaacatctgccgcatcggctgatttcttgtgcccatacacttcaaatcctgaactcattgttccctttgatcgtcgtgcatattcagaccttttggttggtactgtcgatgcggcacaggggaaggaattcgactacgtgatagtatctggtaagacaattttgtgacttattaaggcacattccatttataaacaaatttaaagagacatatattttttaaatctagtcacaagcgattattaaaaattttgatcctaaattttttacttaattatgtgtctcattaaatgctgagccacattaatgtgtccattaatgtgagccacattaatgtgtccattaaagtgagccactttaatgtgtccactaacatgatcaaaatcatttgaataccaattaaagttggccgcaataacacctctacgcttggttttctggccgattcatatcatccgacacttcgaatgtggaagaatggtcgcgttaatgtgatgttttcgcgtcaccgaaaagcactgattgttttgtgtgacgcatcgtcattcctcgcggttagtctgcatgcttttaaaaggaaattattaatcacgagcccgagtcacaagccctagcattcaattggaaccgcttgttagacacatatatgttaaatatacattaaaggacacattattcattctcagcatttcggggcagcattaggaaaaaggatagtgtgtctccttatatgattattatcataaatgtgtctcacaaatcctgagtaacaaatgtcgttgcggtttagaattacaatgaaaatgtgtctcataatttgttccatgaattcttgaaagattgttggaatcattatgtttagaatcctctgctgacgataaatactgctcctgaaggaactgaggccgttgcattcgagtccggcatcgaagctggtcgctttatgccctacaccaaacaaagcttcatggttttcttgaaagaagcaagacgtgaagggctcattttcgatgccaaggaccttgagctctaa

SEQ ID NO: 77604 - DNA, 1021 bp, Heterodera glycines
  Genomic contig location: Contig_ID=SeqID_13690; Location=1483..2503; Strand=-
  SCN-specific regions: Sequence locations=1-159,181-1021
atgacattgattttgatgcaaccatgcataagctctacggcgggtcggggatgggtccccaataggtaattggatcggccattctaaaatattccttctgatcaagtgttttttgtttttgtgatgaaataaactgatgtgtttcttgaataaatgtcatttaagccgttaaaataaaaaggacataaatgtgtcttgtgcataaaaaagagaaacatatatgagtgggtgagtttaaaaaagacactattgtgtcttatacataaaaaagagaaaaatatgagtgggggtgggatttaattttttgggaacgtatatatacattagtgatattcagctcagtcttagagctcaaggtccttggcatcgaaaatgagcccttcacgtcttgcttctttcaagaaaaccatgaagctttgtttggtgtagggcataaagcgaccagcttcgatgccggactcgaatgcaacggcctcagttccttcaggagcagtatttatcgtcagcagaggattctaaacataatgattccaacaatctttcaagaattcatggaacaaattatgagacacattttcattgtaattctaaaccgcaacgacatttgttactcaggatttgtgagacacatttatgataataatcatataaggagacacactatcctttttcctaatgctgccccgaaatgctgagaatgaataatgtgtcctttaatgtatatttaacatatatgtgtctaacaagcggttccaattgaatgctagggcttgtgactcgggctcgtgattaataatttccttttaaaagcatgcagactaaccgcgaggaatgacgatgcgtcacacaaaacaatcagtgcttttcggtgacgcgaaaacatcacattaacgcgaccattcttccacattcgaagtgtcggatgatatgaatcggccagaaaaccaagcgtagaggtgttattgcggccaactttaattggtattcaaatgattttgatcatgttagtggacacattaaa

SEQ ID NO: 77605 - DNA, 442 bp, Heterodera glycines
  Genomic contig location: Contig_ID=SeqID_13690; Location=2752..3193; Strand=-
  SCN-specific regions: Sequence locations=1-256,278-442
ctatgttatctaccatctaatcgtggataacggccaaagaagtgagatagcgtacaagttgcgctataatgagttcaaggtggctaaagttgttggaactggcgagaacactgtcaggatgtgtcccttgttggactcaaagactgattcgactgacgcatggattggatggagcaatcgtctttacaagctaactaaacgcctgcgcatttatgttgagcaacaccaacagaagttgtctgccgtctcggctcctcaaattacagaacatgactacctctttcgtatgcctcagaacccgttaaggggaatttctcgaaagcatttgaacgaggcattgcgaactttctttggtcgtttccgagatgtaaaccctatcccattcacactgcataaaatccgagcaatagtggcatcccaatcagttaattatgcgagataa

SEQ ID NO: 77606 - DNA, 420 bp, Heterodera glycines
  Genomic contig location: Contig_ID=SeqID_2061; Location=2315..2734; Strand=-
  SCN-specific regions: Sequence locations=1-420
atgcacaacagtttgcattaccgacacgctccatttcagtcgattggaattgattttctcgggccaacaacaatttcgttggccggagaaaaaataaaggcatggatcctcatcataacatgccttgcgacgcgcgctgtctaccttgaggcaacattggacctcacatctgaatcattcatcaattttctccgtcgattcataagtcgacgaggaaaacgcgacatcatttggagcgacaacgctacgaccttcaaactcgctcagaaaaccctggagcttctcagtgctccgggtccggatcaggaagtacaaaacttcctgactcagaacagaatcaaatggagattcattgcccaaataagccttgggcaggaggcttttacgagcgcctcttcatacaattattttcaacactaa

SEQ ID NO: 77607 - DNA, 1345 bp, Heterodera glycines
  Genomic contig location: Contig_ID=SeqID_2062; Location=2220..3564; Strand=+
  SCN-specific regions: Sequence locations=1-626,648-815,838-1267,1289 -1345
atggcaaccaatatgcacgacaaaaagacgctgctcaaccaaatacttggtgaagcggatattacagtttctaatagtgggattaccgtaagcggtcctcgcctctccactcctcgcttcgttccgtttgacgaaattggcagatgccactgctgtaagtcaactgaggtcgaagtcgacaccatgttcaccaaagaaggggtcacaatttggtgtagcagaattgacaaagtgcaatttgttccctttgatgtcgtctatgacctaccgggccattgctttttccgactaaagaataaagcacgagtgttcaacatcccgtatggagagcctccaccaatgacgtgcaaaaaccaaaatagtcaaagtgatcaacgagaattgaaacgaaaagcaaaggttgcgctcgatttgttggagaccggactaatggcagatgccttacaagacagtgagagctggaagaaagcaaagacagcaatgaacgtgctcggaaatgtacttttggccgagtctctacctaccgtcaaaaaagaaaacaaaaactctccggcttcccctgttgaccaaaatattgcgcagccaaaggccgagcctcaaaaagaaaccaccaaaaaacgagaagctagcgaagagaagaaagccccaacaaaaagccatcactcacaacgtcaatcaagtggcacacgaaaaagcagcaaagagttgatgaacgaaaagccatcttctcctcgtgctgagtccattcccgtacagcacttggactctgcttccacgcaaattgatgacgtcagcgtgcctaaggcggataaaataccaaaaagcaacaacgaagaagacctcggtgacattgataaaactcttgatgaattttttgctagcataaaagcagcgaccaccggtatgtaaaatgcatatttaagtcattcacgtcatcattacaacacaaattaaaatgcttaatacacaatcatttgttgataaagatatttgctttaaactgccttgtggaattattatttctggtccatcctcctcagggaaaacacagtttttgttgaaatttattgacgaattactaattattccgcagcctgtctctatactgtattgttttggggaaatgaattcggcagtgccggcacttcaacgggcgggtgttgccgtatactcgggtgtcccttcggaggaattgattaaacaacattgcaaacctctcctactcattctcgacgacctaatgctgtccattgacgaacgttatttgtcagagttatttaccaaaaaatcccaccaccaccaatttgcggttgtgtttgtaactcaaaatttatttgaacgaaaa

SEQ ID NO: 77608 - DNA, 2598 bp, Heterodera glycines
  Genomic contig location: Contig_ID=SeqID_2062; Location=4240..6837; Strand=+
  SCN-specific regions: Sequence locations=1-288,364-369,391-1132,1155 -2598
  Gene Ontology: Mol. function=pre-mRNA splicing factor activity; Cellular component=nuclear matrix; Biological process=mRNA splicing
atggctaataaatttattcttgttccacaagaaatttaccgtggtctcacatccgcacctagtacgggggatattaatttggataccgtacggcatgatttggaccgtaccagaggtgaacgtgccaacccttctactaaaaatgtccgctataatcaacagcttaggcgctacttacagatgagacgggaggtcgcagatcggccatccaaagttgagcttaccaagggaataagtgtgctgttaaaaagaggtggcgaagacggagacggccaagttgtggatacacctccccgtcctcctggtccccctcctcctccgccacatcgacctcgtggtccccctcctccgccaccgccgcctggtcgtccaccaagccctccaggtcccggtccctcgccgccgggaagtcctccgcctcgtccacaacgtcctcctagaccaagcagagctgcgccgcctcggagaaaccgtcgtctggagcaatggcggaaaaggcgatacgatatacaacaacgacggcagccagctgtgcgcgactttcttgcggaagcagctgcagctcctttacccgaaagcgacgaagaagctgattacatgctggagaatggattcgcgctgccagcgccttcacaatactatggtgacttgcctgtgctaccagacaatgcggatgaaattgaggaaatggacactgttcaacaaagattggctagcaggaggaaactaaaaaaggacgacgacgacgacgatgatgattggcaagacaaaaaatacaaaatttactatccacctccccctgctcgccggcccccgtctcgtccagcaaaaattgaaccaatgcatccaccacgtcctaacccgaagagagagccacagccaaaggtcgaccctcggccatccacatcaaagcaggccgatataaaacctaaaagggagccaaagtttgagccggatccgcgaccatccacatcacggcaagccgggtacaaccccgccccaccagctcccaaaaaagagccaaaacatgagtggaaacagacaaagcggcgccattctcctcctcgcaccgcaccccatcggattccgaaaagagagccagaaattgaagaaacaccacaagagcaacctccggctgctgctgctcctgctgacgttgaaatgccccatgttcctccgcctaggcgaggaaccaaacgccgttatcccccggaaaatgttgaggatggtcagccgcgcttacgtaagagagtgaggcaagcgagaagagcaagagtatattattcgccagagccaggtccatcgacctctgcacaaagtgatgaacaacaacagcaacgcgaactattttccattccgacaaatcagctgacgatggcacaaagagttgagctgatatgcatcaaatgcaatcgctattccgatcgtatgggtgttcggggaaacgcaattattaacaccaaaaatggacaaccattggtgcgaagcaatttacgaatggccatcaggtatataatagacaggagagcaggccgtcccacgattagaccaccaggagcggacctattggaagaacggcttaggcaggacccaattttgtattcattgacagctccaccaaagagaccatcacagagtacaaccaccaggacggcatcgaaaatcaaaaaagagtttcgcccgaaaaaatggaattaataaatgccactcttgacaaactgtacaacgatccatcctcccccgcggctttttccggtgttactgcactgtggaaagaggcgagaaaaaagataaaacaattaagtaaaaaagaagtgcagaactatttggaaagtcatcgtacctacacgttaatgcgcccccgacgggtgcacttccggagagcaaaaactgttgcagcaggattcatgacagatgtccaagtggatttggccgattttcaagcgctttctcgtcaaaatcgaggccatcggtatctgctcgttgcggttgacgtcttgtcaaaacgcttgtttgttgttccgttgaaaaataagagggccgaggagatgctggaggcattcaaggaacttgttaagcaaatgccaatggttccacatcgcattttctccgacaaagggactgaattcaaaaaccaattactcaaaaaatttttcgatgagcaggaaattcagaaacatgagccagtccactcatccgtgaaggcatcagtagctgaaagagccattcggaatgtaaagcaacgactgtacagatattttgcagagaaggaaacattgaattgggtagacattgttgaggaaattgttgaagggatcaatcactctccgtcacgggtccatggaatgcgtccaattgatgtgaattttaaaaatgcacaaagggtatggaaacgcatgtatcagactcggcctcctattaggcgtccgccgcgcttctataaagatgattttgtgcgaatgactcgtgagaagggacaattcgagaaggggtatctgcctaactacggtgacgagattcttgaggtagatgaagtgttaaaaggtgtacagcctgtacgatacaaactcagagatgatcatggtgagaagttcaggg

SEQ ID NO: 77609 - DNA, 1673 bp, Heterodera glycines; identical to SEQ ID NO: 13693
  Genomic contig location: Contig_ID=SeqID_13693; Location=1..1673; Strand=+
  SCN-specific regions: Sequence locations=1-179,207-236,259-490,512 -711,782-796,820-895,923-1040,1063-1299,1327-1423,1445-1510,1540-1673
  Gene Ontology: Biological process=signal transduction

SEQ ID NO: 77610 - DNA, 1448 bp, Heterodera glycines
  Genomic contig location: Contig_ID=SeqID_13694; Location=598..2045; Strand=+
  SCN-specific regions: Sequence locations=1-41,82-464,486-617,639 -739,761-914,969-1013,1035-1178,1200-1269,1296-1328,1351-1448
  Gene Ontology: Mol. function=heterogeneous nuclear ribonucleoprotein; Cellular component=nucleus; Biological process=mRNA splicing
atgcgtgtgactgcttcaaagcacattgttgtccaaatgccgaaagagggtaagatgatgggaaaaattcataaatgggaggactttttagggccctaagattttgcctgttttcccagtttccgccctggcgttttacccggaattccattttccaagagatttttgatcactaggtttctggttttcaaaaaaaaactgtgctgttttacctccatcccgttttgatcacctgcatccctggcactgttctttaacaattttgttaatttggtttgagtttttcgaatttgaccgaatttcttgatggcataaatttcaaatttgggccaaccaaacggggactgaccggtgctaaactggaagccaaacaatccgtgaatattgcttataaaaaatttgccaacaaattttaaggccagcctgacgccggactcacaaaggaattcacgaattcatcgctgcatcgtttcaaaaagcctggcagcaaaaactacatggtccttaatgccttgggcatattaaaattcggattttcaaattatagaatatttatccgccaagttcgactttgcacttgtcaaatattccaaacggagtcagtgaggaagcaatgcttgaaattttcaaggatttcaaagttgtcgaattcaaatttttccagtatgttttttgaatattattttctgtatttttattaaataattttgcttaatttagaaaagatcacaaaatggcacttcttcagcttgaagacgtggagaatgcaattgattttctggtcacaatgcatgtaataatcgaattttatttttaaactaattatctatttttgaatttaagaattacaaattagccgagagcgctcatttgcgtgtttcattctccaagaaaggcatcaacggctaagctgcaaatttaatttatcatttttatatattttattttattttttaatttcattaattcaccacaccacacgtggggatgcaagttcctaatgagctttatcatttttatgagaattattttttgtcttcattgttgggaccggacataaacaagtccaataattggtctaacaacatttggacaccgaaatttttaaaccaattagtcatttttatcttttgggatttcacatgatttaatacattccaatacatcgtctagtctcttattatatattttttctctctactgtataaggcatattatttcatattaaaactgcacaaatatttgtagtatttcaggttcgattctggacctggatccaggcctggattttttctgagtccaggtcttttctggggtccggattttccggggcttttgtccaggaaatccaggtcaagatcaatttggaaatccaggcccaggtttttgcaaaatgtcgaactctatttgcattattatgcgttagaaaaatctttttctttgtataa

SEQ ID NO: 77611 - DNA, 1579 bp, Heterodera glycines
  Genomic contig location: Contig_ID=SeqID_13694; Location=2175..3753; Strand=-
  SCN-specific regions: Sequence locations=1-113,135-647,672-724,758 -838,875-937,959-1043,1065-1579
gtctcatcctgaaaatcaaattgcttactcatatccgagaaaaggaggtgagaattatgcaaaaaatttttccaccgtttttttctgtctacattttcaaaagtttcaaaattatattttaaatggctttaaggtgtattgtgatgcggactttttcgaagtacccgaagactatgactttacaacgagggtatgtaattttttggaaaaaaaacctaaaaaaaattatttccaaaatcttttaaaggttaccagccacattgaccatgtcgaactgactgagacaagagtaagttggaaaatattctaacattcggcaaattcgattttctccggtagcggtaacggtaaaaaccggaaattaccgtagtttctggctttagtttttccaaaaatcgacttgttaacggtagatttaccaggtttttgccgcgataaattttattttgttgaacgctaaatgttttttttactgttataagaatttaattaacccataattcttcataaggttgcttccgagcaaaagccgcttatgggcgagaaagcttaggaaggatttcaacaatggaacaacatctttggtcatcaaacctaactgtaattcgaaatctcacgacctcttttacattttcgattcgtatttgaatttttttttttaatttaattttctacacaaaattactaggatttttcctattttttttttgcattattaccatataagaaaagtatcttttgttttaaaaacacatttcaacctcttctgccgaatttacttgtctaatttatgtttttataaacattttttttttgattttaaaagatgaagccggacaatttaattatttgaaattatttgtaaaaattttttgccttctcatctcatatgcttaaaaaaatgaccagatcaaaccaaaatgttcatttcaaaacagaatttgatctgtaacagagcaatgtccgatttcatcttttaacattgtttttttttttattaccacgatggtttccatacatcattaatggtgctcgaatgatcgatcaatcacattgttaccaattaaaatggcatgagctaataaactcaattaatggggatgggattttttgaaaaattcataatcgacaaaataaataccctttccctattaattaatcataatcattcatttaaccatgcttaaaacattatatttgtcaacataaacatcatttgttcgttttgcaacacatttgaacactacatattttgagtgagaaaataaaatgggaaaaaacaacatgaaaatttttgaaaaatgggtaaattaaaaaatgatgaatatatattagaatttagaacaaatattaaatgcataagagaggattaacttgttgtttaattccatccaattcaaaaggctataggatattagaaattttagggattgatttgagaaatttttagcttttgaaaaactagaaaaatatttaattcctcaaaaatccctaaaattcctgtttttttaaatttaattttagcattatgaattagatggctgctgttttgtgaacttttaattttacacacaataaa

SEQ ID NO: 77612 - DNA, 821 bp, Heterodera glycines
  Genomic contig location: Contig_ID=SeqID_13695; Location=325..1145; Strand=-
  SCN-specific regions: Sequence locations=1-128,150-164,187-556,579-821
atgcaaaatgttgagttcggctcatcctcagataatccaattatgttctttgatgatgaatcggaacaaacagtccaaaattggcaaatgaaacggccaatgaaaagcagcgaattattggaggagacggagaaacagacaaagagagatgggaagagaacggcggaagaagcggagggggaggaaaagcagagacagaacagagagagcacccgtcgtctgcttggcatcaaaaaagcttttcgtaaaaatggaaaaaactgatttaaaagttttatttgtttttcaagtgaacgaaatctggcaaattgttacggtcagtttcgccatgttgggcatcgcagtggagccgattgagcagcaaatgaatgggggcaaatggccccaatttgaattggcacttcgccaaatcggtactgctcaagcgctgctggttttggacaaagagcagctgcaaacgacatggaactttggtgccaaaacgatcaccgcaattaattccgagtcacaaacatttctcggttctgaaatatttaagtgagtggccaaatgggcataaagtgtttaaagtaatgaatgctaaatgtttattcagaataatggaagttggtggaagagacgaaaatgtcaaatttattggagtaatggacacaaacggcgacaaaaaactcaaaatgctcttcttttttgtgcgactcatcagaaaattagccggagaattagagactccatacgaaagttacagtcaaaaagatacagtaagaacatccacagtatacagtagtgtatctgtgcagatgattaaagagaagcagcattaa

SEQ ID NO: 77613 - DNA, 1989 bp, Heterodera glycines
  Genomic contig location: Contig_ID=SeqID_13697; Location=302..2290; Strand=-
  SCN-specific regions: Sequence locations=1-449,471-479,503-617,639 -710,733-927,967-1161,1184-1225,1256-1303,1326-1410,1499-1542,1598 -1620,1642-1673,1695-1771,1812-1989
  Gene Ontology: Mol. function=acetylcholinesterase activity; Cellular component=cell; Biological process=synaptic transmission, cholinergic
atgaccgaccagcagcagagagacggggctgtctgtgccagtatgacttcaccggttgcggtcgatcagcaaaagtcgctcattccatcgctttccatatcgcctgcatccactctcttttctccgttcatcactcagcgatcaaacaaagacaaagtaatgtcagtggagaaaactcattggcgctgagttgccagagggcaatgctccctttgaataatgaaaaataggggtagttttgcaatattcgtattacggttctgtcacaacccagggaaccatatgtggaatttttgcaattgaagccttaatggcaccaaaattggagaacatgttttggagaaatcatactttaccgtgtcctgagaattcgggtagggactgcaaaaaaaaaaaagttcggctcgggactcgtgaatagaaatgtaacggttttgggattcgaatcggaactacaaaaaccaaatcggatcgagactcgggacgaaaaatgaaagaatttcgggattcgagaccggacgggaaaaaaaagttgcgagacgaaaaaaagtcgggttttctgatggaaggcgatcctttaggtgggaaataaaagaatacttttggtttttattagcttttccaattcgggctttaaaccaattaaaaaatatatgttaaggattttaaattgcttccctatctaccaaagatttgcgttgcaaagaatgcgcaaaaagcgaaggaaaagccggcaaataaagcaaaagcaacggaggaggcaaatgccaagagataaaccagtgccggcagctgctgcagaagtgccaactgatcagtgcggcatgccaaggagttagtggttgaacatctggataaaatttgatgaccaacggaaaaagcgctctgatcacttttccaccattgatatcaatagatcagcagatcagcttgagctgctcaagctgggaatttgggttaaaaagttgagatatagaactcaggaaataatttttaatggcacaaacagggaaatttttcaaacataagccagcttggttaaaaatttcaaattttatcgaaaaattttgccgaaagtcgagtatctcgcatgttcctacaatgataacattaattattgtttaattatgtcgaaaaatttcagagcggcaacatcaaagcatttttctgtttgatggtcgccgacaatttgttgctaatcatcatcatcatctattgctgcttgttgtgctgttcattttgctttgtttttgttctccttccgtccgtgccattccgtccgcttcttctacccagcaacggcaccaccagcagagactgacggcaccgatgcttaacggggacgagccaccgctggtggtcaccaaattgggcaaaattcgcgggttcaatcaggtgagtgccgagggctttttaaaaattaatttttttttgaaaattaaaaaatgccaaataatttaaattaaaaaaaataatttaaaatctatttataaaatttcttgggattcggtgccatttttggcagggaaaggctttgtgaaaattattcttcttttttaattttaaaaaatgccatttaagggaggaatttaaatttaacgaatttagtgccgtttttggatttataattaatgaaaaatttgaaaaaaaggcggaattttttaatttttcagaaatttaatggtaaaactgtgcgcactttccttggcgttccgtacgctcagcgacctatcggtggactacgttttgcaatcccaaaaatggtgtcaaatttttggtaaaaattctgaaattttatttaacatttttcagattgatcgatgggaaggcgaattggaagcgacgagttcggcacggacatgcttttatccgatcggtaaaatctgtacaaaattgaggcagtttgatttaattgttgaatcaattaacggggaacggcgtttaattagaacgcagaaattgcggtccatccccgacgtcgaacactga

SEQ ID NO: 77614 - DNA, 562 bp, Heterodera glycines
  Genomic contig location: Contig_ID=SeqID_13699; Location=637..1198; Strand=+
  SCN-specific regions: Sequence locations=1-340,362-562
atgtttgtgccgtttttgcaccaaacttttttccattgtgcaacggtatgcattttctttattctcctcggagtttttttccgatgccaacaggtcacccgtggcactcttgcgctctgtgcgaaactgtcgttgtcttccacccgctcaattcgttcaatgaagaatgatgcccgctcagtggctgactttgaccgctcgggcaacaacaaaatcggcgagtcgccaatttccatgccgttgccagtgggggcggcccgctcgccttttgaggcgtttgtccaagtgaacgcgggcgtagtggacgccggaaaaacgcggttcgggtaattttcaacaaacatttttaaaattgctttttcattccaccattcgaactgatttaatttgccattgatttttttgtccttttcttaatttatgtctttttttcagtgtcgaatgttcggtgagttcgtgcacccgcaattcgcgccttgtcgtcagtgcacttcgcccactattcagcaactctgtcagttttggcatagccaatctcttgacactgctccaagttgaatga

SEQ ID NO: 77615 - DNA, 578 bp, Heterodera glycines
  Genomic contig location: Contig_ID=SeqID_13700; Location=18..595; Strand=-
  SCN-specific regions: Sequence locations=1-578
atgatgtgtcaagtcaaattgcccgcgccatccgatgtgctgtcccttcttctattcctgatctccgtgacaatctggtctcggagtcgcccgaactccagcttcatggaccagaaaagcccaacaaacccgacgaccatacaaatgagtatggaaacaaagacggaaacggcgaagtacgcaaaattggtccatttgtcaaggagctccgtgtatttagtggaaacttccgcacgaatctgatcgcgcccatccgtgctcactgagcgcgtttgcaaataagccatcgggccgaactaaaaagttgggagctttaaggaaggttgggactccaaaattggattattggaaaagtccaccgacttttcaaaaatgttaccaaaataacgctgaaagatttgacaatttttttattcaatttcttataaattttcagggggcgggaaactatgcggtatgaggaactgataggggggacaaaatgccgtttaccgattcgcgccctccgccgatcattcctcgccgcattccatgatcacccgcgagcagtccaacgaacgaattgggcgctgcactga

SEQ ID NO: 77616 - DNA, 103 bp, Heterodera glycines
  Genomic contig location: Contig_ID=SeqID_13700; Location=1..103; Strand=+
  SCN-specific regions: Sequence locations=1-103
gtcggtgcggttccgtctcagtgcagcgcccaattcgttcgttggactgctcgcgggtgatcatggaatgcggcgaggaatgatcggcggagggcgcgaatcg

SEQ ID NO: 77617 - DNA, 859 bp, Heterodera glycines
  Genomic contig location: Contig_ID=SeqID_13700; Location=999..1857; Strand=+
  SCN-specific regions: Sequence locations=1-237,259-724,747-859
atgtttgtttttccatgttgtcaatatgatgttgatgttatgttagaagatctaaatggcaaagtgttgtacaaggaggctaggaaacagttggacacccacacgtacaaagtgagtgatgaaggcaccggtgaaatcgaatgccaagggtttatttttcataaaaaaaccattaaaatctagtttttgcctccattttcctgcattattgccttaatttttttgtgacagagtaaatttttgagtttttcaaattgcagccaggcacagtaaaattcacaaaattgttgagatttgaaaatttttaagcccgtccttgggaagaacccgtcattcgtcgggcactgtttccaattccatattggaacgtgcactcgcatgcggcttcagcacttgcgaggaccaacaatggactagaagcaactcatcttcatttctctgtgttttttatttaaaaaaaccaaaaaaaaacttcaattttagaagggtctttgtcatcatccggccctttccgacttcatttctgaagtgtgtagaagcatcgacagacaagtggacgcggcaagatcagctcggaattcatacacaaacgacacaaacgttatgttctccaggacgcagtaatcatgcgaattttggcggacgcaacatacaacagcgatgccgaaattcaagagcttatgacggctcttggtctccaggttgcaggatacgcaggaaaactaatggattatgaaaatgtggaagattcagtgcaagccccttagaattacctaaatttattatgttcatttttgttatcttattatcttctttttatttcccgctgattttattcatttattttgtgccaaattga

SEQ ID NO: 77618 - DNA, 411 bp, Heterodera glycines
  Genomic contig location: Contig_ID=SeqID_13702; Location=1834..2244; Strand=+
  SCN-specific regions: Sequence locations=1-122,145-411
atgtcactgtcatccggctcattctccgacagcatttgcaagcagcgcaataaagggtcgaccagacaagcactcaatgacttatcgatttgtctgaccagaggaaacaattggtggtcaaaaatggcatttggttacccaccaaaaagtgaccacctcacctgtacaccgggtacagttcagtcaaagttcggacgtaattccgaaacattccccgactttgggcgcgaatttcgtgccgaaaattgtagtcgcgcaaaaccaaagcgagaacttgggaatacaccttcacattctgaagttggaacaaggcatagtgccaagcatttgccaatgtataataccgtgctcatgtgggcaataatttttggagtgattttggcaaaatgcgagtcggagagccatcgctaa

SEQ ID NO: 77619 - DNA, 1990 bp, Heterodera glycines
  Genomic contig location: Contig_ID=SeqID_13703; Location=41..2030; Strand=-
  SCN-specific regions: Sequence locations=1-12,34-217,242-271,313 -523,555-711,734-735,757-846,870-1068,1090-1276,1318-1796,1818-1968
atgccttcagcagcaatgcttgcattttgccttcttctggcgctgtttggggcattaaatttgccgactgagtgtaaaggtttgttgtaaaggtagcaaatgattattaacaatgtaatggatttgtaaaaaaggaataatccaaagtgggcctcgcccccacaacgtccggcggtacgccaatagctcataaagcaaatccagtgcacggccctcgaaaaaatatttaaaaggttttactggccaacgaagagagaaacaacctttcttgaaataaaataaataaataatagaaaaaattatttatttttagtttccttttcaaccacttacgaattgctcgagacggggacaatgcttctcgacgaagtcaaaaagcagacagacaacgaacgagtggagcatgaagctgatgacgaactcgactcacaaaaagcaaaagcattggaagagaaaggcgacaaatttttaatagccgttgagaatttatgtaactcggaaattgaagttcgaaagcctgtggcagagaagataaaaccaaaagaagatgccaatttgttagctgttaaaaatgtctgccaaaattggaaaaatcgcaaaagcattcggaaagaacagaaagaggcagagaatggaagcgtagcaccagcaatgagcaatttgaaagtgaacccacaaatacacgaaagttttcttcgaacattgtctgaaataaaaattttgaaccccaaaaacaaagaagaatttggaaaattggccaaagttggtattgatttgctgccgaaagtaactaaaattcttaaaggtgatgactgttttcgaatttagaggctaaaaataatcacatttctttccagaactcaaaacgattgctgattctccgtctgatcagacttcggcttctcctgctgatcagccgaaaggcatctcaaaacgacgggaaaaaaaggacaacgaccgttggaatctttttaagaaaagagttcatgatagagaacgctgttcactgtacgtcgtcctggctttaacgtcgagcatcctcttcactgacatgacggttcgcttaactcaacaacacactttttcgatcggaaattcatcgcgtactgatgagcatcgaacgggagttgaaacattttttcaagtacttgaattggtcgcatggatttactcacttcttaccattttggtgagtttcggcatggccatattcgcgtgccggtgcaaagcttcttttttgccccattaaaaatgcatttgctgcttttggggagcgtctttggattttgaactctttttcgttttctttttcttgggaccctattttcaggcctttttttacacggtttttgttcgagttgatttagtaaatcagtctaaagttttcagaatgaaatttaatgttagaatagaaacatcactggccacgaataccttataaacaaatttgttgacactaaaatttgaaatctatttaactagcagcatcgggccactgtaactagaaaagtgctaaagttttggctctcgttattgggcttttgatgatcaaattcctgaatttgggttgaaataagtcgctttttgtgcttttttcatctttctttctttttggtctttttattctttttaattttctttagttttttaaattgttctttattcgtataataccaactttgaagatgtcattgtatttggattatcactattttttgataaagcgttttttgggaattcttttcattaattgatttgctgataaaaggctaagaaaatgttaaaattcgtaggatttcaaatgatagaagaaaaaactagggttgttcactaattatgggtctaattttacgaaattttttgtcagaactttttataaaattttgctaaatttttttaaaatgttagtggatggcatgtaaagctatctcttaatttacctagtttgagctaagttatgatttattattcagcaaaatatttaaataaa

SEQ ID NO: 77620 - DNA, 297 bp, Heterodera glycines
  Genomic contig location: Contig_ID=SeqID_13704; Location=2184..2480; Strand=+
  SCN-specific regions: Sequence locations=1-11,33-196,220-231
atggatacgaaatttcaattaaattcagagagatttttgaggtaaaatgcaataaaaattaattgatttgattggcgacagattcagatcgaatcggcttatgaactttatggaagaaggcaaaaacagcaccaacaaaaggagcatttagcagcagattttcacgataacaattgccctaatgattttttggtggaaataattataaaataattaaaactttcattggacaaattattttttatcgaatttctattaattttagttttttagtaaattttaaataattctaaaaaa

SEQ ID NO: 77621 - DNA, 819 bp, Heterodera glycines
  Genomic contig location: Contig_ID=SeqID_13704; Location=354..1172; Strand=+
  SCN-specific regions: Sequence locations=1-590,612-654,676-819
tcagtctcggcgacacaattggggtcggaacggcgggcacagttgcgcatttgctggacgaagtgctgcgggctgtgccttgcaaaagtgtggcggtccattttcacgacacttatggacaagcattgagcaatgtgcttactgcaatcgatgtacatacaccgcctaattgaacttttattgcccaaattatgcgcattaatttgattagcgtggcattcgcgtggcggacagcagcatcggcggcctcggcgggtgtccctttgccaaaggcgccaccggcaatttggccaccgaagacttggcttatttgctgcacggcatgggcttccacaccgtttgtgaacacgagcgattttaggaaaacatatttaaagccgaaaatcgaaattcaaagggaatggcactgccgcggggcgtgaccggaaaatgcgtcagtgatacaaaattcgtgtccggggttcgaaattgccccttaatggataccggaatcatggtcagtgcccttgaaaacccaaggaacttattttatgacaataaaaatttcattgacgcatgttctactaacgctttttccactgacgctttttccgggcgccccgcgggggcgcaaaaggaaaactttgtgatttttcttcgccattgtcataggataaatggcattctttgctgttgattctctttttaaaaaatgaaattcggcagggcattgacttggacaaactcatcggcacttccgtttggatatgcgcacaaatgggcagaaaaaacgagtcgaaagtgaccaacgcaatgcaaaacagcagaaaatgcggagag

SEQ ID NO: 77622 - DNA, 1758 bp, Heterodera glycines
  Genomic contig location: Contig_ID=SeqID_13705; Location=722..2479; Strand=-
  SCN-specific regions: Sequence locations=1-588,610-674,696-763,785 -988,1010-1295,1317-1321,1360-1699,1737-1758
atgagcagagaaattgaccaatttaacaatgcaatacttctcgataaaggcgatgtaagtgatgagcggatctgagaagcaatttgaaaagtgattaaaataaaaataagaaaaaacatttaatactaattggggatcggattagtaagcaaatacaaaatttcatattttgcatttaatttattaaaaaattggttttacatggttttcactaataaattagaaataactttaaaatcccacaatctttggtcaaatccgacccttaatgataatcggcaatttaaaggaggaattgtggcggatgttgattggacatcatttccactaattgttttttaggagtctgtgcggagagtcggctcttcggcttttgccggcgctgacgagaaggagcagttgcgctttgttggattggtcctttggcatttggtgttccgcgactgtcccatcattgacccgacggcggacgaatttgtgttcatcgcaaaggtcgagccgagcattgacgccaccgacccaaacgtggcgatggcattctgtgccgaattggacaacgaattggcgcgaaaaagccaaccgaaggagcaaaaagaagagaaaaaagtggcggaagaaatgcaagagaaaattgagaaggaattcgaactgtttgaacgattggaggacaaaatattaaaagacaccgcatttaaaggcgtcgagttggagaagtacaacgaactgcacgagaagttcgaactgctcagaatgtattgggactggcaaaaagggaaaaggagacgccgaaacatccctttttacggcatcatcgacagggcattcatcgctttcggaagcgaggcgccggtactgatcgtattcatcagagtaagcaaaattgtgcccaaaattcagttaaaataaaattttattgaaagcaaattttaaaatggaaaaattaaattcgaaaattattaaaatgccaaaaaatcagacagagagagtaaataaaaggcagacaattcaacaattcatcactatacattttagcgatttattcaaatgatttttggtcaatgttttaggtgcttttggaaggtgccattggctggacggacttttcggaatatatccaatatcccaccagaaatacaataaggataaaagatatcgaaaaatactaccaaatgatgcgacaattggaggaaatatgggacggatatggcctctaataggcagaaaatgaactgatcagtgatcactttagaataattaaaatttatactttatagtggaaaaaaacaatgattaaatttttggttttaaatttaattcggcctttttaatataaattttattgcaaaaatttattaaaatgaaaatcgcctccaaatttctatttcataattattgaaatttgaatgttcattaacaaattaatgtgatttggccaccgttttgcaaaacttttgctgacaattttcgtgatgcctttcaacaggtgccaaatcggacaatgaccaattgctcaacgaatttctctgccgaaatcatgcgtttttttgtaattaatgagttaattaactgacgaattaccgatttattttttgccaaatttggcattgttttgctattaaaattccagttttctgctttgccaatgttcaatgtgtagtttgtggcgttcgttttgactttgcattgtccaaattgctcctttcgttttaatctgttttcaaaatttaattttctaagtaattagcgaatataaataaa

SEQ ID NO: 77623 - DNA, 2238 bp, Heterodera glycines
  misc_feature (2216)..(2216): n is a, c, g, or t
  Genomic contig location: Contig_ID=SeqID_13706; Location=412..2649; Strand=+
  SCN-specific regions: Sequence locations=1-360,386-523,545-581,604 -950,972-1057,1085-2008,2030-2238
atggccgctgacattggtcaaattcttcaacaattagttaaaaatcagacggaggcttttcaagcccttctccaaaatgcccaaacaaatcaaaattccaacaaccattccacaatttatgcgactatcaatagccaacttagccaatttacatataatccagaattggatttaacttttcaagcatggctcgaccgttttggcccgtccattcaggtggatggcaaggaccttccagacgcaatgcaagtgcgactgctgcttgggaagctcggtcaggaggagtacgctcgtcatgccgaacgtgtacttccaaaactgccgaccgacttcactctggcacagacaattgataagctcaaaattttgtttggggaaaccaaaagcattttcacacgtcgatatgagtgttttcagttaacaaaatcattttcccaatcaccattagattttgctagccaagtgaatgccatgtgtgaacgctcgaaaatggacttgaccaaagatgaaatcaaggccctcattttcctcactggactctcagatgaagacagagaactgagggaacgatgcttgcggattttggaggaagccaaaaagaaaacaccgccggaagtgatcacttttgagaagcttactgaagagtgccgtgcgtttttgtcattgcgcaacacatctcaatctttggcaactgtttctggaacaaacgccatcactctcaagccgcagaaattgaaggaacagcagctcaaaaagcgcagcacatcacagcgcccgtcgacgaaggcacaaagcaacaacaatcgcagcccttccccttttcagcgccaaccaaaaccgccatcaccgtgcaggttttgtggtcaaatgcattgggtgcgtgattgttcacgggcgccaacttgctcaaagtgcaaccgccgtggtcactacagttccgaatgccgctcatcatcttcatcccggcccaattcacaacgttacaacgcaacaatgtcggtcttcaacattacggacgacgacttatcggaatggataatgatcaactgcagcattaacaacattgatgtggtgttgatggctgactctgggtcccgtctgtcggtcattcagattggtttatgggaaaaattgggtaaacccaaactcataagtggcatcaaaaaggccaaatcttattctggtcactttttcgaaattttggggttttttgtctgttcagttacgtaccagggctgcacgcttcaactcaaatgccatgtcgccccggacggaccaatgaatttgttcggattgccatggatcaaagcgttcgaaatggcattgcagcgaccaatcgctacgacactcaatctcgcacaggcacacgccgtcacagtttgcgacgacccaaacactttggccaaaaatttaaaacaaaaattttcaaaagttttttcctcaagtttgggtctttgtacaaagatgcgggcgcacctccagctcaaaccggacgcacagcccattttctgccggcctcgtccagttccacatgcagccaaagcagctgtcgacgacgaactcgaccgtttgctcgcttgtggtgccataaaatctgtggacttcagcaaatgggcggcgccgattgtggtcgttaagaagaaatgtggcaatgtgcgggtttgtattgattttgcaaccgggcttaataacagtctggaactaaaccgccacccgctcccacgcattgatgatatttttgcctcgctggagggttgcacagtttttagtcaaattgatttccgcgacgcgtacctccaagtcgaattggacgaagagtcaaaggagctggtggacataaacacgcaccgtggtttatttcagtatcaacgtttaccattcggagtcaaaagtgcgccaagcatttttcaaaagttgatggacgagctcaccgctggccttcacggagtgttcgggtatttggacgattttatcgtggccacgcccacgttagaggagcacgatgctcttctaaaacttttctttggtcgcctccaagactgggggctccgtgttcatttaaataagtgcaaatttctttgtccccaaattaagtttcttgggcacattgtttctgccgaaggaattcgtcccgatccggaccgatcagcagcaattgagtcaatgccaccaccacatgactttgcaactctccgatcgttctttaggtgcactanatttattacgacgcttcattaa

SEQ ID NO: 77624 - DNA, 1184 bp, Heterodera glycines
  misc_feature (79)..(79): n is a, c, g, or t
  Genomic contig location: Contig_ID=SeqID_13707; Location=46..1229; Strand=+
  SCN-specific regions: Sequence locations=1-686,708-753,775-1184
atgatttatggccgacgcttcactctgttgactgatcataagccactcatcgccattttcggttcgaagaatgggatcncaatctacgcggcgtctcgacttcaaagatgggctctcattttggctaattacgattttgaaataaaatatatctcaacgaattgttttgggcaggtagacgttctctcgcggcttgtggcacaacaacgcgagacggtggaggcggaagaacgagtgatcgccaacgtcgacaaaacttcacttcaaatttcagatgattcagcgctcgatgaatctgaaacggccgctgtcgactacatcttcatggccaacattgatcagctgcccgtcaccgcggatgaagtcgccgagcacactcaattggacactacgctcaggaaagttttcgatttttgccgtaatggatggcccaagaaatcgcctagtgatttgtctgcctttttcactcataggcacaaactttccgaagtgaatggttgcctccttttcggttaacgtgtcgtcattccggcagctttgcgtcagcgaattttggccgctcttcatttcactcacccgggaatcgttcgcatgagggcattggcacaacaacatgtttactggccccgcatggaccttgacattgaacgttgggttcgccactgcgttgactgtgcgatggcggcaaaaacaccaacaaaaactacactctctccatggcctaaggtctatgagcgcattcacatggattttccaggcccatgttctgacggcaatctctacctcatcatcgtggacgcattcagtaaatggcccgagacttttcaagtgaaaagcacttctgcggacaatgtcatcgttcaactcgagtggctcttttcgcgatacggttttccacgtgaaatcgttaccgacgatgggccaccctttcattcgaaagatttttcccatttttgcaggattaaaggtatcaagcaaacatttagtccgccgaatcacccacagagcaatgggcaagccgagcgttttgttgacattttcaaaaggcaaatgaagaagtgttcacacggagacaaaaagtggatcaccaattctctgttcgcctaccgcaacacaccaaatgccgcactgaaaggacaaacaccagctgaacttttccttggccgttcacctcgaactcaact

SEQ ID NO: 77625 - DNA, 724 bp, Heterodera glycines
  Genomic contig location: Contig_ID=SeqID_13708; Location=782..1505; Strand=-
  SCN-specific regions: Sequence locations=1-489,513-662,685-724
atggatcaacttctttcaacactgattcaatacgatggaaaacatcgaagagtgatcactgtgaatggaaaaaggtgagctacggtaatctgatcaatcgattaaaatggattggattttctatcagcaaattcgcgagtttatttaaattttctatgcctgttttttattggtaaaaaatttcaaagatgtgttaaaaaattttaaacaaaatttctttccgaattaattttttcgtgactttcttgtttgtttttttttttggtagattgacccaaaaaattaaaaacttacgaaaaaaaatcgtgaatatttgtaggctgaatgccaaattttttttttattctgtataaaacagtaatattttttaatctttcggttgaatgattttcaagtacatacttggattcaagcacgcttcaattttttaaatctttttttaaaaaaagaataccacatgccattcaaatatactgaaacctgtgctaatattgtgattttaaaatatatttggcgttttgttatttaatttgtttcatttttgtttgtgatttttgtggagtgttggttgttagtttatgctgtcgcagttttcctattgattgtcctcgccctaattttatttggaattaaacgataatcatcttcggcattgggctgtattgttttgtgtttgctttgggctgttgtcttttgccgtgggcagtgcaacaacattaataaa

SEQ ID NO: 77626 - DNA, 340 bp, Heterodera glycines
  Genomic contig location: Contig_ID=SeqID_13709; Location=474..813; Strand=-
  SCN-specific regions: Sequence locations=1-9,47-101,123-199,221-340
atgttttacaaaataataattataataattgttattcattttttaacatttcgacaatcaaaagcatggagcttttgggaaaaacagcttgaaatggccagaccaaatgaggtgttaaattttattactttttttcccccaaaataattagtgataattagtactctgttaataatttaaggacggaatttatgagtttgatttaacaattgaacatgggatgacaatggtcacaactcaaaatgatggaattacaccaatcattgactattcaccagaacaagtttattattttataatcaatagttaaattttagtggcaaaattgcaaaaaaataaa

SEQ ID NO: 77627 - DNA, 540 bp, Heterodera glycines
  Genomic contig location: Contig_ID=SeqID_13709; Location=2528..3067; Strand=+
  SCN-specific regions: Sequence locations=1-93,115-331,366-467,492-540
atgcgtctaaatatattccttctcctaattgttcatctcctatttgtgtgtagcgatgttttcggtgacgagcaaagtgccgaaaaacaaagacaaatacaacaaaatggcattgcgagtctgaaaagtatgaattcatacacatcacgtgagtttgaagaaatttttggcattacgccaatcaaaccgggaaagctgaataagaaccagaaaaaagagttgaaaaaactgcgcagaaccgaagaaaagaaggccaaggagttcaaaaaggaccttaaatacttgccatttaacaaaggtaaatttaaattgctcttaaaaatgtcaaaagaaattttttaataatttaattttaaataaaaatagctttttcggattaatgttccgaaaatgtagaaatttcgggattcgaaaacaaatttataaaaaggggaaacatttttttacattttttgcttcagaaagagttaattaaaaattatttaaaaattggtaaatcgctcttaaatgtcctaagaatattttgtaattgagttttaa

SEQ ID NO: 77628 - DNA, 275 bp, Heterodera glycines
  Genomic contig location: Contig_ID=SeqID_2063; Location=543..817; Strand=+
  SCN-specific regions: Sequence locations=1-275
atgtgtacttttggaacagaattccatcttttcctcaaggttagcgctcgatttggaggcaaacggttcaccaggaccaatgccgactaatgttgcgcccaaattttgcaggatcggtgtccaaatttcggcaaaactgacctaaagtgaaaattgtaatgtgatattttttcaattttcagtcatgttacaatgccagggtccgtctcggcggagctcgaccaaatcagcacacgctttcccttcatcagcacgcccctttagtggtctcctaa

SEQ ID NO: 77629 - DNA, 765 bp, Heterodera glycines
  Genomic contig location: Contig_ID=SeqID_2063; Location=66..830; Strand=-
  SCN-specific regions: Sequence locations=1-372,394-729,752-765
aaacattgcaaatttaggagaccactaaaggggcgtgctgatgaagggaaagcgtgtgctgatttggtcgagctccgccgagacggaccctggcattgtaacatgactgaaaattgaaaaaatatcacattacaattttcactttaggtcagttttgccgaaatttggacaccgatcctgcaaaatttgggcgcaacattagtcggcattggtcctggtgaaccgtttgcctccaaatcgagcgctaaccttgaggaaaagatggaattctgttccaaaagtacacattttgagtgaattattacacttattttggatttatttctacagttgagcctcccgttgatgtgctgctggcggagacggactgccaggccgaggtggccaagctggtcgaggaacggggcggtttggccgtgtccagcgaatgggtcattcaggttggttctttccattattttaagccatggtttcccggaaatacgaaaagccgttccattttaaaggccatcgtcactggttcgctgcccgacctgggcgagcccggaggcgagaagttccgctacgattttgtttagtgttggctgaatgaacatccacagttttggtggtgaatgacggcggcaatggactttgactctacttgaacacacctaacaatatcataaaccattcgcttttttggaacgatacccggaaacttttctctttttgttgcagaattatctgccctaattaattattattttattgtcccactgacat

SEQ ID NO: 77630 - DNA, 255 bp, Heterodera glycines
  Genomic contig location: Contig_ID=SeqID_2064; Location=186..440; Strand=-
  SCN-specific regions: Sequence locations=45-87,109-255
atgtgtttcggccggaagaagaaagggaagcgacagagttcgcctgagtacaccaaagtggtgagttgttttttgaggctctatgtattgcaatttaattttttagactgatgaagctcctcccgacttttgtgagttgaggcgaaagagttaacgcgaaaatatttttttttcattttcagcggttccttcgagcctgttgtctgatgcatcctcagccgaacagaaggtcaaactgcccggcaacaccaagaa

SEQ ID NO: 77631 - DNA, 1375 bp, Heterodera glycines
  Genomic contig location: Contig_ID=SeqID_2064; Location=907..2281; Strand=+
  SCN-specific regions: Sequence locations=1-1086,1108-1223,1251-1375
atggacgccctcaaaagacttgcgagccgtgcacggcaggtaaaaaaggacggattgtggtgaatcaatttttttaaaattgccatccctgcacatttcagaagtcggcggagatcatcctgagcgcggagaagaccgaaatcggtaaggagggcatttttggatttccaaaaatcaaaaaaacaattccccaaaattcaggcgccgagcttgaacaattgctgaccaagaccgacaagacggaggagcacatgaagaagctggtgcatgccatcgaggtgtacctgcagccgaaccctggtggacacttggaatttgcaatttttggaggaaaacactaatttttcccccaattttcagcagtccgagcgctggacccgcgaaaggacaaatccggccgacagaatacgctggacggtcttggggaggcgatgaaggtgtggtttttggcattcacaacacattttaatgcccaccaaaatttaaggaagcagcatcgaaagcggtgggcgccgagtcgaccttcggaggtgagagaatttgaatcggaaatgctcaatttaattaaccccactaattgcattttctgttcttttcagctattctgctgaaggtgtcacagacggagtccaaaatggcagcaggggaacgccaactcatccaatcggtcaccacgcaaaccttggcaagcctccggcacctcctggagaacgaactgcgcaccgtccaggcgtggatttgcaatttttcactcaattttcgacaatttttaatccaaatccctcccttttcctttacagaaggaacgcagcgtgttgaacaagaaacggctggatttggacgcgacaaaaagccgttggaagcgcgcctcggacgacaaaaaacccgctgtacgtcgtgtgttcatttcgtcgccggggctccatttttcaaccatcgaccaatttcactgttttttttttcaggttgaggcagagttgcgcaaagcccaagacgaatttgacacccaactggagaccatcagcactgcgttggaggctcttcaaacggccgtggtgagaattctcaaccccaaaaaattgtttgacaaaatttcaattcttttccaggatcgtcaggctgaacaattggtgcagttcgtggcggcacagatcgaataccacagcagcagcctcaaacttctgaaggacctgaagcgcgacttgggagcctagtgattgatgagcacaacagcagaagaagaagcagacggatgatgagagacgaattgccatggagattcatattggacatacccatatttgtgtattatactggattaatccaaattgatgcgtatatattacttgtacttgtacataattgtatgtgtata

SEQ ID NO: 77632 - DNA, 1386 bp, Heterodera glycines
  Genomic contig location: Contig_ID=SeqID_13710; Location=65..1450; Strand=-
  SCN-specific regions: Sequence locations=1-263,299-430,484-858,880 -1094,1117-1345,1368-1386
atgcaaccgttgtggcgcaagagcggcacttggtcttgcgaatgcaaatgtggcggcggcgaatggcggtgattttcaaatagattaaacatattcctcacgaaaaattcaaattcaatgtcaaaaaatcagaacaaattgcaaaactttttttttccaagggaaaagggctcctccggcaaccaatgagaaaatttggtgttatgaaatttataaaattcaaatattacgtaatatgccctgagcatcaaccatgactgatcaaattaaaatttaatattttaataaaatttaatttcgaagacttcacatttaaattatcggtcaaaatgtttttttaggttcgttttcctaattatttgtttcttgaaattcctcttttttgattttacttcccatttgtcagcaggcgtttaacgcgtattatcggaataatttttaattttttaaaagaataatagtataaaattaaaaatatattaagggattgtgtataaaatgttaaaattgtctgccaaacatttctttagcatgtttcgaccgagtggggcccaacggtcggtcggactgtcccgaccgcgtggcatactgtaccgtgcccatataccgtagtctgatgatacaggagtgcccgttcacctgcaacttgtgtaacacagcagctctaagccttcagcaacaggcgaaccgatttgtgcgaccacgcatttctcagccgtctccatggagcggcataaatttgccacagacaggcggaggcgtaccaaatgtaataatggcataagcaatgcttcatttaattgatcaattaattaaaattaatgattagtttttaggtacttttcggttttggtctggatttaatttattattttttttgattacaatggtgcgcaaaattgcacaaatatttgttctcactgcagaaattaacgaaatgagtatttgaggaaataattgcgcaaattgtggcatttagcctcaccaaattggcgcgtagtttttgaaaccctttgttgatttaaaaaaaaaatcaattccaggccccaaagccgaaaagtacctaaatttagaaatttctttacaacacaacttttggctcattttttaaatttggcataatgccgcatttttgtgtttttaaaaaaattaatggcaattattagtaggctccaatttttaggcactaaaaaccgtcaaaataggtaggctttaggctctaaaaaaaaccccaaaataggctctaaaaaatggaaaataggcactaaaaatcctcaaatttaagggcgtaaaatgaccaaattcattcaaaaaggcaaaaaaataagtctgatcagcattgagataaataatatctaaatcacaaatacttgtcgagaaaataaa

SEQ ID NO: 77633 - DNA, 703 bp, Heterodera glycines
  Genomic contig location: Contig_ID=SeqID_13710; Location=3025..3727; Strand=-
  SCN-specific regions: Sequence locations=1-41,63-95,131-244,272 -289,332-433,486-634,660-703
atgctttttcacattttcaaatttattttcatttttttggtcatcacgacacaaaaacaacagtttgttgatgggcagcaatatttctgttatggtaatttattaattgaataatttataaattaattttctctgtgtgaaactgataggcgtcaattgaaaatttttaaattttgagaattttttacttttcctgagattagcttcgcttttataatgcctaaacgacacatttcggaatattaaagtttttaataaactcaaataaaaaatttttgatgatgaaagcaatttttaaagaatttttaaaattaaataaaaattaatttttgtagaggttgtccgcgacataacaaccggagcaaatgattgtccgcccccacttgtgtaccagccaagtgttcaagttaaaaacactaacaattaatccctcaaaattaaaaaatatttacattaaaaattaaataatttgaataaaataaaaacaaaaaaggctgacttaattagtttattcacagctgtgctgtggccaacaaccgataccaaacggaacaatacaacaaacttttgaccaactcccacagcccggctcaccggacgcaattccggacggatgcgaacgtccgttaaactaacaatatttatttattgaatacgataatttgtccgaaaaaatacgtcaaatttgtttttttttaataaa

SEQ ID NO: 77634 - DNA, 800 bp, Heterodera glycines
  Genomic contig location: Contig_ID=SeqID_13714; Location=749..1548; Strand=+
  SCN-specific regions: Sequence locations=1-77,220-291,405-434,470 -583,649-663,742-800
gaagtatggctatgctgaaaagctaacaatacaaaaactatggtagaaaataatattatcaatgcacatgaaaattgataattaaatataacataaatataaatttattttgtttaaattaattaaatagaaaaggataagagaaataaaagagagaaaataatttaaaaataaatttaattaaagtaagttgtataatatttttaatgaaaaattaaagcaaaaatatatgctaacaggtcaattctagcagtatctagtccctggtcagttatgaatcaaaaaataccgtttaataattatgtaaattgaatagaaataattatatataaagaaatgtaataaatttaacaaggaaatattgctaaaaataataattataaattattgataatctttataatccagtgagaaataaacagaattttagtgcctaaaaatacatttagaaaaagcctttaaaaatgctaactttttaaaacaatattccgagtatttatgatatgttaaaaaataacgacgcaaagttaagatttttactgttatcaatctaacaacatatatattgcagttatcaaatgtcaataaattaatttaagaaattatttattattttgttttgaagaaacatttttttaaattaaatatccatacaaaatttagaacaaataaattaaaaaccaaaaaaaaagttgaaaaaacaaataaataaacaaattatttcagaaataaatgattaaaattaatttcttaataatcttcgatttatagtgagtgacctaaatattttaaaaagtaaa

SEQ ID NO: 77635 - DNA, 1855 bp, Heterodera glycines
  Genomic contig location: Contig_ID=SeqID_13716; Location=933..2787; Strand=-
  SCN-specific regions: Sequence locations=1-952,974-1481,1503 -1685,1707-1855
gaatttgaatcatttttgaacaacgaattggaaaataaacccgtggaagaagcgccggaatggctgaaatgtgaagaagagcaacggaactgcttaattggtcaactgagtgactcgtggataatgctgggcgctgtatgtcatatttctgatttgaatttttaagagtacggggtcgaaaaccaaagcgtggtaaagaaaattttttcggtttcctctctgtttttgtcgatccatactctaaaaagcttctcgttttattgtcattaaaattttatttagcctatcacaaaagacgagcagttgatgaaacaagacaaatattgtcccagcgaactgatcgctgaactgatcgaagccaaaaatgttttcgatacaatggaccgtaaggaagtggaggcagccaggtcacgagccaacccatacgaaacagttaaggcaggattcttccaaaacaggtaattgcgcatgctttttggctttgtttggtgcattcaaacttattattacaccaatttcccagttttgcagagctgcgatgaaaacagcaaacctcgacaaaatattcgattggcgtctcagctgggaatttgacgatgaaaggcgattggctaaaaaccctctcaacgaaaatgagcgtgacaacgtcgaaaggtgcgttttcaagttattttcttgttgagtcaaccttaaggttttctcctcctttttacttcgccgatgtttgcgcggggcccggcggatttagcgaatatatgttgtggcggaaagccttttacaacgccaagggattcggctttactttaacaggtttgaaatgatccctttgtattgagggagttggtctaaaagaaaagggaggggaggtcgaaatgacgggaaaaagcctaaaaaatatgttttttgctgtcccactctttcccgaatttgatcaaatgacaacattggatttaaggaaaggacgatttcaaattggaaagattcaaagccgcttcatctgattactttgagacattttatggggtcaatgaggatggggacgtgacaaatccgaacaatttggaatcgttggaaaagtttgtgaatgaccgcatccacactggttggaagcatgttttaagattgaagcattccgatccttttcgcttaggggtccatttggtgatgtgtgatggcggtttttctgtcgatggccaggaaaaccttcaggaggtcctttccaaacgcctttatctgtgccaattcattgtcggactgtctttatgccgtgccgaaaggcgtaaaatcaaagaggaaaacgtagagggaaatgctaaagtgacggaaaagggcggcaactttctgtgcaaactgttcgatgtgttcaccccattttcgatgggtcttatttatttgatgtgaacaaaacttttaaatcttataaatactttaactgtaacaaaatgatagggcggaaaaaacagcaaactttggaattgatattttaagaaaataaataatagcgggcctttcgaagttcgttaaaccgttccttcgtcattccccctcttttgcaggtatctctcttttgaccgtgtctctcttcataaaccgatcacttcccgacccgccaattctgaacggtaattccgtcaatcctttccacatttcttttaattctcattttagatatattttttgtgaaaatctgaatttatttggctccacaaaggttaaaaaatatttgatggaagtgaataaacgaatggaatcgatggacagaaaaaaggaggacattatggaattggtgcctgatgaagtgatcagcgaagacgacactttcatggcgtacattcggcaaagcatcgaacagtga

SEQ ID NO: 77636 - DNA, 153 bp, Heterodera glycines
  Genomic contig location: Contig_ID=SeqID_13717; Location=637..789; Strand=+
  SCN-specific regions: Sequence locations=1-51,75-153
cactaaattacaacacttcgccaactgcagaatgttagctgaatttaaatgaatgaatatttaataaaaatgaatgcttacatatattgacgcttgtgtattgttacataaatgttaattgaaataattagaataaatatttgccttaattaa

SEQ ID NO: 77637 - DNA, 563 bp, Heterodera glycines
  Genomic contig location: Contig_ID=SeqID_13719; Location=153..715; Strand=+
  SCN-specific regions: Sequence locations=1-29,51-67,127-129,151 -307,347-563
  Gene Ontology: Mol. function=structural constituent of bone; Cellular component=extracellular space; Biological process=epidermal differentiation
atgcgcagaattgtgcgctcagacccacagggacctacaggaaaagagggaatgccaggctgtaagcaaaattattattattttttaaatccagaaatattcaaaaaataaataaatcaaaattatgttcaaaatgccaaaattttaaatcaaaaactcggatgcaataaataaaataatatggcactctttggaatttaatttatacgccatttgccatatatttggggtaatttcagcagaatttccttcaaaatattcgtttgaggcgtcaaaaactcaaaatttttctatagaaactatttagcatttattatttattttgccaaaaaatctttcagtgaacggcgagccgggccttcccgggccacccggcatttccggcgttcaatttggcgagcagatgttcagtcggccatgcattcaatgccggcaaggaccgcccggcaaaatgggccgccgtggcgacgtcggacagagcggaccgcttggcccacccggcgtaccaggcgcgccaggacgcatgggcaacccgggcaaggagggcaaagtgggcgagcaag

SEQ ID NO: 77638 - DNA, 1714 bp, Heterodera glycines
  Genomic contig location: Contig_ID=SeqID_13720; Location=1954..3667; Strand=+
  SCN-specific regions: Sequence locations=1-1118,1140-1253,1275 -1332,1354-1714
gagctcaaagcttttttgcattcttgctccgttggtgttggctccgaatgggaaagttgttcctcgttgagtctactcttgcactttcttttccaagagcacaaagatacacgccaattccgcaggtcctatcgaaacagtgcgtttcaattgcggactccaaatttttctctagatggttttacaagaaattacagctagaactgaatgatgtcactgcgcgaagttcgaccgccggtcgaattatccatggcattcagatccgcgacctcgaagcgggcatgaactcgccggtggtaaataatgtgcgagtggaaagtttccaactatctgaggacgatcccgacctcttcgaagaattggtccttcttttggacgtcgattaccgtggcggttttcaaatgtctgttgatgcgaatatggcctttggaaaatttgcacaactctctgttaaggtctttcaagtagtcttctttgtttacgacataaattttattaaagttactccaactgaatggccgcgctcgtttttcaatccgacgccaaccattcgcccattggagtttctcttttgttgaagcccctcagatggatttgaaagtcgattctcagttccaaggacggagtctccgccatttaattccgttgattaattcggcctttcggaaggctatacagctcaaacatgtgtggccaaactacaaattgcgtttcagaccattcttccaaaatcctctctacagtccctcgcccaatacaggtccattttggaccatagatcgaatatccctgtaattctaatttagctgccttcgagcatgttgatctctctggtgccggcttagaggtgactgtcctgtccgcatctcgcctaaacttgtccggctttgagcattctgcaatgcgtctgttctgcatggtttccattggtaagttttgaaagcgataacaaaatccattaccaaatataaattgaatagagaagcgacccatcaatccgtaccaaactagcgaccaaaacacttccgaaaagttgagaagagccgctcatttgctcagtgtccttctgcaatttacaagaaaaggggcgggcggtcctttgggactggcattcaacgccaacggcaaggttatttttgacgaagggaaaatgttttgggtcaaatgtttcctccggaattttttgtactggaatgaattttaaaaatggaattttcgactttttgttcaaattcgggtctggggattcggaaggggcttaaattaatggtggtatatttacgatcattaacaccaaaaagcctcaaattattgtttctttcatgccttgaaaataaaaaattttgctaaaaacgcgcaagtatctgaagtaggtatcaccaaattgaattatcccaggaaacaaaaaaagtagtaaaaatttagtctactcacttttgcttcgtgctttttgtccttttgtacacattaaaactgaaggaaccgaacagtcacgagcttcgggtggccaatgttgagccggggtcgaatgctgataagagcggctttcgggtcggcgacactttggtagcggtgaataatattccggtgagaaatgagcgacaggcgacgcgacttctgacggggacagcgggggatttgctcgttttagtggagagagagcttaacgaaagtgtaaaaggcagcgaagaatcggcgggtgaagagacggaag

SEQ ID NO: 77639 - DNA, 724 bp, Heterodera glycines
  Genomic contig location: Contig_ID=SeqID_13720; Location=837..1560; Strand=+
  SCN-specific regions: Sequence locations=1-52,78-198,240-326,419 -427,449-454,476-510,532-724
tagagttgagcgggagaccgggaccggggcgggaaatcccgggtttttcaggtcccggtcccgatcccggtcccggtttttggaaaaacagaaatcccggtcccggttttgccagtcccggtcccggcgggactaaataagcactggtaagaatgggggtctgggtgagaaaagagaagggaattggtgagggatcagaaatttttgataaaaaattaaattatttattttcatttatagcatagttcatatgcataagtggttaagtggctaaacatttttactttcattatttgtctcttcggttcaattccctgatggaacagaaaaaatttttatattttctttaccattattttaattgaatttaattaataaaaaatatcttaatttaaaattattatttttttcatttttagtagcctaaaaacccataaattaaccaaattgtaaatttattttaaaaaatacagaattttgggactcagaaaattccaagaacccccctgaaaacaaaatttttataattttcctcgaactcgtcccccaaaacgtacaaaattttatgggtacatttttgaatattggcaattttcataacaaagtgcagttaaattttcaatttttttcaaaaaaaattttcacttgggaaaagtcccggttggtcccgggttttttcgcggtcccggtcccggtcgaaaaacttggtcccggtcccggtttt

SEQ ID NO: 77640 - DNA, 430 bp, Heterodera glycines
  Genomic contig location: Contig_ID=SeqID_13721; Location=589..1018; Strand=+
  SCN-specific regions: Sequence locations=1-134,263-430
atgacatttgccgggcgttttaccttatccccaaatcaatcaattcgatggataatttttatccaactttcatttgtaaaaggttagaaattttctttgtcaaccaaatccaacatttgttggtagcaaaaatggagaaacaagggaagaggagggaaatagcattggggaaggaggagagacggaagagaaagagaggaaaaggaaaaattcgacggaaggaagaggaggatgagagaagaatgaagcagaaaagagaggaacagcagcaaattgacacttttgaaaattttgaggtaggcccaaaaccgaaaagtaccgatattgttagatttggcttacgaagaaaaaagtgaatagttcaaagctccaaaacatgccaactgctgacggattccgatgcattcataagcagcgaaaacaaaacaaa

SEQ ID NO: 77641 - DNA, 391 bp, Heterodera glycines
  Genomic contig location: Contig_ID=SeqID_13721; Location=2341..2731; Strand=-
  SCN-specific regions: Sequence locations=1-226,255-391
atggtgccatttgaatttcttaacgaatggacaaaggaaaagctgacattggccaaagcaaaggaattgggcaaccgatggataatgaaacgatgcaaaattattggggagaccgcggcggttcagcagcaaaagaaagatgaaaattggggcaacaattgtaacaatgtgttcatttggctttacatttgcaataattgcattgggtgagcaattaaaaaaaggcatttaattttgtttaaataattaaaattccgcctaatttaggccattgtctcctccaccattcgcagaagaatccggacaaagcatcacaaaagggccgtcttctgctgacaaaatgagtgatggacaaaacaacaaaaacagtgatcagccgcagaagaaatga

SEQ ID NO: 77642 - DNA, 1514 bp, Heterodera glycines
  Genomic contig location: Contig_ID=SeqID_13723; Location=12..1525; Strand=-
  SCN-specific regions: Sequence locations=1-9,215-276,306-369,411 -646,668-747,769-879,903-1001,1022-1186,1222-1294,1316-1384,1406 -1455,1497-1514
  Gene Ontology: Mol. function=protein binding; Cellular component =axoneme; Biological process=N-linked glycosylation
gcaaaaaaggaagaaaaaagaggaggacaaaaaggagcagatagaggaagaaaaggaagaggaaaaggagacaaaagaaaaggaaaaggagtataaaaaagaacagacaggggaagaaaaggaagaggaaaaggagaagaaggaggaggaaaaggaagacaaaaaggagaaggaggaggaaaaggaagaggaaaaagaagacaaaaaggagcagacagaggaagaaaaggaagacagcaatttgataagtgataagagaagtggtaaagaggagtcaaaaaatgaacaaaaaatggaagaagatgcgcacgaaaaaggcaacagcaatttaaattatgttttgttggagcacgaaaacctaatggcatttgtggaaagggtaaatcttcttttcttttaaattgttttaaattaatcagtgccctcgagtgtactcattttagatttgcactgcatttagcgatcaaaatttaagaagcaggcaatttttttgaattttcccggcggcgcttatcggcaccgccagcagacctaaaaagctccctgattcgaaaaaattgactcaaaaatcgcgagcaaatttggttattttttgtacaaaaactgttagtaaatctcacctaaattatcccgaggcgcctgtcggcaccgccttctccccctcctcgggattttggaccagagtctgaatttaaaatttggacgatgtttgtttgtcgtgaattcaaagaaataatttgattttgatttaaaattttcttcatttttagtatagtaattttattgtgataaattgcgtggcggagcagaaaaatgtttatgacaatttatgcaaattccttaaaggaaaaattagaacaaaattaatggacaaaattgaaataaaaaatataaaaaaaattgaaattggtgtaatggacacggaggcgaacagagaagtaacactcaaaattgtggacgaattggttaaccggggattcaggtgacaaattgggcgggagtaattaattaattaattaatcggggttgaattgacatgaaataacgttgagggaggggagcgggtcatcaataaattaaataaaccctataattaccttatcccgagaaattttgacctttgaagtgattaatgcaaatacaaaacaaaaaaatgtcgctcgcccgaaaaaatttattatccttcatttttttcaatttaaaattttaaaaaattaatttgttcaaattttagcattaattttggcaaagtttggctttttggcattaaaataccagcgaatggcaacgaaaatttgaaggaacacttgatgaacttcgatattgaaatgaaaatggaatatttgcagcagttgggccttttgtctgttgaaatggacgaaacggaaataattaacgaattccaaaaattgggtgccaatgttttgtcgacggtggcgaaaaaatggtttttgatggacattttggaggacaaaaaacattgggaaaatgatgaagtaacaatctatgaatga

SEQ ID NO: 77643 - DNA, 387 bp, Heterodera glycines
  Genomic contig location: Contig_ID=SeqID_13724; Location=173..559; Strand=-
  SCN-specific regions: Sequence locations=1-3,59-65,243-284,314-387
  Gene Ontology: Biological process=N-linked glycosylation
atgaaacaaacggaaaaaagaacaaaaaaagaaaaatgcaaaaaaggaagaaaaaagaggaggacaaaaaggagcagacagaggaagaaaaggaagaggaaaaggagaccaaaagaaaaggaaaaggagtataaaaaagaacagacaggggaagaaaaggaagaggaaaaggagaagaaggaggaggaaaaggaagaggaaaaagaagacaaaaaggagcagacagaggaagaaaaggaagacagcaatttgataagtgataagagaagtggtaaagaggagtcaaaaaatgaacaaaaaatggaagaagatgcgcacgaaaaaggcaacagcaatttaaattatgttttgttggagcacgaaaacctaatggcatttgtggaaagg

SEQ ID NO: 77644 - DNA, 819 bp, Heterodera glycines
  misc_feature (641)..(641): n is a, c, g, or t
  Genomic contig location: Contig_ID=SeqID_13728; Location=11..829; Strand=-
  SCN-specific regions: Sequence locations=1-99,121-434,457-758,780-819
atgtcaatgagtttttcgacttttcttaccagagaagaaaaggaattggaccaggctttcgacaagctcaaacaaatacgggaacaaattaacaagcgaaagggtgtcaaagttgaagcaacaaaaaatgctaagggcgaagtgataattgcgcagggtgtgtaatgttaatttaattttagttttgcttccgtactagcaatgaatgaatgtaaaaaaagatcaattgcaatttaattaatctctcaaaactgcttaagcctttcaagacggtgaaacgaggacagtggaagttcgaaaagctgcggcagatggcaaattggtgttcagttgcaagcctcaaaaagatgtattcaaacaaaggccacacaccaataaacggaatagggtaaagaaaaccaaaaaaagatactagtacgttttcaagcggtcactttagaatgacgataacagcaacagtatttccgaagacaacaacgacccatccgaacaacaggttggcatggtcaaacatggaagactcgaatcggacggagttcagaatgaacacgaaggcacagtccaagccactggagagcacacctcacaaccagcggatcagatggacggtgccgagaaaacacagacaaatgtcggacccngtcggtctgttcttcaatgcaccaatttcttctaaatgctattatttgatcaacgaaactgcatattttcaatgctatgaaaattagttcttcagggcttttcaatggaaactttcgcattccaaaaaagaaacccaggatggacgaccaagaatttggtgtcgagtttttcaagtaa

SEQ ID NO: 77645 - DNA, 862 bp, Heterodera glycines
  misc_feature (42)..(42): n is a, c, g, or t
  misc_feature (46)..(46): n is a, c, g, or t
  misc_feature (60)..(61): n is a, c, g, or t
  misc_feature (75)..(75): n is a, c, g, or t
  Genomic contig location: Contig_ID=SeqID_13728; Location=1279..2140; Strand=-
  SCN-specific regions: Sequence locations=1-176,224-620,642-768,790-862
  Gene Ontology: Mol. function=transporter activity; Cellular component= mitochondrial membrane; Biological process=mitochondrial transport
gttagaagtgctgaagacgagattggctcttcgaaggtctcncaanacatatgttctttnntagtcgcaattatntaattcttgtacttttgttttagaacaggcgaactcaatcgtgggctgtgccattttgctagagaaatgtaccaccgtgagggcttcacctgtctttacagagttttttctcaatttctttttgacaaataaaacaatattatagggatatgccgccaattgtattgggattattccatacgccggcatcgatttggctgtttatgagacgctaaagaatttgtggattagacggaagaattcgcctgggacggacccgggttggatttatatttaaaataagaggccaaattgggtttcggcaactaactaatctattttgaggagtttttatcaggtgtggtcgtaattctcggctgtggtcttgtctcaagctcagtcggacaagtcataacatatccaattgcactcatacggacaaaattacaagccagaggtcagctgacgaaaaattttaattgaacaaaaagtaggaacgaactgtaatagagccaaaaattactttactcactaaacacaaacaaattttcgccgtataatcttgcaaattacattattttcagtaatttcgagtgatccaaatcagccttcgacaataacaggacaggtaccaaactgcgagtgttctttaatgtcgctttcttaggttgcgtacatagtgaaacacgaagggtaccgtggcttataccgaggactggcgcccaatttcatgaaggtgctgcccgccgtttccatttcctacttgacctatgagcaatgccgaaagtggttgggggctaagatgacc

SEQ ID NO: 77646 - DNA, 198 bp, Heterodera glycines
  Genomic contig location: Contig_ID=SeqID_13729; Location=698..895; Strand=+
  SCN-specific regions: Sequence locations=1-198
atggctgcacgttctaatactaataaagaaactctaaagaaccatcaaacgagtaaaacaattgcaaccaagaagctggtggttcaagactacaaaaatcgattgaaggacagtataaaatcgttaaatgataattttgaatgtatattgggcgcttcgaaggtcctgttattgctgattcgtggatttgtcggcatc

SEQ ID NO: 77647 - DNA, 435 bp, Heterodera glycines
  Genomic contig location: Contig_ID=SeqID_13730; Location=98..532; Strand=+
  SCN-specific regions: Sequence locations=1-147,171-435
atgctaaaggtaaattgcgatgatgcgacacatcgatcaaacagtgccggaaaattaggagagcattatgcaatcagaaacgaagcaattgcgagggctgcgcttctcgtcaaggcaacaaatgagttaaaaatgctgacaaagtaagtttttatttattatgaatttcaattaattagtaatttagtgaaatccgagaatttctcactattcgcgacttcaattttataagcaactcaatttccaagtcagcattcgttcgcttagctatttacccgacgataaaagcaatcaaagaaattcagagcagaagaagatttcaaaaagcgattgaaacaatatgaaaatgattacagtgcacttcggatgagcataagcacaatggcatcagagattgatcgagaattggtggaaaattctttgtatagattctga

SEQ ID NO: 77648 - DNA, 652 bp, Heterodera glycines
  Genomic contig location: Contig_ID=SeqID_13730; Location=651..1302; Strand=+
  SCN-specific regions: Sequence locations=1-595,617-626,651-652
atgagtgagtcaattaacgttagagacttatggagggaattcaatgagataaagtcagcgcttcagaaaaaaatgcttaaaaaaccgaatttccacgaagcaattgtgcagtgtcgtcgtattgctactttattggagtgagtgaaatgcattcttattaagtaggagtttgggtttttggaacatccattgctttagggacaatgaacaattcgatcagtcggcagtatgtcatcgagaaattgcagcattttgtgcaaagattggaaatcattttatggagcgacggcatttgctgaaggcggcaaaattatattattatgcgcagatgatgatccaacgaacgaattcggaatgtatcttgggaaaggactaattgttgcaatgggtggatagaaggattttctccgcttgattttttgctaatttctcgccattttaggctctgctgagtttggcaaactcatggagcagtgctatttggaagtgatccatggtttgctgaggtcggagtcttccttcaattatttctcaatcgttggcttggttcattttgaacttgcaattcaactgatttcgctaaaagaaccgttcaaagcattcatttatttgaggagaggtcagaagaaaaattgggcaaaaaaggggccaa

SEQ ID NO: 77649 - DNA, 724 bp, Heterodera glycines
  Genomic contig location: Contig_ID=SeqID_2065; Location=1750..2473; Strand=-
  SCN-specific regions: Sequence locations=1-724
  Gene Ontology: Mol. function=protein tyrosine kinase activity; Cellular component=nucleoplasm; Biological process=signal transduction
atgttcccgggcaagtcaaatatccaaatgctcaagttcatgatggatttgcgcgggaagttcccgaacaaggtgattcgaaaggcggtcttcaaggaccaacacttcgactacaactgcaattttttgtaccatgagacggacaaagtcaccggcaaagtgagtactgacaaacaaacaatcataaattctgagtaaacctttgaatgcatttgtctttccattgtcaggacaaagttacagtgctcaccaacatcaaattgttgcgcaatcttccggctgaactctccggtgatcaggaacttgacagagatgggtttgccaaggttgaccatttccggtctttgctcgaacagatgacagctttggacccctccaaacgaatttcgtgttcggatgctttgaaacaccctttcattgtagaaaagtgatgtgaactttaagcgcagaacatatttgaacttaattccacttcctttataatttgttttcattaaacaatcgaaaaagtacggaaaataatgataaaagttttaaatgtcgccgaaaagaaaaaaatgaattcaaagagatttttactttttttctgatatttggcaaattttgagtttttgaaggaaaaaaaatttgacgacctttttaggtgcaccagttttcatgtcctttagaagatttagaaaatggggggggggcagacaaactgttaccttttcttgttaataaa

SEQ ID NO: 77650 - DNA, 1079 bp, Heterodera glycines
  Genomic contig location: Contig_ID=SeqID_2066; Location=291..1369; Strand=-
  SCN-specific regions: Sequence locations=1-386,408-618,641-678,700 -707,730-1079
  Gene Ontology: Mol. function=protein tyrosine kinase activity; Cellular component=nucleoplasm; Biological process=signal transduction
atggcaaaacaagccgaggaatatgaacgggaagagaaaatgcgccaatttctggaggagaagcaaagggaaaaaattgaacgctgcaaaggggaaagtgccgaagttgtagaagaaagtgagcagcagcaaaaggaggcggacactgcggatgggtcccttcagttcgacatgttcgccgatgatgcccccgttgaggtaaaacggaccaaatatcctttgtaattcgttttgtttcagcttctttcgaaagcagccacaatccaatccctggacacaaccacagctgcgttgaaggataattgggatgacaccgaaggatactatcgtttgtttttttaaattggtttaatgtacaagaaattagaaatttcagcattttaacgataaaaaaaataaatttaaatgacatttcagaattagattttatgttctgtttttttaatcttatggtgtttttgctctatttatatgttccaatttcttttattttaaggtgtgcgaatcggcgaacaattggacggtcgttaccgcgtttacggctacacaggggccggagtgttcggaaatgtcgtccgggcaactgacactcaccgttcaaattcaaaagtggctataaaaattatccgcaacaacgacatgatgtgagacacaaaaaactgcagtattccgttaaataaattcttttttctattgaatgaataatattcattaaatgtttaattaggcgtaagaccggtgtgcgggaattggaagtgttgaagaagttgaacgaggccgaccgattggacaagtatcacattttacagctttacaggcaattttaccatcggaatcacttgtgtttggtcttcgaaaatctcaggtgttttcttttgtcgtcactttgttagtaacagattcccccccccccccccccctttagcatgaatttgagggaagtgctgaagaagtacggcaacaacgtcggccttcacatgaaagcggtccgcagttatgcacaacaattacttttggcaatgaaactgctgaaaaaatgcaacattttgcatgcggacataaagccggacaatattttg

SEQ ID NO: 77651 - DNA, 3415 bp, Heterodera glycines
  Genomic contig location: Contig_ID=SeqID_2067; Location=1801..5215; Strand=+
  SCN-specific regions: Sequence locations=1-605,627-667,690-960,982 -1123,1147-1801,1825-1843,1865-1949,1988-2085,2108-2509,2532 -3328,3350-3415
  Gene Ontology: Cellular component=exocyst; Biological process =synaptic vesicle docking
atgactggtattatttcaaccgaacccagtgtaaatacagtcgatgattccaaaagcagtggttcttctgcaagtaagcgattctcagctaatggactaaccgatactttgctcattcagaccctgaaatcagtgctgaacaggaattctgtctatatgaacttgaaacactttctgattcttctagcattggcttggttctgaggtatctatttatttgcatactttggcagtaattactttccaccaaaaagagcaatttatgattctggagatgtgcacaaattcacacatgctttggagaagcgaataactcactatgacaagagcatattgaaggtgtgcactcatcattatcagggctttctcgattcgatcaaacagcttcgtgggctcaaagaaaaatgtgcggagattcgcgtaattttctttttttaatgtttttcaatttatcatttaaacagaaaatgacagagacgactgatcaccaggttcaagaggaaagcaaggaactgctcaagcgcagtgccgaaattgtccgatatcgacgattacaccgaaatgccaacatagccattcaacaactttcgatgtgcttaccaatgttggaaaattatacacatctgcaaaaattaatggagcagaaaaagtaatggttctaaacgcgattttaggaaaataacattggactgtctatcatggctcttatttatgggggttaaactgtatgatagtccctatcattgcactcttcgagatcatatttttttaataaaaagaccatttccaggtatttacaagccttgaaaattctcgaagaacttgagcataattacttaaatcagcttcataaatatcggtttgcgcatcaattcgtcaaatcaatcaagccgattcgagaccagattagagagaaatcgtattccgaactgaccgacttcctcgaaaaattaattgtaatttttacatttatgatttaaaactgaaattatttgtttagaaaatctcagaaacaatcggtgaagacgcatgcaaacaagtggacatttgaatgattgaaatttatggaccttttatttttagaccgagaagttctacacacaatttcattcgaattccgctgagaaaacacaaaaagcaaaccaaatgggcagtgcaaatattttagtgggcaaaatggaattgttggatattgaaatttccgaggacggatcgttgcttagaaagacagcaaacgcagcgaaaccaatgcaaagggacaacgaaggaaaaacaacagaaaaaccgaaaccgatggctagaaagatgcttccggcgaacaaacaacaacatcagcatgttcaattccattcacaggacaaattggaattggggccggtccaccgatgctgccaaatattcaatgttatggtaggcatttggagaaattcagaaatcacagcaatttttaattcttttcaacaacagttaatgttattataacagggtgaccgcgacaaatttgaagcctactacagaaagcaaagatgcgaccaactccaactgattgttggacgacaaatttcaatggtaagttttttatgaatatacgaacaatttcagaatagtcaacaaataaaaatggtgaagaagaatgccaaaacggacctgtcaggattttcccgggatcctgtttgtttattgatgctaaaattttgttaattttgcataatgtttatccaattttcaatttcgctttttaaccccaaaagtgttcctttggtgtttggaacacactgccgaaccgtaaccgttcctttcagaaaataaaaactagaaaaattgattgaaatattttagctctcttgtaattttttaggctttttgtattctcatgtgggtaatcaaatgtgattcgatccgtgtcctatttccaaaccccaaacctgaatttttcaaaatatggtctcttttttatttaattatatatgttttttatttataaatagcaaaagtgttcactaatcaatggcgaaattatgaagtttttacgcttgcaaattaaacaaagaaatttatatgattttttattatgatttcttttgcaaaaaatgcctttgaaaataaatgattgacaataagagaattttgtctattttttaaacatccgaaaaatttagacagattccgtggaagtgttcgtaccatatctcaacgaaatcgtcggcttttttgtcattgaaaatcgaatcgctcaaattcagtcgtcgcttgtaaccgctggacacaaagacgaggcctgggaattggccttaaatagcatctcagactcaataaacgcacattttgtgagttttttttaattaaaatcttaacattttttgatttagggctcatgccaaaatgtttctctgatgttagcaatgaagaaactgatccttctgtttacacttaccaccaaaagttgtggttacgacccgaccactctctacagtctacttcaaaactttaggtaattatcgtttttctaaaaattaatttagtttctttttctgggataaatacaaccaaattttgatcgaggaatacagtgaacagtttgaaaatgcgttagagaacgacgattacacgcccattcaagtgaaggatgagcgcgagtatcgcaaggtggtcgaagagtttcccgtcaacaaaagaagcgttgaccaagaggtgagttgacccctttataatttggttataatttgattgattggaactcactcattttcaggatgcatttccacgaaaatttcccttttctcggtttgtgccaaaagtttattgccaggcaaaagaatttgtcgcgaattgtgtgcgctttatggaagacctgcaattgtcccactcggaagtaagcgacaccgtcagacgatatgcaaacattttattggccaaatggtcaaatgcgctgagaaagttcgtcagctcgcgaaaacgatcgcttattcaggtggggtttcccaattcctttatctgcaccaccgcattttaagctcatccaaatcaccattaacatgggatatcttgaacgatcttgcgaatttctcgagcgatttattgcggaaatggcgcgtaatttaagtggcgaattcgttggttcattgggcaacagtgggggcactttgtttgaaggagggggccatttggtcgcattgaagaaccaatgtatttatccgattggacatttattttctatgcttttcatttttagtgttcagagattctcgatcagaagttgagcaactcatagacgaggctttccgggagaaagtccaagtatttttggacaattgtaagttaacgtttgccggaatatgcacatatttcgatacttttagcgcattacgtttgggagttggaacagtcaagtggagtcgcaagtgaatttatgtga

SEQ ID NO: 77652 - DNA, 489 bp, Heterodera glycines
  Genomic contig location: Contig_ID=SeqID_2068; Location=56..544; Strand=+
  SCN-specific regions: Sequence locations=1-489
  Gene Ontology: Cellular component=exocyst; Biological process =synaptic vesicle docking
acgtgcaaattccttgccgatcgcatgagttcgatgttactttcgtcggagcatcgttcggttagcatcggtgcacttgagcagttttcgcttgatgtgatgcaatgcgaacttttcactgcccagtgccctgtgcccggtttcgaagataatgctctcgccattactttcgcacatttgcgtcaattgttggacttggtgatggggcccgactggacaactttctttgccgaaagggatgaaggaaattcgcatcgcaagggcggaagcagcggcaccaaatacgcccgagtaaaggcgtcgagtgccgcggcacttttggaaaagtaaacctctgaaatgttttgtgtccagctttttaaaaatttcagagtaattgaatttgaaaagaaaaacagtggcttttttgctattggtcgagcggacagtcgcgacaaacagaaactatatgagacaattctacgaaaattgcgatcatttacagattaa

SEQ ID NO: 77653 - DNA, 499 bp, Heterodera glycines
  Genomic contig location: Contig_ID=SeqID_2068; Location=1506..2004; Strand=+
  SCN-specific regions: Sequence locations=1-116,139-499
  Gene Ontology: Mol. function=ATP binding; Cellular component =intracellular; Biological process=intracellular signaling cascade
ttccaacacaattggcgctggacaatttgggacggtttatgcgggaacaaatgtaaaagatggacatcgagtggccgttaaagtaattagacaaattacctattttagtttttgacttattttttaatggttatttcctcaggttcttttaaaagagaagtttctccactcggccttttgttgtgttggctcgttgagaaatgagttcattttgcttaagaagttgaaacatcccggcatcataaacttagaaatgctgacggaatcttcgaaagaaatattcgctgtgatggaaagggcggacaaagacatgctcgagttcatcctgagccaggcatatttttcaggagttttttttaagaatgataattttttaggaaaacaggcgactggacgaacgtcacaccaaatttttgttgcggcaaatactcagtgccattcattttctccacggtcggagagtcgcgcactgcgatttgaagccgggtaaagacaaacg

SEQ ID NO: 77654 - DNA, 1656 bp, Heterodera glycines
  misc_feature (1578)..(1578): n is a, c, g, or t
  Genomic contig location: Contig_ID=SeqID_13732; Location=417..2072; Strand=+
  SCN-specific regions: Sequence locations=1-605,627-706,728-1656
cttgccgtcagaaacattcttcgctatgttcctaatcgcttccatcactttcttggccctgaatttgccgatgaactcgtccattgcgggcacatttatgccttccgttttatgccctactttgtgctaaaggttagggcgtatgagcggagataattgggacacataattaatactagagactgaagtttttcgagtcgagacaaagcgaccgtttgtaaggtttaggcaccgccgttggacaaaattgagacgcggagcagacaagcagctgcaataattctgatgctgttgaacaacttggacccagaagttgcccaatttccgcaggtcactgcgattaaatggcaattagctaattaccatttgacgtatttccgccattcccataaatcgtcttcctttttttattgtcaattgaccatttttgttttgtttgaaggaattggtcacttacggcggcaatggccaagtcttttccaattggatccaattccgactgacccttcgtttgttggcccaaatgacagacgaacagactttggccatgtattcgggccacccgctcggtccttctcctcccgataattagctgaatgccgcccttcccttctttagggcttttcccctcccacaaagatgcgccgcgaatggtgatcaccaacggaatggttctcgacattcaccaatgactgcataatgaatcaaagcaattccttcccctcagatgatccctaattactccaccaagtcactctatgacaaattttttgctctcggagtcacaatttatggccaaatgaccgccgggagttattgttacattggaccgcaaggaatcgttcacggaacaacggcagacaaaatttgaacatccaaagcaatttgtttttcctggcacagattacactgatgagtgccattcggaagtatctcggaaaggggataagtccagcggggaaagtgttcgtcacttctggtctgggagggatgagcggagcacaggcgaaggccgcagtgatcgccggtgggtcgaagggattttattcggcaaatatttgccacttttaaaggctgtgtcggagtgattgctgaggtgaattgttaacggaaatacaaagtgatcagaaaagatactcttggcaaaggtcagcgaaagtgcgctgaagaagagacatggccaagggtggctggacacattcagcgccgacttggaagtgatcgtccgatgggtcagagaaagtcggagcaatcgaagggtaatcaaagacggacaaattcatttataaaacgaatgaaggcgataagcatcggatacttgggcaatgtcgtggaattgtggtaaacactgcacaataacccctgctaattgaaaggatcaaatgtttaaaatgccagggaaagactggcggaagagcccgagttgatcgtggaactgggctcagaccaaacctcgtgtcacaacgcttttaggagggggctattgcccggtaggactaagttttgacgaggcaaatcgaatgctaacggaggacaagccaaattttgatcggatggtgcggcagaggttgggattanagcgaacacccctacacatttgtccattctgaagcttattgcgacatattgccgctatcgaaaaactgttcgctcgcg

SEQ ID NO: 77655 - DNA, 797 bp, Heterodera glycines
  Genomic contig location: Contig_ID=SeqID_13733; Location=1..797; Strand=+
  SCN-specific regions: Sequence locations=1-39,62-681,703-797
cagacagactgtgagtagaattacagactttcaatggtcttttggcaaaatgcctttgtcagtgagtgaatggaggcgggagcagtacgaagacaatttgttgtggatcaaaaatgcggagaagcaccaattggtggtgggatcggaggcacgcattttatattcggacggaatgggaagggtcgaattggcacgggcattcaatgcggcaattagggaacgaaagttggaggtcgaaagggatggttggattgtgtattatgttaaaacacgtgaattgttgtgcgggacagggaccaattgtgatcagtcgagaccatcatgacgtcagcggcaccgattcgcccttccgcgaaacgtcggacatcggcgacggatcggcgtacacagccgacatggccattcaggtgccaatggccgagaattaggcgacattgccttaccttcagaatgtaatcggcgattcctttcggggggcgacttgggtgtccattcacaacggagggggcgtcgggtggggagacgccataaacggaggcttcggcatgttcctcgatgggtccgcagtgagttacgtaagacagagaacagtgaacaaaggaaatcccatgaaggaagcggaccaaagactgagttcgatgttggcatgggacgtggcgaatggcgtggcccggagatgttgggcagggaatgagaaggcaatggaaacggtgaagagaatggaagggatggacccggtactgaaagtggtggtcccggaaagggtggacgaagaacttttggacggactgaaattc

SEQ ID NO: 77656 - DNA, 1207 bp, Heterodera glycines
  Genomic contig location: Contig_ID=SeqID_13735; Location=1222..2428; Strand=+
  SCN-specific regions: Sequence locations=1-103,125-324,346-541,564 -876,911-1207
atgtctggccaaataaagactccgactaatcagaaattgctcacaaatgttgcaattgtgcggatgaaaaagtgtggcaaacgctttgaaattgcatgttacaaaaacaaagttttgaattggcgcaacaaaacgttagtttttttatttgggcagaataaagcacatcattttgttcagtgagaaggacattgacgaagtgctgcagacgcaaacagtttttgtcaatgtttcaaagggacaattggcaaaaagggacgacctccaagcatcatttggcactgaagaccaattggaaatttgtaaattggtcagtccttaattgggaaaatgaaaattttaaacagtttttagatactcgaaaagggcgatttgcaaatttcagacaaagagagacaagtgacctcggagagctcttttaaggtaatgataatttcttctaatttccgctcactttcaatccaaataccagtccttttttccattttaggaggttgccaatctgatcacggatatgtgcgtcaattccgagacacagcgacccttttcacttgctgtaagatttgattgttttaattatgctaatcgaattgactaatttgctgtttcagacaattgagaaggcattgcatgatgcgcacttctcattgaaaagcaatcggtccacgaaacaacaggtgaccgttttatttaaaccttttttattgaaattttaaaggccctcgaaatgataccgaaattgcgcgagtcgttgaaaattgaccgtgcgaaaatgcgaattcgagtgtctgtgcctgccaaaaatgcgaaaatgttgcacccaaagctaaaggcattttttgacaccaccgaagtcgaagattgggacaaaggcgacctcgaaatggttattattttatgtgtggaataaacccagataatgtattgtgcttttaggtgggtctgattgagcccggcagttacaaaacaatcgttgaacttgtgaaaggtgacaaaaaggagaaagttgaacagattggactggaactgctgagtctgaaggttattggagagaatgaggtggaaataagctgaaaagtgaaaacattcgaatgatttcgttttttattgtgatttgacccattctcaacatttgacaatgaattttttgcatttgagtcaatttgctgccccgcaggtgcattattcacaacttaaaatgaattga

SEQ ID NO: 77657 - DNA, 1386 bp, Heterodera glycines
  Genomic contig location: Contig_ID=SeqID_13737; Location=1084..2469; Strand=+
  SCN-specific regions: Sequence locations=1-1341,1363-1386
  Gene Ontology: Mol. function=protein phosphatase type 2A, intrinsic regulator activity; Cellular component=cytoplasm; Biological process= neurogenesis
atggtgtcgaaaaacattttccgtgttcttcccccaagtgacaattcggaatttgacccagaggaggacgaacccacgcttgaagtgtcatggcctcacttacaggtactccaataaaaaatagaaatactctgtgcaacctatacaactaaattctttgcatagtattgccaaagttttgataactaaattcgattattttagctcgtttacgaattgtttttgcgttttctcgagtcaacagattttcaagcatctattggcaagaaatatattgaccagcgatttgttcttcaactgctcgaacttttcgattcggaagatccccgtgaaagggattttctaaagacaattttgcaccgtatttacggaaaatttttggggcttcgtgcgttcattcgaaagcagatcaactacatgtttttgtctttcgtatttgagactgagtcattcaacggagtgggagaacttctggaaatccttggaaggtgtttttatgtagccgaatataatggaaactaaaccaattaatttaagcatcatcaatggatttgcgcttcctttgaagcaagagcacaaagtttttctcgtaaaagtattgttgccactgcacaaaccccgttgtctgaacctctatcatgcgcaggtcagttccgcttgggttctcttaaaaaccaagttttatgcaaaaaataaagacgaacagtttattttatttttattttccgttgacctaaagtattactagtgtgaatgcagtaaagtaaacgcactctatgattgttttcggctctcttttagctcgcttattgtgtcgtgcaattcattgaaaaggattcgtctcttactcctcaagtgttcgattcgctgctcaaattttggccaaaaacatacagttcaaaagaggttagttgtatttgtattcccattgcaaaatttagttttgtttttgcttttaggttatgtttttgggcgaagttgaggagattttggatataattgagccggaacagttcaagaagatcatcgaccctctttttaagcagctcgccaattgcgtgtcgagtcctcattttcaagtatcaaattaaacattttcaaatcatttgctattgtttgaggttgccgaaagagcgctttacttttggaacaacgaatacattctgtcgctgattgaggactgcagtgcccaagtgatgcccattatgttccctgctctttatcgtatcagcaaagagcattggaacccaaccatcgtggctctcgtttacaatgtgctcaagacttttatggaaatgaatgggaagctgttcgacgaattgaccacgaattacaaattggagagacaaaagtaaagaaaaattaaatcaccttttacttgagtca

SEQ ID NO: 77658 - DNA, 875 bp, Heterodera glycines
  Genomic contig location: Contig_ID=SeqID_13738; Location=1918..2792; Strand=-
  SCN-specific regions: Sequence locations=1-413,435-819,844-875
  Gene Ontology: Mol. function=general RNA polymerase II transcription factor activity; Cellular component=transcription factor complex; Biological process=transcription from Pol I promoter
atgcaaaagactgtgctttttacacctcttacaaatctcgtaatgacaggggcagtaatgacaacacttaattttatgtggacagttcattttttcaatttaattttatttttggttgctatttatagaaggggtatataaagggagtgaaaggaccatttgattggtacattgtatcaaaaattcaaaaaccgataatcgtaaatataattgctctcactaatctcggtaccggaattaaactaaactctctgacgatcaccgaattcgaatttaagtataaccctagaaaattcaatgccgcggttatcaaatgtacaagccccatcaaagccacggcattattatgggaatccgggaaaatgatatgtctggggacgaaaagtctgatagactgtgaaaatgctattaaaaaatttatagaaataattaagagctcggggtgtccgggggcttcttacaccggacacacggttgaaaatattgtttcgacctttaaattcggacgtgaaattgaactgaacgagtttcgaaaaaatcgtcgtgcattttatgaaccggaaatattttgcggtttaaatttcaagcggggtaaaagcatggcagcgttaattttctggaccggtaaagtcgtaattacgggaactaaaaacaattctgaattgaggaaatgtatcatgatattctcccctatttgaaaattgctcaaaagaatttaatgagacgataaaaaatttttatttattgagacggtcccgaattgatattaaaagaaatttttctatctaaattagtacagaaacatatgtattttgttgaatatttaattaagatatatttttgatggtaattgcataaagtttttttttaataaa

SEQ ID NO: 77659 - DNA, 3292 bp, Heterodera glycines
  Genomic contig location: Contig_ID=SeqID_13740; Location=628..3919; Strand=-
  SCN-specific regions: Sequence locations=22-159,224-225,257-295,317 -378,400-1886,1912-2082,2104-2166,2189-2715,2737-2874,2897-3292
atgttgttgttagtggtggtgctgatgttcatttgtctcttagaggaggtgacaatgttagttcgcaatccgcatctgagacggattgccaaggtcaccggcaggggcagcagcaacaagaatcggttaatttaataaccacctttagggacaaacaactttaaaagtaaataattaaatttttaaattttttataattaattactaaatttttgaaaaaaatggctgaatattttattttattttgaaatggaaaaatgcttctgtgtttggattttacagctttgcaagtttggttttatttaaccatttctataacaaatttctatagcatttccatatattgagtttattattttacgttttgttgctgtttatattctaatttttataagaaattctgcaattctttcttcaatattacaagcgaaaataatttaatgtcgccgcccatcaaaaaaagaaaagcattttccggcgccgtcaattcttctgcaacaattagtgaaaatcagcagcaatcgccgagttcacttgtgaaaacattttttggaagtcgacggcattggtaacactgacgaaacgcaattaaaaattgccaatttaatgggggaggatcaaaagtagtagactttttcattaaaatattaataagttgggtgtcgtccgaaaattaggatggtcatgatgaattgggcgcgtaaactgaaaatttcagctgggtgtgtaacgacatttggatggacattttcccactttttgaccgtcctgaacttggcctcaaattggtactgatttcgccccgtttcgatgcgttggtggacacgcatttcaatgccagcacaacaaaattgataattcgaaaaacaatcaaaattcaaaaaaagtttggtgcggaagaacccaagctttgtgtgcttgccatcaatgccaaatttgcggaaactggcgcggaaggacaaaaaattcgcatgttgactaggaatgccgaattcgtggaattaccttggcccgacagtccgctgcctaacaaaattcgcttttatttactttccattgagtaatttttttcaaatcgcgggttctctcctggacggacgatttgtacctttttccaaaagaattttcgacaaaaacatacataatataaaatcgattctacatccgtttcgaccaattccgaacactgactcaaacaaaaaatcgaaaccccatttttgaacaaaattcagatttatacacaaaccgcaaaaaaatattatagaaatcaagtccggattaggaatttgttgaaacggctgtaattattgggtttcccgaccctgaaaactcctaaaataatttgggccaacaaatcagttccatttcaggtgtatcgaccattcagttatcacttttctccgttccaatcaaaaaatttgggacaatgggaccaaattggttttgaatgtgcgttgttcacacaaaaccggaactgattcccagccgatttgggatatttgggcccgtcaaatttggccaatttttgtaccaaatattcgccgttttcaatttctcaatgctgacaacctggacaatttgcgtcgtctcatctccacaacaattctcaccgatctcaacctgaattcaatgcattctggtaatctgttgcccgatttgatcgctgatgatgggccaaatgcaactgctggccaagcgttgtccaaatggttgcacacgccgagaaaagatggccaaccgaggcgattgcgttgcagaattatgaatacacctaaagattgggtcaacgatttcaaggaggttacaatatttcggggattttttcatgttagccccaaaaactctaaatttggacaatttattttcgttcattttgctatctattttttcaaaaagaaaatgaatcctgcaaataaaacaactttgtggaaaagaaaatattaaattttaatgattcttacgcgtgtttttttgccttgaaaaacaagctaatgccgggatttttgaaatggcattgagtcgtccctgctaattggcgctgtttcggcatgcaatttactaatgggctcgcaaatgtccttattttaagatttttcttattttcaggcttcccctaaactttttaaatttattctgcttaattatatttttttttgctggtttttgatttaaaaaatcctttaaaatggcctttttataaaaaaatgctaccaaaaactctcaattttcaaattttcccgcaggcgtctatcggcactgccggcccccaaaagccttatgttcttaaaaattggttcgaaatcgcaaaacttgagcctttttggtgaaaatctgttgataaaatgaactcaaattttcaaagaaaaattttccacggccctctgtttccaaaaagtttgttttgttttttggaaaaaacgcgtcgcaaaaaattttttgttttcattttgactaaaatttccaaagtgttgatttttgagatgattttcgtcggccaaatgctggttttgaaaattttagacagcctagtttttaattgtctctacaatgtaaagccttttgttcaaaaatctttatttttggggtcaaaatcttttttttaaccgtttaacctcgtttgcccttattttggaaaaaaatactttcaagacttgtttttactcgttaattgtttaggcatttctccatgccacaacttcaaccagttacataattagctttgcactgtttgggtcaatgccaattgaaccattcgaattggtgaacgaacgaacgggggaaaagctgacattgatgagtaaaaaaacaaacaatttttatatttggtggctgaagcgatgcccaattggggaagaggcgacagtttggcagaatgaagaaaatttaaacaatgtttacttttatttaagtgcccactgaatttggtgcggcaacggcattttcttttgttattaaattatgaattaatcgatgtacgaaaaattgcgaatatgtacgaattttcgaaattggtatttctagttcaaaaattgcataaataatctcttattgaaggattgatggttttcaatttgtttccgtgtgtttaaaccaattttgtccaaaactctaatttcgaaaattatgactttcgactttttgttcgaattcgcgcccggggttcgaaattcagaacgatatttgtcaagaattttatttttatactaccatacttaatgctacagaactttaatatagaatatttgtagcactgacgcattttccactaacgattttccggtcacggaataaa

SEQ ID NO: 77660 - DNA, 1103 bp, Heterodera glycines
  Genomic contig location: Contig_ID=SeqID_13741; Location=139..1241; Strand=+
  SCN-specific regions: Sequence locations=1-48,71-435,476-551,576-1103
  Gene Ontology: Mol. function=chromatin binding; Cellular component =nuclear chromosome; Biological process=chromatin modeling
atggtggacagtgactttgaagaggaggaggagtatccgatggataatcaccaccaccaccacaaacaacgggcgtgcatgcagaacaatcaccgtcaccagccaaacaacctaaaaaatggtgacatttccgctgctgtgccgtcctcattctcctcaacaacaacggcaccaccggttggagcaacgagtgcaaacgcctcctcttcttccgtttctcataaacgggcaccgcgtcggctgaacgcggacggcacgccggcggagcgattgaagccgggccgcaaatcggtggacgaattgcgggagaaatttgcgcaaaagttgaccgccgtttggcaggacgtgcacaatttgaaggttggaaatgcttttttagatccatggatgtataatcaaatcgaacatcatactcgcgcagtacttcaaattattgtaaaatttagacattttaaaaattcgccaagctattaaattattctaccaaagcgcaacttatttcttgtatttttcaaaaactaccatgtcattttttcgcacaatttcttaacaacaccaattattattttttatttcacttgatacttcttacaattagcattggcagaccaagaattagttagaatcgtctgaaaaacaggaaaatttgtcctaaatcaaaaaaggagacaattttaagtattcatttgttaccaaggtgttcttttcgtcaacagatattccaaaaatcactgtttttaaatgataataacaacaatttttaagatgggcgaccgtgcgttggccgagccgttcgagtacttgccatgtgacaagacattccccgactactaccgcaccatcaccaagcccatctcgttgatgtgcattcagcgcaaaatcaaggagcagcggtacgcggactcggacgaactgctcgcggacctgcgccagatgtttgccaacgcgcgcatcttcaacaaaccggacgcacaaatctgtgcggatgtgactattttggagtcggtggcggttggctcaatgcgcacccataccgagggggtcacactgttctacccgtacagacgcactgacaagggctggtcggagaaggcgtccattga

SEQ ID NO: 77661 - DNA, 650 bp, Heterodera glycines
  Genomic contig location: Contig_ID=SeqID_13742; Location=1..650; Strand=+
  SCN-specific regions: Sequence locations=1-442,559-650
ctcattgtccacaaatgcggacggcacaaatttgtcgtcagtgccatcaaccaccgctgcaactgcacaacagctggcggcacatcatcaacggcaacaacaacaatctcttccgcaactgcaacaaccgactcacaatcagcaacaacaccacccctcagcaatatgtgcacaacaacagcgctcattggccgccgcttcgtcttccgccgtttatgttgcaccgccgctgccgccgtcctcggtgtgccagacactgaacaacaacaacaacaataatgccattgccagcacaagcggtgccgtttattatgccgctggtggtggctatttggtgccacagcagcagcaacaattcattttacatcaccacaacgtcatgcctatggcacaagcgcaaccgccgcaacaatttgccgctccccattcggttgtccatgttcagcaacagcagaaataccttcatcaacaacaacaacaaccgatggcattagcaacatctgtcaaacacttgcagcagcaacaacagtgccatcaatcgcaacagcagcagcagtatttctcgtcaacttcggcactgatcaacggcggtggcataccgccaaatgcggctttgcagcaagcgctgcacaatgggccaattgctgcag

SEQ ID NO: 77662 - DNA, 563 bp, Heterodera glycines
  Genomic contig location: Contig_ID=SeqID_13743; Location=1..563; Strand=-
  SCN-specific regions: Sequence locations=1-48,73-470,492-563
gctcactttgcagggttatggaaagaattcttagccaaaatatttacaactttctcttaaaaaacaataaaatttcggaataccaatttggttttgttagaaataggtctacgacaagtcaactaataacagttgtggaagattggtacgaggcaattataaatggaaaaaatgttgactgtatttatattgattttcaaaaagcatttgactcagtgccccataatttacttttatacaaattggaaaaaataggtataaggggcaaacttttgatgcggataaagggctttttgagtaataggacttttcgagttaaaattggggattctttatcctcaagtaaaaaagttacctctggcgtcccccagggctctgtcctgggccctttattatttttgatttatattaacgatcttcctgatgctttgccatcaggagtgaaaataaaattatatgctgatgatgttaaattatatatttgatataaagcaagagccgacacggaaattatgcataaatcaaagcataatttattcgaatgggcaaataaatggcaaata

SEQ ID NO: 77663 - DNA, 1232 bp, Heterodera glycines
  Genomic contig location: Contig_ID=SeqID_13743; Location=713..1944; Strand=+
  SCN-specific regions: Sequence locations=1-9,31-632,655-967,1003 -1141,1163-1232
atgacaaaattaataattgatgatcaatatttatttgtcaatattacctgtcaggttgaagtgaacccgggccaaattggcggccccggcgcggcaactgccgtttcaaagtgccaccgtaaaatgctggacaaggtggagattatgcatgtcaagaaattgccaattttggcgaaggcatttgtgcctgaaaatcgcccagggccaggaattgcgcggaccctttaccaagcctggtaaacaaaattcaaaaatgcttttaaaatcgattaaagtcaattagcacattcattagtatggacatactcaacaattaatgccaatgaaaaaaaaagatttctttgatagggtagcgacaaaatttcaaggacagataaacgtgcaaatcaagatacttagaaatatatatattagttcgtcaatttttttgacaggaaaatgttcggcgacccaaacgcaatcattttgtacgtcaatcagcccgacctgttcccggtgtgccacttagagcagctccaatttgtgatgttccaagtggaaaagcttgccaagcaggacggtaaccatgtgctggtccgtcgggcgtcatttattgaactgcgcaaaagatgaacaaatttgggaatgtctaaaattggcatccatgtgccattcgagacaaggtgccatgcgtagtttaaagagtcaacaactttgaaagattgggatcaattattggaattaatctggacctgattttgaattgaacctattttttgtggttttgtgatcggatcaggatcatggaaaaatattttcaggatctttctaaactgtggcccaaacttatttaaaacgaaaaaaaccctgattcgctgattactgatctggggaccgaaaaatccatgtgaaatccgtatgcatgaagattgttttggcgatctccgatgcacacgatccattgttctgctgatccgatccttggatcaattttatttttttcgaaaataaaaaattttttttcgattctttcaaaacccaaaaatcctattaattctaagcctaatttttagacttagccttgacgaggccggcgactattcactgtattttgacggtaccaagcgtgttgcattagttcacatggcctacggttatttgcctgaacattaccctgagaaggactttgacctgcgcgtgatgatggagcgttcaacagctattgtacaaatttaaattcattgaaaatataa

SEQ ID NO: 77664 - DNA, 271 bp, Heterodera glycines
  Genomic contig location: Contig_ID=SeqID_13744; Location=431..701; Strand=+
  SCN-specific regions: Sequence locations=1-151,194-242,269-271
atggttcgcccgttcgagaagccgcaccaagaggaagtgaacagtgagatgggcatctatggctcactgatcggtgatcagagtacgggaaaagtgctggtcaactcggtgaacgggcatttggtgcgaagcaaagtcagaatttgaacacaataaaaaataacttaaattaaattaattttttaatatattagcaaatgcgtgttaattctgcgttgtctttccattagtttaaagttcattagcatttttatacatttttatattgtta

SEQ ID NO: 77665 - DNA, 931 bp, Heterodera glycines
  Genomic contig location: Contig_ID=SeqID_13748; Location=42..972; Strand=-
  SCN-specific regions: Sequence locations=1-211,233-338,362-516,539-931
atgattaatttaatttttccattattcatatatggtataacaatgctttccgaattggccgaccacggtaatttcaaatttatttaaaaaaaacccaaaaaatatattatctaatatcaactcaatattctagaaaatgactttccgacatctcttgatctacgctacactcggcgcggagaacgacgtattccttatccacaaaatcaaggtaaattcttgaatgaaaattttgttgaccaacatagttcggtgccactgtttccgtgccattgcggatgaagaatccttaattttttctcagttgaccaattttataaatttgatttatatcgacaaagaaggccattttaagatatttctaagcatttaaaaacattgtcaaaagttgtaacaaaaaacttcaaaaaaagtttaaaaattttgagttctctggcacgaaacgttggcacgaaattgaaactagaaaaatttaataggaatcaaggccaatagatttgttataagaacctggataagaaatggaatttaacatagtaggtcggattagggtcgagtccgacctgaattctgggtcgggatttggtacgcaaaaaacgatggctctagtgcactttatgagtccaatcgacttttatgagtccaatcaattgaaaatactcggtttttatacaataactttgttcatgttcgagctaaacctatctttttggtatcatttgaaagtacaaagtctaacgaagctaaaatatataaaatcgcagcgtttaggcaattaccaaaaaagatttgattatttaagtaaatacttattattttcgtttgtaactttcttgaaatgttagaattttcttgttttctcgtattattacattatttagacttcgtactttcgaatgataccaaaaagatagggtttgttcgagcataa

SEQ ID NO: 77666 - DNA, 876 bp, Heterodera glycines
  Genomic contig location: Contig_ID=SeqID_2069; Location=100..975; Strand=-
  SCN-specific regions: Sequence locations=1-4,290-475,507-603,625-876
atggggaaaagagaaaagggaaggggaaaagaaaaagaggaaaaggaggaagaggagggaaaattgaaatggaagaaaaagagaggacagagaatatggattagggaggaaaagaggaaagggagaaagaggaaaaaagaggaagagaaggaaagaaaaatggaagaggaaaaggaagagaaaataggaaggaaaagagataagggaagagaaaaaaagaaaagggaagaagaaagatgaaagggaaggggagaaaagaggaaggagaaagggaaagaaaagagaaaagggatgaggaaagatgaaaacggaagaggaaggaaatagaaaaaggaagggtagagaaaagagaaagagttcgagtggggtggtgttgtaatttgtgtaacggagtaggacaaacaatcggcgaaagtgaaagcaaaaggacagtgagaagcgacgacagcccaacagaacaaaagtcgaatggtcgtttaatttaattaattttttgttttttttttgtcgcttttcccttttctccccaattaatcacttcccttctttgtgttacttttggcagcctcataaaaatgcaaataacagctgaagtcactcataagagagaaaacattggcatggcattcgaatttggtggcacattttcgctggggcggggaaggcaaatgcaaaattggtggacaattaattggcgaacgaatgagcggaggagcacaacagaatcgatgaatgatgttttggagttgggggaatgggggaagaaagtcaacggaaggacggagggacaggggaggcaaaacggcaccaatttgacggcattttgtcattgcattggcacgccttccctccccaagtccacgttcgcgcaataaa

SEQ ID NO: 77667 - DNA, 1524 bp, Heterodera glycines
  Genomic contig location: Contig_ID=SeqID_2069; Location=1689..3212; Strand=+
  SCN-specific regions: Sequence locations=1-571,593-596,640-743,799 -838,861-972,1001-1001,1361-1397,1421-1524
  Gene Ontology: Mol. function=clathrin binding; Cellular component =clathrin coat of trans-Golgi network vesicle; Biological process =vesicle-mediated transport
gagctgagaaaatggtataaggtaaggagtaggaggagaaaaatgagcctaataaatttaaatttttgaggactttgtccgcgactgcccaagcggagaattgagactcgacgaagtgagagacagagagatagagagggggggggggcgaagagaggggagggtgggcgtaaaggatcacggaggcggatcaaagtgtttatttatgattttggtggctttagttccaaaatatttatcgtcaatttttccccaacggcgacccgtcaaaatttgccgcctttgtgttcaatgtgttcgacgacaatcgggtggaattgcgaagggatcaatatcattcagttaatttgaattctgttcaggacgggcacatcagtttcaaagagttcatcgcggcactttcgatcacttcgcggggaacgctcgacgagaaattggactgtcagtggggggggggggggggacgaattgaaactcgaattcgattaatcgcctttttcttattttcaggggcattttcactgtacgacgtggacaaagatgggttcatcaccaaagcagaaatggccaatgtcagaacaaaaaagcaattgaccaatattatttaaattatttgagtaattttaatgaataaattttgcacagattgtggacgcaatttactcaatgattggcaatatgttggaattgccaaaggacgaagacacaccacagaaaaggtgaatgaaaatggaaaacagtgcaaaaataaaaaattaaattaaaaatataaataaaataaaaaatataaaaataaaattcagagtggagaaaatctttgccaacatggatttggtgagaaaatgaaaataaattaattctccaatcagatgagggtttaatttgtttttttcattctcagaattttgacggcaaattgacacgggaagaattcaaacagggatcaaagaatgacccatggatagtgcaggtaaaaaagaaggggggagagaaagggggaaagagagagagagggggagagagagagagagaaaagagagaaagggagagagagagggggagagagagagaggggcagagagggggagagagagagagggagcgggagtgagaaagggagagggaaagagaggaggagagagagagaggggcagagagtgagagagggggagagagagaaagcgggaaagagagagaaagggagagagagatggggagtgaaagagaaagagggggagaaagagaaaagagagagagagagagaaaagagagagagagagagaaaagagagaaagggagagagagaaaagagagaaagggagagagagatggggagagaaaggtggaaagaaagagagaggcgggagaggacggaacttaccctgggaggggcagaatggagaaggggaggggagaagggcgcttaaaacttataaaggcttataattgaaaattctccaggcactgacaatggaaatgaatggcgccgccggcgaagagcaaacgcctcaaaaagccgcgtga

SEQ ID NO: 77668 - DNA, 154 bp, Heterodera glycines
  Genomic contig location: Contig_ID=SeqID_2071; Location=1114..1267; Strand=-
  SCN-specific regions: Sequence locations=1-68,97-120
gatttcaacgtggtacaaaagatcaaccaagtgcccgtctatgaaaaggtatttcctaattgtaagcgaattttaatttaaaatttattatttttagagtgggagaccccgagaagagatttcaatcatttccatttctctgaagagtgtttag

SEQ ID NO: 77669 - DNA, 2437 bp, Heterodera glycines
  Genomic contig location: Contig_ID=SeqID_2072; Location=629..3065; Strand=-
  SCN-specific regions: Sequence locations=1-81,106-512,537-749,772 -1140,1162-1800,1822-1909,1931-2255,2277-2371,2396-2437
  Gene Ontology: Biological process=protein folding
atggctgtcgatgctccgaatgatcaacaaaaaagtgagccatcatctgagtcaattcccaaaaatgttagttttctttactttttattgtaaatttaaaaaatttacaggaattccgacgacccgcggacccaaatattaaggaaaatggaggacgagcgaagaaggcgagggttgagcagcaaaaaagtcaaattggggagccaaacattcaccaaaccaacacaatcccccggtttcagctctgaaacacgaggaagtgtatttgcgtgccatcccgcggtcggaccaatacgaaaagtcatttatgcacagaaatgtgataactcacgtcaaatgcacggagtgggctgtgttttatgggacattcgaagttataaattgaattaaaattaagaaacgattttatcatcacggccagtgaggacggacatttgaaattttggaagaaaaagcacaacgaaggcatcgaatttgtgaagcactttcgttgccatttgagtgggcaaccgttttttttttttttattattatttgtttgttttttagaaggattttcggacattgcaattaatcacagcggaacactgatggccacttgctgtgcccatgacaaatcggccaaagtgttcgacgtggccaacttcgacatgatcgtacgctgttaaaatgacgaattgtttgcaacatttcttctttttctccctctactcagaatatgttcaaattggacttcagtccgcgctgcgtttgctttgtccaccagggctccgatttgatcagcgccttggccatttccgatgcgaattcaggcaaaatttacattttggacgcaaacggagacaaacagccgatccatgttttcgaatcactccaccaacacccggtcattctcatgcaggtaaactgaccgctgaaacgaccagactattacaatacataaattgacattttgttgcatttcactcgctcacaaagggcggaaattttatatttttcaaaaaaaaagcattttaccatttaattacagtacacagcggcatttgatgtagcaatttcctttggtgagtttagaaagcaaattttttgaatttgtccaattttacagacgaaattggaatggttgaatattggtcaggcagcagaaatgagttttcatttcccaagacggtcaatttcgaatttaaaacggacacggatttatacgaattttgcaaggtttcgtttgctgtgatgtcattcatttaacccatttgatttgacagataaaacaaatgcccaaagcattggccatcagtccggacggacggacattcgccgtttggtgttccaattcgtacatttacatttttgacttgagaagcggcaaaataatcaaaaaactcgacgaaactcttcaacgatacatcgaaatgggaaaggagactaagtgaattaagcaaaaaaagttcattgaattggactgaatggttaaggggcaacggactgccggcgatcgaatggaatcgccgtgttgcgctcgaaaaggaaatgagccgtgacccgaacgcactgcgattcatcagcatcacttacgacgcctccagcaactttctcatcttcccaactccgctcggcataaccgtaaaccgtcgcggaattgccaattattttggcacattctaattttggcaggtgtacaatttggtcagcgaccaagtggcaaggcgtattggggcgggagagaatctgcgctttgttggcgttgcgttgtgtcgcgctgttcccggcgtaacggtgccattcatttccttttgaccatttaaaatagatttttctaatggaattgcacaggaaaaactgcaaggtgcagcaacaagtgtgaaggttgaggcggcggacaatccgaaccttcgcatcaacgaacccgacccaatgctggtgcttatttatttgcccaacccaccaacgaatacattctctaaattaaacatttttcaggtgacttgtgcgcatcgtaagtttttactgtcacaaattcaataaaatgcaaaaatgaacttcaaaagtccaccaaattgtgtcccctccccatactgaagtgtccgaactcagctgtcctcgggcatgcccacccgtccctctccttataagtaatacatttgtacaatttcccttcccccaggcaacaatcgtttttatttgtttaccaatgtcgaaccgtacgcggaagaagcggatggtgtgttttgttatgcaaaaacagtcattaaaaatcgtttttgtctttttaagggtccactcatagcagagacgtgtacaacgaaaagccgctaaaggaggacatgatcaccgcaatagaagtgagttagggagacgagccaattgtgggaaataatttaatttatttttattactgcaggaagaagcaccccaatcgaagctgtgcaacaagtaa

SEQ ID NO: 77670 - DNA, 635 bp, Heterodera glycines
  Genomic contig location: Contig_ID=SeqID_2072; Location=3221..3855; Strand=-
  SCN-specific regions: Sequence locations=1-373,401-408,438-635
atgtcaaattctttaattgaatcgctcgttagagccgctgggtttttgatttatcgtaagaatacggctggacaaattgagtaccttttgcttcaagtgtcttatgagcctttccattggacgcctcccaaaggtaattttgatgctaatctcgagaaaagacctatcattgttattcaaaatgtaaagctatcgcttgggccgattttagggcatgtcgaccccggggaggacgaatggacggcagcaatcagagaaacgatggaggaggccgggattgacgtgaacaaattgcgaatccacaaggaatttatgtacgaaatgcgctatttgtcaaaatccaccaaatacggggaggaacagaagaaagttggacatttaaaaaattaacttttgaaaattcaacacattttggaaaagaatttttctcatttgaattggtttcataaaattgttctgtttaggtcacttattggcttgccgaatccacagacccggaagtgaaagttatgttgtccgatgagcatcaaaattggaaatgggccgagcttaaaagtgcgcttgaattggccaaatttgatgagatgaagaaacttctgaacaaagctgagatgtttattgccgagaatctgtaa

SEQ ID NO: 77671 - DNA, 318 bp, Heterodera glycines
  Genomic contig location: Contig_ID=SeqID_2072; Location=4874..5191; Strand=-
  SCN-specific regions: Sequence locations=1-257,279-318
ggattctgcgtggcgctggagggaagccgtttcaaaggcaccgaaatgctcagagatttcgtgacggacgaagcgacgagcgaaaaataccaaagaattgcggacgaacagccaatggccagcgcattttacgaagtgatgttttcttcgctgaatgaaagcggcgaggcggaaaatgtcactttaattgcgattgacgaggaggagggaatggggacgacgccaaacggaaatcggacaaaaaaaagggaggagcaaaacgaaggaaaggaaatggaacgaacagcagaaaacggaacagtgccaacaaataattaa

SEQ ID NO: 77672 - DNA, 1236 bp, Heterodera glycines
  Genomic contig location: Contig_ID=SeqID_13750; Location=240..1475; Strand=+
  SCN-specific regions: Sequence locations=1-217,241-333,492-856,880 -1180,1205-1236
  Gene Ontology: Mol. function=ATP-binding cassette (ABC) transporter activity; Cellular component=integral to membrane; Biological process=programmed cell death
gttttcgttttgcttggccacaacggcgcgggcaagtccaccacttttgctgtgctcaccggctccgtgcgcgcctcgggcggcgatgttctgatctgcgggcaacagttggagcacaatttgcgcgactgtcagcgtcgcattggcttctgtccccagtacaatccgttgttcgacaaattgacagtgcgcgagcatttgctgttttacggacgaatgaaactgagccaaggggagggcgcggaagaattgagacggcaattggacgtcgaagttgccgaattggtcgcagaagttggcattgcggcgcaattggacacggcaagttgacgcgagagggagcggggaaagtggggaggggcgtgcgagaagtgagaaggggtggagagaaaagggcgggcgggggaagacgggagacagacgcgagagaaagtggggaggagaagagggcggcagaacgtgtagagcaagggcggaaggacgggagggagttaattctgctgctaaaaattcgtccataattttttcagttggctaaaaatttgagcggtggacagaagcgcaaattgtgtcttgcgatggctttggtgggccgaagtccggtcgttttgctggacgaacccaccgcagggatggacccgggggcgcggaacgaggccggcaaagtgttggagaggataaagcgcgatcggtgattatttttttgggcgtgagagaaatagccggggaatggctaactcgccccttgctatcactctctgccaaactacaacccgtttcattcgttgatcactaccatccgccgtttgagtacgattcgcttggccacccaaacgctttccatttcagtaccattctgttgaccacccattacatggaggaggccaacacgttgggcgatcgcattggcattatggtccaaggccgcatggtgtgcaacgggtcgcccgagtttctgaagcagcgctttggcgtcggctacgttttgtccgtcgttgtccgtgcgggtgccgactttccccgcgcagtcggcaaagtgttcgacgcaattaccaaacattcgcccggcgcaaaacttgaacagaaccaaaaaccacccgagttttccatcgtcctcccgctgggcgacaagcgaaagttcggcgacattttcgcggagttggagcagtgcacggacgaatttggagttgactcattcggagtgtcttcaaacacgctggagcaagtgttcctcaa

SEQ ID NO: 77673 - DNA, 1276 bp, Heterodera glycines
  misc_feature (224)..(224): n is a, c, g, or t
  Genomic contig location: Contig_ID=SeqID_13751; Location=595..1870; Strand=+
  SCN-specific regions: Sequence locations=1-137,198-375,399-648,678 -820,842-907,929-1194,1216-1276
atgctgaaggatctgttcaaagatgtgatgggcaacatgggcgccgcaatgtccgtgatcaccgccttctccataatgactgccacaatggtgatgccgttggtggaggagcgaggaagccgcttcaaacaccaggtgagggacgggcggaggacgaacggacggggaatgggcggacaattcggcggatggacggaaacttattggaaaagaatgaaagttgngagaccggtgatcaatacgtcattcctatcgaatgtctgatcaaatttaaacaagacaatcttgctcaaattgccaaatgccattgtccataatatttgccttggcaaatgccattcttccgatcgctttgatcactttctattttcctattttcttcctcttttcttccttaatcttccctaatctccccccccctccctctgctgcagttgttgctgacccatctccacccctttgtctattgggcttccgttctgttgtggaacttcgttctgtacgccgtgttctgttccgtcatcggtgtctctctgttcttcttcaattggatgcgtccctttctcggctccatcgttctcctttggcttctttacttttgggccaccgttccaatggtcggctgcgcgtctttcctttttgaaaaggtataaatattatttatttattttttatttcaatttgatttcttcactttttgctccaggcgacgaaggcattcagtgcgcttatgtgttggtttatggtcggctccatgctttccaccattggcaccgctcttttgaaactgaatgccggtgccatcggcgaacgtaccgcccttctgctgaacatgctgcttggcattgtgttgcccaccaaagcgttaagcggcggcattctcaacctggcactgattgccacttatcagcaactgattggccaacatttcgacgacgggtccgacaacagtttcttcggcactgccgggcccatcggcgagctgtggaaggaattccgacgggaactgttcgccatgggcatcgccgggctcatcttctgggttctgttggcactgctccaatcgcgccgcgtcgcctgggcatggcacaaaatgagcaacaacatcgccgtgagggacaatgcttttggagtcccttctcctgataatgcgacagcattcagatggtcatctacggcaatcggtcgctgtctgaggaggacgaagacgaagacgtacgggaagagcgggacagaatgttacgggagaccaacgagagccacgcccttgccgtga

SEQ ID NO: 77674 - DNA, 2225 bp, Heterodera glycines
  misc_feature (2106)..(2106): n is a, c, g, or t
  misc_feature (2180)..(2180): n is a, c, g, or t
  Genomic contig location: Contig_ID=SeqID_13752; Location=902..3126; Strand=+
  SCN-specific regions: Sequence locations=1-102,126-912,951-1162,1184 -1291,1314-1375,1397-1408,1430-1491,1514-1772,1794-1822,1910-2225
atgatgcttgaccagaatattattcgtgagtcggaatccgagttcgcttctcctattgtgatggtcccgaaagcggacaaaaaatcatggagatttgcggttgattacagggcgttgaataaaatgaccaaaaagagagtttttcatcttccgaatattcaagagcttttggatttaatgggagccaaaaaatattacacatgcatggacatgcagcaagggtttatgcaaatccccatggcaaaggaggacattgaaaagacagcttttatttctcatttgggcatttatgaatttatcacgatgccttttggtttaacggcagcaccggacacatttcagagggtaatgaaatgagactaattacccatcgattgagcgagaagctttggcattagtctattcagtgaaagaattttcaccttatattgttggatcaggaataagtaagatcatcacagattgtatgggaaatcgtgagaactgagattgtgaaagcacaagaaagaaacaaagagggaaatgatgccataagaagggccacagaaagagagttcgaaattggggatttagttttggttaaaaaggaagtgatgaaacataaatttgatcaaaggtggggtggaccattaagatgtgttggaattgaggcagaaagaaaaaatttgattttacagtcattagatggaaaaggaaaatataaaaaagtacatcaagaaaaagtgaagaaattccatggtccagcaactttgcctttgagagaggcggatgagccgataaattgggaaaaatatgtgcatgatccaaatttggaacaggaggaggcagaagaaagtgaagaagaaggctttgagattgtcttgagtaaagagaaagaaatgagcggggaaatgattggcaaaagcaaaaaattttcaaaatttggttttgaaagcagtgaagaggaggagaatggtaatactattgcttttgttcaaaatcaggaagaaataagtgacgatgagggtcccgaaattttctttgaaaacagaaattttgtgttcgaaaatgacgagacaccaactttgttggcagttatgttgaacggtaaaatggttacggtgtgtacagggtggttaaatcccaccataattccccttacttcatcggtccctgagaaccaagtggaagaaaattgggaaatttatagtaatgaagacggtgagagatatgtgacgtgttggatttttggagagagttttgaaatgtacattagcagtattacggacaaaattgttttgggcatggatgtccaatttctttttgcagaaaaatggtcattaaaaacggaaaatgaacgggaatcatattgggaaataatttcgggaataaatggagtaatgtatgaaataaaccagattccagaaattttcataagtgaaaaagaaaattatgacgaccaaaacgagttcagaatgagtataaatgtcataagaagtgaaaaaaatgaagaaatgggacaatttatgaaaaataaggagcgaaataagcagcttttaggcctaatcgagaacatgaacaagaaaggcagattaaacgagcccaaagaaaagaacgggaaaatttacgaaagccattcatttttcaagatggaattgttatcgaaagaggaggaagaatctctgaagaggttgaagagaaagctcgaacatcaacttctgaaggtccagcaaagtctgaccgaaagcgaaaaatggaaatccggaacgtcggacgatgatccagtgggaccacaggagcgagaagaaaatgaggaagaaacgacgaaaaagggcaaaggaatggagaaaaaagaggaggaggagaagaaaggaagagaggaaaaagaaaaagagacggaaaagaagaaggaagagatgaagcagaaggacgagacggaaaccaaacgaagcctcagcgtcggaacaacgaaagacgatgaaatctcgattgtggattctgaagaaaaagaaagagatgccttcgaaaacccgccgaagccgacaaacgagcgaatggcattttgggagtcgactttgaacaatgaggcaaaaaaggatttgcgagaggacaaagagaaagccttanaaaacacaggccaaggtattgtcgtaagctccagaaaacgaacgataaacgaagtcgacccgccaactctgtcnaatgaagccgccacgaaattcggggaaaaatgcggcaagcattga

SEQ ID NO: 77675 - DNA, 1435 bp, Heterodera glycines
  Genomic contig location: Contig_ID=SeqID_13754; Location=224..1658; Strand=-
  SCN-specific regions: Sequence locations=1-245,284-530,552-659,683 -740,762-1113,1139-1281,1304-1337,1366-1435
atgctcaaaacttttgcagcccggaaagtttatgcaccttataattatggaagtgttgattttgaactacgggctcaagaaagttcaactgtggcgttaattgaagcgcttccaaaagcgaaaccgagcaatgaagaaaaagccttttttacatttttgagccacaagttttccttcgccggtgatttcagcccaataccaatttaaaaaattcggaaaggagaaaattttgtgtaattaaagccatttaaaataatattaaaaaattaaataatattaatatgttagtgcattgttattttttggttatttcagaaaaaaccaaaacaaaaataactgcatggaatattggcggattttttgaattttttattgagtggcaaagaagtatgaaaagcattaaaaagccattaaaaatttttttagggatgcactattaaacttcaaaatgtcaaagttaaagaaggccttggaaaagacgagattgtgttcgtttttgtgaacacaagcaagattgtttgttttttatgaaaaaccttttaaaaaactttatttagtagggatggatattttggcaaaatcctaaattttttacgtacttaatatgcacagttaaacacgaaaaacaggtttacactttgcttaggatgtctacaatgatttttaatattttttattattacttttgttttgtatttaatacctaggaacgtattttttggattttttgaaaaaaacaccaacaaaaaactattagtaattggaaacatttctcaaaaatttctacaaaatttttttgttgatagaaattttgattgagtgatttttttgtaatttaaagtagcaatttcgcgatttttatgcctgaaatttccatccttactaatagtaaattgatttaataattttaaaacacaaggttgtatccgtttatgcgtggcacgaaagccgacagcatacaatcttacaaaaagattggatggaacaatttgtaccgatggtatcaacaaaacccaatttgtttttcccaattcgatcaaatttgaagtgggcgatgaatttacagcgaatgcagtgaatgcggacactaatgagggtttgaaaaaggctatgttaataatatttttattaaaaaaatgcatgcgtgaatttaaataaatcccttttaatttctttgcagctggagttttgacattgacttcttatgacgagtctgcactggtccgacacaacgataaaacaattacttatgaattaacagaaattgaatatccataatatattcacatcctttaaaataattcgtgttaaaatgaattatcaacagagttttcgtcaaaaaataattttattttgttttaaaaactctgttaaattttttaatttgtgtttttttaacgcttgaaattatggaaatatttttgtttgaaataaa

SEQ ID NO: 77676 - DNA, 371 bp, Heterodera glycines
  Genomic contig location: Contig_ID=SeqID_13756; Location=1114..1484; Strand=-
  SCN-specific regions: Sequence locations=1-21,45-334,365-371
atgcaacaacaaaaatgcaaaaaacccaaatatttaatattcatggtaaataaagtgatccgcggatcaggtcgatttagaggaaaggaaaatagcgttggatttgatgagaactactgaggaaaagaaaaggaatacaatccacggatcgagatccatggatcacccaatccgatctttatgcatacggattttgatccacggatttttcgatcctcgaatcagtgattcgtggatcacgatccggggatccgatcctgatctttatgcatacgggtactgaagtttccattgcattattttattatttgtttatcatcataatcgctacttgttttttaattatattaatttatgattttttcaataaa

SEQ ID NO: 77677 - DNA, 1220 bp, Heterodera glycines
  Genomic contig location: Contig_ID=SeqID_13756; Location=1635..2854; Strand=+
  SCN-specific regions: Sequence locations=1-500,524-789,811-1048,1070 -1145,1168-1220
atggcggcgcgattcaatgaagccatggtggctcgcttgatcgaacttgttcaatcgcgtcaagatgatttgaaccctccaactcgaactgcaaaagcaaacgaaaagcaaaaagaggcgtggaaatttgtcactgattctatgaatcgtgagtttcctcaggaagtgccccagggcggcttaacgattgcacaaatccaaacaaaattcaaaaatctaaaacaaagggccaaggacgaacgacaaaccgaaaaaaagttaatcatatgtgcgcctgtgctgggtttcagcattttctttaggcatcagcgtgccacaggcggtggaaagaaattcgaaatgactgaagtttcgcgcaatgttcaagatgatttgaaccctccaactcgaactgcaaaagcaaacgaaaagcaaaaagaggcgtggaaatttgtcactgattctatgaatcgtgagtttcctcaggaagtgccccagggcggcttaacgattgcacaaatccaaacaaaattcaaaaatctaaaacaaagggccaaggacgaacgacaaaccgaaaaaaagttaatcatatgtgcgcctgtgctgggtttcagcattttctttaggcatcagcgtgccacaggcggtggaaagaaattcgaaatgactgaagtttcgcgcaatgtttcccaattgtttgctgattcaccggcatttgagggtagatatgtgttcgagctaatgtgtaagtagatgtttgttaaaggagtgcccggcggcgtacagaccggtctcaacatcggcgacaccattttctttgaaggcaaagaacaagaggaaagtgccgaattttcctcacagcaagttgttgttgaagaaggaaagtcctatgccgttcttggcactgtgccacgcggagaggcggtgaaaactccaaaatttgaatcaagcacctctcgcgtgccattccgatctcgtgccggaactgcttcaactgttacagctgctgatgtaatggaactgcagcggagtgttctcgagatgcaatttgaagaaatgacaaaaaaacaagaaatttttaaaaaatttgaggatgttcttgacgatgctaagacattttttactgagggtcgcgaattttttcgtggaaagcattcaaatgagaaagaaacttaaataatgctacattcatttattaattggtgcgttttagcactttgtatttttttcagtttatttta

SEQ ID NO: 77678 - DNA, 1119 bp, Heterodera glycines
  Genomic contig location: Contig_ID=SeqID_13759; Location=413..1531; Strand=-
  SCN-specific regions: Sequence locations=1-193,384-385,408-464,493 -501,523-537,649-704,733-741,763-777,889-944,973-981,1003-1119
  Gene Ontology: Biological process=protein biosynthesis
atgagaatggagataaaagtagaatgtgttagggaagagagtatctcattggaaagagaagaagagatacgaattgcaattaatgtgcaacaaaaagactcaaatgggcaagtgacagctgtattagaggtaattagcaaataaaaaggaggtattagtgaagaaataattagcaaagcaattagaaatgtttgaagaaatagcagaagaagaaacagcgagagaaagaaaaaggcagaagagataaacgaaaaagccgaagcaggaagagaaagctgcggaagtgccgaagtgaatgaagaaaaggagcgaaaggaagcagaagcaaatgggaagagagatgccgaagaaaaggccaaaaaagaggcagaagcaaagaaaaaggaggaagaaatgaagaaacaaaaggcaaagcccgaggaaaagcccgcggcacctgcagaagccaaagcactagtgccggaacagaagaaggcagaagagacaaaggaaaagctgaagcaggaagagaaagctgcggaagtgccgacctcacctgaagaaaagaagagaaaggaagcagaagcaaaagcgaagagagatgccgaagaaaaggccaaaaaagaggcagaagcaaagaaaaaggaggaagaaatgaagaaacaaaaggcaaagcccgaggaaaagcccgcggcacctgcagaagccaaagcactagtgccggaacagaagaaggcagaagagacaaaggaaaagctgaagcaggaagagaaagctgcggaagtgccgacctcacctgaagaaaagaagagaaaggaagcagaagcaaaagcgaagagagatgccgaagaaaaggccaaaaaagaggcagaagcaaagaaaaaggaggaagaaatgaagaaacaaaaggcaaagcccgaggaaaagcccgcggcacctgcagaagccaaagcactagtgccggaacagaagaaggcagaagagacaaaggaaaagctgaagcaggaagagaaagctgcggaagtgccgacctcacctgaagaaaagaagcgaaaggaagcagaagcaaaagcgaagagagatgccgaagaaaaggcccaaaaaagaggcagaagcaaagaaaaaggaggaaagaaatga

SEQ ID NO: 77679 - DNA, 826 bp, Heterodera glycines
  Genomic contig location: Contig_ID=SeqID_13760; Location=341..1166; Strand=-
  SCN-specific regions: Sequence locations=1-94,116-125,178-468,494 -591,614-642,768-826
atgccaaatttagccgaattccaatggatggttaataatttcgaagtgaaagatggcaaaaacgtcgagatcaaacagatggtcgagaatcatgaacaaataacattcaaaaagccaatcgaaggaagaggtgaagggaaagagaagccaacagaaattaaatggaaggacaaattcagtggaagtgcacgcggtgaacaaattgggcaaggacagccaagggacgaaagtgatcgttgactatgaggacggagttgtggaggaacagcagcagaaggacaccaaaacggggaagggcaaagaaatggtggaggagggtacggtagaaagtgggaacagtatgatggaggacacggtagaaggggaagacggtagaataaaggatacggtagaaagagaggacggtaagataaaggatacggtaatagtaaaagaagcggagaaaggcacagaaaaagcaagtgaagcggaggaaaagcaacagcaaaaggcagacttgatcagcatagagaaggaagaaggtgaaaatgtgccatgaaattttggaggtaaaatttgtttttcagaaagatacgcagtgttagtgaaagtggcggagagtgtggcagagcaaatgatgctaaaaataattgtaaatgccatggaagaagcagcggaggaattaaaatgggaggaggaggagcaattgaggaggggaaaggaggaggaggaagagcagctggaaatggaagtgcgactgggaagggatgaggaacagaaggaagaagtccaagcaaaggttgaggtaatttgggacacgggacaacagaacgagttattacagtaa

SEQ ID NO: 77680 - DNA, 2021 bp, Heterodera glycines
  Genomic contig location: Contig_ID=SeqID_13761; Location=726..2746; Strand=-
  SCN-specific regions: Sequence locations=1-40,62-131,153-181,210 -752,774-817,839-931,954-1271,1306-1886,1908-1923,1945-2021
atgaatttgctcttcaaatttttcatcattttcgtgatattgcactgcgaatgtgaaacattgggaagctgtgctcctggcggcggtatcaatatcaattttttgtccaaacttcgaaaaaagccaatcgcttcatcaacaggtaaatttgtaaattaaagaagagaatttttaactccgcaaaatttcaaaaaattatttaaaaaaatcggaaccaaagacctggatttcctggaaaaaaatccaggaaaatccaggtccatgaaaaatcttggttgccgaaaaatggcctgggcctggatccaggaaaaacccaggctcctaaaggcctggatcaggcctggacatgggccaatgccagatctcgcacgatcccgttgaaaaggacaacataatccctcaaaacctcacgaaaattggtcgaaatttcgagaatggccatataaatgggccaatattttagagacttcagcggataataggccaactatttctgccgctgagtttgatcagcgattgaaaaagattgagcaaatgcttggcccacttttgaaattcgaaaatgccgaccaagtcttggcacagctcgagaaacgcattgaaagccttgcgaagcgcatggaagcacttgaaaccaaaatcactgcttggaatgtgacttttgagatcaaagagaagcagatgatggaacaacagcgaaaacaattgcacgaagaaggattatctgttggtgagagtttttttatcggcacatttgctcgacattggcacatcggaatggtcacatctgaaccaattagtagggatgcgttttttaggcaattgcctaaaatttctgcgcatttgatacgcacagataagcacgtcacgaaaaactttgttaacaaattgcaaaaaatttaaaagtgaacggatttactctcccaattactaattgtttaaattattattttgacatatacaaaaaatataaccgaaaattgagttgataaaatattgttcgattctcagttaaacatctccgggcagtaacggaatatttaaaatggaataagaatgaacggagaacattttccgaaaaaatttggcgttgtaattttgcagttatcaaatttttcgaaacttcttcggcaaaaggatgagacccgatcaaagcaataattaacatgatgtgatctgatcatggaaccattttcctggtctgataatattttattgtcagtaacacataattctcctatttaactgtctgacaaatggcttgggtaatgaattatatacataattaattaattaattttttttcctttaattagcagttgcatcctcacaaggccggcaatcaacagcaacagcagctgatcaccactctcataaattagtgctgaacaaaaacagcatcgttccacagacagcaacaaccacggtagttgggcagcagtatgggaacggcaaaatgccaatttatggcatggcatcggcacaaatgggacgccgaaacacagtggcccatcctggacaacgtcatccgccccatcaaagaggtgggataatagtgcgatttaagtattggaaaagcttttatggactttgaaatcgagggaataataattggattgaaattatgtagctatttggcatgtcgattattcaatcagatgctcttaacatgccatcgcaacattcgattattcaatcagatgctcttaacacgccatcgcaacatttgccaaccgtggagaaaaatgatcaacggcttgaaagtcaaagatccgggccatcaaatcttgaggaacatactgaagacatggacaagctttggattgtctcatcagacgaagagaaacactgaacggaccaaatgagaaaatattggcactgataaatttgaattatctttaaaatgggtttttttaatagttttaatgatgaatagtcaaatgtatttaatatatggataaaaatgcataaacatggataaaaaaattacaaaatatgaaaacaaatgtaaaaataataaa

SEQ ID NO: 77681 - DNA, 274 bp, Heterodera glycines
  Genomic contig location: Contig_ID=SeqID_13763; Location=82..355; Strand=-
  SCN-specific regions: Sequence locations=1-10,32-93,116-274
atggcaccacagctgactgaagctgatggtcacaacgacgcgatcccgtgggcactcattcaatttcgcctgagaaaattcgggagtgagccgaaaatttatttaaaaaattgttggagtgtttgcactgggtttcgagcattttctatactcgataccaaaaaatggcttttccaacgatatttttaacgaaaaccctaaaatttttcgtaaatggatgtacgtctaccgatgtaataggcctaattccacgaagccgctcgatcgaaactga

SEQ ID NO: 77682 - DNA, 1034 bp, Heterodera glycines
  Genomic contig location: Contig_ID=SeqID_13763; Location=840..1873; Strand=-
  SCN-specific regions: Sequence locations=1-128,151-152,175-248,270 -478,500-1013
atgcagaatttttttctcaatcgatatgcaaaatttggtgtggatttaacaaacagaaaaaaagttaaacaggatgaagtaaatgttgttctttacattattaagaatgaagagatagtacgtaaaagtgagagaaataaagataaaaagtaaatgtgacagaacgccaattttttcccataattatccataaaaagatttattgtcgcttttttttcttttttaccgtccatggccaggtttccatataaaaatttttcaattttcaagaacttcgaaatttttgagcacaagggttgttaaattcgggccagcaggacgttttcgcgtggccgttttcgcgtggttgtatataaaagagaagtgcaaaagcaactctaagcacacttattgatgtcaacagaaattcaactaatataagaaaaaaaatttacaaaagcctaaacttaggcctagtctaacaataagccattgttcgagttgcctgtgtataagttgtcatgataaccttaggtttaacaacgaaatttatagttaaaaactttactgaatacctgacaaaaaaagtttttctcttagttattaggacaactataataccatgagaccagggatggcacggaattccgatttccgaaaatttttggggtctcggaatgccatccgtgccatggacacaaaatgtcatgggacgcgtaaactgttgttgggacgcgtaaaatgtcatgggacgcgtaaaaccgactagaaccttttttaccctagaaaaaatgctttttgaaattttactattttttccgtcgggaccacaattccacaccattgccctagaatgggtgtcagtcaatcagaccctgaagacccaggaaaggcgtttgattttctaaaaaatttatttttttcagaaaataggagggacatgcagaggtattacccgcctgcctcaaatttaaaaaaatcaaatcactgtcaaactcctcacacgccaaggaataagattttcctaattactccaagcaattcataaaattaaa

SEQ ID NO: 77683 - DNA, 108 bp, Heterodera glycines
  Genomic contig location: Contig_ID=SeqID_13764; Location=1..108; Strand=-
  SCN-specific regions: Sequence locations=1-108
cttaagactcccttaagagagacccttctcttctcatgtacctttaactaaaatgttgttggcacaaaaagtaaagggggaaaaagaatacaaatcatccgatcaagg

SEQ ID NO: 77684 - DNA, 387 bp, Heterodera glycines
  Genomic contig location: Contig_ID=SeqID_13766; Location=167..553; Strand=+
  SCN-specific regions: Sequence locations=1-387
atgccatttccacccatttttgccttgcgcagggcgccggacttttcgacagtggatttttcgacagaggacttttcgacagaagttcttttcgacagcaaaggacatttcgacagaaatattataaaaatgggcgccggacttttcgacagtggatttttcgacagaggacttttcgacagaaggacttttcgacagcaaaggacatttcgacagaaatattataaaattcaggaggggacttttcgacagtagatttttcgacagtaaaaagtaattaaatttcacatttagttgtgtaaaagcgtaaaattttttccaaaaatcaacaattaagccaaatcagtattgagatacataatatttaaactcttaattaacaaaaaa

SEQ ID NO: 77685 - DNA, 369 bp, Heterodera glycines
  Genomic contig location: Contig_ID=SeqID_13766; Location=661..1029; Strand=+
  SCN-specific regions: Sequence locations=1-50,72-151,173-369
attacatttttattcataaattttgagcaaaaacaaaaaaggtcaaaataggttttgttaaacttcttagggttcaaagaaaataaaaacgataaaataagtgctaataactcgaagagttgcttaacaatcaccaaaaaacatattttccatgctttagggccactggaagttcagaaaaaataagtaaaatctaaaaaacttatttctatgtagtaatattatttagcaatacacattaatatgttaattaaaaagaaatttagtaaaactgacaaacaataacttgtttttatgattactgtcgaaaagtccattattttttatttttctgtcgaaaaatccttcactgtcgaaatgtcctttgct

SEQ ID NO: 77686 - DNA, 371 bp, Heterodera glycines
  Genomic contig location: Contig_ID=SeqID_13767; Location=130..500; Strand=-
  SCN-specific regions: Sequence locations=1-331,353-371
atgactgaagtggtcacttctccgaacatagaaaaggaagctgtttctccatggcgaaggtgtgttcaaggggaatttgttttcgcatttccttttaggtttgctccttcagagaggacaatgaaaggagttgtgatcggagggattacgggaggcatcgaaatttgcatcacttaccccactgagtacgtcaaaacgcaacttcagttggatgaaaggtcggcaactccaaaatttaaggtgatgattaatgactaattgttctttttgaagttttgtccattccttttccagggccccgccgattgtgtcaaacaaacgtaccgaagtcacggactttccggcttttaccgcggactgtccgttctgct

SEQ ID NO: 77687 - DNA, 445 bp, Heterodera glycines
  misc_feature (411)..(411): n is a, c, g, or t
  Genomic contig location: Contig_ID=SeqID_13767; Location=1136..1580; Strand=+
  SCN-specific regions: Sequence locations=1-258,281-445
cttgctaataattccaacaattgcttgtattttgagactgccgcggatccgtcgtcattgaattcttcgaattccgctgccgttgaatcaatggattcggagggtgtttatctttttgctgaccgtacccaatcctccaactcgctcacccccgaacaggccttcgtccacatggtcaaggcaatgcttggcaccggacttctctctctcccttatgcgttttcccattctggtctttatgtgagccatttctccacactttaatcatttgcctcttttcagcttggtttaatccttttggtcttaatttgtcttgtttgtatgttttgcatgcggcaaattgtttttgcggcccattacatttgtacaaagttagtcttttttaaatacattcttgattaatgttttctncatttacaggaatggtcgtgagattattgactat

SEQ ID NO: 77688 - DNA, 2264 bp, Heterodera glycines
  Genomic contig location: Contig_ID=SeqID_2073; Location=115..2378; Strand=-
  SCN-specific regions: Sequence locations=1-17,40-94,116-244,266 -332,354-1025,1047-1479,1501-1600,1623-2264
atggtcatcacacgccggagaagacaggcagaggaaacactacaaagcgccgaaggagacagacaaagaggaggcgaccaacgactgggggagtctgacagagaagaggaggaaatcaatgcagaggaaggcgaagcagcgacacagccgatcaattacgtattgggagttccattgctggacaccatcggcgagtctttccattgccgcttatgtgttccaattccaaaaattttcaaacggcatggtgatctgtcgaagcatttaaagcgttatcaccccaaccagcggattgtctttcaatgcaacacttgtcttatcgttttcgatacagtgaaaaagtgcaaagctcatcagcaaaagacgccagcatgccgaaatgcgagagctgtcccggaggaaatgccgcagcgtcctttggctgcccccggtgctgcaattgttcagcgcaatttcttcaacccgcgggcacgccaggttgagaatgttgaccggccacagccaattcaaaggcttgtcaccccagcgagtcagtcaccaccgcaattacaaataagagacgacagaaggcaagtgagtgtctctagtgattcctcttttgcttctgcagacagcgaatttgttgtcgatttaaatatggacagtcaaagtaccgcctcttctcacactcgataagcaaacagaaatgttagagaaagacacaatcggcgttccccggtggaacccgtccaaccacaacatctctccacgtcgtctgagtctgttgaacttggccaaaacaatgcacggccattaaatcatcctcaacattatccatcaccagtcaatgtcgaggccgccgaacacccaattcaccaaaatccgctgataattatcccgccaaaatcagaacatcaaaaacgttggataaggttgtttgaagcagtaaatgactcgaacgattttgaaacaaatttggtccaactattggcagaagttcggcaaaaggccaaaatcaacatccatccgcaacagcgtcgtcccccaaggggtaataatcgaaaccaattacaaaacccccatgggggaagacggaacgccatgaatgctgcccaagaaccggcatacgaccctgttgcggcttctcgaattcaaaaactttaccgccaaagtcgtcctcgtgcataccgagaaatcacagaacaatcatcaccattttgtcaaattgagggaaacgatctgcccaatccgacccaaatatcgacctgtcggttggcagtgctcaaaatcgtactgagcaaggcgatgaaagtggcgaacttggcgaagaggacgtagcccaccagtacgtccttggagtgccaattgccctgcctttgccatgtcggttttgcgctggccgatcattcaacacacatgccggactgtcaaagcatctaaagaaggaccacacaccgcaaaacacatggaatttggccttccgctgcaatggatgccgacaaacttttacacagctgaggacatgcaatgcccaccagaagaagtcggcacaatgccaaggcgcacagccgatccaagaagaacggcaccaaccacagcacgcgaatgttgttcgccaggtccgaccgcgggctcctcgcctccaggagcccgtttccccggctcaacccgctgctgcggatcagtccgggaccactcccagcggtacgggggcacggacagaccgcatgcagtgccggcgcgaatcggatgtaccgtctggtcgttcgaccccgcctgcattggttgcacaacggcactcggcaggcaccgcctcgcccaatggaagtgaccgaagcgctcgcacagcgcacagccgtaccgcccgtcaaaatcaaacgccaccgacacaattggtcgtcaatgcccaacctgaacagcacgatgatcaagccgttccagtggtcgctccacggcaacccaacgcacaacaacgcgaatgggttggacggttcaatgcggtgacaagcgcacagcagctcgacgacttactgaacgaattcatcaacgccgtccgacagcaggcgcaagtggcgttcacgcaaaggcccgctcagcaaaaacgtcggccaagaccaccaccgaaccaacatggccgacgccgaaaccaaatgaatgccgacgacggtccgccatttgacccggctgccgccgcacgtattcaaaagctgtaccgcgcttcacgcgcaagggcataccgggaaattacagagcagacatctccgctctgtcagctctcggctgaa

SEQ ID NO: 77689 - DNA, 1144 bp, Heterodera glycines
  Genomic contig location: Contig_ID=SeqID_2073; Location=4080..5223; Strand=+
  SCN-specific regions: Sequence locations=1-235,274-386,408-524,567 -842,870-1144
aaatccttttttgggatttcgaattgccaatgaatttgcgtatcggtttttaaaagattaaatgtgaaaatattttgagatttttttttggggggggggggggtttaatttaatccaagttttagggtgtgtatcagggaaaaaattttcggtttttatttttcggaaaaatgatcgtcgatcggaacttctatttcaaacaggtccgaaacaaaacaaggattttttacaaaagaaaaaaaatcaaaaaattttaatttaatttaattaaatcgtttgcttttaattttacaaaacaaataaaacaaagccatctcaaaattttaataaacaataatcgaaatcaatttacttcgctttttttctctaaattcaaaaaaagataaatttattttagattttaaagttttcctaaaatcccttagtttttgtgggatctgctaaaaaaactctcaaaaatttttttgccgcatatttttataaaattttttggtggaggaggggccgacgatgccgataacagttctgttgtgaatttttgggttgaaatttaaaattttttagggcactcgtggcattatagacaaaaggagcttaaaaaatcgaattggataccctaaaaatagttttaaaaaaatcggaaattgaggcccacgcaaattcaatcttctgctgctgatcattgcaatgaagtgagagataattaactaattaggaccaacagaagcccgaggtaataaataattcaattggttactgtaggatttttgaaagaacgttcagattgcttactgtatgcatgctgtatactgtagccttgcccatttaaatattttcgaaccattttttaatttaatttttattaattactccttttaatcatcaaagtctgccgcgaacataagtgttatttttcaaggcttttccaccgccgcccccgcaggggaatttcacagctaatttaatgacccccccccccccgcggggttttcccgccggtcgccccccggggctctaattgccaacaacttccgccactttcctcgcccctacagtatgccccatcttagtgacttcattagcaacagcagcacagttcgcaaattagtttttttcaaatgtaattttctctccccgccacaaa

SEQ ID NO: 77690 - DNA, 3209 bp, Heterodera glycines
  misc_feature (3148)..(3148): n is a, c, g, or t
  misc_feature (3184)..(3184): n is a, c, g, or t
  Genomic contig location: Contig_ID=SeqID_2073; Location=3747..6955; Strand=-
  SCN-specific regions: Sequence locations=1-308,333-1699,1728 -2007,2035-2310,2353-2469,2491-2603,2642-2921,2943-3077,3107-3209
  Gene Ontology: Mol. function=ATP binding; Cellular component=integral to membrane; Biological process=cell-cell signaling
ggcgatggccgatctgttggtgggtctgttggtgatgccgttgacgctgatttacgaaattgtcggcgtttgggtgctgggtgagtttcattttacagtccaatttttagcggaatttatatataaatgcaaaccaaaaatagatttaacattaaaattgtcaagaatcgagactcttgacagttttatatgttctttaaaaaaatgtttagaaatttgaattcggttggatattcacagtttttcacaaccgttgattttgaatgtaagaaaaaaaaattgcattttgccaagtcgcaagactttgccaaaatcaaggctggactgaaaggtccttcgtaatatgacaagattggaccattggcactttctgccgaatgaagcctcgggactggggccactcttttcataataatgtcaagattcggggagctattgcagagattggcaaagccgattccagagaaatccaacgaagatgggattaattttgtaactcgaaaatccatcggaaagtgccgtcgtggtcgtctcccatagttttacattttagcattttttgaagtccctctcctggcattttgccaaaaaaaaaagattttgccaaattcaatccaaaatccttttccaggcagtgtgctgtgcgagctgtggctggcgctggacgtgctgttcgtcaccgcctccatcctgcacatttgcatcatttccctggaccgctattggtccgtcacgcagccgctcagttatccggccaagcgcacgccgagacggatcagcatcatgatcggttgggaatttcgagagtcccgacttttaaattgatcgaataatcccatttacccgttccccggactcttgatttctctgtctcgattcccggcaaaaatcattaaattttcgagaatccagtctctcaggggctctcgatttctctgtctcggtttccggctaaaaccaatactgatcagtccgggccgtgggatcagtgccaccgatttccgatcggttttgtacagccggagatttcctcaaatgatgatgtaatcgagtctgatcacagctatacagtgagtgatcagccagtttatagagagacagagtaccattgttcaattacagtagggtggacgctgacagtatgccctataaagtatttattggatttgcttttatctcgacttctggcacacaaaattcttgaattatttgcttggctttttttgttggtcggtgcctaacagcacctacagtaccctctaatgcactattttttgagaatatttatacggtaatgacgggcatttccagtaaccaaattaaccatttcaacagtaattattatcaatttgacagcatttttcccaatttttcaggtgtggcctggatggtctctctgctcatctgtttccccccattgcttggctggcgaccgaaaagggtgagtttatttgtagaaaaaaaacaattccaaaaacaaaacggcatttgccttttttaacggcatagaatttttgggattttcgtgcccctaaccttgacctggtgttttccttgattttttataggagttttattagggctcgacctggattttcctggaaattcccttacagctaatcattttttcaaaatttctgtctctactttttttaaaaatatttttgttttcaatcatttttttgttttgccaaatttcattaaaaatatattattattttttaaatgcaattttgtggcggggagagaaaattacatttgaaaaaaactaatttgcgaactgtgctgctgttgctaatgaagtcactaagatggggcatactgtaggggcgaggaaagtggcggaagttgttggcaattagagccccggggggcgaccggcgggaaaaccccgcgggggggggggggtcattaaattagctgtgaaattcccctgcgggggcggcggtggaaaagccttgaaaaataacacttatgttcgcggcagactttgatgattaaaaggagtaattaataaaaattaaattaaaaaatggttcgaaaatatttaaatgggcaaggctacagtatacagcatgcatacagtaagcaatctgaacgttctttcaaaaatcctacagtaaccaattgaattatttattacctcgggcttctgttggtcctaattagttaattatctctcacttcattgcaatgatcagcagcagaagattgaatttgcgtgggcctcaatttccgatttttttaaaactatttttagggtatccaattcgattttttaagctccttttgtctataatgccacgagtgccctaaaaaattttaaatttcaacccaaaaattcacaacagaactgttatcggcatcgtcggcccctcctccaccaaaaaattttataaaaatatgcggcaaaaaaatttttgagagtttttttagcagatcccacaaaaactaagggattttaggaaaactttaaaatctaaaataaatttatctttttttgaatttagagaaaaaaagcgaagtaaattgatttcgattattgtttattaaaattttgagatggctttgttttatttgttttgtaaaattaaaagcaaacgatttaattaaattaaattaaaattttttgattttttttcttttgtaaaaaatccttgttttgtttcggacctgtttgaaatagaagttccgatcgacgatcatttttccgaaaaataaaaaccgaaaattttttccctgatacacaccctaaaacttggattaaattaaaccccccccccccccaaaaaaaaatctcaaaatattttcacatttaatcttttaaaaaccgatacgcaaattcattggcaattcgaaatcccaaaaaaggatttgcttaaaatgactgggactcatattagctcaaagtgcttggtactcaattgtaccgtcattccttattttaccgtagggtggcaaattgtgccgctatttggaattttttggcaccaaatattacataattcccaaattttgttcagcgtcccggcgagtgtaccgtatcctcagagttggactacgtattgtactcctcgctgggctccttctacatcccggtggccattctcgtcgtggtgtacatgcgcatttatatgatcaccaagcnggcacagtcagcagcgactgaaggacacccaacggnatgggccaaacgctgtgccaactga

SEQ ID NO: 77691 - DNA, 858 bp, Heterodera glycines
  Genomic contig location: Contig_ID=SeqID_2074; Location=800..1657; Strand=-
  SCN-specific regions: Sequence locations=1-158,182-858
ctgctgctccattgtcctcctcctcctcctcgatttttaccaacccaaacagcacattggtggtggtggtcaagcagtatcagcaacaacagcagctgaacaaccatcaccacaaccatcgcaacaaccatgccgcggcagcagctgctgctgttctgttgccattcaacaacaacaacaatttgacggatgaaataacagaattggcacacgcgacagtgcggggcgacggcgatcggcattctgattactttgctgatgggtaagcaaaattagtgatgatgaagatgatcagacggcaaaagtgtctgctttgataggtggttgaaagtgcaggaatggcgattcagtaaacatatcggattgaatcggcaccgaaacaaaatggcataacaaagccaattgcactgtttattcactgatcagactgattggtcaaaattacttttattcctttgccccattctccgtctgattgcttgtaaaagcaatacggtacatggtcttttgtcattcctaaagcctataattcgcacccaaaatgtcttaagccacctggtcatttagctctgtaaataatgccgttcattgatcaaaataaatggccataaatttcggttcctttcgagccgatctgatcagctttcaaggcgatttcaatcacataaggattttgatcactaaatttatccattcatattatcccgatcatttctacattctgtgttaagcaccatcattctgttccacggtgcggctgaatggtgcccgaacgtgtcgaatgccgtcgtgtggccctcgtgcattacgctggcagaagccttggccatggcattgtttctgctcatcgtcatgctg

SEQ ID NO: 77692 - DNA, 313 bp, Heterodera glycines
  Genomic contig location: Contig_ID=SeqID_2075; Location=279..591; Strand=-
  SCN-specific regions: Sequence locations=1-262,284-313
tagggatgcgatttttaggcaaatgcctaaaatttttgcgcatttaatacgtacagttaagcacgaaaaacgcattttccgcttgatttggcgtgtctacgatgacttttataatgcctaactttgcctattttggattttttgtgcttaatgcctatttgcctatttttgtgcctatttcgccatttttgacgaatttttcaggatttccggaaaattcgttaacaaaaaatgaaaaatacacccctaagaatcgacttgaaaattttttagaaaatacaccccctaagaattgaaaaaaaaaaattcacaa

SEQ ID NO: 77693 - DNA, 752 bp, Heterodera glycines
  Genomic contig location: Contig_ID=SeqID_13768; Location=245..996; Strand=-
  SCN-specific regions: Sequence locations=1-40,63-115,149-188,220 -268,292-310,360-605,627-723,745-752
  Gene Ontology: Mol. function=hydrogen:sugar symporter-transporter activity; Cellular component=integral to plasma membrane; Biological process=anion transport
atgctagtttatggtttgataagcactctttccacattatttacaccaatgacagtaaaatttggtggttttttcccattgctttttctacaatttttgcaggtgtttttacctgaatttttttctaatttattttaaatatttttaagggtattgcaatttcaattggctggtcaggagctggtacgattaaaaaatattttaaaaaaaattttaaatcccattttttaggtgtaatcagttcatcttggagtccaccagatacctatggaatatttctttctgtgcttacactaaattttcaggcaagaaaaaaatattaattatacttaatttatttaaatttttttatttaattacagtttggccctgtcataacaatgccattagcagccgctttgtgtacctctgaaaaatttggatggccaacagtttactacgttttaggcaccagcacattattattttcggcaatttttttgcttttttaccgtgatacaccacgccaacaaaagtgatttgaataaataaatcactcaaaaaaacatatttttagaaatgtgtcgaaagcggaattggcattaattgaacaaacagaattagccttaaacaatgctgaaaaagtgcgacaaaaaattccatacaaagccattttcaccgatctgatgatttgggcacaaatttgtgtgcatgtcacaaggaatatgggctatatgatcccgttggtttatggagccatttattttaacaag

SEQ ID NO: 77694 - DNA, 593 bp, Heterodera glycines
  Genomic contig location: Contig_ID=SeqID_13769; Location=239..831; Strand=-
  SCN-specific regions: Sequence locations=1-81,108-199,250-402,458 -509,561-593
atgaaaaaatggaaatcgcctcggctcgcggttggtatgttctgtcaccacacatcgtccaaccttttccagacagtcgcttacaaaagcaaagcaaacaaatcaattcggtcgggaaggatgcgctcggggaagaaaatgcttttcatttattagcatttgcagagagtggggacaaattccttgagaaatcttttccaatttttttatattatttttaatttgttttattttttaattcaattaaaagcgttggcatgtgcaaagttacaaaaattttgcctgacaatgagactaaaaatgattgtctaccattccaacattgttttggcatcacacgatatgttgtgctagtgttgagcacaatctgtttgtcgctgatcgccaggtcattttcataatttttatttatttatttaatttgatttaatttattaatttacatggaattttattttcagcagttggttggcttttaatttcaccgtcatttgcatggtaaaaggtggaaaaattattagaaaaaattatttacctatttatgtataattaaattaaatgttagtattttcaagcacaaaaatttaaataaa

SEQ ID NO: 77695 - DNA, 949 bp, Heterodera glycines
  Genomic contig location: Contig_ID=SeqID_13769; Location=1224..2172; Strand=-
  SCN-specific regions: Sequence locations=1-127,177-303,325-650,754-949
atgtcggtgccaacgccgaattggccaatttggctgtccagttccgagaacaagttggcacaattgacaccaactgtgctgcgctgggcattcatgttgggcaaatcagcttgggcactctcaagggtaattaaatttttattaaaagttaattaattttaataaattttttttttcaggagaccatccgcaagtgcatgactctgagagtgtgcttagtaaccctggcaccagcgggtctcacaagcgcatttaagtgcattgcgacgattccgatgatgtcatcatttgttgattgatatgctatagaaattattttattagataaaaaatgaatcgttgctattttttttttttttgcttaaaaatcccagcccaagtaattaacttataaggtagggcagcaagcactttttaaatttaatatggctcatttgactacaaaaaatgaccaattttactaatagcaaaagttggtcgagaaccatggcactatttattcgagtatgcggagaaatttgatcaaacaccaaaaattccaacttttcaattacattttctaatcaaaacctattttcgactttgtagccatggaaacaaagaaattctccatattaacttgtttataccacctaatttatttaagcagcaaaatattttcataaatatatttaaaaatatataataatgaaataatttaaatttttaaatatttaagaatgatagttaaataatttaaatttttaaaattttcttgaaaatgaagactcttttgaccagccagcagctgttgctcccatttttgttcttcatacacattaattttcgacagctgtgtaagcaatggagtattcttgttcactaaaatttaaaaaatcatctccttattttataccggttttctaaaattggttttttttaatttttctatccatgttacaccaataaa

SEQ ID NO: 77696 - DNA, 388 bp, Heterodera glycines
  Genomic contig location: Contig_ID=SeqID_13771; Location=714..1101; Strand=+
  SCN-specific regions: Sequence locations=1-250,279-388
atggagatttttcgaaaaattatcatgacttcaatcccgcgggatcccgcgggattggtaaaatggtcgggagggatcccggttcgggatcccgatgaaatcccgatcccgatcaatcccgatgaatttaaaaaatccttctggacggatcccgaggtcgggatcccgaatttaatcccgcgggatcccgtagaaatcctgcgggatccctatcccgtccggtctctagttaataacaaaagtgcttaagattataatattaaaaaattaaaataattccatgatgcttaagtaattattaaagtttccttgcaaaaaaaagagcaaatgtaatttattcaggtaattaaacaaaattaaataagtattaaatgcaaacaacaaaata

SEQ ID NO: 77697 - DNA, 1687 bp, Heterodera glycines
  Genomic contig location: Contig_ID=SeqID_13772; Location=238..1924; Strand=-
  SCN-specific regions: Sequence locations=1-484,508-807,829-907,929 -1092,1114-1386,1408-1422,1445-1687
atggcctataatttcgagacacaaatggattttggtgaagaaaagcctctgactgggcttcgagcactgaagtgggttatgtgctcaaattaagggcccatttcacatgtttaattatgcttttcaattatttaaatgcgtggaaaaaagaaattattcaatctaagcaaaaaataccgaatttccccccccccaattgttgttttacctttaattttcttttctttttgccagacatcccttcgttgtgttggcccatttgggctttcgaattggcgcaattgtcttttatgtgttggccgatttcttcttcagttcgttcatcattcagtttctgattttggtaaattattttacgatacgttttttttgacatcgacttgggctccgcttaattttatttggaatttgaatatcaaacgacactttttcggctgatgcctgtttttgtaacggccctcaattcataaaaaattgtagcgcgatttaaaaaatttaaaaataggcaccgctttgccaattttccaagttttcgactcacttttgaacgaaatttgccaaattcgtgaccattcccttttgatttagcgtattctttgcgttttcagttggcacttcattccgcggatttgtgggccgtcaaaaatgtgacgggtcgtctgttggccggccttcgctggtggagtttggtggacgcggacggcaaaaaccattggaaatttgaagtttcccaggttttttccactattttttccatattctctcattttcttcgtgttttaaatgccttaccacctcaaaaaatgagtgtcatcccataaattttctcctttccaaggaacccgacaattacgacacgtttgagcgcaaaattttctgggccggcctggtggtggccccattcttctggactctgttggtgtgcaccgctttcctcacgctccactggcaatggatggtggtcgcagcaattggagcaggtcagtgccaaaacagcaaccattttaacgttttcgggactttgtcggcccaaaaattttagggacagtttctatcttggtaatgatccgaccgtttggtttgatgtcctcgttttttctgtttgttggggagaaacaggcggcaaatacctatgtgttctaaattagcctgcaaaatctctaagttcgttggtttcccaacatttttgaccataacttctcgtttcggaaaaaatcagcgatttttcgtttttatcgccgaaaaaatcgtaatttacgctccaattctttaaacatttcccatttccatctttctccaggcatgaccttcaccaatctgtacgggtatttgcgatgcaaatggagcagtacgcaggagatgaccaaccacatcacgcgatgggcctttttctcggtgatttttctaaccattccaattgccatatttttaaaatccccccattttttgcagatgttgaagaggaattttgcgccgcaacaaaacgcggaaacggcggcagcagcgacaacaaatgttcaacagcagcgccaaccgtcaccacggcttcaagaaattgtgtaaagtgatcaaaattaccataaataattcaccaatggcggagtcatttgttttttgtgtgggctatgttttaattttttaggtggttgaccaccattctgatcataaacatggtcaaggaaataaa

SEQ ID NO: 77698 - DNA, 798 bp, Heterodera glycines
  Genomic contig location: Contig_ID=SeqID_13775; Location=251..1048; Strand=-
  SCN-specific regions: Sequence locations=1-353,383-456,479-604,656 -752,774-798
atgcctgagatcagtcaaatgtgcgaccggggcaatgtgatggtggagatatcgcaggcaatttctaggatcttttattaattcgtgttgcaaatttctgactggttagaatactctcccattggcggcagtaatttgaaacccacgaaaatttaaaaaaaactaaaatattgtaaggattgggccagtgaacgattaaacgcgttaaagcagaggcatagagaacaaaagggaatggtttgggtgataagccgattgctgttgaacaaaaaaggtctagggttcgcttccatctcaagtataaaaatgaaaaactttggaatttctctctgggattttaaaaagcctttatcttaaaaaattactaaaaaattttatttttggtttttccttctaattttctcttccttccaattcaacaaatgtactaattttataacgaatttgactaaattcttttttttttatattttaatatggttcgacccaaaaactcaaattcaataattttaatttttcgactttttgttcgagtttggatcagggatacggaactggttgaaatggatgctattttcgtgatcagcaatctctaaaacccttgaaatttattttcaataatttttaaaacataaaaaaatttctttaaaattatgtgaaattggccctgtaaactagacaatccctctcttatccctctgctcatgttcaattccgtctcatcgcgattaatattatatctccataagatttttgttaaaatctaaaaatttattttggataaaaactataaataaa

SEQ ID NO: 77699 - DNA, 1277 bp, Heterodera glycines
  Genomic contig location: Contig_ID=SeqID_13775; Location=1211..2487; Strand=-
  SCN-specific regions: Sequence locations=1-182,204-207,229-406,428 -1159,1181-1191,1214-1277
atgaatttgtggctttttaaaatacgcggaaaacataatgccaaaaatgtatacaaacaatctttagtcactcattggcaatccgtccttttttgggccagtttggccaactccttcgtggaagcactgcggctgggcgggctcattcatcccgtcatctccatgggtaaaatgtcaaattgttaattttaaaaataattatagcataaaaaaggaaaataaaactttggcaaattggagtgcaattgtaccaaatactgcttactgctaattagtgaatttttttcaggcgcccaggccgcgtgtcgtccagtgtaccagggccaagaaccgtcgctgaattgccaagtacgaatttaatagtagaacatttgattgcttctttctgttagccttagggccaattattaattttttgagaaaaatgcgcattcgtgggagagccagtcctggtacctagcattgttcaaactcggttcaattgcaactcgtataagacaattcgtacaaaaagcaactcgtagaatagtcaattcgtacaaaagtcaaaaggtacggttttatgagtccaatcgacttttatgatgtccaaaggtattttatgtgtccaatcaattgacaatacttggtttttatacaataatgttgttcatatccaacaagcccatctttttgatataattcgaaagcataaagcctaaagaagctaaaatatataaaagctcagcatttaggcaatagcaaatgtttaatcaagtaattgttgattattttcgtttgtaactttctttaaatgttagcattctcttaatttctcgtattatattaccttgttcagactttgttctttcgaatgataccaaaaattagggtttgttcaaacatgaacaaagttacggtataaaaatcaggtattgttatttgattggactcataaaatacttttggactcataaaagtcgcttgggctcctaaagtgcaatagagctaaatgtactgtaacaaattttacaaaaaaagcctaagcctagtaccaagcaggcctaaagctaattttgtggccggagtcagcaaaaaacagcggcaaacttttcggaaaatggtaacaaatgaattgaatctataatttttttttattcatggtaattaatttgaattacttttgctatatatgcaaaattttaaatctaaaattcacaaattaactttcaaatccttcaaattttaatcgtttggaatttgttgcgctttaattcagtttttttaagattaataaa

SEQ ID NO: 77700 - DNA, 1237 bp, Heterodera glycines
  Genomic contig location: Contig_ID=SeqID_13776; Location=20..1256; Strand=+
  SCN-specific regions: Sequence locations=1-50,73-167,190-292,379 -421,445-453,475-826,848-863,885-943,965-1237
  Gene Ontology: Cellular component=integral to membrane; Biological process=anti-apoptosis
cagccgccccacaaatcggcctccgactcacgcgttgcagcactatccgccgacgcggcacagcaacaacaaaaccaacaaggacaggaaggcgcgacaaacggtggccgaacgggtggtggtaatggccgaagacgacaacaaagccaaccgcagcatggtttgcaaaaatgaatttatttaaaaattggcaattttacactgggggggggagtttgcttattaaaaaaaattgcggggtttttcggggtcgctgaaaatgaagaatttagatattttttttggaaatttcttattaaaaaatttctaataataagatttttcttaagattttttcttgaaaaattctaattttgaaaaatttttagaaaaaaatttggcggcaaaatttcgtcctgtttcgctgtgaaacacatttgggaaaaccaaaaattaaaaccaaaacgcgacccctatttttgaccactttttaattagcgccaaaaaacacgtttctatgggtttccaaagcctaaataaattcaacaaatttatgcataaataaaacaattgactcttaaaattttgtcttttcattttcaagaggaggaatacgcagcgctcaaatacggtgcttcccacgtcattctcctgttcgtgccgggtaagcacttttttggcacttccatgccatcgcatttttgcggcgtcctttttcggttttaattcccctttttatatgcccggttccctgattacgaatattacatccctttttggtaattctgaacccaaattctcggctttattgtagtttagacgcccaattgactttcggcatccaatcaatgactttctttagtttcatagatagttccataaattgttttcttttggtcaatgcctaacaatttcttggtatcaatcgaatggttaaatctcgagaatttataaatgcaagaaagagccaataatgacattaagaaagtgttacaatgagaaagaaattctgtagactaagatttcaattgataccaaaatttaggcatttaccaagtaagaaaaaaagttattgtctaagaaactgagaatgatcattgattggacgcctaaagcgcaatagagccaaaatcgttagggctgctgaaatattttcgttttacatccattttatatttttagtatccatttgtatggccgtggtcacaatgacagttgcgtcggttggcttctactccaaaaatgatggcctctactt

SEQ ID NO: 77701 - DNA, 736 bp, Heterodera glycines
  Genomic contig location: Contig_ID=SeqID_13777; Location=283..1018; Strand=+
  SCN-specific regions: Sequence locations=1-311,338-559,602-736
  Gene Ontology: Cellular component=integral to membrane; Biological process=cytoskeleton organization and biogenesis
atgtgcatgtctagaagcgtaagaatttctttgttgggctaacaaaactgaactaacgaaattttatgtttaaattgccaaaaaatccccccccccccctctctctttttagttctatttgatcgtcgtttccgctttgatggcattgcttttcatcaaatatttgccggattggaccgtttggacagtgttggcaattctgtcaatttgggtatttttttcactggcattttttggctgcatgacaataactcagtttttgtttggcaccatttaaaagttcaaattctgcatcgaaaaaccgagtgctgaatttaattaaaaaaaaaaaaaatttcgtttaattgcaggatttggtggccgtcctcagcccaaaaggtccgctgcgaattcttgtggagaccacgcaggagcgaaatgagccaattttgcccgctctcatttattcatgtaaaaatttttttcgtgttataaaaaaattactaggatttctgaaaaattttgtttgaaaattaacaaaaaaattcaaagggcggggggagcagtaatttatccaatgtaataaataaatatttaaatatataatatttttaataaaattcagcaaccgtcactgtcctctactcatatgtgctccatggcgttgtttcttccgcttttattgtcgccgccggggtgggcacaaatggcgatgatgaagacgaacagcaacaacggcaaccacaaccgaatgatg

SEQ ID NO: 77702 - DNA, 241 bp, Heterodera glycines
  Genomic contig location: Contig_ID=SeqID_13779; Location=104..344; Strand=-
  SCN-specific regions: Sequence locations=1-96,137-241
atggttgtcaattcggtgttgccaaatttgttaaatgtggcccaaattgtcaacattgtcacaccatcacaaaatcaagtcacaccatcacaaaatcaacaacaacaacaacaacaacaacaacaacaacaacaacccaatggcgaaatttttgttgaatttccatcccaaaatattatgccagcccaacaaatgccaattacagtagacaataatgaacagtttcaaaacacacattatg

SEQ ID NO: 77703 - DNA, 313 bp, Heterodera glycines
  Genomic contig location: Contig_ID=SeqID_13779; Location=2166..2478; Strand=+
  SCN-specific regions: Sequence locations=1-135,157-210
atggccaaattcctttctggcattatgttttgcgcattgttggcactgctggacaccaccagtgcatggaagcgcgagtttttgcgcatgccgaaaagcaatgaaatcggcacggcggacgacagcagcgaaagtggcaaaaatttgaaaagccaatcggaactgatcgcttcaatgctgccaaaaagaaaaagtaggaaaattggtaaaatataaattacttaaagaaatgaaaatgaaaatgggaaatattaatattaaattattattatttggaaataaaaataattttttagtattaatttttttttaa

SEQ ID NO: 77704 - DNA, 361 bp, Heterodera glycines
  misc_feature (39)..(39): n is a, c, g, or t
  Genomic contig location: Contig_ID=SeqID_13780; Location=31..391; Strand=+
  SCN-specific regions: Sequence locations=1-110,141-361
atgttccgcaccacacggggcactgaaggtggtgccttngaggaggtcaaatgcgatgacgaagactatgaccgctgtttaattggcaaatgcaagggtaaaaaaatggcaaaaaatatataaaaatttcaaaaaaaattccaggacaaaattttgtcgaggtccgcaaattctgtgccaccaaagatggatgtgccgcgtttggatgtgccgttgaggaggaacttgaatgcaaaacgtgctttggcgaactgtgcaacttgtaaaaatggatcgagaaattattttcggattttcaaagatttcatgacatttttcggaccaatttgttcatggacatacaattaattttgtatattta

SEQ ID NO: 77705 - DNA, 710 bp, Heterodera glycines
  Genomic contig location: Contig_ID=SeqID_13780; Location=952..1661; Strand=+
  SCN-specific regions: Sequence locations=1-11,33-95,185-212,234 -422,444-710
atgtttcccgcgggcccaaagaagaaattttgttcaatatgccgggccacaattgaagtgtttgatgaaaaagtgatgacagaaagacatataggttaatttttttaattatttttaaaattttgcgattttaatttaaattttgcggattttttatttatatttattaattaaaataaatttagtacacaaaaaatgcttcaactgcggcatttgtaacactccattgttgattggacgatgtgcaatggatgatgtgctttaccatcaatttggtcatatttttgcttattttgtgggattagaatggaaccccatggggttggaaatgtcggctcccggacaatccatcagtgatggacaatccgtcagtggacagacaattcgtcagtgaaaaagcgatattttatataaaattatgtgaaaatgaatttaaattgaaacaaaaaaacttcctccccccccccctcccccctcgaggggaagtgagtgagtgtaagtgaactcgttttcggagaggggaccccgcactgcattatcagcaagtttggcgcgcgccatgttccgcagctgtttccggcgcccccttcgactgggcaattttgtccatttttgatttgggtgggcaaaaaaggaaaactgttgaaaatttaaaaaaagaagttcttggcaaaatgtttaagttttaagagcattttaaaatgcgcaaa

SEQ ID NO: 77706 - DNA, 566 bp, Heterodera glycines
  Genomic contig location: Contig_ID=SeqID_13781; Location=16..581; Strand=-
  SCN-specific regions: Sequence locations=1-334,356-566
atgggcatgcccaccgcgttcaccgacaacgccaattttgagggcatttccggcaagaaaacgttgctgctcagcgaagtgatgcagaaggcggtcattgaggtacggtgattgcccacaattagtgcccttatttttgtggattccatttattttcgcacttattttgaacgaaaaatccaaatacaataatggtatcttttagcctattttaagtttgtaagatgcgtttctattcatccttttttgtccatcattaaacaaatttgccaccatcgatgtgcaaaatttaaaaaaagtcaccagccggtccagagaaaaattatacatttttgaccagttttagctcaattctcaaagaaaaaactaatttaaacaacgaaatttaggtgaatgaggagggcaccgtcgctgcggcagtcacagaaggagaagtgtcggattgtggttcgagcaaagaataccgttttgtcgccgaccgtccgttctgtgcctttctgattcgcgatgacactgtgcttttcagtgtgattttccgcaaatgattccatcccatttgtattaaa

SEQ ID NO: 77707 - DNA, 1554 bp, Heterodera glycines
  Genomic contig location: Contig_ID=SeqID_13782; Location=634..2187; Strand=-
  SCN-specific regions: Sequence locations=1-322,344-698,720-1022,1045 -1127,1168-1224,1248-1367,1390-1554
  Gene Ontology: Mol. function=serine protease inhibitor activity; Cellular component=cytosol; Biological process=regulation of protein catabolism
gcacaggccgattttgcgttgaaattgctgcgcgaagtgtccacggacgaccgttcgtgcattgtttcgccgttttctgccgccgtcactttgtccatggtttacgcgggcgccaaggaaaagaccggcgaagaaatgggccaactgctggcaaatggtggaaagtttcgaaatttcataaactgaaaattatgtaaatcatttttagaatttcggttttttgttcgaatttgggtcttgaattcgaatttggccggaataaatggcagattcgttatcaaaaacttagaaaacccccagaaacattatcctcctacttttgaaaacaacaatttctcttcttttcagtgcccttgaaaaatgcctcacctaaagtaatgagggacaataatcatccccttccccttttaattaccctcccccaccaatcctccctattcctaattgcccccttattgctaattgccccctctctttttgtttaggtgcgcccgagtcggaggtgcacaaatacttcggcgctttgctcaaatcgatcacaagtggaacgaacagcagcaacactttggagacggccaacaaattgtacgtgaggaaaggcagcaaagtgaaggacgcgttcaaagagcaaattgagggaaattacgggggacagtttgagacggtggactttttggacggcaaagggacggcggaggtgggaaatgttttattggcgtaatgcgaaagcaggcccaaaaataggaaaatatcagctaaaaatgtcaaaaattgcttcatttttaagccattccattccgttagaataataactcttcataaaagtcaaattttggggttttttttcttaaaaagcatacggacagtggtgaatccttttggtgcaaaaattttttgtttcattaaaagttgggaaacattatttttcgccttcagaaaatcaacaagttcgtgaaagaagcgactcataagaaaatccgcgatttggtcacgcccgacaattttgacgggaacactcggtaaaagtttttaaattttgtttctaaaattctgtggcaaatctaatcttattcaatggataacatacttttggcccaaaaacgtcgccggacaaaacatcgttccgcaaaaaaatactaaaaaaaagaaaaaaacgtaaaaaaaaaatcataaagtttttgaattaggctgtcttcggccttttgcggcaatttcaaaagtccgaatatttatttttttttttaaatgttatttgatggaaatagcaaaaaaaaaaattgtaaaagtttgaaaatagttatttattttttgcagtttggtgctgatcaacgcgctttacttcaaaggcacatgggcggacaaattcgactcaaaattcaccaaaaaagcgaaatttcatgtggacgcgaaaaacttcaaagaggtggcggagacaaacacattttaaaatcctagcttcattttcattttgtccgtaaacgaccaattttttagctggaaatgatgcatttggaggcctatttcatttactacaagaacgatcaggtcgtttag

SEQ ID NO: 77708 - DNA, 477 bp, Heterodera glycines
  Genomic contig location: Contig_ID=SeqID_13783; Location=396..872; Strand=+
  SCN-specific regions: Sequence locations=1-5,27-131,153-201,288 -311,336-477
atgccgttgccattgccaccatcaaatgccgaagtcgtcgccgaaccaaatgccacaacttcaataacaacagcagcaaaagtcatcgccagccgaaataccggctgctctacatcatccaccgcattgacaatggtcacgcgcagtgcacaacgacgtgcagcggaggaggaagcggttccggcacttgcaattcgtgagtttaatttttaaaaaattaataaaaaaattttaaaattgattataaattcattgtatttcctttattaaaattttttgaaatttaagcgccgccgccacctgccggctgctcatcatcatcatcaacagcagcaaatgttcctcagccgtcgtcgtcgtcactttccgccgaagaaatcacacgacaaaaaaagagggataaaaacaacaaaaacaaattcaacaaaaaacaggcaagctttaataaaaagtttaaatttcatagcatttaaataa

SEQ ID NO: 77709 - DNA, 86 bp, Heterodera glycines
  Genomic contig location: Contig_ID=SeqID_13783; Location=1..86; Strand=-
  SCN-specific regions: Sequence locations=1-86
ttctgccgccgtcactttgtccaaggtttacgcgggcgccaaggaaaagaccggcgaagaaatgggccaactgctggcaaatggtg

SEQ ID NO: 77710 - DNA, 1951 bp, Heterodera glycines
  Genomic contig location: Contig_ID=SeqID_13785; Location=1499..3449; Strand=+
  SCN-specific regions: Sequence locations=1-130,155-193,215-226,248 -315,337-1006,1028-1350,1429-1473,1496-1524,1547-1616,1638-1743,1772 -1951
catacagagaattgaaatgcaaagttggccgtgctcaggcacagacaaacagtaaaaaattagaagaagtcaaaactggaaaatgcgcgtttgaacagtatttttgcctgatgatcacctgtgttgttggtaaattaattactaatttgaactcagcacggcaaaaaattatagactttatgtcatagaaatattactaattcaaaatttttatgatttatagagcaatttgaaaattttatttgacataataagaatttatcaaaaattccaaaatacattagttacgaaaatagtgagcgaaacgcaaaattattgacacattttttaaattaataaatgctataaatcgttaaaatgaagagtatccgagattaaaacattgctttcgtacttcccaaacaaaaaaaaattaataaaaatccctactcattagacataagccaagactgatctgaaaggtcttaacacattaaaatgccagaaaataggtttaaatttttgcagttggaaatccgtcgtacgctttcactgattggcaatgctcttacagcaacaatgccgaggtgtgtgccgaaagaactgaacaaaaattgcgagaactaaaccaattcaaaaacccgcgctgcaaatgcgaatttggcaaattcaacgaggaaatggccaatgaaaagccggcggcacaactcccgacaacgccattgccaagtgcacttttcactagaccttgtcgggactttacagaatactaggccgggtcaatacctagtacctctgttggggtcctagtatgcgtttttcaagattcccgccacgtttgggcatcacggttgggcaccaacatgtttttgcactataacttttttctttttcaactaaatctaacatttttggtatcattcgaaagcttaacatacttagacgctatttctaagctattgtttcgcggttagacaattgcaaaaaaaattataacatgaaaattgcaacaaaaaaagtctaattttctgaaattttttctaaaaaatttttgtaagactaattagagcacatccaaagagctttcgaatgataccaatcaatgttggatttggatgacaaagaaaaaagttatactgcaaaaacatgatggggcccaaccgtgccggctcaactgagtgaatccgaaccggcggcaatagataaactcagatattagctaattttaacgggttttttaaagacttgttctgcttgcggggagcatacgattacaaaggctatggcatcgttgaagaccgtgaatgtgcccgagaagatcggcattgctttatcgcaaattgcaagacaggtaaaatggttggaattgagtaataaaaaaatatatttaaacaaatatataataaaatatttaaaaatgtttaaacaaatatttaacaaaatatttaagcaaataccgtatttccttcaattatatgcccgtctccaattatctccccctttctgaggaggttgaaaaataatatacccgggcatacaattagagaaaataaggtattttaatggatttccagataaattatagaaaaaccttgaaactgctcgtaaccacaaaaagtttcatattatttaactgaatataatatatattttccattccatcagttccgtttgaattaaaatatgggattaaatgattttctgaataatttatttcccggcatttaattttggccaatgccgccgaacccctcatttttggcattctcccattttttcagcagacagtaaagatggcatcatggcttggggttgtgcggaaagcgataattgtacggcaattacggaaaagttgtccacaaacaagcacaaaaattacgaatgccgttgtgcatttggcggttttggcggcaatatgaccaacgaaaacatgacaattccgtcgtggattccaccgcccacgcttccgtaa

SEQ ID NO: 77711 - DNA, 471 bp, Heterodera glycines
  Genomic contig location: Contig_ID=SeqID_13787; Location=525..995; Strand=-
  SCN-specific regions: Sequence locations=1-270,307-471
atgtgcaaatttaatttctttttcaataaaaattatcgtaaatttcaggtattttgtcttttaaattgtttaaaatcaatggcccgtctcgaacctgaaccatatatatttgtgcgtttctgtttattaaccatttaatttttaggggtaatttctaaatttagatgataaaatcgattctgcatgatgcaggccgcttcaaaagcacgaactggttaaaaaaaaattggagacctacaaactgaattcgaaaaagcatgtaataatgacaatttttatatattttatttaaatattatttaatttgtttaggtcaatccccgagttaaaaagactctgcggacctacgttgggaatggtgagctcgcagtcgaagctggaagatattcggtggccgcatcgggcggtggtgataaatgatttgtttgatggttccgttttgtttttttctatttgttaattgttaataaa

SEQ ID NO: 77712 - DNA, 795 bp, Heterodera glycines
  Genomic contig location: Contig_ID=SeqID_13787; Location=2775..3569; Strand=+
  SCN-specific regions: Sequence locations=1-432,454-476,498-568,592 -637,659-749,780-795
atgtttttgaaaattaaaatcgaatcgtcgggctggccggataatacgactactgaaaagcaaaaaaacgagtttatgagtatgtacaagcgtaaatatgatatagagcttgatcctaataatataaataaaaatccaggattacttttaatagcaaaattggtgagaatcaaattcatttaaatatgtatgtaaaattttagggtctaaactccttatggggtaaattttcaatgagaaactccctttgtcagaccaaagtgattgatagttcggctgagtggtataatcttttgcttgatgattctatagagctttctagcccaataataataaatgatgagatgattcgtgtgatctatagaaagaaggatagttttatcaaagaacacggagtctcgaacataatcatttctctatagtgagactgtaaattatacggtgttttattttatttttaggacaactagtgctgcatgtttagttttatataaaaatatggaaagggtatttaatacgccgggctgtcgtcttttttattgcgataccgatatgtcaaaatacaaatttagttgatttttattttgttcagattcattagttattgcccaccctccgaactcatgtcctcttaaagaaggaaaatttttggggaaaatgactagagaatatgcagattccgatattattgagtttagggtggtcctaaacagtatgcattgaaattaaaaagacgggaaactggagaaatttggtataaaaccaaaatacgcgggataactttagatcgtaata

SEQ ID NO: 77713 - DNA, 2027 bp, Heterodera glycines
  Genomic contig location: Contig_ID=SeqID_2076; Location=1481..3507; Strand=+
  SCN-specific regions: Sequence locations=1-139,169-585,607-693,741 -764,804-834,857-867,932-940,962-1029,1051-1185,1208-1284,1306 -1529,1603-1641,1663-1797,1819-1895,1965-2027
atgagcacttttgccggtttccctggtggtggtagtgtcggtatcggcgtgccaattcggatagaaagcgcttcgcctcaccaagcaaccgctcaaccccaaaatgccaaccaccaacaacgccaaaacggtgctgcagcacaaccatcatcatcatcatcttcctcggtggtggaccgtctccaacggcttgaggcggagatggacgcggaagcggtggcgggcgccatccacttgccggatgaccgggagttgaccgcgcggctggccgccttcctggcggagcgctttccggacgcggatttgcagctgaccgtgagcagcgtgcggcgcacaatcaccaccaagcaacagtacgagacggagacgccgggcatggttggcctgccggtggatcagctgcaggagttgcagcgcaaactgatggccaagatcagtaagctgtgcttgtctctctgactgaacagggcaacaacacgtaaaaaaatgagaaaaatggtggcacaatgccaaaacgccataagacttgaaaatccctaaaaaattcaaatagtagggttaaagaatggcacaatgccaaatgatttgaaaatcccaaaaaattttatttgattaaagaatgaatgactcaatggcaaactcagttaacctgaaaattgctaacacttacaattaaagcatttatttaaacgcttaaaaataaatttaaaatgtattaaaattattttagtaaattttttggccgatggggccaaagaattaacaaaaataaattaattaataaatcaattatcattattttacatatgcacttgtactttttatcatgtttacttatttatttaattttttttttgcactgcacaattttatttttatttcaattttatttttatttcaattttatttttatttcaattttatttttattatcgattgcttttccttttttcttctccaagtgctttactttttattatgttagttttgtgtgtgttgctttttgcttctttttgttgtatttacaatttatgagtatttattattttaacattaagcgaaggcgacggcgttaattttaaaatttaacaacaaaaaaattctaacaaaaatgggtacgaattaggggtgtttcatgagacccaaaaatctctggaatccggaatttcgggtagaaaaagcctgaattatggaattatgatttgtaaccatccttggtatggttttttttagaaaaaatcctaagactggtgttccgtagcttattgttagcatttttttttcattttatgcaaaaagaatttgttccaggcgcccaaccattcgaacacgcaaaatccactgaaaagggtgaagaaagtgaggagaagcgagaggaatgggctcgtcgtgggcctgagggtgagttttccgaaaaattgtaaaaaatttcaggggcctagccttggttggggttagggtttaggcttcaccagttaaattaaatttgaaaaaatgggattctccaaatggaaaacgaaagcaaaaacttttaaaaaaatttcaattaaaatttttgtattttaaaaatttgtaaaatgttttttttacttttttaaaattctctaagcgtcgccatcgtttttttttttgaattttctgtgtctttgtcagatgtgcaacaaagtgagtcggtcgaggagggctttgggcctaccgacgacacgggcacaaccattgccaagaagcgcatgcacgtgctggccaccagccagtcccaagtgcaaggtgataaatatatctgtgaaaaattgtggtgaaaaaacccaattaattttgtgtggcgaagtgtcaattttttgtggttttttttttgtcttaaaaagggaaatcgaagtgtgaaggaaatttttcggaatttttattcttttctttttttttttttgtaaaactaattttttttattaatgcatattttattttatcccatttttcttgctacttgtgtgttagctgtgggcagattttcaaaaattttttttttgaga

SEQ ID NO: 77714 - DNA, 473 bp, Heterodera glycines
  Genomic contig location: Contig_ID=SeqID_2077; Location=25..497; Strand=-
  SCN-specific regions: Sequence locations=1-44,133-262,285-473
atgacagacagacaaacgaacggttggaaggacaagcaagaaacattttatttataaataaaataaaaatttttttttcttttttataaaattaatttatttttttattaattaatttttctaaaaaattttgtttcacggcaaattaaaaaaacaattaaaaattgcgttattaaaacaaaattaccgtcttcgcctcggtgttgctgctggaaaacaggaattccgctgggtgtgtgctgtggctggaaaccttcgaggccttaaaaatttttctaaattattttccattattcgaaagatggacgaaggcttcatcttttaatgaaaaaacatttattttcaatcagaatttaattataaattatggcaaagtgtcaattcaattacatttgtctgtttttatgatcatcctctgaatactgtaccgattattaagcgaatattaaagcgatagattagggataaataaa

SEQ ID NO: 77715 - DNA, 651 bp, Heterodera glycines
  Genomic contig location: Contig_ID=SeqID_2077; Location=2573..3223; Strand=-
  SCN-specific regions: Sequence locations=1-164,199-395,417-447,502-651
agctattaattttttatattgcttatgcttaattgagtttcactgttagactaatgaagacttccttaaaaaccaagaagaagcatctcataaatatttgggtacaaaagcggatctcaatcggtcatgaatttttagcgcaaaatatgaaaaatcatttactgtaattttaacataattaattaaattttaaataatgtaacttcggatcattaaaataattattttgcttttaatttgatcacttcacttttcgtacttcgccactaattgcactttttcgtacttcgtctcagtacgacacgaagcatttaaataccgtaaattttaaaaatatcattaaaaatggaaatgaattttcgaatattgaccatatatttataaaaatggaaagaggatcagataaaaatgaaacagtctgaaaaaaacaaaatgttagtgaacaacggaatcgaacccgcgctttaacacaatgcgtattacgctctaaccactgaactaccaacgctcaaaatttcgacagcttaattattacctaaatcgaaacacgtgaccatttcatacaaattaccttccagcttctcgctgcacaacttcgtccgcttcacgtcgcattgtgcgccgttcggcggtcgatggtcgccagccgaa

SEQ ID NO: 77716 - DNA, 3596 bp, Heterodera glycines
  Genomic contig location: Contig_ID=SeqID_2077; Location=2609..6204; Strand=+
  SCN-specific regions: Sequence locations=1-114,169-199,221-417,452 -648,797-1473,1495-1997,2020-2056,2103-2188,2258-2358,2405-2490,2512 -2627,2649-2853,2875-2931,2953-2969,3126-3228,3387-3486,3516-3596
  Gene Ontology: Mol. function=structural constituent of muscle; Cellular component=sarcomere; Biological process=embryogenesis and morphogenesis
atgcgacgtgaagcggacgaagttgtgcagcgagaagctggaaggtaatttgtatgaaatggtcacgtgtttcgatttaggtaataattaagctgtcgaaattttgagcgttggtagttcagtggttagagcgtaatacgcattgtgttaaagcgcgggttcgattccgttgttcactaacattttgtttttttcagactgtttcatttttatctgatcctctttccatttttataaatatatggtcaatattcgaaaattcatttccatttttaatgatatttttaaaatttacggtatttaaatgcttcgtgtcgtactgagacgaagtacgaaaaagtgcaattagtggcgaagtacgaaaagtgaagtgatcaaattaaaagcaaaataattattttaatgatccgaagttacattatttaaaatttaattaattatgttaaaattacagtaaatgatttttcatattttgcgctaaaaattcatgaccgattgagatccgcttttgtacccaaatatttatgagatgcttcttcttggtttttaaggaagtcttcattagtctaacagtgaaactcaattaagcataagcaatataaaaaattaatagcttttaaagcttttgtttcaccatataatataaagtttattttgcttttaatttttaaataattatttttctttttaatttttaaataattatttgcttttaattttcaaataattatttttcttttaattttttaaataattattttgcttttaattttcaaataattatttttgctttaataatttgatcacttgcactttttcatacttcgtcatagcaccgtatgatgtcataaaatttatatattcaattgaaatcttggattatgattccttcctgattacattttttgctttaacatttaataatgaaattttttattttagacaactcaaagctgaagacgaatctccaattagccccatcaaaggaacagacgaacaaattgtaacaattgtaacgcaaccgattgagtcacacgcggaggaattagcgacacaagcacaagcagtaccagcacaacaccaacagcacagacatggagaggaagaagaccatcaagcagtacaagaagaagaaccaaaacccgaaaaaattcgcaatgaaattgaaataattcaacaagaagccattgaaacgcctggatcagttgaagtgaaggaaattgaatcaccaaaattgatcagcagaattgagccgatcattacggtggaaccgccatccggagtttttgaagaatcgcctccagaaagtccaacacgcgatgaaatgaaaactgtgcaagccgaacaagctgaacgccatgacacggaggttgaaaagtacgttcctgaagaagaagaagcatttgaaaagcgtgttcctgaagagacttttgaaaaacgccttccggaagagatgattgaaaggcgcgtcccggaagagaaagaagcatttgaaaagggcgttccggaagaggaagcggaagaagaaacattcgaaaggcgtcttctggaaggagaaccgaaagaggaagaagctgttgaaaggcgtattccggaagaggcgtttgaaaggcttattcacgaagaggacaaaccgtttgaaaggcacgttccggaagagaaaggagcatttgaaggacatcgtgtggatgaagcatttgaaaaacgcttcccggaagaggaagaaatatctgaaatgcctttaactaaaatggaaaagccaacagatttgagtgtaaaagaggaagtagaatccgaacttgaaacaaaaacgcaaaaggaagttgaagcagtacctgaagaaccacatgtgaaaagtgaggctgttattggcaaatacctcccatttggggctgaaacgcccggaagggatgaaaaagcattggtggaagaggaggaaattgaacaaaaaggcacggaggaaattacgttaaaaggagctgaacggggtacttttgaatacaaaacaaaaagttttttgataaatatttttcatgtacacttttgtttttataggtttttaattattttatttttacatttttgaaattaaatatattttagcagagaaataacagaattccgtaaatgccgcactttttcgtaccgcaattttttttttttatagataaaacccagagaaatttggaattttattttttttaaaatggaaatcttattttttacgttttaaaaactaaaaaattaatttttattagagttgttaaaccaatccataaatagcaatttaacgtaatccgaaccctaatttttcctcctgatgatgcttattgacactcgaccaaaatcttttctctgatattttaaagaaaatttgtttaaaaatcaaaaaaaaatatttaatcttgaaaactaattgaggcctccgcttaacccttattagtgaataggattatcattccaatgattaaatgaattttgttgaaaatttagtgaattttttcaaaatttttaattgcaaattaatcattaaacaaacaaataaaaattgcagaaaaaccaaacaaatccaatctcgttgttggagcaaggaagcggaagaaacatatttcttcatcattaattccaataaaacagtggaagaagggcgacaaaaagttggcaaaaatgccaaaaatcgacgctgcttttaaaggagcaaaaaaatcctttattccaaagccaaaaaaagtggcaaaaattcaaaaacccaaagtgatgtcatgtcgcataaaactcgctgtaattaaaggtatttaaaagaataaaatgatgtgtgactgacccccttttatgcttcattttcgggctttccttctttatacattatgggaatttcgactcaccctaaatggatttcagttttttcgggttatggaattttcagcagcgattaatttcattctttttaacgggaattaatttaaaattttttatttttttcaatttattattatttcttccacttttccttttaagttttttcaaaatataatttattttaattacctattatcttcacttccatttgaatttttattttttttataaataatatcaatattaaacaattattttttataaaactttcattagcgatttttaattttggaatttttcagctcgaataatttgaatcttttttaaatttttttccttttggataaattaacagtataattttctcaatttattatttgtttttcttcaacttttcttttattttttatttaaaatatatttattttttaattaatatcttctttaatattaagttgattttcatattggatttttatttagtttttataaataatatcaatattaaacaatttattttttataaacctttctttagcaatttttaattttttttttctaatttcaattctttattttgtttcttcaaattcctttgggattttcgtttttttcaattcaaatctttaaacaacttttttctctttggactttcgtttatatttcttctccaaattagttcaattccaaaaattgcagaagagtcgtcacttggaacagacgttgtgaagaaatga

SEQ ID NO: 77717 - DNA, 1231 bp, Heterodera glycines
  Genomic contig location: Contig_ID=SeqID_2078; Location=347..1577; Strand=+
  SCN-specific regions: Sequence locations=1-119,154-210,233-485,507 -699,731-752,774-928,950-1231
atgactccggtggaacagcagattgagcaagaaatgccatcagttgttgagccatcgacaattgaacagcttcaacaaattcagggtcagcagcggttggatgaaacggaaaggtaggcataaatttagaattttattaattattattaaattgtttgtcgtttaaaattagaaaattttccagcaggacattattaggggaatttgttccaaaaatattcataatttttcattgttcgccaaaatatattcttataaataatgttaaaatgctttttttctccaatagtttataattttgaaaaaaattgattattttttttcaatttcatttagtccaatcactgaaattgctgaaaagaaggaagaagaagcaccgatgattcatgtgctgcatcaatcccaaactgaacataagccaattgtttggcttgaagaaacgccactggagcaggtgatagcattataaaaacgattttatattattctttttgaataaattttcattcgaatttcatgggttacttaatattaattagaaaaactggactaattttcagaaatttgctaaattttcgaaacacattttttttgggttaatcactcagttttccaaaaaacctaagatttccaacattaccacttgccaaatgtaattaaataaaaaaatgttctcttcaatttttgcattaaatacactatttaaatatctttaaattaaatatttattcggtttcaggcaccttatgaagctgaagatgttgcaaagctgcaagccctgcatggcgttcagagtgagtcagcagcacaacagccaaaggaggcgccagacgcaagcagttcaaccaaaccatggttttccgccgtaatcggcggaattgcgggcgctgtagctgcagtcggaatagcaaccgacaaagcaaaattgaatgaaaatggggaagaagaacaaattgaagcagtacaggaacggaatttggagttggaagacagtttggcatttgaggaccaacatcatccgactgaagaggaggtgaaatttccagaacacgtgaaaacggatgaggttccggaagacctgaggacagttgaggagtatccggaagacgtgagaactgaagaaataattccggaagagcatctggaaaacgtcgtttctattgcaaaccacccggaagaggagacaactccgaaacatgtgacagcagtgaaaagtttccggaagacgtga

SEQ ID NO: 77718 - DNA, 129 bp, Heterodera glycines
  Genomic contig location: Contig_ID=SeqID_13788; Location=3137..3265; Strand=+
  SCN-specific regions: Sequence locations=1-79,101-129
tatggcacggaaagacttccggtttccgacatttttggggtcggaattccgacttccgaaatttttgatgaaaagtcggaaatttttttaatttttttttcaaaaaactagtaagttttctacaatttc

SEQ ID NO: 77719 - DNA, 536 bp, Heterodera glycines
  Genomic contig location: Contig_ID=SeqID_13791; Location=106..641; Strand=+
  SCN-specific regions: Sequence locations=1-126,157-536
  Gene Ontology: Mol. function=protein tyrosine kinase activity; Cellular component=mitochondrial inner membrane; Biological process =transport
atgaacaacttcatcagtgccttttacgacgctgtgttgctgtatgcgattgcactgaacgaaacactggcggaggggttggacccgcgcaacggacaaagtatcacaaggtgtaacaatttcaactttttattttttaataattaaataaataatgaataagattctctattttttgtaacattttccaatttcagcaaaatgtggaaccgcacatttgtgggcatcaccggcaatgttagcattgataacaacggggaccgctactcggactactcattgttggacctggacccggatcaggacaaatttgtggtccgtttaatataaaatgattacacaatgacaatgattcatcctctattaaagcggcccttgacctctaagcactgaaaatttttcaaaaactttattttctgtgatattttctcgaaatattgctaaaaatgtactttttaagaattggaaatttatgccaaaaataagtcaaataatgaaaaattgttttcctttttactcagttttcttcaaaatga

SEQ ID NO: 77720 - DNA, 634 bp, Heterodera glycines
  Genomic contig location: Contig_ID=SeqID_13792; Location=710..1343; Strand=+
  SCN-specific regions: Sequence locations=1-125,147-191,264-293,349-634
atgacatggaaggtaaatcttctgaaacaaaaacaaaaaaaattttctagtcatttctaaagaattctttcacatatttttccttttttacattttcaaagaaaaaatttttcaaaatctaaagctttatttattttttattttttgattttcctaaaaaacctaagaaattaggaagctaaaaatttcggtttattaaagaattttgtatatatattttaaaattatatataaatattttcaaaaatcattaaaataaaaaagatgcaaggtttacctaatcaaaaaggaacatttatatgaaaataaataaaacaaaataagaaataaataaaaaattaaaaaaaacttcactggcagatcaaatgggaagagcttgacggcgaagatgttcgacgggagaagaagaaaaagcgacaacagaacagctcgacaaagttggcccgcttcgatgccgcggaacagtccgaggcgttgctgcgctgcaacagtcgcatgtccgtcggctcggacaaggtacagtaccgtctcgcattggaacttacgataaaatgaaactgtatgcatactgacgaaacccaactcttactgcaccgactcatattttttaagacatttgtcaaagttgaccaaa

SEQ ID NO: 77721 - DNA, 997 bp, Heterodera glycines
  Genomic contig location: Contig_ID=SeqID_13793; Location=8..1004; Strand=+
  SCN-specific regions: Sequence locations=1-5,46-221,243-270,416-997
atgaatttgttgtatttaatatttattcttattttctttatttttgtaattgactccgacaaaatgcgaccaaattttgatgaaatatttggcaacggatgggacaaaaaagaaagtgaacaaacagtgaaaattgaacaaaatgaacgaaatgagaattcacaatcagcagcagttgatcaaatgggtgaagaaatgggaaatgaccgaaatgatcaaatgaaaaatgatcacaaaaagagagaaataattcgaaaatttgaagcaattaaagaaaagttgaagcaaaaaggaaaatacgaaaacaaaaaccgaaccaaaattgagagaaaaattgcaaaattattaggagcaaagataacattaataagtaaatggaaaaatgaattaaatctaaataaaaataaaataaaaaaggaattttatgagatgaaaaagagtgaattcattgaacgatttgatgaatttaaagaattatatggccaaggcaaacagaaagaatttgcgaaggaattgggcatttctgaagacacatttcgaagatggaaaaaagaaatgctaccaaaataccataaaagtcaaagtaagaattattttagtgaaattaaattgtactttttctttaagaacaccataccaatgatgataaattgatgaagatgaagcaatattatgaaataaaagaagcaaacccaaaagtgactgacaaaataattgccaagaaattggggattggatggacaactctgaaaagatggaaaaaggaatgctctcatccaattgatcagtgatttttatttgatcatgattgttgatgaccatgaatagttttcgaaatttacaatatcatttagttgagactctaacctttttttagtttctttttatgtcatggtaaaaagattgtttttcaaaatgctggttcttacaaatgattaaacgatttgtgaaatcgaattaaaggaaaattattcttaaaattggttttcatttataa

SEQ ID NO: 77722 - DNA, 332 bp, Heterodera glycines
  Genomic contig location: Contig_ID=SeqID_13793; Location=775..1106; Strand=-
  SCN-specific regions: Sequence locations=1-93,121-332
ccttctaagaatttcgcccagaatttccgccaaattttttcaggaatttcataaaccaaagtagaattagtatatattactaagtttaatggttttatttatttataaatgaaaaccaattttaagaataattttcctttaattcgatttcacaaatcgtttaatcatttgtaagaaccagcattttgaaaaacaatctttttaccatgacataaaaagaaactaaaaaaaggttagagtctcaactaaatgatattgtaaatttcgaaaactattcatggtcatcaacaatcatgatcaaataaaaatcactgatcaattggatgagagca

SEQ ID NO: 77723 - DNA, 718 bp, Heterodera glycines
  Genomic contig location: Contig_ID=SeqID_13794; Location=823..1540; Strand=-
  SCN-specific regions: Sequence locations=1-5,27-393,415-513,557 -676,709-718
atgataaaaattgaacaaaatgaaaacagtgaagttgatcaattgggtgaagaaatggcaaatggtccaattgatcaaatgagaaattataccgatcagaaccattcgaaaagtgatcagaatattatagaagaaccaaatgatcagcaaaagagagaaattgttcaaaaatttgatgcaattagagaaaagttaagagaaaaaagaaattatcaatggaaaaacagagtcaaaattgagagaaaatttggaaaattattaggcgtaaatcgcaaaaaaaatttacaaatggaaaaaggaattaaatttaaacaaaaagaaaacctatagaatgaaaaagagtttttatgatgaaaaaagagcgaattcaatgaacgtttagatgaatttaaaagattatatggccaaggcaaacagaaagaatttgtgaaggaattgggcatttctgaaaaaacatttattaaatggaaaaaagaattgatgccaaattaccacaaaagtaaaggaataaggaataattaaatttttaattagtttaatcatttttattatttaagcacctaataaatattccaatgaggaccaattagaaaagatgaagcattattttgaaataaaagaagccaacccaaaagtgactgacgaaataattgccaaggaattgagaattggaattacaacactgatcagatggaaaaagaaatgcttatccatttga

SEQ ID NO: 77724 - DNA, 230 bp, Heterodera glycines
  Genomic contig location: Contig_ID=SeqID_13795; Location=1387..1616; Strand=-
  SCN-specific regions: Sequence locations=1-1,25-230
atgccttccccctttgttggcacattcactcatttgtcacgtaactgctcagcgttgggatgccaaagggacggacaaccgtttgatacaacggcaccgctaaagtgccaagttttgttttggcgccaatccgatggaaaagtgccgagggacactggttgtaaagttcggcaagtacaacatcaaattgttctgcttgaagacggcggagcaactcatcgtcatttcga

SEQ ID NO: 77725 - DNA, 329 bp, Heterodera glycines
  Genomic contig location: Contig_ID=SeqID_13795; Location=1922..2250; Strand=+
  SCN-specific regions: Sequence locations=1-329
atggcatttttggaagcatttgcccgcttttcgtactatgaatttatatggaaagttaaattgtcttatgaagatgccaaagtgtttgccaagtacaaaaatgtgaacccggtcaaatggatggaccaaaaatcgttgctaagtgagttaaaaaacgaaaaagtttgaaaattcagttaatcattgatcacttagtaataagttcactaaaattaattacccttaatttcggaggctttaaattttttcatattcggtcaatgcccaaattcttggtatcaaacgaaagctcaaagtctacagaaattttttatttagcgaattgcgga

SEQ ID NO: 77726 - DNA, 491 bp, Heterodera glycines
  Genomic contig location: Contig_ID=SeqID_13796; Location=419..909; Strand=+
  SCN-specific regions: Sequence locations=1-199,221-389,413-491
atgcaaattctccaacaaaaaactgggcctgagcccgccaatgtcgagctggtgttgacggaagatctgagcaacggtgcggaaccgtgcaaagtgcgtgtgctcaaccaggtcaatgcggagcagccgaaaccgttcgagtacatcaccagcagggagaatgcttcggatttggtaaaaaaaaatgagtttattacagtaggattgggcaaattttaaactaaattttcctaaaaatttcaaattttaacatctgttcattcaaggaagacgattgtgcgcacaagctttccaacattgcacgtccagacagcttctttcaggtggtaaatcggacaagcgatgtcatcatttatcaaaaaattttcattaccattaatatgcaatcgtaaaataaattaaaataatttttcgataattaaataaccgtttcgccacaatttaaaaaaaagaaaataatcatttttttcaaataagcaaaaaaaatagaa

SEQ ID NO: 77727 - DNA, 454 bp, Heterodera glycines
  misc_feature (107)..(107): n is a, c, g, or t
  Genomic contig location: Contig_ID=SeqID_13797; Location=1814..2267; Strand=-
  SCN-specific regions: Sequence locations=1-64,92-107,139-155,263 -263,295-301,330-454
aaatggcccacttggagctcaaacattcaacgctgggtttcagagtcaagcaaccctggcttcatacccatttagagtttgagaataggttaaggacatttcgtccncaagtcctctaatcattcgctttaccgagtataactgcttaacgagctccagctatcctgggggaaacttcggagggaaccagctactagatggttcgattagtctttcgcccctatacccaagtcagacgatcgatttgcacgtcagaatcgcttcggacttccaccagagtttcctctggcttcatcctgctcaggaatagttcaccatctttcgggtctcagcgcatacgctctgtctccgccccatcgcatgcgatcgagacgggactatgttgcgccccaacaccgcagtgccagggatcacacatcagctccgtaagaagccttcactttcattgcgcctt

SEQ ID NO: 77728 - DNA, 1316 bp, Heterodera glycines
  Genomic contig location: Contig_ID=SeqID_13798; Location=1..1316; Strand=-
  SCN-specific regions: Sequence locations=1-1316
aaaactgtgccaatttgttgtcagtcgcgtgatttggacctgtccgccgtcgatgccattttggtgtccaacacggcctctctcgtcgcgctgcctttttacaccgagggcaccggcttcactggcacagtttacgccaccgaccccacctaccaacttggcaaactggtcatggaagacttgtgcgacatgtttgagcgcgtcgaccgaccggctgaagacgtttcatgggcgtggaagacgctgtgccgatcgtttccaaacgcaccgctcagtgacccaaacgaatggaggacattttacacacgcgaaacgatggagaagagtttggcacgcattcggagagtgttcttccgcgaagaaattgtgcggctttgtttagtgcacatttggacatattgcccaattctccgttgaggtggtcaacggggagctgcgcgtgtccgccttcagcagcggctacgccatcggctccagcaattggctgttacagacggagcaccaccgcatcggctatttggcgccttcctctctgcgccattcgcacaccaaaccgatggaattgactgctttcggacagctcgactctctgctgatcacttccctgtctacggccgatcagacgcccgatttgaccgtattttgatcactttgagaccccttttagggctccgttctgcttaaaggtgtacaagttctcttctgcggtgattgaaacattgaaaatgggaggaaatgtgctgattccggtcactcccactgggttggtctacgacatgttcgaatgtgtgctgaaaacaatcgaattggtgagcgatggtcggggtttggttggcaattctatcattaattaaaacagcaaaatgtgtcccgcaacattcccatttacttcgtctccaccgtggccgaaagttcgctgcaatttgcgcagatttttcccgaatggttatccgaagacaaaagcagcagagtttacaagccggaagaacccttctttcactcagaggtggcaacactcgagacaatttccgtggcagtgaatcatttggccaaatttacgcactgcgcctccctaatatagccccccttgattaaatttgccatcgattgcttgtacatcttttattcacccgtttgccccttgtcagctcgcccgcactggtcgcattcgtgtctacgactctctccatgggcccttttcccgcgagtgtcgtcagccctgcgtggtgttcgccgtccatccgtcgttacgaattggcgaaattgtgcattgctcgatttgtggggtggatgtcgcgcatgccatcataatgatc

SEQ ID NO: 77729 - DNA, 1237 bp, Heterodera glycines
  Genomic contig location: Contig_ID=SeqID_13800; Location=348..1584; Strand=-
  SCN-specific regions: Sequence locations=1-253,275-532,554-574,596 -680,702-818,854-860,883-953,977-1039,1064-1156,1178-1237
atgccggtgccattgatcgaaccccggctaaccaccgccaactcaggtagaacgggatgacagaccaacacgggtgtgctgcactatcactttacatttctcaaaaatttcgaaaatcaagggctaaagcgagtcgaaaaaaactaacaaaccgtaataattaggccactttttggtttagaaatgtcgtggtgggtactttcggttttgtggccggatttgaaatcgttaaaaaaagcaacaactctttcaaaaaatttatcaaataaatttcacaacttttgttacccccccccccccccctcccgtttcaggcaatgtctatgtgtggggtgattttgaccaaccgttgcccggcatgccgccccaggggacgcacgtgcgcattttgcgtgtccgtaacttgaacatgactgggccacccaaatacgaccagcaaccgcagcagcagatgccgatgggcggcggaggaggctacggatggcaagcgcctcccggcggcgcgagcggagcgcccccgtacccagcggcgggtaaaacaaataattaattatgccaattatcagtaattaccctttcctcctcctgtgtgtgttaatagggtgaaactgaagacttggcgagttgtcaccatttctagcaatttaaaaaaaattcaactgaaaatccatccaaaaaatccaataatatgaactatttaagtcttggggtagagcactcggcaaattttaaatgtgttattccctctagcaaggcaatttcaaaaattatagcctataaaaattaatggcgtaattttgatgtctccattgtatcggttttgtttaattaaagttttttgtaaaaatatttggcacatttccctgcaggagggccggcacccggcggcggctacggatacggacaaggagcagctggtggtgcaccaccaccgccgtactcataccaacagaaacaataataataataataataagcgtccatgtctccgaagaggcaaagatggcatttcaaacggtgtcagaatgcgttggatttccttccatcatcttatgtaaacctgtcagatattatgaccgattaatataattttgactgattccccccccccccccccaccatttccatatcccaagatatatcacttcaaaatcgcaaaaattataatattatttatcgtaatcttaaagatttaatggtaaattgtatttttcaattttgagaatttggaaataaa

SEQ ID NO: 77730 - DNA, 1481 bp, Heterodera glycines
  misc_feature (1122)..(1122): n is a, c, g, or t
  misc_feature (1134)..(1134): n is a, c, g, or t
  misc_feature (1140)..(1140): n is a, c, g, or t
  misc_feature (1147)..(1147): n is a, c, g, or t
  misc_feature (1153)..(1153): n is a, c, g, or t
  misc_feature (1157)..(1157): n is a, c, g, or t
  misc_feature (1159)..(1159): n is a, c, g, or t
  misc_feature (1233)..(1233): n is a, c, g, or t
  misc_feature (1238)..(1238): n is a, c, g, or t
  misc_feature (1249)..(1249): n is a, c, g, or t
  misc_feature (1251)..(1251): n is a, c, g, or t
  misc_feature (1254)..(1254): n is a, c, g, or t
  misc_feature (1264)..(1267): n is a, c, g, or t
  misc_feature (1274)..(1274): n is a, c, g, or t
  misc_feature (1281)..(1281): n is a, c, g, or t
  misc_feature (1286)..(1286): n is a, c, g, or t
  misc_feature (1305)..(1305): n is a, c, g, or t
  misc_feature (1326)..(1327): n is a, c, g, or t
  misc_feature (1343)..(1343): n is a, c, g, or t
  misc_feature (1350)..(1350): n is a, c, g, or t
  misc_feature (1369)..(1371): n is a, c, g, or t
  misc_feature (1375)..(1375): n is a, c, g, or t
  misc_feature (1378)..(1378): n is a, c, g, or t
  misc_feature (1384)..(1384): n is a, c, g, or t
  misc_feature (1390)..(1390): n is a, c, g, or t
  Genomic contig location: Contig_ID=SeqID_13801; Location=1..1481; Strand=-
  SCN-specific regions: Sequence locations=1-122,144-150,172-384,412 -1481
aaaaatgcgaaattcgaaaattgaattttcaactttttgttcgaattcgggtcccggtttcggaattgttcgatatgaatgtcatattcgtgatcagtgaccccgaaaccccccccccccccaaaaaaaaaatttttttttatgtggcgtaaagtgaaaaagtacccatttttgacctaacaataaggcacaaattttcattaaaaatgaatttccattgtgtaggacgtgtcaaatttttgttcgcgttgaaagtgcagagccaagccggcggaaccgcatttgcattggtctcccaatccgaggactacggccaatatgtggtgggtggctagataaaaaaataatttatccggggtaaattaatcgctttgtctcctcccctaaaattttaaattttttttataattactaaccctttcctaaaatttctgagttttttatttatgcttcatatacttgtcataaggtcaaaaacaagccccaaaaaacttaaaaatgaaaatgcaaaattctggtcgctcccataatttcttttcgtgcatggggcgaaacgaaattttttgttttttgtattttaataccgtatttctcaataattcacagatgcatgtgtggcggttgaatttgagcgcggatggaatgcaaatggcgtccgagccggcctcgctgctgcaggcaccgcttgtcattgacgaggaatggatttgcacgatgcgcgaggacgcgcccgagttggtggtgagccaaaaaaaagaagcattttttttctttatttttccctgaaatttttttggaacggaattccgagagcccaaaagtcgaaaaccacccctcccacctcaattttctaaaaaaaaacaaacttttgtgaggttgtccatggccccggactgaatgtggtgcgagtgcatgccgatgcctatgggccccaacaaccgattgaccgcttcagtgtgcccggatcgcagctgtcccatttttatgacggatttctcagccgagggtaattaaaaaaaattctttcatcacccggctttgtgttcagaagtatttactttgtgtccgcttcaccggacggccattttggccacagccgtatccatgcactgaacctggatnctcgtggtccgntcgctncgctctntttgcncccngnccctctgcgtggcttccctgccgcgcgctggcgggcggctctcgtctcggtttcgggtgcgggttttgcggggnggcgnccggttgcggncnctngttttccctnnnngccgggntcggggncccgnccgggtcccgttcccgttntgggggggttgtggtgccccnntttttcgttcggtttnggctttnttctgttggccggcggtgnnnttgnttncggctncggctncgtggctcgcctggtaagtattgccgctcgaccttaccaacttcacgtcctagtgtaagcccgcccaaatgccggtgccatagatcgaacc

SEQ ID NO: 77731 - DNA, 492 bp, Heterodera glycines
  Genomic contig location: Contig_ID=SeqID_13802; Location=497..988; Strand=-
  SCN-specific regions: Sequence locations=1-112,134-286,309-319,345-492
atgtctgaaaaaagcatagtgagaccaggccaaaaggctgaaaaaatttttaattttgaggccagggcgcctcatttttctcttagccaaaaaaatttgttatctcatcagcaaaacaatttaatacattttatcgtgaaattagacagaaaataggttccaatatttaaacaaaaaacgagaaatactcaacaaaattgttataccgatcttataggttgacgaaaataaaatttcgttttagatttttccaaaaaaaaaaaaaaattgatttttaactcaataatcttattatttcatatttcagttatattttgagttgattttatttcttatttttggctgattttcttgaattaattacccgagattaattattacccataaaagcaattaaaaaattgacctttatctgcaatgaatttaattgcgaaatgacagccggactttctcttattctcagcgaaagtgtgacagcgaagatcaaataaa

SEQ ID NO: 77732 - DNA, 408 bp, Heterodera glycines
  Genomic contig location: Contig_ID=SeqID_13802; Location=1160..1567; Strand=+
  SCN-specific regions: Sequence locations=1-10,47-373,398-408
atggtaagacattttaattttcaattaataattaaacaatttttttgcctccttcaaaaggatttccacctgtcatttatttggcccttaacaaaacgatacgcgacgattgtcgcttactgtacatgaaactgttccagcggcaccgtatcgaaaagaagaatggtgttactgtacttgttaaagctgttcctacttgtccacaaaacattgcttcttcaccattgtagtatacaaattttgtttttcactggtcataaagtcggagagaagagatgggacaaatttcgagttcgaaaatttttggatctcctgagttccggtttctgaaattttttaagctaacttcgggattttttggaattcgatttggtttatttatttttttaatttaaaagcactgccaaa

SEQ ID NO: 77733 - DNA, 394 bp, Heterodera glycines
  Genomic contig location: Contig_ID=SeqID_13803; Location=599..992; Strand=-
  SCN-specific regions: Sequence locations=1-200,223-331,353-394
atgctatacattactcgtgaattaaatggccagtgtaagcatatgattaataacaaattatagcaaattattgattgacttttttacatttacccttttacaatttttttctagataagagcattttataattagataatgtaaatagaaaaaacgtaaaaatgtaaaaatataaaatttgtaaatggaaatccgttcattatatataatatgcatatttttgaatgtctaaacggtggaatgttgtgccaacaaaataatggaaaaccaacccaggtttcactcggtctccaaatgtttttttttgtcatttcatacatcatttcacatattttttctgttgagaatattttgttcatttagattaaggcttgttgggcataaacctaataaa

SEQ ID NO: 77734 - DNA, 357 bp, Heterodera glycines
  Genomic contig location: Contig_ID=SeqID_13803; Location=1546..1902; Strand=+
  SCN-specific regions: Sequence locations=1-121,154-247,269-280,304-357
atgtttttattccaattttcgccaatcatcatgatatttatgtttttgttgtgcccaagtgatcaaatgatgcaaggacgtaacggaataaacggtattgatattttaatgaatgcattgcaattaaaagaataaatttaaatatttattaaagatagttatgatacgggcccggatttatcttttttaaatgtttttttttgagaatattttatatgtatgaaaaactcataaatagcattgttaccagttttattttgaatcaaagcaagttattcgcaaaaaaataataatttttttttagacttttgtcttatactaaactattttgatgtattttttgcgatttttttttaa

SEQ ID NO: 77735 - DNA, 846 bp, Heterodera glycines
  Genomic contig location: Contig_ID=SeqID_13805; Location=638..1483; Strand=-
  SCN-specific regions: Sequence locations=1-69,91-574,598-846
atggaacgagcgatgcttccccggatggatcaatcggcgcctgcccgccagtgtcacggaggacttcaaccggtgccgcctctgcggtttggacgtacggcaaacatcgcggcacattgcggagtaccacctgaacatcccgctgcaccagtgtccattgtgcgagtacggcgcggccgaggcacggcttgtgcaacgacacatgcgcaacaatcacacgctgaaggaatgtgaggcaagagaacggacagacgaaagggtaaaaaagacaaagggacagacgaaatttaagggcatggaacccatcgccaacgtggagaagcacagagccgaattctcggagttgcacaaccaatgcttcccgggcagaccaaaacggttgtccaacattacaattgcggacgaaagcagaagggcaaagtgccgaggatgtgctcaggtgagagacagtgagggaggggggacaaattgccatttgatggggaaagggaaattggggcgtttccaaggaatgagaaaatggcatttccgtttccatccattcttttgagttcaaagcccccgccccgagactcatttttccaaattaaacttttgcccatctcagactatcagtaagaagcgtcgtctgctgcatttgctggagaagcatctgaagaagcccatctacaagtgcaagtactgcttgttcacctccacccacgacaaagcgacggtggacacccatcagaaggagaaacactcggggaaggcaccgcacgtgctgtccacgctgtccagacacaaagcggagctgaaaaggctggcgacggaatgcttcaacgagcccgacctcaagttggagga

SEQ ID NO: 77736 - DNA, 1308 bp, Heterodera glycines
  misc_feature (660)..(660): n is a, c, g, or t
  Genomic contig location: Contig_ID=SeqID_13806; Location=590..1897; Strand=-
  SCN-specific regions: Sequence locations=1-77,99-600,622-708,784 -862,884-943,965-1006,1029-1308
atggccctacgccgacgtgccgcgcttcgatggtcgactcaaaagcaattcgaaaggcgcactgtcaggtgagagacggagaaaacggcaaaatgaaaacgaaagggacaaacagacagcaaagttaaggtgtgcaatttggacatttgttcaaccgcacgacagcgacacgtttatatggtccatctgaagaagaaaggtgggccgggaaagtggcgaatgtggcacgggagggatttgttgtggggaaaagggttaactctgaactgctccatggggtggaagcatttttggattttgggaaaatagcaatttacagatttgttcaaatgcccccactgcgaatacacaaattcgaattccgtgtgggaagtgcaaaagcacagccgcgtgcagcacggcaaagacgcgcgaccgatcagtcaggaggagaagcacaagttggaaattcaggtgacaatgaagcgaatcaagcctcaatcgctgttttggtgtcccatcttaagatgtggagccaactttgtttccccgaatggaaacagaaacggaaaattgagcacggcgactcgacggaagaggagacagcgctgaaacggcgcagagagggcgaaggcggcgctgaagtggacgacttgttggagggatttggcgaactgttgnggcacattttgcagcagcaaaacgaagcgaaaaacacggaccaatagcggaggaggagggagaagaggaggacgaacagcagcaggaaagcggaacaacggaggagcagacggaggaggacgaatggcgggacaacgcgtcaccaagtgacaaagcgccgacaacggcggccgacgaatgcgctgcaggcaacgacagactttgccacctgtgcatgtgagtggtgccatggaaattgccgaccgaaacaaaacgccaaaatgggggatggcattttgaaagcgtgggaaagggaagaaaggaatttacgatgactcaaagcgaaaaccatcgaataattatgaaaaattgtgcagggaagagtccaaatacccgggacggcacattgcccagcgccatctgaagagaccgctctacgaatgcccaatttgtgccaaattcggcagctacgaaagttgcacagtgagcaaacacatcaacaaagtgcacccgaaggaggcgaagaatgcgatgccaataagcaatttggagaaatacgcggacgaaatcagagaattgcaggcactgactaaattaatggcatgccatttcctcacccattcacttgacactttctacagattcgctgcttccccaaccgacaaatga

SEQ ID NO: 77737 - DNA, 1127 bp, Heterodera glycines
  Genomic contig location: Contig_ID=SeqID_2079; Location=144..1270; Strand=-
  SCN-specific regions: Sequence locations=1-95,117-397,419-475,497 -536,573-596,619-678,700-944,966-1127
atgaattctgaaaaatcagaaaaagctaataccattttggtggaagctgcaaaaaaagagacagagagagcatggagggatgtagcggcgttagcagaagaagttggcgattttgccaagtcttctcgggaaacacttaatcaggcaataaaatctagagaaaaagctccttatgctaacggtgttcgagaattatatcttaaaatgtccgattcaatttgggaaattttcaaaatcgaggaccaaatcaatttggagtctgtaaaggctgaatctgcatggcgcgagttcgagagatgcaaaacttttgaccaggcaacaaaattcgaggaacaagcgcaaaattcgttaatggaagcccggagattacatttcgagtcccgaagggttcagagccaaatgttaaattatgaaaataggctcaaaacaattgtttgggagcacgttggtatataagaacaaaaaaataacgatataccaaaatggaaaattgtgccataattgagtcattatgtcatgaggacttaaaatttggctttaaaaaatataaaaccaaattttattttaaaaatcctttcctaattaatgcggaggaaaattttaaaaatatcctcgcatcaataatcgtaaaaatttataaaaatgaacaaggaaaattcaaaagcattctgaagatttcttttggttttgaatcattttattgccctcttagatgccctagtgaaaacacagccgaggctttgttccaacatgtcctattaaaagaagaattatattcgcttttctatcctttggatgatgtcataacactagaagtaactataatcccagatgtcgacaatagaccaagaaattaattttataaaaaacaaaattacgagaaattggaaaatttctggaaaaatacttaaacgatcaattaatctcgaaatttttgcaaatatgctttttaaacgggtgaaaaatttctacataacagcatttagtgcacctggaatggaaaatttatatttttcattcttagaaatgctcgaaaaaattcaaaaactacctaaacttattatgcatgagtatagaaaccaagcattagctatgcaaaaaatagaaattggactcaaagaaataaa

SEQ ID NO: 77738 - DNA, 674 bp, Heterodera glycines
  Genomic contig location: Contig_ID=SeqID_2079; Location=2256..2929; Strand=-
  SCN-specific regions: Sequence locations=1-606,644-674
atgtactcgtttcaaaaatattttgaggaggctctcgaaaaagaagcgtttttttggccaaaaaacagagaggaagttgaggcattgttatttgactcatcagattataaaatagcaatacacagagactacgacagcgcttattcagattatataactatgtataatcgcacctcaattttttgtttcaccatggttgagagaaatgtgagatattttcatgactcgggaagagggacgcctatcggaaggtttacaactgtgctaaatgttacggtgcaggcgaattatacgggagaggggtacatggcaccagcgttttacttttggttctattgggaaggcagaagccaaacaaccaacgcatccttcaggagccgtttttttttatattgcgtttccgcgttgagagtgatgggcaaagcctggggcagagagctacttttgacccctgttgaggtcttaattgacatcttctaccaccgtatagataggtcagaacatagaaaaaacaaattttcaaaaaatattttagagagttggttggaacatgggcgctactctatagacttccaccttcactttttaacacttcacggcgggtggttgctgagaaggcaatggaagaatttttaaaattaccatcattttttcgcatgattttttataataaa

SEQ ID NO: 77739 - DNA, 468 bp, Heterodera glycines
  Genomic contig location: Contig_ID=SeqID_2079; Location=3018..3485; Strand=-
  SCN-specific regions: Sequence locations=1-81,108-130,152-468
atgtcaaagaaaaatttccaagaaacttcaaaagaaattcgccgctcgaaaaatacaaaaaattatttcaagaacagtgctaatttgggaaaatgttttgaagaagtggaaagtcacacaaacgaaaataaaaaatttgggataaaagaacatgtgactactttctattttaagtgcccagaaaacgaagaccccgaacaaatgtttaaaaaaatcctgaaaaaattaatgacggatgcgatgaaccgtgaagctgagccggactggaaaattgagaaaatttcagtcgatctgtattgcagtgccctgtcggacccagtgatcatccctgcccgccccttccaacattcgaacccagacattgttttcaatgagttcatgcacagacagcaatcatttggggaagtgaatttgttggaccagagaatttcgataattattgccacttattcctttcctgttaaataa

SEQ ID NO: 77740 - DNA, 3045 bp, Heterodera glycines
  Genomic contig location: Contig_ID=SeqID_2079; Location=4044..7088; Strand=-
  SCN-specific regions: Sequence locations=1-124,146-506,528-743,765 -767,789-1041,1064-1538,1561-1839,1877-1911,1933-2571,2593-2817,2840 -3045
atggttttagaattgatggaaaaggcagggattagcatgggcgacaaaacatttggtatccaacaacttgaggctgtacaaaagttttgggacgcccaatacccggacaactttcgcatcgttgcttttgaaatggtaaataaattcgcttgaaaaaatataccggtacatcttttttagaagacccgacttaagccaattttcaaaggggaaggtgttcgaagaaatgaagtttgtgtgataagagaaggcaatcactgggatgggatcaaatcggcttcctggttttttggtgttcgcaatttttgtgtggcttgtgaggtgacatatgatcgaactgaacggcaccggatggaatgcaaggaccgctgtaagaagtgctgtcggatggggtttggctttccatgcgtggatgtctgtgatgagattcactgcggcgaatgtaatctcaagttctacaaccgggaatgctttgaagcgcacaagaagatggcttgtaaagagtacaagaaatgtgaaaaatgtggagaagtctaccaaacacgttcaaaacacgtctgtggggaaaaattttgtaaaatctgcaaagttaaccatcctggtcgtcaatgtttcatcaaaccgattaaagtgcggccgcagaaagcatatagaattgtggcatacgacctggaaacgacagtagatgggggagaacaccggcctaatcttgttagtgcctcacatacttgtagtatttgtgcgggagaagagcgggaatgtgagatttgcgaaggccccaagaaaatcacatggtcagtagcggatggttttgacccaatgagcgagtttgttgcctggataatgggttttcaacgatttgaaacggttgcttttgcgcattatgctgggaggttcgattcccactttgttttgtccgagctaacaaagaaggaaattgcgacggagctgatgatggcagatttgaagatttatcaaatcaaggctggaaaagtgtatttccgggatttctggatgcttagtcagaacaagttgggggatctcccaaagaccttgggactgaacatcgcggccaagttgtattttcctcacaaatacaacaaaaatgagaactttgggaagagattgtcacacctgccgccacttggagactattgccccgacagcatgaaagaggaggaagcggcaaaattggaagcatggcacaatgagaattttcaaacagaatttgaattaggtaaaactaaaaatatgggatttttaatttaaataggttttaggggagcagcttagggtgtattgcgaaaacgacgtggaaattctcatggcggctattttgaagttccggcagttgtttttggggataacaggagatttggatgtcatgaaggacagtgtcacaatcgcgggtgtctttatgaagatcttcagggcaaaattcttgaaggacaggcacattccgattatgcccgagggagggtacgagagagctgagaatcagagcaaaattgcagtgaaatattttgagtggctggcacaaagaaaaggagtaaaagtgcggcatgcgtgtaacggaggagaagtggaatttggggggctgaaagtggactgtgtgattggggcagagaaaaagattattgagtttcaggtgaaagaaaaagaattttttctttttaacaattcttaaggggtgtgcgtttcacggatgttcgagatgttttttgccctggacgatagcgccaaacggacggacaatggaagagaaccgcagtagaacggaaattcgcatggaaaatttgagggaaaaatgcaaaaatttttcaatcggagaagtttgggtaaaataaatatctagaaatattttatttatttttttgtttataggagtgtgacgtgagtgaggaattgaagaaaaataaggagatgaaaaaattctttgaaagtgtgccagacaagggaccgatcaatccaagggatgcttacgccggggggagaacgatgccgttttgtttgtacgcaaaggctacggaagaaatggaaatatcaatgttcgacatcatcagtttatacccctttgttaattacggtaaaaaaatctgattaattaaaaaaaatttcctcgcttaagacaccccataccccgtcggggtcccgaaaattgtagtcagcaggaatttcaatgtgaattggacggtgcccgacgatgttccctatgatggccttttgaaagtaaaagtcatcccaccgaaaaatcttttgtaccccctcctcccaatgcacatcgatgacatgctcctcttccccaattgttgggcttgtgcaaaaagggccaagaatgagtttgtgatggcaaaagatgtaaagaaatgcaaccaccggccagcgcagagagcatttttgggaacgttcacatcaattgagttgcggaaggctttagagctgggatatagggtcacaggcttctatcgggcctatcattttgagcagtttgaccgccaactgttcaaaggatatgtgcggatgtttttgaagataaaggtggaagcgtcggggtggccgacggaggtgaagagtgaggaggaaaagagagcattcctcgagatgtataaggcaaaatatgacattaatttggattacgataaaattggactcaatcctgggttaagaatgattgcgaaattggtgagaaattatcaaaaatatcgaaaaattgttcaattttagggattaaacagtttgtggggcaaattttcaatgcgtaataccctttcaaatacggaaattgtggggagtatggaacgttggatggaattgggaagagataatacaattgaatttgggcgcccagtaaaaataagcgaagagctatcccgggtggtttaccggaaaaaggaggcgttcatcaaagagcataaagtgtcaaatattgttttgtccttgtggaccactagtgcagcaaggataaagctgtacgagtacatggagcaagtctacagggaggaggggtctaagctgctgtattgtgatacaggtcggcaggaataa

SEQ ID NO: 77741 - DNA, 1187 bp, Heterodera glycines
  Genomic contig location: Contig_ID=SeqID_2079; Location=7445..8631; Strand=-
  SCN-specific regions: Sequence locations=1-80,102-642,667-706,728 -980,1002-1115,1137-1187
atgcaacaaccactgccgctgagagctttgccgcaatttggcatccctccgccaaacgtgccggtaattagggactcgttttttgttgctttttctcaaattcccgagtgctttttcaggctgttcgtgtccaaccacagccgctgagagactttccgccaattcaccatccgccacgaaatgtgacatcaatttggatcaaattgtggttgcttttcctcagtctctgggtgtttcttcaggcaattcatgttcggcaaattcaacgcgaatacgccgtaccacaatttgcccatccgccgcgaaacgtgccgtatcatccacccgaaaacgttccggtaatgttgggtcttgttttcgtgcgtttctcatattttccggatgtttcttcaggacattcaaccagtacaaccatggcaacgaccgcggcagctgagagacgtgccactattcgtccaaccgttgccaaatggaccggtaatttccgaccctgtcttttacctaacaccaaaacatcttttcttaagccaattcatcccaaccctccgagagtgctggaagtgatccgacggctgggagagtggagaggaagaccaagggacccaagacgtccgcctcaatgaatgaatggaattctgataaaatttgttgtttttaaattttttgtaatgataagggtttaatcccattacctaactttttttttgaaaattaacaaaatttaagaaattagatgcaaaacctaacattagacaaagattacgagcaaatgaaaagaaatgacaaaattttcggaatgcttctttttgttatttatggactttactttttgtgttttatttttgcattaataaggtgttgtcgacacggttaattcttcatttgaaaatcatttaaaatttgctataaccccttttttgaaaattcaccaacattatgccctgtccgctccccgccgaattgatcaaggaaataattgatgctcttccccctccaaaaacacatcgactgctgtgcataaattttgttttggcatcctttgttaaatgtcggttttattccatgatgagaagattgtttcgctcagatcatattttaatgccaatggcccgaagaactggaatttatttatttttcgatgtttttattccccacacaactcatccaggatataaaatttaaataaa

SEQ ID NO: 77742 - DNA, 1063 bp, Heterodera glycines
  misc_feature (956)..(956): n is a, c, g, or t
  misc_feature (1055)..(1055): n is a, c, g, or t
  Genomic contig location: Contig_ID=SeqID_2080; Location=58..1120; Strand=-
  SCN-specific regions: Sequence locations=1-661,683-1063
atgttccccgatgacgatgggtacgaatcggaagatgatgaaattctcttgccacctccgccgatccccccgcaacttggccaccctccgccaaatgtgccggtaatttcggttcgcttttcgttgctttttctcaaatttcagagtgcttttttcaggctgttcgtgttcagccaatacatgttgggcagcagcgtctgcctctgagagacttgccacaattcgattaccatccgcaaaatgtgccggtaattttgggtccattttagctgctttttctcaaatttctgagtgctttttttcaggctgttcgggtccaacaaccgataccactgagagacctgccgcaaatccaccaccctcccccaaatgtgccggtaattttggtctcgttttttttgttcttttcgtaaattcccgagtgtttgcaggtaattcgggtccaacaagtacatcaaccagtgccgctgagagctttgccgcaaatccatcaccctccaccaaacgtgccggtaatttgggactcggttttgtttctttttcgcaaatttgcgagtgctttttaggcaattcgggtgggaatgcaacaaccactgccgctgagagctttgccgcaatttggcatccctccgccaaacgtgccggtaattagggactcgttttttgttgctttttctcaaattcccgagtgctttttcaggctgttcgtgtccaaccacagccgctgagagactttccgccaattcaccatccgccacgaaatgtaacatcaatttggatcaaattgtggttgcttttcctcagtctctgggtgtttcttcaggcaattcatgttcggcaaattcaacgcgaatacgccgtaccacaatttgcccatccgccgcgaaacgtgccgtataatccacccgaaaacgttccggtaatgttgggtcttgttttcgtgcgtttctcatatnttccggatgtttcttcaggacattcaaccagtacaaccatggcaacgaccgcggcagctgagagacgtgccactattcgtccaaccgttgcccaatggnaccggtaa

SEQ ID NO: 77743 - DNA, 755 bp, Heterodera glycines
  Genomic contig location: Contig_ID=SeqID_13807; Location=32..786; Strand=+
  SCN-specific regions: Sequence locations=1-69,95-256,313-439,470 -628,650-755
atggaaattgaaaatgtaggtgaaaagtatcctttcaacttaaataagtaccggatttaatgataatggtaattttattaaatatttatttattgtgcagaaaattggtcttgtaaaagttcggcaacacttcgaattgtttcacaaaagaatggcacggaggatttaattggaagaattggtgatcgcatttttaataaggaatggagcatttatggatttaattatttcattagttttgcggtgagtgggattcaaataaatttaataaacttcatattttaaaattaaaatttttaaaattttaaaaaagaaagtgacaaaaaattgaatagaattttttgaaattttttggttataactctttgtaaatttttttctagatcatcgtttaatttaatttaactaaatttaagctaagttatggtttcttattagcaataaattaaaactaataataaatttaaatgtttctatcattgacacttttgtaactttggctcaccatgattttatattacataattgatttaaaattaaagttataatcgtaaacattgctgattttcatgttaaaaaaaaataattacaatatttgtcaaatttttgcatctccaaataaatcactaaaaattaaggaattgttggatccgggcaaaggattttacgacaaagatgaggacaaagtcacattggccattgatgtcaacgatgcaacgccgatttggggttggaacgatttcatttcatttttg

SEQ ID NO: 77744 - DNA, 75 bp, Heterodera glycines
  Genomic contig location: Contig_ID=SeqID_13807; Location=842..916; Strand=+
  SCN-specific regions: Sequence locations=1-75
gaattaatggacccaagcaaagggttgtacaacaaagacgaggacaacgtcaccttggcaattgattttacatgt

SEQ ID NO: 77745 - DNA, 1898 bp, Heterodera glycines
  Genomic contig location: Contig_ID=SeqID_13809; Location=73..1970; Strand=-
  SCN-specific regions: Sequence locations=1-16,40-164,188-402,424 -685,707-1150,1172-1792,1834-1898
atgaaccagcagcaacaaattaaaacaaaacgaaacaaagttaagttggaacatgacggcgcgctctatgttttcgaccaattgagcgcagatggacttaagaaattttggcgatgtgagtttcatggcccgtcagacaaatgcaagggtatgttaatatattattttgaattttgcaaatcttttaaaattcagggcgtttgcacacggatttaaataacgttgtgcagaagttggtcggagttcattcgagcgacatgaatgctgcgcatgtggaatgtcagcgacttgtaactggactcaagcgacgtgctgctgagacgtgcgaggcacctgcgactattcgtgctcaagtgctgcaaaacacatgcacacctgtgctagcagcttttccgagcaaaagcgccacaaaaaagtgggtttatatccaaaaacaattttgttatttttttgttttttaggtaatcaaacgattgcgccgtgatgaaaatgcaccgcggaccgaacctctcaatttggagcagttggaaattccaaatacctatcgtatttacaagcgaactgaaattgacgaggaacaatttctattggcggacaccggcgtttttcaaattcaaggacaaaatggacctcaacggtgagacatcatttatacattaaatgctgatcattgaaccggtattaaggattctcatttttggaagagtttctacggcggattgggcccatcagatgagtgacatttacgcggacggcacgttttcattgacgccaccgcttttcagccaaatttatgtgttgttggcaaagtaaagttaattgtgttatcacaatgttcaatctttttaggagagatggttgggtatttccaatttgctactgtcttttaacatcgaagtgtgccgcaatttatacgcgcatgttacagcttcttttggaacgatggccgaatttcgcgccgcagacaatttcgatggacttcgagttggcaatggtcggtgcggtccgcacagtgcttccggcatgcagtgtccgctactgtttttttcaccttgtccgcaacatgaagaggcagatcagaatccttggcctcacacatgtcaattgaatttttcagatgataaatttttttcttagtagtttaggcttacaacactgatcctgctttcgccgagaagtctaagatgatcacttcattggcctttctgcctgtgcaccaccttcaaaatggccttaatgttcttcgagcacaaattccaccacaacttaacggcgttttcaattggttaagtccgaaggcgaattttatgatttttttatttttctaggtttttggacaactacatgggccgaatgcgtttcaatgttccaatggcggcgcctctgttccacccgcacgaatggaatgttcatcagcgcaccttagatggtgctgatcgtaccaacaacttcgccgaggcattccatcgcaaacttcagcggcaatttagctgcactcatccaacaatttggcgcttcattgacacgatcagatgtgagcagaaggcaattgacgcggacatttcacgttgtgtcatgggagaatccgctccacaaaagaaaaagaagtatcgcgaagccgacgcacggattctccgactcgtccaccgttataacgaaatcaataacattcacctccctcaaaatgatcacaattatgccaatgccaatgtgaatcccgaaaacattatcaattttctcactggtgtttcccgaaactatgaaatgcgaccttagtttgttctgaaatttgttattttttgttatatttttataaaattttaattattttttccgtttgatgcacatccgaccaaactgacaaattattgtagaaaatactagccgcaagaaataaa

SEQ ID NO: 77746 - DNA, 1003 bp, Heterodera glycines
  Genomic contig location: Contig_ID=SeqID_13810; Location=170..1172; Strand=-
  SCN-specific regions: Sequence locations=1-771,810-1003
  Gene Ontology: Mol. function=ryanodine-sensitive calcium-release channel activity; Cellular component=integral to membrane; Biological process=calcium ion transport
atgccgtttaaagtgcccgttatgccctcctccggccccggccgtcagccgaccattaaacgcggtccgtcgcctctcaaaaagcgttttatcagctcaaagaagcgtcacccgttggaatcggccaattccggcctttccgccgcccaaattgcgcgcactcaatcagtgcttgctccaatgagctcaagcgcttttatgcagcagttggaacagcaacaaatgagcgacagcggaggcattggccaaaggctttcattgggcacgggggaggagggggggccggtgctggacgatgtgcaggccatgcaagagatgggagaccaggtaaagcgaaggaggaggaggcaacagcggaggaagggataaagcgaaggggaaggcggtgccaaatgggcgggggaagggagggaactgatggacaaagaggggggggggggtgacgaaacaggcagatcggaaatggaaaatgggaacaatggggaaaagcaaccgaacaaagggcggggccaatatttcctgcaatttcagatcgacgagtattactacggcgtgcggattttccctggccaggacctttccaatgtttgggtcggttgggtgacgccccaattccacgcttatgacaaattattcgacgcaaatgcatcggtgcgcaagtgccggtacgcggaattggaccagcacggaatcacggcggaaaggtctaaaaatggcacaattagtgggggaagggcaaagtgttttttaattcggcacttttgggagtgaccaaaagaagaaaaatgaaaagggaaacaaaacatttttgctgttcagcaccgaatatcgcaactgttacatgcttaacgcggtggaactgctcaatgcggtggcggacgtgagcaacaccaaagtgtccgggctgcaggtgattgaatatcagtgggaatgcaatcagcccaatgataaaagccttttgcatgaaatgccaaaggcattccgccgtttggccatccattaa

SEQ ID NO: 77747 - DNA, 620 bp, Heterodera glycines
  Genomic contig location: Contig_ID=SeqID_13811; Location=1079..1698; Strand=-
  SCN-specific regions: Sequence locations=1-410,498-620
  Gene Ontology: Mol. function=ryanodine-sensitive calcium-release channel activity; Cellular component=integral to membrane; Biological process=calcium ion transport
atgactttggccgccggccaacgcggcaaattcaattttggccaagactcaaactctctgaagttcttcaccacgtgcggccttcaggagggctatgagcccttttgcgtgaacatgttccgcacgatgcccttttggtacgccaaacgattgccacgcttcgaggaaatcgatgaacgatcgaaattggacgtgcagcgattgccggcaacggcgacgatgccgccatgtttaaaattgtgccaaaagacggggagcaacgatggcacggggggacaacaggaaaagacgcgcatggaattcattcggctgtcccttccggtgaactgcaacagagtgtttgtgaagaataagtgagtaaaggcaatttgagaaagcgaaatacgaggctaaaaagcaattaatcactcactgattgattgacaaattagagattaattgcttagtcattgatggcttaaccaattagtgattaattggttggtcaatcgattgatcacttcagggagaaggaggcattgcgttcacggatggaggaactccaacaacgccgaaatgcatctttgtcctcaattttaaaggggaaagagccggaggaagaacggccgagggttcgttag

SEQ ID NO: 77748 - DNA, 1348 bp, Heterodera glycines
  Genomic contig location: Contig_ID=SeqID_13813; Location=1267..2614; Strand=+
  SCN-specific regions: Sequence locations=1-46,68-125,147-248,270 -460,482-579,604-1348
  Gene Ontology: Cellular component=synaptic junction; Biological process=protein targeting
atgaacgacccgcgcaacggacaacaatttgcactgctgatcgcaattatgaaaggacacacagaaattgctgcacttttggtgggcacaattttcgggaccaacaactcaacaataataaattttgcacatttttcagttggagaaaggcgcggacgtgcatcagaccaccgttcgccaagtgaaccatgtgaacatgggtgagaaatgcgttttgcggacccaattgttgctgatgcctaattcatccctttttcgccccattttcagccgttacgcccctgtgggttgctgtcaatatgcgccagttggagatgtgccgtgtgctgatcgctcatggtgccaacgtggacttgggaagtgacgcctccttgacgccgctactgctcgcatgtgacaaaggcagcacagaaatcggtgaatcaatcgtccggaataatttctcatcagcactttttcaccattttcagtcacccttctcgtggagaatggcgccgacgtcaatctcggggacagcgaaggaatgatgccgttaatggtcatttgccgtgccggaagggtgaaaaaaagcaaaacttggaaaaacttggcatttttcatttgttcagatcgaacttgcgcgcttcttactttctcacggtgcaaacgttgaacagatggataacagcggtgggtgcccgtttttaaataattattgcactaattaatatgtctttttcaatttcagggatgcgatttgctcttttgtacgccgcctctaagggccatttggaggtgtgccgtttactggtggaagaatgggcagctgacgtcaatcagcaagcgaccgacggcatcaccgctttgatgggcgcgtgcatccgcggacgcttggacattagtaagaagcaattggtacaaaagccgattcattctctctcccaattttcagccgtttttctcatcgaacatggcgcccacattgaccacgctgacatggacgggtacaacgcgttgatgtgggcagtgaagcaaaaaaagactgaagtggcgcgtcatttgctggcaatcggcgcgaacgcagaccaagtgggaattgacggtgggtgggcccaaaaagggcttaattgtgatgcttcaattgactgctctcccccgccccctttttaaggcaaaagagcgagggatttggcccgagaaagcagacgtgccgaattgattgacctttttcgcaccacagctaacaatgagcagcgggaggatggcaatgcgtaagaaaaaaaaggaatttctgttcaaaaattatttatgatttttcaggcagcaggacgagcaaccgcagcagcagaaagaaatgccatgtaattga

SEQ ID NO: 77749 - DNA, 981 bp, Heterodera glycines
  misc_feature (755)..(755): n is a, c, g, or t
  Genomic contig location: Contig_ID=SeqID_13814; Location=54..1034; Strand=+
  SCN-specific regions: Sequence locations=1-311,333-486,508-882,914-981
taatagagataaaaaatgggaaaaagaaactgtttgaaaacaaaagaaagagaacagtgaaatatttaaagatcaatgacgtggacaaccccaaagagacaggtgcgaaaacggaaaattaagcaaatgtccaattaattaatttacataatttgaggtttttcttcattaaaaattgcagctccgttaattgccaataatcaaatgccaactcaatcaaagggaaagagttctttgttaaaacgttatttggagaacaaggaaaaatttccaagacgaactctgagaggacacgcgaaagatttgtgtgtgaaattgaaaacattgaaaaatgtgaggaataaattgaagaacaaaacgcactgtgagttaaaatatttgtcaaaaatcatttaattgtgctattaactgttttcactttcattaattagtcagggctcccattcgccaagaaattctaagtcgtcaagaaaaattgacctttttgctaaattcttcaaaatttctaggcagcatttgagtatcgcaggaaccaaaattttctgttttaataaatagatccaaaaatcctataataatcttttggccaaaatttcttagcaattgggcataaattttcaaaagtccggcggaacttgccggcaacgctctctgttcgcccttaaaacaaaaaaaaaagtgcggcaaaaatttaaaactctttgaaactaagaaaggttctaaatgcaaaatgtttgccacatatattttatganagcattacttcttctttaagcgactttttgagggtaaaaatgtttttattgggggccaaattcttagatttaaacccttttaatgcttatatatttttttaagaaacaacctttaattgttgcattattcagacacaaaagaagaaatttgcaaaaaagaggcatttgtgatagaggatttttgagagtgaaaaaggaatattttgaaaggaaaccgaatggcaca

SEQ ID NO: 77750 - DNA, 1913 bp, Heterodera glycines
  Genomic contig location: Contig_ID=SeqID_13814; Location=2226..4138; Strand=-
  SCN-specific regions: Sequence locations=1-205,229-791,817-874,897 -927,966-1163,1186-1249,1278-1309,1332-1351,1374-1523,1570-1628,1688 -1698,1720-1913
  Gene Ontology: Mol. function=microtubule motor activity; Cellular component=kinesin complex; Biological process=vesicle-mediated transport
atgtacaaggacaaggaggacccattgctgcacgtgtacacgtccacgcaggagaagctggacgcattggtgcagcaatacaaccaggagaagcagaaggtgggccaaacggacgaaaagacactaataaacatggaaaattatgaacatttattcaaaagcaaaatagcggaggactcctaaatttcgtctaaagatgccccataaaacatttaatgaaaaaaggagtagcaaagatttcaagaatggtttttgagaaaataagttcaggaggaggcgggatatttattttgtaccttatacaaaaaatggttaattacctttctcaaaaaggtgcaagcgttggaaagcgacatgcacgacctatccagcgagttcgagctgaacagactggactacttggagaccattcgcaagcaggaccagcagctgaaactgttccatcagattttggagagaattcagcccgccattcacaaggacagcaactacgcgaacattgagcgggtgaagcgcgaagcggcgtggaacatcgaggcggagcaatggacactgcccgagctgacgtttcgccaagcgctgccgagcgcaagcgcaggtgggacggaagagggcacaacaacggaagaaaaagcattggcacagcgaaaagggtgcgggtggctgactttgtgcttcttctcaagagtcttagcccgggaaactctcgggatttagactttggttttgaatctcggcaatttcttatcatcacaatatatcagcattctttgccattaattatttggagcataaaataattaaaattttattttagtgtcacaaaatgcaaaaaatgggctgaaaaatggacaaatggaaaagagtgaacttcagaacgaaccagaggaggaggaatcgaggctaaagaaggtaaaattgacaaaataaccaagaaatttgaaaaatattttttctttaaatttagcgattgaatgaaagcatggacaatgactttgtgcaaaggtactttaagccaatcagccgacaaaacattttggacaaatacgacccggagaagcaccggatgttaggtggaaggaattgcaataaaaatatcaattactattaataaggagatctatttggtcttttagcaactgtttttacagttttcgaaaatttgtaaaatcccaatttttaataagtttcataaaatatcgcccattattatagatctttctgaacttttacattttgaataaaaagctaattttttttaataagaaattttaaaacaaagaaaaatgtgcaagagagcacaacaccgataaaaaatattttaatattttgtcgagcattttagaagcgaagaaagttgccgaattcaaaaagcggaatcaatttgcgtcgggagttgtttacacagacgcactctacggaaatggtaaaaaaataaatatagtaaagcatttgctaaattagtaagaggaacagattgtttcctactcataaaaaattaaggctttaattgcaaaaaagtcataatttttacatattattttaatattttataattttttattaaatcggcttattttgctcaccgtcaatggacgattaatttcttgaaacctaagctataagccaaattatttatgtaaaatttaaagattaaaatattaaaaatgtaaattcttttaaatttgcatttcgcccaaaaatgcatttatttttaagagaattggcaacaacaaaatggcacaaaacagtccaaaatgccgagtaatcatcaaagaaatgggacttcaaaggccggcaccagcgatgcttcgcccgcggtgggcgtaaatcggccgatcagcggaatgcagcgcaagccaccaccacggcttgaagcaatccaagtggtgcgaaacaaatcgttcacatga

SEQ ID NO: 77751 - DNA, 467 bp, Heterodera glycines
  Genomic contig location: Contig_ID=SeqID_13814; Location=1496..1962; Strand=-
  SCN-specific regions: Sequence locations=1-86,109-142,202-244,277-405
atgtgtatttttgatgaattgaataaaacagtaagtgatttattgctctttttcaaaatttagtttttgaggcagaaaatcactaataaaaaacccccaatttccttgtaatacgatgtacaatatttcttttccaaaaatcttaatttttgttatattttaattgtaaatgaaattattaaatattttaaaagtttttttgaataaggacaaatttttatgaagaaaaaaatattttagggaatcatatttggaattttcttttcaattcttggggtgtattttctgaaatttttgggtcatttattaacgtaccaggtgttttcgacagtagttgattttgacagtgattggtttcgacagtagttttaaattcttttttctatataatttactgtacatatgaattaatatttaaatataatttgtataaacgaaatttataatttaagtaataatgaattaaa

SEQ ID NO: 77752 - DNA, 1474 bp, Heterodera glycines
  Genomic contig location: Contig_ID=SeqID_13816; Location=627..2100; Strand=-
  SCN-specific regions: Sequence locations=1-156,180-280,302-874,898 -910,954-1053,1076-1137,1159-1474
tttcgtgacactgaacaatcagcaacttaatggactacaatttgtcacctcaaccacagtgttgcgtgactgtgccaacctgcgcggcatcgaatttcacagattgccttatctcggcgaaatcatggatgaatttgacagcgacattgagatgatggacggtgatggaggtggtggtgaacacatttatgtgattgaagacaataatgacgacgaattggcggaggaaattgatcagcaattcattggcattatggccaattttggcggcaacaattccggcggcgcatttggtgccgaaaattggattaatggattgggcgtaattgcaaatgatgatgatggtcatgaggatcaggaacacatggctgttgatcagtaccagccggtcgagatggatgaagatgaacccttgtggccgtgccgtgcattgtaccaatggttgcacaaggggcgcgaggacgggcagcctaaactgctcaaatatatcgaaaggggtcatgtaaccccggctgacttggctccactcaaggaggtcgcctcatttgaaccaatttgatccaaaattgattttcttgatatgacacataagtgccaggtgtattagataaggttgggccccggtccgatgcggggaattgtgaatttcgtctgtcgcactccaaatcggatgagaatttctttaaatgagttacttacctttttttgttttagatttgatattttctaaaaatttcctactcgatgagggacttgctcccctacattttattcagccattcccgacaaattttgtcgggaaatttcctccccgcttcttattttagcttttgaagtcgtcaggcatatttagaaaaataacggaatcggcacaaccatggctttttgtggctttttactgcgttttaacaaattttaatcaaaattttatatatttttaaatgtatttttaaggcctaaatgcctaaagaagatacattataatgcatatttaaacaacaaaaaaatgacaaccacaacccagaattcggaacaaaagtcgatattcgaaaaatttaaattactgcttttattttggatttcgaaattggtcaaattcataatcgtgatcacttatttaaactattttaatagttcaaaaaataaatccactgcattaattagtaattgattcaagtgcctgaattcacttattattataggcattcctcaacaatcgctcttctccgatcagttacattatccgtttggaggccactctggtggacattgagccgtttgagctggaaaaccgttggacccgtgaagtgttggtattgcgccgctttttcgaggatttgtggctgtttgagcgtggcccaatgggacgggcggagagtgcgtgcgattccgatcgggtggtgttgaaatgcggctgggaggaccaccaaaatgggatgatcaacgtggccctctacggagatcgagatgttgg

SEQ ID NO: 77753 - DNA, 99 bp, Heterodera glycines
  Genomic contig location: Contig_ID=SeqID_13818; Location=17..115; Strand=-
  SCN-specific regions: Sequence locations=1-99
atgttgcgtttcggattgcaacagccaaagaaagtatcgagttgggacccggacgagaaagcattgaccccgagactatctagcataacattaattgaa

SEQ ID NO: 77754 - DNA, 671 bp, Heterodera glycines
  Genomic contig location: Contig_ID=SeqID_13819; Location=256..926; Strand=+
  SCN-specific regions: Sequence locations=1-202,236-398,434-671
atggataatgctgacaataatatttgcgactatttgaacatcagcacgacaacaaaaagtgatgttggtaatttgaccggaaaatttgccattttggacgcatcgaaaaatttgacagtttttgaatggcttttcagttcaatgattcatcaattaattgtcgcaaaatgcgcgtatcagttcaaagtggcacaagttgcggtaaaaaattattttatttcttaattttaaatttggcaatttaagtccgattggtaccataacactgtgctcatgttctttgacaagttgaattgcatttcgcctgttctcccttggattgtcttcccaaatattttcactccgatttcgattctgttcaatttgtctctcatttgggtcacatgcacaaaaatgtgaattaaattcataattttaaatttaatttaattttgctccaggactgatcacaaagtgtgcaattggctgatcgcctttgattcgctgtgccaactttttgtggtggcgccgttcggcgtcaatttgcttggcgtcattttccaatacagtaccattgactaccgttgctgcctggccacccttatggcagctaccgtagcatcgtacgcctcaatcatggcaatgtatctgatctcactcgaacgcctgttgatcataatgtacccaatcaa

SEQ ID NO: 77755 - DNA, 858 bp, Heterodera glycines
  Genomic contig location: Contig_ID=SeqID_13820; Location=173..1030; Strand=+
  SCN-specific regions: Sequence locations=1-433,455-481,507-532,556 -680,702-737,759-765,787-858
atgcgcaaaatgttgcgctcggtgtttctgctgcttttggttttgctgatcggctggctgatcagttcggctgctcgcaatttgatcaccgtatttttcagagatagcatcactctgatcataaacagcctcttttctgatacggacactcagaaccgtcttattaccgatatcacttcgtgggtgatcggtattatcacttgtcttccaattttggcgtccgccagtggcgcgcccattcttttgctgaacaggcaaaaatgaaataaaaatgggcgaatttatttaaattatttttcagtaacgattatcggactgcgtacaaaaaagcgatgggccgaagaaacaattcgccgggagttgggccgctttttagcagcaaaattgttatgatttccaatgtgaaggaaggcaaagtgaaatagcgcagaacttttctgatttatttttatttaaactaagaacttttcaatctgtcccattatttaatttttacatcaattattcttagtttggcaaaatgagttttaacaatgatcattttcattcatttggattggataggaaggagtatcataagtagggcgtataattatggaaatccatatttttttcctggactgtggtgatcctgaaacgcacgaaaacatatttttagcttggtttgaagctttctatacccatatttttcataattttcaatattttgcgatttatgtccatatttatccatattttggcatttaagtccatattttatgtccatattttggcatttttccaaaaaccctctattagaacggccccttcagataacttggcctttttgaccccaaagaccggaaaattttccaaaaa

SEQ ID NO: 77756 - DNA, 351 bp, Heterodera glycines
  Genomic contig location: Contig_ID=SeqID_13821; Location=59..409; Strand=+
  SCN-specific regions: Sequence locations=1-65,142-218,267-351
atggtaaagaaattgacaacagtgggtacagagaatgccaatggaaaacggatgaaagaggacaaagaaaaagagagggaaaaagagcgaatggacgaggaacagagaggggaggacagagaagcagagggagggaaagagcggtgccaattctcggaacggtggctgaacaatttcaaaaggcggtatggtattcaaacaacgatggagggtactgtaaatgcggaaggagacgaagagacggaagacgacgaggcggagagagaacggcggggcggagacacaattttagtggaaggtacggaagagaaaaacagcgaaaatgagggaaagggaaaaggcgcccagtga

SEQ ID NO: 77757 - DNA, 1211 bp, Heterodera glycines
  Genomic contig location: Contig_ID=SeqID_13821; Location=994..2204; Strand=+
  SCN-specific regions: Sequence locations=1-50,72-73,95-964,986-1211
atggacagtttgtactgtactgtaccgtacatattggctggcatcgtagccccaggagaggaacagaacgcccgtgttgtacttctcccagtggctggcaatgaacacgagttggaccgcgatcagaacggagagcaaagtgagcggctcaacactgtggggaaaaatatagcatttttatacttagaaatgttgcagttatcaaaggcgtaggcagggggaggggctgagggggcttaagcctcctcccgaaatgaaaaatttaaatgaaaatgggaaactcctgaaaagcattttttaaattttacccaaaatcggcaatttttgaaaaaaccttaaaaagggcaaaattctaaaaaattttctggtggccttaccactctagaattaaaaaaaaaattattggaaatctggctaagaattttttttctatttcgtatcaaaacattccgttaacgatttcttgacagaaaaactctgggagaaaatgtttttgtgtttccaagttcatttaagatgcaaccatttttacttttcgaacttattgttaaaaatttttagggaaagaaattttctgattttttaaatcttttagatatttacaatttttttcctcgagattttcttataaaaagggcttgaatttttttttttttagtaccgtcggtcggcaatcagctaattagttgttacctgaattggccccgtccaaaaagtgagaaaatggtgatcgtaaatgggacggttgaccatgaatctgtggcgaggagagaccgaaaagtgcggggaacgcgttaaaaacaattggcaaaatgcgttttgttagcagacaaacgctcaccgaatccgtggtcaactcgaaatgttgggaaggcaaaaattaggtaaatctcagagaattaaataaatttatttagaaaatttcgtaaaaattccaggattttacgaaactccggtgaaaatcaattggatttttaagaaaaaatagatatttgtaaaaaaaagtgtcgggttaagccgccagagatttctgatctcgtggaatttcaaaaccgggccccctagccccatctgataccaatttggctttttcgagccgaatttttggcctcaatagcccggaaagtaattttaagtgccccgccggtctttggcattctataaatctctggcaaccacccaattttgtttcaggaagggcagcaatttta

SEQ ID NO: 77758 - DNA, 1660 bp, Heterodera glycines
  Genomic contig location: Contig_ID=SeqID_13823; Location=1444..3103; Strand=+
  SCN-specific regions: Sequence locations=1-55,77-130,152-322,344 -407,430-460,498-907,933-1003,1025-1280,1302-1500,1529-1660
  Gene Ontology: Mol. function=aspartate carbamoyltransferase activity; Cellular component=cytoplasm; Biological process=arginine metabolism
atgccaaagaaattgatgtcgatgcggtggcaattgggggccgtgtgttggtcagtgccatctctgaacatgttgagaatgcgggtcggtggtcggcacatttttgaaaaaaacacctaattcaagcaaattttctaattggtttttaaaggcattcattcgggtgatgccacactgataacaccgccccaagacctgaacgccttcaccactcgaaaaattcacgaaattattcgtcacattgcgcgacgtttcaacgtcaccggaccgttcaatttgcaactgatcgcaaaggatgacaatttgttcgtcattgaatgcaatttgcggtgagcagtcatgatgaatgaatgagttgggtcaataacaaacaactcgtactttttgagaaatttttgcaaaacccgaaaaaattttcttgaaaaaggtacggggttgttcatgacacttcaaacttcagaaaaaaaattttatggatttttttttttaaatttattgacaaaataacccatccacccttcaaatttgtctgaaaaaattacattttatcaactaccaccataaaaatatcaaaaattccttactttatgattgcatgctcatggtttcagagtgtcacgcagtttcccgttcatctccaaaacgttggacatcgattttgtggcgttggcaactcgggcaatgatgtggacgcaagagccaaccaaattcatccaatccttcacccgtcctgaacagtccaacaacaaagtgggagtcaaagtgggtatttttttttgccaagttttttttttatgttttattttccatggttccaaatttatttttttaggtcccccaattttcattttctcgtctcaccggtgctgatgttgttatgggggtggaaatgctgtccaccggttggaacttttaatattattattttcaaattaatgaggccaagttttaattcaattttaggcgaggttgcttgtttcggccgcacacggagagaggtccaaaaattttatattttgggtttggtcatgcccccccctcctcatctgaatttttttctaaaattttttccaatgataattttaaacaatacgaaactcgctttaccgaatcccctaacatttgtttgcgtgaaacaacaaatcaaaattatagaattacatctaattttagcgcctaaattatgctagaaaaaaaacctagaaattttcaatgggaagcggagggtgggtgtaacgactttgaaacaccaaaatttttagtttttttaaatacaatgtatatattttttccccatttaaggcctatctgaaggcactcctatccaccgggttccaattgccaaaacgggtcatttttctctccattggctacaaacaacgggccgaaatgttggagagtgtgcgcatgttggaccgacttggcttcacactgtacggcagcaaaggcaccgccgattattacgcctccgaaaacaacattcgagtgaggggggggggtggaaatttttaaaaaatgtaaaatttttccccatttcttaaagattaagaatttggaatggccatttgaggagaaggacaattaccatgtgtacggtgccaaaatgaatacggtggacgaatttgtggagaagaaaatcatcgatttcatgatgggctga

SEQ ID NO: 77759 - DNA, 1089 bp, Heterodera glycines
  Genomic contig location: Contig_ID=SeqID_2082; Location=699..1787; Strand=-
  SCN-specific regions: Sequence locations=1-532,554-731,753-763,786 -1089
atgaggcgagtgacttttgcaccaacagcagaaggtggtgcggatgggaaggcccccgaatttcgatcatttaaaatgcgacgaatgtctataatcagtaagagaagaagagcggtattagccaaaagggtactaatgcactttagcagacatgaaatttttttttttgtctttattcatgtaaactagcttccgggctttatagcatcattattaagaatctggcgttgaatcaactaattccgtacaccaaaacccgaaatcgaacttttggtcgaacatcgaaaatgcaagcattgattttcgttgatttttcattattaaatattgttggactttttttgaatagaaggattttgaagatttcgatgttcgaccaatagttcgatttcgggttctggtgtacagaattaattgaatcatcgatgctgaaaacccccggaagctattttacatgaattaagaccaaaaaaaaatgtatgtctgctaaagtgcattagtaccgccaaccttggaactgttttcacgactttttagaagaaaacaaaaatttattccaaaaaaggggggggggagggacaaagcacactattacccacaactataacatttttgttcagtacccaaggaaccacagtttggagacgcaatgaaagagaaaggcaacgcgttcataatctcaacagcggattcagccaattgcgcgaacaattaccgctaattgagcggtaatttttaatcgccatacaaaaccaattaaatgcaattgatttgcccttctgtcgccaatttgctctccaacattaagcgatcgacgcatgagcaaagtggacagcctgaggctggccatcgcttacatccgccaccttcaattgcttcttcagcacaatgagcactggacggagtgcaactgcttcaggcaaagttacggtggcggggacggacggagcagtggcgcggagagcacaccgcccccaaattaacgagcgaaagagcagagggacgcctttatgcacagaacgaacaacggcgattacacttttttttcaaattgaggacggattacatacgaaaagaatgacgaataaa

SEQ ID NO: 77760 - DNA, 1918 bp, Heterodera glycines
  Genomic contig location: Contig_ID=SeqID_2083; Location=288..2205; Strand=-
  SCN-specific regions: Sequence locations=1-42,75-447,470-601,623 -654,676-795,818-980,1134-1412,1434-1734,1756-1918
atggaattggcaccgtccgaagatggcacaaaagtgagtgccaaagaggaggaagaagaagagagtgaggaagacgaaccccaatgggacgaagaggccgaatttggcgaagacgaagcgccaaacgcagtggcgaaacgcaatgtgccctcgggcgacgactcaacgacgacgagacgaccgatagaacagcgacaatggcactccctcagaaagacacacagcgattcggaaacataacggacgggaaaacacagccaaaaacaaatgatcacgttgtaaaatgattgatccttttgaaaaataaaaatctaaaaaattacccaaataaattgctgcttttgtggtgtatggaagtgctgctcaccatttcaataataatctcttctcatccaccaattgtcagctgcacaaatccaacggccaaattctgttggccaatgcaaagggaagggaaagggatggagaggagggcgaattcgatactgtggtcggccggggcgaggacgagcggtgattggtgccaaaggggcagagggggagggatgaaagagggagccgacgaccaattcatcactcacaacaatcagtcgcatccacaaaataaaaatgggaggcaattaattagccgcttctcataaataattggccaaattaagcttttcgcttttaaatccaccacttttattaaaaattagaaatgatcgataatccaatacaatttaagtaaatttgtggcactttcattggactaaaatgataagtgccaatgcggccgatgtcgcccaactccaacaacaaaatcactcccaaaatgcgccgtctctctcctttctgttcagcgggccgtccgccgatggcaccgcaaattgtggtgcctttcaccaaaatcagccaaatggaggagccctttatcagcagcacaatcatccgcagcaccaccaccattcagtaattgtgcatacgcatcaaatgccaacggcggaagggacggagagagacaatggggagaagagagaacggaagagaaagggacggaagagaaagcgaagggagggggcggaagacggagaagagggagcggaggaggagcagcggtcgcagagcgaggaggaggcggacgagggggacgaccgcggcacgacggcacgtaccacggcaccgtcaccgcgggcgatcggagtgcgccgattcatcagtcccttcgaagacaccgtcaaaattccactgccccacgagttggaaatgaggcgagtgacttttgcaccaacagcagaaggtggtgcggatgggaaggcccccgaatttcgatcatttaaaatgcgacgaatgtctataatcagtaagagaagccttggcggtattagccaaaagggtactaatgcactttagcagacataaaattttttttgtcttaattcatgtaaactagcttccgggctttttagcatcattattaagaatctggcgttgaatcaactaattccgtacaccaaaacccgaaatcgaacttttggtcgaacatcgaaaatgcaagcattgattttcgttgatttttcattattaaatattgttggactttttttgaatagaaggattttgaaaatttcgatgttcgaccaatagttcgatttcgggttctggtgtacagaattaattgaatcatcgatgctgaaaagccccggatgctaaagtgcattagtaccgccaaccttggaactgttttcacgactttttagaagaaaacaaaaatttattccaaaaaggggggggggacaaagcacactattacccacaactataacatttttgttcagtacccaaggaaccacagtttggagacgcaatgaaagagaaaggcaacgcgttcataatctcaacagcggattcagccaattgcgcgaacaattaccgctaa

SEQ ID NO: 77761 - DNA, 670 bp, Heterodera glycines
  Genomic contig location: Contig_ID=SeqID_2083; Location=2413..3082; Strand=-
  SCN-specific regions: Sequence locations=1-284,306-327,349-499,574-670
atgtcgcgacttcggctgaacagcttgaactttggcctctgttcaactgatcgaagccgcgcgaacagcggcgtagaaggaaacagcgacaatctgaacggaagtccgctgaggacagccatgtcgccaacttcgctcagcggcccattgacacaaagcacgacagtgacaggcgaagaaacatcggatgggtcagtacatccaatccaagtgattattagttgatcaggagggagggagaggacaaatcccgtcgagagtgtcgagaaaggacattcatattccaattgacaaagtttaaaaaatatgtgtcccaatactgatttggcttcattttgttgctttgtgggtaaaattttacgcttttataccctaaattttagggttttagtgaaaattttccatttttagtgactatttttggttttttaggacataaaacctaccctttttgtctttttttagagaataaaattgcatcattaatcattatggttggtttatatagtatttcaatattattaagaattttttaaaagttaaaagaaaacaattgttttataaaaaaataatcttgcaggaaatcgtctcgaaaaataatccaaaaacccaattacggatcaaaattacggaaaaatcccaaaaatccgtaagccgtaatccgtcatga

SEQ ID NO: 77762 - DNA, 698 bp, Heterodera glycines
  Genomic contig location: Contig_ID=SeqID_2084; Location=3396..4093; Strand=+
  SCN-specific regions: Sequence locations=1-288,310-343,435-518,547 -635,657-698
atgaacccattcatgatcactttgatctcggggatgccggaccctgaacaaaagcgggcgattgtaatgccaaaatggacggagcaaacgaccgatcgcttgggcggagacgtatttgcagaccaaagcggcggcaccgacaaaaacgacaagaaagccgacccaagagacgaatcccgacaaaggaaagcaaaaggcaattgggactaagggaatgccgaaagagacataccaacatcacatcgtaatcacgggcaaagtcgaacagaatggcacggtctgaaggtgaaaagggaaaaatgggggaagtgaaaatgggagggaacgatcagaaaattatggaagagaaagtgatcaaaaaagagagtgaaggagagagaaaaaacagtgaaaaacagagacactgacaaaaaaaagagagagtgaagaaaaaggatactttccagggatgggccgaggtttcgcttttcgcatttcgctttttggcgcgaaatgcgaaatttccaccctaagaaatgaatatatttgaaaatttaatttttaaaacgaatgcttcagtctaaaaaacccccaaaataggtgctaaaaatgggaaaataggagccaaaaagttccgaatttggggtgtaaaatcgaaaattttcttcaaaaagcaaaaatattatgccaaatcattaatgagatagataattttcaaa

SEQ ID NO: 77763 - DNA, 284 bp, Heterodera glycines
  Genomic contig location: Contig_ID=SeqID_13824; Location=700..983; Strand=-
  SCN-specific regions: Sequence locations=1-17,39-284
ctcgctctccgtgtctttgccgaccatgcgcatgagccggctgaacgtcgtcgactgttggaactgtgcagtgcccagggggccacggaatttaccaaatttgttcgacaggtttaattaaaaaacttttttttttgtcttttcgaaatttcattttttagcctaacaattccctggtggaattgctgtgcacattctcttcacttacaccgccgtttatttattcaagtaataaaagtccaaaagaagggacaaaggccgcttatactttcggaagagaatga

SEQ ID NO: 77764 - DNA, 3019 bp, Heterodera glycines
  Genomic contig location: Contig_ID=SeqID_13825; Location=1..3019; Strand=-
  SCN-specific regions: Sequence locations=1-123,145-429,453-973,996 -1180,1205-1566,1588-1973,1995-2832,2854-2855,2878-3019
cccctcccttcaattttggactttgttttggccgacttcgttctgtttttaacacactttcagctaaacccgacctcctccaaaagtacgactccattatacaggaacagaaaaatatgggtattgttgaaattgtcaaaaatcccttcgaattttcgcctccattacattatttggcacatcacccggttatttcaccccttaaaaccaaagtgcgtattgtctacgacggttccgcacacgtcggaaaagaactatccctaaatgagtgtctttttcccggtcccataatcctgcctgatcttatcggtctcttgttacgttttcggattcccccaattgtcattacaactgacattgaaaaagccttcctccaagtcaatgtgcacccggcacatcgtgattgtaccctggctgaaaaatacctctcttcccccatcaaaagcaaatactcaaatccttcgatttacccgtgtttcttttgggctcacatgctccctttttttgcttgcggccacaattctccaccatttatcagcttttccctccaatttgtccaccgaaatttcccaaaatatttatgttgacaatatccttatttctgcctcaaattctaccgagggacagaagaaatcaacctccgccatttccttatttcaaaaggccggaatgccattacgtgaattcgcctgcaattatccggaagccatttcccatctcccaagccaattaaaacttcccgggaccgaacaaaagtttcttggacttaaatggaacactgaaaaggattttttaattttggaactttcggtccctccgcctgattttgtcccaaccaaacgctctgtcctttcctttattgcatcacattttgaccctcttggcctaatttcccctcttatcctccccttaaaattatttttacagtcactttttgaacttaaactcaattgggatgaacgatttcccacagaaataatcacaaattggcaaaaatcaattgaatcctggaaaaggacggacaaagtaaccatcccacgttcccccatttcgtctcctttatctgctcgtgaataccaattacattgctttacggacgcaagcaccttggcaatgtgcgcagccgttttcctccgagtttcacaccccaaattttcccaggcggaaacctttttaattttctcaaaaacaaaagttaaaccaattcacaaaggcgtcccattaaccatccccaaactcgaactaattgctgtagaaatgggaactcgtgctctgaaatttacccaagcccaatttccctctctaaatttagacccaaatttaaatctttggacagattctgcgatcgtcctttcatggcttaattgtcacaaattgcccacggaaatttttgtacaaaacctacttaaagccattaaatccgttgatcatttaactgtccgacatttgcctggcccggaaaaccccgcagacattggtactcgaggaatttcttccgcacctaccctttccgctctctctgcctggtggtcaggccctcaatggctttctctcccggcaaaccattggccaaataacccacaaataaaagagtattcatacggaaaatcagaacctataaacgccccttttcaagcaaaccctccccctttgttcacgttttttaccgaacagacacccgaattaacacatttaattgatttggcacgtttttctaggctaccaaaagccctcagagtgttaagttatgtgtttcgtttctcaaatggcacccgaaaaaattccaaatataaagcaccgaatccgatttcctttaatgagcaaagaaaggctctacaggaattaattttacgagagcaaaccctaaatccaccctctgatcaggtcacgaaaattttgggcctttactcagacccgcagaaaattattcgcgcaaagggtcgtctcggaaaaagccagcttccaccgtcggcaaaaaacccaattttcctccctcccaaatcgccattaaccaatttaattgttcacgaaatacacctaaacaatgtccattcgagcccattgttgaccctttcactattgcgcagaatttattggattccaaagggacgacaaattgtaaaaccgatcatttcgagatattgtctaacctgtcgacgttttaacacccgaccatttgaccttcccccctttcccccccttccggaagatagggtaaaaccttcgccccccttttcgaaagttggcttagactttactggtcccatttatgttgtcacaaacccccacgtaccaaaaaagcgtaaaatgtcgaaaaaacattggatagtcatttgggtttgccttccgacgcgtgccatttctctcgatttagtcgaagactagtcggcgcccgtctttacactcgcttttcgccgtttttcctcaaaatacggcatcccttcgacgatttactgtgataatgccccaacttttgtcgccctctcaaaatttttggctgtccaatttccaactcaatggaattttcgtgttccacacgcaccgtggcgtggtggacattatgagcgtttgatctcactggtcaaacatcatctacaagggcatttacctcatttcgtcctcgagcagttcccttagctcagttaatgacctccctctcggaaattgaaatgattgtcaactcacgtcccatcacttttcattccgcgaatcccatggatcctaacgccctaaggccaatcgatttcctgcgccctcttaatcccaaccaaaaccctctttcacatttgatcatccccataaatgccgagacagaattgcccgaaagtacccaaaaatcattacaaaatctatgggaaactgcttcccaacagacagaacgtttttggcaccaatggttcactgattatttaccgtccttgagagaacggtaccaaaaataggcccgacaataaaatcgtggcaaaattggagaacttgtccttgtcatcatccactgaacccgttcactatggaaaac

SEQ ID NO: 77765 - DNA, 1562 bp, Heterodera glycines
  Genomic contig location: Contig_ID=SeqID_13826; Location=14..1575; Strand=-
  SCN-specific regions: Sequence locations=1-652,675-866,890-1112,1134 -1198,1221-1230,1252-1562
  Gene Ontology: Mol. function=ATP-binding cassette (ABC) transporter activity; Cellular component=integral to membrane; Biological process=programmed cell death
atgaattcactaattctgtcccacccatatcacttgctttatctgcttgctgtccctcataaattaacctcagaaggtcttccgccaaatgaaaacattgaaacggaccgggcgagttcaaaggaccaagcggacattgttgtggacaaattgtgcaagcgatggcgacagcctttttcttcgtccagccaattttcgctggcccggctcagcttcaaggcatacaaaggccaaatcactgtgcttttgggccaaaatggggccggcaaaacgacgacattttccattttgacgggactgctcaaatacaattcgggacgagtgctcatctgtggcatcgaccagaagaagcacatgcgcgaatgtcagaacaaaatcggtatttgttgttttaatcaatcaaattttgtgattgggtctgaaaacaaaaacagacacatttcgagctgtgactgcactggaggttcggttcctttccacgaaacaggataaacaatcattaaaacgcggaaaatttatgcaaaatatagtgaaattgtttgaatagaaaaaaaagttatatggagaaagtaaattctgtttttcctccattctctatttattggttcatctctaatgtttagagtcggtgtgtataaaaaaaattcagtgtttacattttaaattgttaaaatgaaaccccgaaatccaagaatttaccacagataacttcttttaggcttctgtcctcagtacaatccgttgttcgattaccttaccgtcagagagcatttggaattttatgctggcaccaaaactggccatttcaatggaccctatggcaagaaggcactgattcaggagattcatacggtggcgaatgaattgcacatcgaagccctgctggacatggtgggttcaattttttacacatgggtattgtaagtactcgttaggtgcagctctggaaatggttaaattgttaaggaaattgtaaattttgaaaaaattgaaaaatgatcaaaaatcaggataaattcggttatctaagaaattttaacatttttttgcagccagctcgtgctttgagtggtggccagaagcgaaagctttgcgttgcgatcgctttgatcgggaagagcagtgttgtgttgctggacgagcccagtgccgggatggatgctaaagcacggcgcgaccttggcgatctgttgaagaacattaagcaggacaggcaaggcattttatggcccagttatttgattcaaacaattgcaatgttgtgagatactcttaaaaagggctggtcaggtccatagccagaaaaaaaattccgatgggcgaatccgaagactttttttactcttcgggccgaaaacaaaatttcttttgaatataatttgtggcaaattaaagttttgcttctaaatgagatttgcatgattttgagctaattgtatgcgtcctggttcagaaccattcttctgacaacgcattacatggaggaggctgacactttggccgaccgaattgtgatcattgcgaacggacgtttgaagagcaacggatcgccacagttttga

SEQ ID NO: 77766 - DNA, 972 bp, Heterodera glycines
  Genomic contig location: Contig_ID=SeqID_13828; Location=503..1474; Strand=+
  SCN-specific regions: Sequence locations=1-395,417-433,455-800,923-972
atgttcgtggacgcaccggcagaaaaatttgggcctaaggttcgcaagaaccctaagcagggaaaatatgaggtgcaggccattttggccacgacaacgtacaaaaaggatgggcaattacgacggatcttctatgttcagtgttaggtaaattaatttttaacaattttatacaattgttaataaaatgtattcaggctatagtcaaaaagactatagttgggtcttgaacgagtggatggacacgcaggagcttgtcacagagttcactgttaactctgtgatcagctgggtcttcaaggcaattcgtggcgaggaagtgccggaagaaattgccgaaaaactcaggacaaatcctgagtatatctcgcgtagtttttatggggaaattgatgaaataattaataaatttaattgtttgatgaatgagttgaggcgcaatgtcgacattaggacgacgccaattgggttctcgtcaaccctggcgggcgatgtgagacagcaaagaattgtaagttttgaaaattaaaaatcatcattttcatcttctctctcattttatttgtgtgtttgttaagcctactttcttagaattgtgggccccaaattcaccgtctttaggggaccaatagagtaaaccgcacagtctcgaatgtgtggcctctattgttcttctatttcttttttaattcctactataaatatttgtttttaaccttggaaaattattgaaaaaattttttttcaggctgcggagaggctgaaggaattcttaaaaaagaaaaaatcgtgatggatgcataaaaatttttaaaaaaaatgaaaccaaaaatattaataattaaaacccaaaaaaatctttaaaattaaaaaatcaaaaaaaaattttaaactaaaattcaaaaattttaaatattaaaatccaaaaaaactttaatactaaaaaattccacacacattgttcttcgtata

SEQ ID NO: 77767 - DNA, 2568 bp, Heterodera glycines
  Genomic contig location: Contig_ID=SeqID_13829; Location=290..2857; Strand=-
  SCN-specific regions: Sequence locations=1-264,286-569,591-1153,1188 -1379,1424-1730,1758-1790,1812-2182,2205-2302,2331-2568
  Gene Ontology: Mol. function=ATPase activity; Cellular component =nucleus; Biological process=protein complex assembly
atgccaaggagaagagcaggcaaaaggtacagacaaagccacccgaaaacggaggacgcaatccatttgattgagaagcgatgcaaaacgattgaaattgttgaaattgaagaaccaacaacagccaccgacgttcagcaaattgtggcacaaattgaagaaccgacaacatccgctgacgttgagcgaattgtggcactttttacaacgaaaaaactcgtcattttacaggttatctatggaaaaatagtacatttacatcaatttttaacaaattttgaaaaaatcgaacccaaatctttgctattttcgttgctaaattttcgttttcaggggcctcatggatgtggtaaaacgcacacagcaaattgcgttgcaaaacaacggaacgtaccgctcaaagtgttgcagatcaacgaacaatacgactcaaaggtttttactgaacaatgattttattgcctttttggcagtgagtaaattttttggaattttttctggtagtgcatacttttgcatttgtggcacaatccaaaataaaaagggagaccttggcgatattctatccgaaaatactggggaaaaaattgtatctttcccatcaaattggtgtttttacgtccaagcctcgtctctttagtccgatttagacgaaaatggtaggttcaaatttttcacacaaatttttcaaaaaaattttttcttcggtgtttggggattggcccgacactctaaattaattaatttttaggtgttatacggcagttacagttgttctgaagttcccggcgaatttttttggcagccttccaaatttgctcaggtttgtttttataaaattcaaaaacccactctttttaaatagcgccatgcattttttcaaatattttttagtttttgcaacgggactgtgtgattttgtgggagaattgggaccatggtgggtcggatttggcctcggcaatcgttggcttggccgagcgtggccatgccgtgttggccaacggacggcacattccgatgggctcgcaatgccgtattttgggcacaatttcacgggaagagcaccaacaccatacggcaatggttagtctttaagaggtgtttacgaattcaaaacaattttttgttgcattttggtactgtcagtcagttttatttaaaaaactaaaaaaatttttttttttgagggggtggctgaacgttcacagagcggaatgaaacattttgtttctagatttggcgagactacccattcactgtccgaatggcaccgatccaaccggcacagatggactcaattttggcacaaatgaccaaatcgcatcatggtttgtgtttgaaaatgattaaaacagacgaaagttccatcccactcgaaaaattaaaaaaatttttttttttttaaagaattaatttaattgtacgtctttgtttgcaatttcagaattgttcaacattcggtccaaacttttgcaaacatttgtcaccgtttctgcactgatcaaccatcggaaggcctccatggaccgggcactgaatgccaaggatttgttccgagtgatcagccatctcgtgaattcaactgatcagcagcatagcccgaattctctcgtttctgatcggaatgcattgtttggcgaactgtttgacgcgtgggccgcccatttgagcggcgatgaacttcgccgttgtgttgcaggtttaaaaaagaattatgtcggaaatggaaattatttaaaaatttttttttttttggttaattgacaactgcattacattggtacgaaaaatttctaaaaacattgacattcaatatttccctagtttatagcttaatttgcttaataacgagtctgattatgtcaatatgttacagttttactgtaaacattgctgatttcgtgaattttcgggccacaatttttgcatttttttaaatggacaaattttcctcttttttaagccgtcattggtgaagcgttgtcattgtcgcctgaacagcagcagtgccacatcgacgtacggtttccggatgtgtccattctggagaacaacaacaatgagaacatccgcagcagtcggaggattcctaaacaggcgcagcaccaacagaaacgggtccaattccaatttggtcgggtggtgttggaacagcggacggatgcggcgcaacaggaacaacagcaaagcaacaacgacaacaggagtggaaaaaggttcaaattttcgtaaaaatgaatgaaaaatgggattttttgaatctttccttgccgtttttagtggttttccgtgtgattacaaaaaaaaaaattaattttaataaaatactgacaattgtagttgcgctggtgctgtggcaccgtttgtgctcacccgggacgctgcccagctgttggaacgggtggccgcatgtgtgtcccgctcgccgcccgagcccgtgctgctcaccggtgacacgggcgttggcaagacggccaccgtgcagcacatggcccgcctgttgcgggtcccattgcatgtggtcaacctcagccaggaatcggagttcagcgacctcgtcggcgg

SEQ ID NO: 77768 - DNA, 807 bp, Heterodera glycines
  Genomic contig location: Contig_ID=SeqID_13830; Location=188..994; Strand=+
  SCN-specific regions: Sequence locations=1-774,797-807
atgatacaaaaatttatcattgctattcaaatgaatcccaacgtaaagttttagaaacagctctaatttcagtctttaattgggctgaaacatggggcttaaatttttcagtaaaaaatcttccgtcttatatctaggtaaaaataacaaaaaaataccgtacacaattaaaaattcaactttccctgaatcaaaaattattcgtgatctaggtattttaatcgacaacaaactcaaattcaacgaacaggtttcaataattctccaaaaagcttatctcaaaagcagaattctttttaaaaaaattaaaaccaagtcaaccaagacttggattacagtttataaaagttatattcgaccccttttagaatacgcaaccgaaatttggaatcctcgaaacaaaagaaataaaccgcctggaaaaatttcagaaaaactttacaaaaaatgttttcagaaaatgctgtctcccctacatctcatacagcgaaaggctaaaatttctaaaactttccaagcttgaaaccaggagaaaatatcttgatatcataacagcctttaaaattatcaaaaatactattcaccttaacccaaaaaacctttataatttttcagataggaaaagatcaccttttcctattttggtaaatccttaattttatatagtaaaaatttgcccttgcccatggactgaatttggtccaatctgtggaaaacaatcaccggcgagttcactcactggctaaatcccactggcgaaatcacctgccatcagcaaaatatttgctggagtttgaaaattaatca

SEQ ID NO: 77769 - DNA, 1617 bp, Heterodera glycines
  Genomic contig location: Contig_ID=SeqID_13830; Location=1294..2910; Strand=-
  SCN-specific regions: Sequence locations=1-125,157-321,344-1468,1490 -1617
  Gene Ontology: Mol. function=malic enzyme activity; Cellular component=cytosol
acctcacaacccattcgcgtgttggtcactggtgctgccggacaaattggctattccctggttagttttgtattttgtaactgctatccattttgttttgtccgttttttgacctttaggttctgcaaatcgccaaaggggatgtttttggcaaagaccaggtgtgttccttttggtctcttcggctgtaaatgttttcccttttcgcccattgtcctcgtccttctcgacgtccctcctcttgctgcagtgctcaccggcgtccattacgaattggttgactgtgcgcttcccaacctcgtcggtacgtacgttggctaatctttctttcattcatttgtttctgcttttctgaatgggtgtcactttttgcgttttttcgctcattttttctttttttaaggcgttgagacagtgaccactgaagaggcggccttccaagacattgactacgcttttctggtcggagcgatgccccgcaaagaagggatggagcggaaggaccttctcgcggccaatgtcaaaattttcaaatcgcagggcgaagctttggccaaattttccaagccaacagtcaaagtgtgcatttgttggttaccgatcatttatcatccttaaaaataaacttttaggtgctcgtggtgggaaatccggccaacacaagcgcattcatttgcgccaaatacgcggccaacaaaattccggctaataattttaggttagtctttttttatggttcgtttgtaatttggtttcaattctagtgccatgacgcgccttgaccacaaccgtgccatggctcaggtggcgcaaaagtgcgcagatggaaccaccgttgggatggtgaaaaatgtgatcatttggggcaatcattcgagcactcagttcccggatattcgacatgccaaaattgtcaaaggtttgagctattcaatcggaacagcaaaaatacaatcaaataatccaaattacaggtggttccgaaactttggcctatgatgcggtcaaagacaccgcgtggattcaggaccaattcatcaaggttattgtgaatttaaaccatttcaatccattttctccccaaaaagaccgtgcaaaaacgtggcgctgtgatcatcgaaaagcgcaaattgtccagcgcaatgtccgcatcaaaagccgcatggtaagcaaatctttctgtatttctctctgattttttaaaccgtctttctgacagtgaccacatgcgcgattggtttttcggcactccgtccgacggtcgttgggtgtccatggctgtgccatcggatgggtcttacggcatccccgagggattggtgttttccttccccgtcaccatcgatgcacagaaagagtggaaaattgtgcagggtcttgacctcgacgactttgccaaacagaagattgacatcaccaaaaaagtgtgattgaatgaactgggataataacaaattgggaattgtaaaagaggatatctggaccgaatgtatcacccgttcaatccatgcattagccagaaaaaaatacgagggggaacccaaattgcccttttccccgcaggaattgttggccgagcgcgacgaagcactcgcggcatgcaaataatgcaaaagg

SEQ ID NO: 77770 - DNA, 379 bp, Heterodera glycines
  misc_feature (291)..(291): n is a, c, g, or t
  misc_feature (304)..(304): n is a, c, g, or t
  misc_feature (315)..(315): n is a, c, g, or t
  Genomic contig location: Contig_ID=SeqID_13831; Location=35..413; Strand=-
  SCN-specific regions: Sequence locations=1-195,219-259,304-379
atgtttttaagtcccaccgtgaggcgggacagttccaaaatttgtgccacattttactgtggaaagtccaagtaccttattggacaactacgtgtcaatgagcacagtcgcctttggccagttgtggaacggaaaaatgggaatatcagatggggtgcgtcccttcctaaaaatttctcttttcgtctaaccatcccccctttttgtgcactatttcattttcaaaattgggaacattttttgtttgtttttttgaaactaaaattaaaaaatttaataaaattatttctnattttatataatncttctctttcnaatcttttcactctaaggaattaacctgtaatttttagaacaaataattctcctaggagattaa

SEQ ID NO: 77771 - DNA, 323 bp, Heterodera glycines
  Genomic contig location: Contig_ID=SeqID_13831; Location=1116..1438; Strand=+
  SCN-specific regions: Sequence locations=1-198,255-273,296-323
atggtcaatttggcgataaaattcatttggttggtcgatcaaaaatcagtagggattctttttttaggcacaaaaaatcgcgaaatagcacctaaaaaggcagaaaaaaatcgcaaaataggcattaaatcggcacaaaaatcctcaataggcacaaaataagcaaataaaaattttttattaacacttttaggtagcaaaaaatataaaattttaaaaattcacaagtaaatgaaattattaaatattttaaagcttttttcgaataaagacaatttttgaaccaaaaatttttatcaagaaaaatgtattaaattagtgga

SEQ ID NO: 77772 - DNA, 983 bp, Heterodera glycines
  Genomic contig location: Contig_ID=SeqID_13831; Location=1708..2690; Strand=-
  SCN-specific regions: Sequence locations=1-258,280-387,410-556,579 -766,788-861,884-983
atgttgagaaggataattctcgaaataagagacgaattcccaaaaataatgtgattattatatacgcgagttatccgatccgcttcttccactacccaaattttgaaagtttttcaaaaaatatgtaaccttttctcaaaaactccccatgtgccaattcaaaaatcatttttcccaaagaatgaagaagtttgtttatgaaattttttcgttcaaaattattcttctaactttgctatttcagaaaaacatttattttagacaattgaaaaattatggccttacaaaaaagtagtgtcctccatgtgagggttttttggaagaacttggccaattcacggggccataattttgtgatgccaaagtaaaaaccctaatcaattggtcaaaagtaggggttaaaataagggaataatatggccaagtttgattaaatttactttattacttgaattgttatgatgttttgtgtgtaaaccagtgatggcattccgaggcccaaaaatttttcggaaatcaaaccccaaaaaatgtcgcaagtcggaaagccctgcggtttaaatttaaaataatcgaaatcgatccaatcagcagcaggtagtttccaatttggtcattgtccgtgcgcattgtaaaattgcaaatccaaacatcataacaaatccaactaaatacgtgaataccagcaggggtgggacacgcctctcacctcttttttgggacgagaagtgaaaatgcaccccctaaagattgaacttttgagcagtcagaaaaatatttaaatttacgcgaaaaaacccataataattctctttctcttcttcctcgagtcatatttggtgtaaatctgttaacaaattgcattcaaattttaaaattttcccgacggcggcatcgccggaccctcccgccggtcccaaaattgtttcttggaaaacctgccacaaaataacctttttatttgattttttatttgtaataaa

SEQ ID NO: 77773 - DNA, 1597 bp, Heterodera glycines; identical to SEQ ID NO: 13833
  misc_feature (1472)..(1472): n is a, c, g, or t
  misc_feature (1524)..(1524): n is a, c, g, or t
  misc_feature (1559)..(1560): n is a, c, g, or t
  misc_feature (1563)..(1563): n is a, c, g, or t
  Genomic contig location: Contig_ID=SeqID_13833; Location=1..1597; Strand=+
  SCN-specific regions: Sequence locations=1-235,257-273,295-453,475 -780,814-985,1129-1294,1335-1344,1366-1597
  Gene Ontology: Mol. function=cAMP-specific phosphodiesterase activity; Cellular component=insoluble fraction; Biological process =cyclic nucleotide metabolism

SEQ ID NO: 77774 - DNA, 1030 bp, Heterodera glycines
  Genomic contig location: Contig_ID=SeqID_13834; Location=348..1377; Strand=+
  SCN-specific regions: Sequence locations=1-401,428-826,848-1030
atgccgcgcgaagagttcacccaaatgcgtcaggcgatcatcgacatggttttggccacggacatgagccgtcactttgagcacttggccaagttccaacagctgatggccataatgccggacaacacggaggaggagcgggacgccaattcgttgatcatttgccgaatggtcggcggagggattgggcacgcataaacagggccaaggaaaagacggcatttcttcagatggtcaaatgcgcggacattgccaatccgacgagggagtggcgcttgtgccacgagtgggccatgcgaattgtgcaggaatactttgaccagacggcggaggaaacggagcgcaagttgcccgtcacaatgaagggctttgaccgcgagacgtgcaatgtgccgttgacgcaggtcattcattcattcatttaatcgacgtgcttttggcatttcgttttggttttgatcacccaattttgctcccatatgatcagccaatcatttggccaattgtgcctttgtccgatcattcattcgtccatttcccctttcagtgcactttcgtcgacatgttcgcccgcgaggcgttcacactttggtgcgaatttgccgacctgccccatctgccggttcagttggaggagaactacgcccagtggaagacgagatccgccgaatgggacccgaaaaaggacaacgacaatttgttgaagcggacggaacggtgagagcggacaaagcacagaaaggaggggaagcggcgccgtttgtgccgtggcaatggacccaccacccaattggacggcactttggctgtcgcggcgactcgtccaattcctttcccaaaattaaattctcaacaccaataattattatttatctgctgttcttctgtcttcgttttcatgtgcaattgtctttttgttgctttttgcctctttttcgtcccaattttcaatttgtttttccttttcctttctttagcgtcgctcattttgaatcttttaagttatatttcgcatttttctgtcatttaa

SEQ ID NO: 77775 - DNA, 1647 bp, Heterodera glycines
  Genomic contig location: Contig_ID=SeqID_13834; Location=1916..3562; Strand=-
  SCN-specific regions: Sequence locations=1-62,99-142,197-197,221 -231,253-674,696-1020,1061-1104,1129-1207,1231-1356,1378-1503,1525 -1530,1552-1647
atgggacaccaaaattgcggtaaatccgaattcacccccaaacagacgctgattttcccggacggaaagccgctgaatatgattttggacgacggaggtgagtcacttctgctgcattggactggaaaagcaccccctccccaggcgacctgaccaaccttgtgcaccaccaacacgccgaacttctgcccggcatcatcggactgtccgaggagaccacgacgggggtgcacaatttggccaaaatgttggcggccggactgctgaaaacggcggccatcaacgtgaatgactcggtgaccaagtccaagtttgacaatatgtacggcatccgcgaatcgttgccggacggaatcaaaagggcgaccgatgtgagtcattcccccccctttaattccggttgatcgtttctcaaattgcctttcccctcaggtgatgttggcgggcaaagtcgccgtcgtctgcggctacggcgacgtgggaaaaggttcggccgcggggctgcgcaattttggcgcgcgagtgatcgtcacaggtgcgctctgtccttgacaccgatgtacaaaacgccaaacgtttcagaaatcgacccaatcaacgcccttcaggcggccatggagggtaaggcaaaatatttgaaaaaaatgaaatttttggatattttaataattcgggtaggtatcgtccgtttatgttccgtcggcactcatttgtcacttgtccctccacgccgcttttcaggttaccaagtgagtacgctggacgaagttgctgacattgctcaactcgtggtcaccaccaccggctgcaagaacattgtgaggggtgaacacatcgaacggcttccggaggatgccatcgtttgcaatgtgagcggtggtggttggaatggcactttagggctctcatatttgctaattactcctaattgccaccatttattcttccatttcattgcccccttttttgaggttgggcatttcgactgcgaaattaacgttacctatatgaacgagaattgcgtgtccatggagcaggtgaagccccaggtggaccgctatttgatgcgcagcggtcggcacgtcattctgttggccgagggccgactggtcaatttgggctgtgccaccggacattcgtccttcgtcatgtccgctagtttcaccaaccaagtgatcgcccagctcggtctgcccgtttatctccctttttctcattttctgcttttcctcgtttagaattgtacacgaaatacggcactccggacgcttacaaaacgggactgtaccttttgccgaaacagttggacgaggaggtggcacggctgcacctggacaagttgggcgccaagctgaccaaattgagcaaggaccaagccgagtgaggaggggttgggggttgaacgaatactgattggcattgcttctctcagatatttgggcattccccaagagggaccattcaaaccaggccattaccgttattgaaaagcagcggatggaaggagaaaagcggaaagaagacctttctatttgtcaatttcactttttgcaattttttttttgtaatcattggcatgttgacacgacattttgttggtttgccgttgtgggttcgtaaatcggttttgttattacttagaataaa

SEQ ID NO: 77776 - DNA, 2728 bp, Heterodera glycines
  Genomic contig location: Contig_ID=SeqID_2085; Location=1266..3993; Strand=-
  SCN-specific regions: Sequence locations=1-119,166-754,789-1038,1085 -1225,1247-1269,1316-1485,1508-1551,1593-1946,1968-1985,2007 -2190,2219-2398,2433-2728
  Gene Ontology: Mol. function=monooxygenase activity; Cellular component=integral to membrane; Biological process=gametogenesis
atgacactgaacaatggcatttggaaagtccaactttcggttggccaattacgccaatttgatgctgcaatgatttgtacgggccatcactgcgagccattaatgccgcaaattacaggttaaaaaataataatttaatttgaaatttcatattatttttattttggcttacttcttttttgttagatatttcgtcgagttaattagcatgttaaatgacttgtcagaatggccaccttaaaatcagcgcattaaatcagcatatttgtgaattctttgcttccaggataacatttttaatgcttattttttcattttcatgcctctttttctttttcagaaacttctaatttttaaacttgttttttactttttcgaatatttccaattcttcacttttttcgtccacaattgaagcaaaaaagaaaaaaagtcgcctttcagatggaattttcgacaattttccttgaaattgcaaaaaattttccgctttttttactgcttttattcaattttttgattttttcctaattattgcgtaaaaatctcaaatttaatttaggccttgagaatttcaaaggccaaattttgcatgccaaacagtaccgcgactataagggatttgaagacaaaaatgtattcattgttggcattggcaattccgcgttggacattggcgtcgaattggcaaaaatcgcgaaaaatgtgggaattttgaattttttaaatttagaaactgaaattgaaaaattcgaataataatttaataaaaaaaattatcataattagccgtaaaatatgtaatgtctttaaaaataggtcaccatttccacccgacgcggcacttgggtgttcaatcgggtcatccaaaatgggctaccgtacgatgttgtttatcagagtcggttttacgattggctgatgcgcactttgccatggacaattgccaacgattttcatgagcatcgaatgcaacagagaatgttaatgcataagaataataatttaaaaacagtagtgacagcaataagaaaattcaaaaattttattcaataaagaaattattttaaaaaatgataaaattgataatagtttgaaaataaagatgttaaattgagttattttagagatttttattaaggcaaaaagtctagaaccttcaaaatcagaactttcagcctaaaagcaaaaatagatattacaataataagtttttcaaatgatccaataaaaaatattattttcttaccaattaccatattttaatggatttttttaaataaattttgaagaaaaataattttatttttttattctatttgtgaaaaattcttttttgaattcaaataaataagaagatgagaaaaaaaaattggtatttaataattttccagaataagatttcgagaaaacataataacatcgaaatccagggaccatgacatatacgggcttcgtccagcacatcgcttcttccaacagcacccagcagtgaacgactgtttggccaatctgttggccagtggccgtattacaattaccgtatgaaattaattataatattattattaataataataaaaatagaaatatttaataggacgacatttccaccattggcgaacactcaatttgtgtaaaagatggacgtgaattcagtgcagatgtgatcattttgtgcaccggatacactttcggatttccattcattaggccggcagaattaattcccatcagagtaaacattttaatagagttttaatgctgaaaatatgaataatattgctccggggcttcgggtataactacgcctatttgtccaaattgaatgcaatttgatatcattcaatagcactaaatattctaaattagcttgcaaaattaaaaaagcgtttaaacagtttttgaacttacattttttggtttttctttcgttttttttaacctttaagaaaattataaaaaatcgttttgtgttttttggctcttgggtaccacctgatcaatattaagctaaattttaatgttcttaaacgctccatttcagaaacaaaatgaaattgacttgtacaaatatgttttcccgccctcaaattatgtggcaaaacgtctggcggttattggtttggtgcagccaattgggagtgtggtaagcaaaaaaaaaattgaaagtttttgaggtaaaatcccataatttgttttttaatttttttaaattcatcaaaaataactttgtttgaagcttcagagtgtttctttttttgtttttcttttttttaaccttacttatggattattttctgtatgattgggcatataattgctctcttttgtgtttttgtgccttttatttttggcatttttgccgaaaaattcgcctcaagcatcggcttatttgattttttaaaagaatttataatttttattttattctcaggcacccattgccgagatgcaatcccgctgggcggccgcagtttttgctggtcgtcttcaacttcccgacaatggcacaatgtgtgaggacatagcacagacgcgggcacaaatgcgtcgtcaatatttcgagtcggccaaacacactgtccaagtgccgttcatcccttacatggacgaactggccgaactcgtgggatgcaagccgaacctggcaaaggtggttggcactttataattgggagtgaatttggcacaattacacattccatgggacaatttaatgaataaa

SEQ ID NO: 77777 - DNA, 171 bp, Heterodera glycines
  Genomic contig location: Contig_ID=SeqID_2088; Location=2461..2631; Strand=+
  SCN-specific regions: Sequence locations=1-31,55-171
atggcaagagaggaatactgcttcgatgcaacggcggcggcagcggcggagcagtctcggccttcggcaacgacttcaacacttgtgcaaggagatggcctgtcaagcagcttcgtggacgcgatcatcaggaaggtcaggcagtcgcctgtccaacgcttcacggatgag

SEQ ID NO: 77778 - DNA, 1514 bp, Heterodera glycines
  Genomic contig location: Contig_ID=SeqID_13837; Location=222..1735; Strand=-
  SCN-specific regions: Sequence locations=1-777,799-1189,1212 -1474,1496-1514
atgaatcgtaaaaaaattgaaaatcttcaaaaatgtcgtaagcgcaagtttttggataacaatgacagtgaaaacgaaacgctatctgctgatcaccgtgaacaaaatgagaacaacaacgaccgcgacgatgattttgaagaacacgccatcgtaaacttcgaacttggagaaacgaaaagaggaggtgtctgcatttggtttaatggtgagaaaaattttttcaagaaatattttcgtttttaagggttccgatttacgcacaaacaaaatgagttgtggagatgcagtgtgcgtgactgccctgcacgcgtaaaaattgtcagcaaaagtgacaacggaatgtccggttaccaaatgcaaaaagatcacagtcacttgccggagccgcaaaaacaacaagtttggatggttaatattgaatcagccaaagaaattcaggccgaaaaacgacgacaacaaatactcgagcgcgtgagagacaaaccccgagtcaagccgacacggcttttggcggagatgaggcgttcagccgccgatgaaacttatgtggctatgggatctgacaatgcgctcagctgcatgatgcgacggcagaagaaaaaaattttgggcaacggactgtgcagacccattggcattcacaattccggacaaattgcggctgaaggatggcgaggacatagtgctctacgacagtcgcacggtcagaattggagaaaaggacgttgtgcttgtttttgggagcgaacgggtaatcatcaggggcgaaaacagaatttaaatttaaattttttagactttggacattttgagcaaaaacagtgcaacttggcatttggacgggacattcaaggcagcaccaaacatgtgggagcagtgctttgttgtgggcgcgtctgtcaaccaccgaatgtgcattggagtctggggtcttctgcccgggaaacatcgacgctactacgaggaagtgctgaactttctacgtaaccgaatttcaccggtcgcaccgagaaaaggtgaaaactaacacataaatttatgtgaaaatctagttttcttttagtcatttgcgattttgagaaagccgaaatgaacgccgtatctgctgttttccctgcaacaaacatcctctgttgcatgttccactacgggcaaaacctcttccgaaaaatgaaggggcttaaactggtgcaaatgtatggggaacagtctgtgcgtggtgaagcggtccgacactctttcaggtaaaacaattcaaaaattgacctgacttcataatttttttagaaatgtcctatctttgccattgttgccgaaattcccaaaattgttgatttaaaaaattttaagcccgtccttgggaagaacccgtcgttcgtcgcgcactgttcccaattccatattggaacgtgcacttgcatgcggcttctgccctcgctcggaccaacaatggcctcgaagcaacccatcttcatttctctgtatttattacttataaaaccccaaataaa

SEQ ID NO: 77779 - DNA, 1002 bp, Heterodera glycines
  Genomic contig location: Contig_ID=SeqID_13839; Location=3..1004; Strand=-
  SCN-specific regions: Sequence locations=1-10,32-375,398-407,429 -821,843-1002
atggccacccttttaaggaaagcaattttcaattttatgcactgcccgaaggatgtttcggtgttattaatattttcaattgttcgccaaatttcaaaaaatttagctaattgtaagttcccaaaaatgttcgaaaaacctgttttgtttttttttggttcctctagccataactttttgaaagttaacgaacatttttgaaaatttgcaggctaataaagaacacttaaagctatcgaatgataccaagagtttttaaaaatttggttacccttaagcaaggtaatgaagagttttttgtcaaaaattttccatttgatggttttctgaacaatgccctttttgatggtttttgagtaatgtccaagcaccgaatgggacgaaaatttttaatttagtttttcgcttttcaggtcccccctcccattcctcggctcgttttgctcatcatttgtcaactctcaccacgtatgtatcgctgagaatcaagtgtccggcgtcggtcatccgctgctccttggccgtctgtttgttggggaaaatgatgttgctgcgctgcgcctgcaccatcagcaacgcctcgcacagtgtgccggaccctttgcgcaacacctgcgatgggtgccaaaacaacagtgttgccgcaagggaagagacaaaaaaaattcgggatttggatgtgaaaaatgcaggaattcgggatttggatgtgaaaaatgcaggaattcgggatttggatgtgaaaaatgcaggaatcggaggagaaaaatgtcgaaactatggatttggatgagaaaatgccccaatttgggatttgtatgagaaaaatgggtactttttaagtttacagggtattttaaacatacattttcagattcctataaatgtgttttagaaattaatgaaaataagttttaaggggttttcaaggtcgctgatcacgaatatagcacccatttttgccaatatcgaacccctgacccgaactcgaacaaaaataaa

SEQ ID NO: 77780 - DNA, 1410 bp, Heterodera glycines
  Genomic contig location: Contig_ID=SeqID_13840; Location=211..1620; Strand=+
  SCN-specific regions: Sequence locations=1-56,81-448,470-1028,1141 -1173,1196-1318,1342-1357,1394-1410
atgcccgaaatcgctttgactttgacagtgccggccagccgtggcgagtacgagatgatgatgctgcagttggagaaggaacggtttggcaaggagcgcaagccgtacaacgctctggcgcaggaggagcgggagaaaattgccaaggagcggattaagggtgggcatgatggcgaaacaatttggcgcaaattattgtatactgtaatcaagggttacggttgtccgtccatttttgatggtttcaaattttaaaggcattagggactgtcccagagttttgaaaatgacttttccgaatttgttttccccattcattttttgtttgctttgccattttgcaaaattcatttgtttgacatgccattatttttgccacagaatattgtcggaatgcgtacaaacggttgcacgacacgcaagaagttcagcggacaaccaccgtttgccaacgggagaaccccttttacgtgaacactgtgcgcgcatttcgcgaccgtcgctacgagtacaaacaaatgctgaaggtggttgtgttgcaacgggtgcaaaatcaatctagcgattttttcaaaattttatgatgtattcactcattattttatttttttatgaagaatttcctaagttttcagcgttttttggagaaattttcgagaaataacccaaaaaattttggaaaatcgccagaaactttttcaaattttttttcctttgaagttttcttataaaaaattcgaagattttttgaatttttttttttcatttttcggggggcggagaaaacttattgttagtgtacccccctcgatgtgtactgtatttattctactgtattttgtctgtagaaagccaagtcggcgctggaggcggtgccgtcggacgatttggccacccggaaacaggcccagcaacgcgtggtgctctacgactcgctgcagttggcgcacaagtgcattctgaactccttctacggctacgtgatgcgcaagggctcccgctggttctccatggaaatggtcgaattttttaatttaatttaaattttagtgattttttagttttattgtttcaaaatttaatttttatttatttttgctcaataatttagaatacttaaacttaaatttatttttattttactatagcaaattgttattttttagttattctaatagaaaatcattcggttaattaaatttttgttttccttttttttattttaatcgtccatttctttgtttatactttttatattatacctatttaattttatttgaaattggtattgtacatttttactatttttcagttaactaaaaatatcagaaaatcgaaaacttcactaatcacacagaaattttaaaaaaaaatatttttaattctttttaaacatgtttttacacaata

SEQ ID NO: 77781 - DNA, 956 bp, Heterodera glycines
  Genomic contig location: Contig_ID=SeqID_13841; Location=309..1264; Strand=-
  SCN-specific regions: Sequence locations=1-409,431-636,658-956
atgccactgccacctgagctattgtttgaaattgttgaagcccttccttcctcaaaattgtctacagtcttcttgagcaatcatctcatgtcaacatgggctaaaaagcgtatcagagggactttcaattcgctgatgtcacagaaacaagaatggagaaatctgttaaaaatatctcgtttggtttttgaaagtcacaatggattaaatgtacaataattggtttttagtttttcgtggttttatgccattttattgttaaatctcaatgcgtttttaattagtttttgcagcaaaaatgtcagaatttctcattttccttttgggtttctcttttgccatgcttctcatgttgtgtttgctggtttcgctggtgctctttgttctttgtgcagcatggaattattggacaaaagaagaacaaccagaagaatttgatgattttccagaatacccaccgccttattaatgaaataatttttttgttgaaatgtgtcatgaaaaaacttggtttaagccatgtacattttttctgctttaaaatttccatttcaaatatctaagttttgaaaaatgttcaactcatcctttttttgctgatgtcaaagaactagggcgtattccaacaccaaagggaaaatttagtgagaagaaaaatgaaactcaatttatgaaaatatttaggtatattttatgcacttgagttcgctaagctttatcaaacgattggacgtgaaatttctcgtaataaattccgccatatcatgcaaacagggaaaaaacaacacgaattagcattggttttgatggaaaaggctgggataaacacccaggagaaagcttttgggcttaaacacctcgaatttgtgcaaaacttttgggacaaggaattcccagatatatttcgtatcgttgcgtttgatatggtaaacgaagatttcctaaactgcctgtga

SEQ ID NO: 77782 - DNA, 108 bp, Heterodera glycines
  Genomic contig location: Contig_ID=SeqID_13842; Location=126..233; Strand=-
  SCN-specific regions: Sequence locations=1-108
atgacgacagttacaccgcaacaaacagctgcaacagcagcaggtggaaattgtgataaagacccggtcgacctgatgttcatcattgacacgtcaacgagtgttcaa

SEQ ID NO: 77783 - DNA, 171 bp, Heterodera glycines
  Genomic contig location: Contig_ID=SeqID_13842; Location=573..743; Strand=+
  SCN-specific regions: Sequence locations=1-171
aaaatccaacgcataattaaagtacaggctatagggaagctattccggaaggattcggtctccccataaatctgggcgcatcggttcggggggactgccccgaaaacaaaaaaatcgattttttcaagtgctcgtttgtggtactcaaacaattatggggagcaaaaatcc

SEQ ID NO: 77784 - DNA, 1270 bp, Heterodera glycines
  Genomic contig location: Contig_ID=SeqID_13843; Location=717..1986; Strand=-
  SCN-specific regions: Sequence locations=1-47,71-326,380-572,605 -870,892-937,982-1062,1084-1171,1195-1270
atgtcatcacaggtggatttgatgttcatcatcgacacttcccaaagtgtgcaggaagcatttgaacaacagctccaatttgccgtggatttggtgggctttaaaaaatatgcaaatatctttaaaaaatgattttttccaatttaataataggtcaaacgcttgccggaccaagattttgcacaacgtgtccaagttggagcagtatcgttcaacaaaaaagcccaactgcaattcacgatgggccaattgaaagaaaagccggtcatccttgacgcattattgcacattaatcacacaggcggcggcacttcggtaaaagaatgaaatatttatattaaatattttttaattaatataaattcattttataaaaaatctctcaacaaacagcgccattaataatttaaaaaatgatttggaatgattttatagctcattttaaagcgaatagtcagagcttgtaattggtatattcaatacatatttacattaattatttttttgtatgctactataaaaaaaaagaaaagagaaacagcagtgggtgaatttgcttcaaaacgacctagtaataaattaaaaattaaaattttaaaaattacaggttgtcagtggtgtgaatttggcaatggaccaggtggccaaacatcgacgaaaaggcacccgattgatggttgtgctaatctcggacggtaatttctttttttgaatgatttgtccaagcatcgccaagggatagaaaatttttgttgaatttttattaatttcctagctaattgcgcagaaatttatcgaaaatatctttgtttattttcataggcaccagtcaagatccatgggcagatgtgatacgttctgcggtccgacttcgagcagctgaagcggatgtttacgcagttactgtcagccatgactatttcttcaggtgtctgtctataaaatttttttattatttggattatttatattttaatttttggatagtttttataacataaaattttttcgtgctggcgcgtttgttaaaaactgccagcgcgtttgttaaacctgccaatgggtttgaaaacaaaaaatgggtaaaataattaaattaatagcttggctcaaattcaaccaaattaatatttcgtggtatcattcaatagctttaattgttctctttcagaatataattttcctaaatttttaacttaagtataaaagaagttataaagcattgaacaggctatgttttttgcaatggtaatgcatatataataataaa

SEQ ID NO: 77785 - DNA, 265 bp, Heterodera glycines
  Genomic contig location: Contig_ID=SeqID_13845; Location=1924..2188; Strand=-
  SCN-specific regions: Sequence locations=1-129,151-233,256-265
atgattctattttgctgttttatcaaaaagaaaaagatagattttttaactttgctgagacggaattggctcgacgagttcgcccctaccgcgataggcgccgcgttagaaaaaaaagaattttgaatatttttcatttgatttcactaataaatgggaaattttaggtccaagttttgaaatcttaaaggatttgtggcatggagccgataggtgccgccgggaaaaattttataaaaatcccaagtttttcattttaaataaa

SEQ ID NO: 77786 - DNA, 1045 bp, Heterodera glycines
  Genomic contig location: Contig_ID=SeqID_13845; Location=2424..3468; Strand=-
  SCN-specific regions: Sequence locations=1-358,448-575,630-834,869 -934,956-1002,1031-1045
atgctcttctcaaatcctttcatcctgtgccttctgctgaattttctgatcattggcccgtcccaattcatcggccaattcattacattattggtgaagtaattagcatgtcgaccattatgaaatttttttattcttttcacgacactttttgcgccgcattttttcaaaaaaaaaaaaacttttgaggaatgggtgggggtgagaaaaactttaatcgcttaacagatttttcaaaaaatgaccaaattttgcgttttgaggactgttttggagtagttaagcatccaccccaattttgaaaaaaaatttaatttatcagaattaagctatgatgtatttttcaagttttcttgtgaaattaaaaattttaaaataaaacaaaagtgataaaaaggaaatatcaataaaaaatgtaaaattatttttaaaatcattaatttaattgccaaaagtatttagactaattaaacttattgtttagtaaagagttcattagtaatcaaagtaaattcaaattaatatatggaaacaacaaaaatctttttgttcgtccatgagtaactaaaaaagtgttaattaaaaaataattaataaaatattaatttaatgataaaacaaatttaattcatacttcaataggaaattataaaaaagacaaaatttggtttttaagccagttttaagaaaattcacaggcggcgccgacaggcgccagcggtaaaaattgggtttttttgtgcgtaataactgattttagacaaaaaggcttttttatagaaaaatataagttgaatgatacggtgctaggtcaaacctaaaaaagtatcagtgtataataaaaataaataaatttaaatgttataaagtgagtaaatcctataaaattctaatttttagcgttttttgcagccattttagcattatgtttacgcaacatttcttctcgtatttcaattcaaacatcgatatcaatttttatcagaaagtattagctagctagaaacttaaaaaatgaatgaatatatgtaaaaaaaataataaa

SEQ ID NO: 77787 - DNA, 1358 bp, Heterodera glycines
  misc_feature (414)..(414): n is a, c, g, or t
  Genomic contig location: Contig_ID=SeqID_13845; Location=4177..5534; Strand=+
  SCN-specific regions: Sequence locations=1-52,95-202,254-260,282 -382,417-479,537-739,831-1001,1043-1053,1077-1115,1202-1358
atggccactttcaatgtggcccatctcatcactttaattggcgttggggtacaaaaatttaaattaaattttattcctattttttataatatttgattttgttttagtcaattgcttcatcggttgttgctgatgagcaacaaaatcaaaacaaaactcaaaatggagcaggaggcttaaagcatttgtttggatcagatggtaaaaatgatatttttttatttgaaatttatttaaatttaattaaataaatgttgaacaatattttaagggttaatttttgcttttagttttcactgagcttcgggacaaacaaaatgcgatggccgagaaaatgtcgggaactgaggccaaattggaaaagcaaaatgaaaatggtaagaatttttttaattgaatttttatattttattntaggaatgcgcgaaacccaaactttgttgtccaccaaattggaaaaacaaattgaaaatggtaagtatttttatttaaacataaattaatttatttaattaataaaataatttaaaaattttgtttagtatttactgaactgcgcaacaatcaccaggggctgaccaccaaaatagaaaacggtagaaaatattatttattttcttattttggaaatgcgctttaggaatgcgcgacagccaaaatttgttgtccaacaaattggaaaaccaaattgaaaatggcaagttttattctttatttgcctatataaattttggttttgatttaaaattaaataattttttatttaaaaaaattatattttttatattctatttgaatttgttttttatatttttttttacaaatttataccgttcaattcctaaataatttccaattaattgccagtattcacatataattggagctttttagagaatatggtgtggtatttctattcatttgtatttaggaatacgagagaatcaaaatgcattggccgagaaagtgtcggaaactgaggccaaattggaaaatggtggaaaattaatattttttctaaatttaatatttttattttaatcatctgcaggaattcaaaacaaccaaaaggcgttgtctctgatgaagaatatggcaacattagcggtttttacaatttaaaaaaattaaaaataaatgccaaattttatttttataaattaatctataatttatttagttgttatttaaaaattaatatgaatttgattttacagttctttcacttccctcttccaatttatcatcgatggaatgcctcggattgtcacccaaaaattgtgatcaatgaaagcacaaatgccattcagcgcaacggaacagaaagtgaccagaaatcattgaaattgaatgcataa

SEQ ID NO: 77788 - DNA, 2451 bp, Heterodera glycines
  Genomic contig location: Contig_ID=SeqID_13846; Location=98..2548; Strand=+
  SCN-specific regions: Sequence locations=1-37,59-155,177-208,230 -1043,1065-2045,2081-2451
atgttcactgaccgttttgacatgtggatgcgtgtatggtgcagcaaaattgctgttttccaccaggagctctatgaaaagagtttcttcggaacaatccttggctcaggcgagtcaatggagttccaagggcgtggtggcccacacgcacacattgtagcccagactgacctggacgcagtcccagaagtcatccaggaatacatatgggctcatattccacctttgccagacaaagatgatgactccccaattgcacaaatgcatcgcgaagtacgagattatatgcatatgcaactgcacagatgcagtgatagttggtgcggtccacgtgaccccaactttgggcggtgtaaaaaaggcttcccagccccgtactcgaaatgtacgattctgcacccggacaggcccgcgttgtattaccggcctagcccaaccgatggtggtgccaaaattgaggtgaacggcttaatatacgacaactcacaggtcgtgccgtacaacccatacattttgctgcgttaccgagtgcactacaatgtgttattcgcttatggtaacaaagcgaacatcaaatatgcactcaaataccctttcaaagggcctggacattgttatgtcgagtgcaaagaggagtccggcagcaaaatcggtatcgatgagccggctcaatatgccaaaatgaacttccgtggtgctacggaagcttttgcagttgtgcattcaatgcaatttgcaaaactctcacatcacgttgttcagttgtccattcatttgccaaaccagcagcccgttgtatacagggccttccaactggtgagcaaagctgaggaaattcagcgaggcgagctcccagagacgccatgctctgcctattggaagcaatggcaaaacgaatggcagcatgttccttcgctcaaggacatgctttttgaaaaagtcccagagcaatttagatgggcaaaagatcgatgggtcccatataaaaggaagcctaccaagaggcccccaatcggtcgtgttgtacctgtcgctccaaaggacattgaaagatttgcactttatgtgctgatgcgtcactttcctggtgatcccgaccacttaaaactggtcaatgggcagcagtacagcaccttccaggaggctgctttacagcatggtcttcttgaagatgaccaaatttggcacaaaacgctcggcgaggcagccttgcatcgctggccggatcagatgagatggctcttcgtgagcatcctcgtttttgggcagccaagcaattccctggaactgtggaacaagtacaaagaccaaatgtacaatccgcagggcattatcagtgcggctatacgccaagcacgggagcaggaagcgctagccgacattgattggcgattgcacttctttaactcaagctgcatgcactgtggcctcccagatccaccaaattcaaaagccaaaaatatcaatttggcaattgaagaatatttctatggtgatgatggtctgaatatgccgcctggccagccaaaacaaaggccacaacaaaacaccccacctccactcaacagcgaccagcaaaaggtctttgatgctgttgtgagggcaatacagtcggacccgaaggaccagactgtgcctcgccgtttcttcattttcggcgatggaggtacaggaaaaacattcctgtttggccaaattatcaagcgcttgcgcaagcccccatacacctataaagtgcttgctacggcatccactggctgtgcggctattttgctgccatatgggaaaacagctcattccacgttccgtctcggcagagaagtctcgctagacaagcttccaagcattccgcttgaaagcttctttgcccgacggatacgtgaggcccaactcatcatcattgatgagatcaccatgcttcataacacggtgattgcggtaatcgaccgagtgtgcaaagaaatggcaattcgccagcacaaggacctcctcttcggaggaaaaacggtcatttttagcggtgacttcaaacagtcactgccggtcgtgcctcatgaaggcttaaccgctcaggtgacagcctgttttcaaacatctccgttgtttgggcagttcagcacgatgaaattgaccatcaaccagagattgggccaaggtcagcaagcgtacttgcaaatgtgccgccaaatcggcctcggagagaccggagaacacttctggattcctccgcagttcctcgtaaagagcagggaagagttgatagactttgtctattccgacttccaaaaactccttggaaatgacatggaactgctcaatcgtctgatcctcgcacctcacattgacacgtgcgatgagatcaacgaaatcatgatggcgaatgtgcctggtcaagtgcgcgaatatttgtcttcggacagccgcttgacgagcgtcactggacatcgatga

SEQ ID NO: 77789 - DNA, 684 bp, Heterodera glycines
  Genomic contig location: Contig_ID=SeqID_13848; Location=392..1075; Strand=+
  SCN-specific regions: Sequence locations=1-178,211-684
atgatcggccaccttatttattgtatgtaaatagttaaagcagaaagatttttgcttttgataagtttttcccaaattttaactctttttgaaaattttaacggcgccaaatacacatgccaaatttaccacgacaccatttttgggattttcgtctttaccaatccattctttagtcataaaattattaatttttctattttttttaatgtacaattcttgatcaaatttcattaattatacatatagtctatttagctatttacccaaccgcgcacaacactgttttttaggtgctggctctaagtaaattaacccctgcaaattgggtgttttcaacataaatttgccatttaaaaaaattattttctttcaaataaagttgtgacaaattttatatgttaattaaaataagccaaccagcaggcggtttttgcgaaacgaccaagcacaaaatttggacccaattgtgaaacaagcgtacttaaaaatgtccttttttcagtacaccatgaacaccaaattaatactccttctaatttttgtcctcctcaccaattctgttgcaaaaatacaagacgacgttaattctgtcgctcttatctccacattgaacccggtgctaagctttctaatgacctctaatcatcattaaaaataattacgaagtgcgaaaaacaaaaa

SEQ ID NO: 77790 - DNA, 317 bp, Heterodera glycines; identical to SEQ ID NO: 58927
  Genomic contig location: Contig_ID=SeqID_13851; Location=2179..2495; Strand=+
  SCN-specific regions: Sequence locations=1-56,78-317

SEQ ID NO: 77791 - DNA, 781 bp, Heterodera glycines
  Genomic contig location: Contig_ID=SeqID_209; Location=1101..1881; Strand=+
  SCN-specific regions: Sequence locations=1-149,171-748,770-781
atggctttgggaaattcctcaggaattaattttcgttgtctaaagaaatgcgctagtgtcgggcattcatctgctgcaccggccgaagaagcgatggagccgccgccaccaactccaggaccagtgccaacgccagaaatggacgaggaaattttggaattttgcttttcgctgccatcggcatctgtcacaccaatcggcgatttggtgccgttttcgacaacaccaactgcgccaatggacaccggagagacgaccccgccaccgctggccattgacgagcgatcagagcgcatcgaacaactggagaagcagctcaaggaccgggacgacaccatcaaatttctgcgcaagcaggtccgaaaccgagaagcgctgatcagtgatctgcgtcgtcagctggagcaatgtgcggcaccaccaacggcgacaccaacccattcaatgaaaaattcattacggaacatggacattgaatcatcaaaattctcgaaatccttcaattttcctgaatgttcttcaatttgaagaccgatccccgtcaccaggccatggatttatttcaccattgttgttgcatttcgcgtccgccaaaattctcataatgacggcgtcctggaggatgtatcgtttgtgtcgcttgtgaatgaaatggcgagcagatcgggcagcgtccacctgtctgtcgatgctttcattgactccacagatgaagtcagagagtgccgggtggtgacagagacctttctaaatatatttttaaaaatttgcccgtagtaaa

SEQ ID NO: 77792 - DNA, 1465 bp, Heterodera glycines
  Genomic contig location: Contig_ID=SeqID_210; Location=1..1465; Strand=-
  SCN-specific regions: Sequence locations=1-24,49-524,546-983,1005 -1291,1313-1415,1437-1465
aatagttgtatatccgaaagggacaaaaagaataaaaagaaatttacgcattagataaatgtgttgatccaatgtgttatcctttgctttatccgtcaaatatcgaaggatataatgttaacattaaagagacatcaggaaaaaaggtgtcgttatgtgactacagtaaattttttgttttttcgagaaaatgaaaagtttttccctcatttttatgcaagcaaactatttcgacaatggttagtagatcaagcagctaaaatcgagtgggaccgtttagaatatataagaacacatcaagccaaactatggagtagcaattatttaaatgttgaggattttcttaaaaatagagcttcaaaaaccggggcagaaataaggaagaaagttatacttccgtcaactttttctggaggaccccgcagtatgcatgaacattttatgaatgcgatggctatagtaaacgaatctggcaaaccagatttatttattacgtttacatgtaacccgaatgacccggatattttaaaatgtcttttaccaggtcaaactccatctgatagacccgacattgtaacacgagttttttatttaaagaaaacacatttattagacttaattttgaataagcatatttttggagaagttatagccaattgctgggtaatagaatatcaaaaaagaggtcttccacatttacatttattagttacgttgcatccaaaaaataagtggcattcgaccgcagatatagataaatttagttgcgctgaaataccaagcgaaaaagaagatcctgttctttttaaaataattacaaactgcatgatgcatggaccatgcaatgaaaaatcaatgtgttggaataaactaaagaaaaaatgtggtaaaaaatttccaaaaacttttcgtgaaaatactgagcttaatgaagatggttatccactctacaaaaggcctgataatggacgttttatttatagaaaaggacaaaaattaacaaatcaatatgttgttccgtataatccttttttgagtaaaacatttaatgctcatataaatatagagagaatgattctgcgaccgttgaatgtattcaaatcgaagaaaatggcacaaaaaaaatattaaaatatgatgaagtgggagcctatcttgaggcgcgttatttaagcccatgtgaagcctgctggcgaattttaaaatatccaatgcaaggaaaatctcattctgtcgacttattagatgtacacctcgaaaatatgcaaagaattttttataaaaaatgcttctgaagaacaaatagaagaagcatcagtaaaagatacaacattaacggcttattttaagttttgccaacaaaatccaacattaaaattcaagtacatagacatgccaaaatactgcacttggttaaaaagggaaagaaaatggaagtatccaagacaaaacaatcaaaaaaaga

SEQ ID NO: 77793 - DNA, 1063 bp, Heterodera glycines
  Genomic contig location: Contig_ID=SeqID_212; Location=68..1130; Strand=-
  SCN-specific regions: Sequence locations=1-11,33-297,334-467,489 -594,624-1063
atggtccgcactaaacaaaattttccaaaagattctgcctgttgctcttcttctctccagtatttagacgccgaaccggttcaaagctccggaaaacaaaagcggattgaaccggttcaaagctccggaaaacaaaagcggtcagaaacgaacttaacaaatgaaaaaaatggtaacaaagaaagcataaatctcgatgaaatgaatgatttttcttatacttctgatgaagaacatactatgaaatcatatgtggcgcaaagaaaagcaaaacaaagaaagctaatggataacgatgaaaaagaaaaagaactttttgaaaatagatttagaattggactaaaaagggctaaaatgactgaagaagaaatttcttatgtgagaaaaaatggccgtgttaggcatgccttaaagcgaatgcaaatgactgatcaagaattaaaaaaccaaaaaacaacaaatttagctttacaagaaaataccagaaaacgcaaaagggaattttgttcgttacactatctcgccgcgacagaacatcaaaataccgaattttatcaacttggcaagtttaatattaaatgtctggaataatcctttttataagaattttattaaaaatattagaaggtataatagtatttttgcctgtgcatctattagttgctttaaatttaaatttccaacaccgggtccgccctgttataaaattcaagggcaaatttaccataaattcaatccaagtgcgatgccaaaaaatgaaaaagatcttcctacaaacggccaactttatttcattgattcggaagaggctataaatatacgttgtgaaattgataaggaatgtctcccggatttattggaatatattgaaaaatatttacgaaaaaataatccattcgcacagtcatatttaatgatgaaagaagtgtatgagcaagaagaaaaaaagtgtaaagaaagaggccataaaatgcctaacataaagttactttttagcttaaaggagaattatgaccaaaggaggtataatataccactgagtaacgaagtttgcgctataatg

SEQ ID NO: 77794 - DNA, 852 bp, Heterodera glycines
  Genomic contig location: Contig_ID=SeqID_212; Location=1522..2373; Strand=-
  SCN-specific regions: Sequence locations=1-7,30-191,213-314,337 -375,397-458,488-531,584-852
atgtcggaaaacagtaaaataaatgaaaatagttcactgtcgaaatcggtcactgtcgaaatcagccactgtcgaaatccactgtcgaaatcggtcactgtcgaaatcagccactgtcgaaatgttacagcaccgtcattccgtatgtcacattttaaacggaatatttattgaaacgaaaacttttattaaatttttgcgagagaaaaggtaaagattagagagcaaaaacggagaaagggcagcagtttaatgtgttgaaaacaaaatagaaagtaatgatggctgctttgtgaaaaaaacaaacattgtgaaatttgatccttttctttttgctttcatattcttaattaaactatggttttttatgtttagaaacaacaattaattttaacttttgtaatagtaagaatcacttttgttttaaattcccatataaactttttagttttttcaacatttaatttaattacatttttttaaaaaacagttgattgttgcgcctttatcatattaccccttttagaaaagttttaataattttttttacttattaattatttcaataacaattaaatttattgatattgttaatgttaatggacaatccataatattcggacaattttcaatgataatccgtcgacatttaccagtggctaatccgtcagcggaaaaaccttcaatggacaattcaacagtaattttatttttttggtgaattaatcaataatttttcgaacacataatttgtagctgagttttaggaaataagaaaacttttcctaaaatggtaataggaattaaattcaaatttttttttatttcagccgggacctgaatatgaataaa

SEQ ID NO: 77795 - DNA, 459 bp, Heterodera glycines
  Genomic contig location: Contig_ID=SeqID_212; Location=2522..2980; Strand=-
  SCN-specific regions: Sequence locations=1-144,166-459
atgcaaaatgaagaagttttggttcacgatgcaggcggagtaggtgataattggattcgagggagaattgaggcgcttaatttggcacagactcgacgctctttttccaattgaattgtggaatgtggtggacagagtagcagaagggcttggaagaacaaacaattcgcttgaagtgtggtgggatgtgaccattttttcatgtcttttcttcagggttggcattcaacttggaatgtgcaccttagggggaaccaacgaccgagttcatttgctcggaaaatgatcgaggaagatgaactgtggagaattcgggttgcagattatcagattgcaccggctgacggcattaaagggcctcatcgtcaagaccaaaacttggaagcacttgtgcaggattttttcaatcgtgatccgatccaatttcttcgcgcttgcgcttatcatctgcacttttaa

SEQ ID NO: 77796 - DNA, 1848 bp, Heterodera glycines
  Genomic contig location: Contig_ID=SeqID_213; Location=831..2678; Strand=-
  SCN-specific regions: Sequence locations=1-298,320-539,597-859,885 -1509,1531-1848
atggctctactccgattcgcagagaccaaaacaaatcgtgggaaaattcttctatctcgtagcggatatgactacactttcgaggttaaaaggctaatttaatttcgtgaaaatgttaaacgaaaaattctaaggctgtttcgaaaactgaagacggaatggagtattggcgttgcccaaaccgtccaccttattgcccagggcgtgcttgtgtacagtgccgttgggaagtcgatgccgatggatcgcgatataaaattggacgcactaccggacagcataaccatccacccgttttggggggtcatatggtagaaatttaaaatgtaacgggtgttaagtagctaattaggtgagacaagcatctgaacgtctccgacaagaggcgcaaagcgaattcccgaccacaagccgtaacatcatcagagaagttcggtcgaaccttagtgatgagattcgggcaatcagtgcaccctctgcagctgatatgaggcgaacatataattatcagaaacggaagcatcaggaagaggcaaatgataattagataattaaaaatataaatttaataagcaaaaataattttaaaaataaatggttaggtcggcgatgttggattggatgtcttacccgcatctcaaatcatcataccggacagattgcgtgatcgtacgatttatgatcaaactgttaatggagaaaaaatgatcattttttgttctcgttttggccttgatcttttggcgaattatcagaatgaagtggcaatcgatggcacttttgaggtgaataactaaagggcacttttagctgatagtggcgagaggcatataaaatgtgccgctaccaatataccacaaaataagtaaaattgtttttatcttagacatgcccaaggggatttactcaagtctacacaatggcagttgtcatcgatcattgtgcagttccggcagtttatggtttactgcccagcaaaactctcgccacatacacaagattcttcgaaacaattcgtcagtctgttggcaataattggttcccgtaccgtattatgagcgatttcgaatcgggagcgatcactgcagctggcaacgtctttccaaattccataagaaccggatgcttgtttcactttggacaagcaatttggcgaagaattcagcgattgccaaatttgctcacgcgatatcgtgacgatgaagttgtcagaacatccttgcggtctctacaagcgctggcttttgtccccgtcgactttgtctacaactatttttgcattgccatgtcaattcttgagccgactcctgagcttcaagagctgatcatctatttcattaacacgtggatcgggcctcgccgaatcatgcaaaatgaagaagttttggttcacgatgcaggcggagtagctgataattggattcgagggagaattgaggcgcttaatttggcacagactgacgctctttttccaattgaattgtggaatgtggtggacagagtagcagaagggcttggaagaacaaacaattcgcttgaagtgtggtgggatgtgaccattttttcatgtcttttcttcagggttggcattcaacttggaatgtgcaccttagggggaaccaacgaccgagtttatttgctcggaaaatgatcgaggaagatgaactgtggagaattcgggttgcagattatcagattgcaccggctgacggcattaaagggcctcatgaaacgagaaaggccaaatacattcgtcaagaccaaaacttggaagcacttgtgcaggattttttcaatcgtgatccgatccaatttcttcgcgcttgcgcttatcatctgcacttttaa

SEQ ID NO: 77797 - DNA, 633 bp, Heterodera glycines
  misc_feature (622)..(623): n is a, c, g, or t
  misc_feature (625)..(625): n is a, c, g, or t
  Genomic contig location: Contig_ID=SeqID_213; Location=3172..3804; Strand=+
  SCN-specific regions: Sequence locations=1-43,65-457,479-633
gcactgtcgaatattaaagaggcgaaagaattcacagtatcgtttctaatagggaaatattgacaggatattcggctaaaaacgggtttgatcatttttagcgcatttttaggtatacatttgagacaattgggcaggacaagaaaagaatgaagttgatgcctcatgaaactcggaattggttatgtttagtcgaaaatatgcttacataatactcataaaaaatacaaataattcaacccacctattctatgaccacattctgaaaaaaatcccagaaatacgaggaaagatatgcttggtcacaataaaataaaaaatggctagtatgtaaaaatttgcggtcactaataaaataaaaaatggctaatatgtaaaattggcgtccagaaatttttagactaatccgaagcaaagcacgaatgaattaaagaggcgaaagaattcacagtatcgtttctaatagggaaatattgacagtatattcggctaaaaacgggtttgatcatttttagcgcatttttaggtatacatttgagacaattgggcaggacaagaaaagaatgaagttgatgcctcatgaaactcggaattggttatgttttgtcgaaaatatccttanncnataatact

SEQ ID NO: 77798 - DNA, 216 bp, Heterodera glycines
  Genomic contig location: Contig_ID=SeqID_2089; Location=644..859; Strand=-
  SCN-specific regions: Sequence locations=1-14,36-147
atgaaaggatgtaaaaaagcaattttgggcaaaaacattgctaaaaaatatttgggtaattttttatgaaaaaattaataatcattcaatcattcagatatattcttatctgtcaaatggttaatttagggaaaatacaaatgcgacttattattcaatttgtaatattagatttttatttttcaaaattttttcattttcaaatttttaaataaa

SEQ ID NO: 77799 - DNA, 747 bp, Heterodera glycines
  Genomic contig location: Contig_ID=SeqID_2089; Location=466..1212; Strand=+
  SCN-specific regions: Sequence locations=1-172,248-408,458-708,730-747
ttaccgaaagaattgaaaaatggaaaaaatcgaagtaaaagaaacaggtttattataattcattactttttggacatgcgaactttttcagatatgaagtcaaatctgatcgaccaaaccattgaaattgtgcgcgatggcctgcaaaaatatggccaagataaattaagagaattattttatttaaaaatttgaaaatgaaaaaattttgaaaaataaaaatctaatattacaaattgaataataagtcgcatttgtattttccctaaattaaccatttgacagataagaatatatctgaatgattgaatgattattaattttttcataaaaaattacccaaatattttttagcaatgtttttgcccaaaattgcttttttacatcctttcatgcggaacaaaatgctaaaattcttttttttaaattcattaaaaagatttattgtaaattaattggattaccaaattgcccccccccccccgccctgcaggacattgccagcttcgtcaaagacacaatggagcagcgcttcgccggcacttggcattgtgtcgtggggcgcagtttcggctcacgcgtgtcctatgaattggagtcattcgcgcttttcaaggtcaaccaacacaccgtgctgattttcaagtgcggataatgggagaggaaaacaaattatatcaaatgctaatacaaatattcattttgtatatttgtaaaatacatttaaaaatagctgtttcaaaatca

SEQ ID NO: 77800 - DNA, 519 bp, Heterodera glycines
  Genomic contig location: Contig_ID=SeqID_2089; Location=6058..6576; Strand=+
  SCN-specific regions: Sequence locations=1-519
atgggagtgccggcggagaaggaacgcgccacacacagaaccatgggagtgccggtcgagaaggaacgcgccacacacagaaccaggggagtgccggtggagaaggaacgcgccacacacagaaccaggggagtgccggcggagaaggaacgcggcgccacacacagaaccacgggagtgccggcggagaaggaacgcgccacacacagaaccatgggagtgccggcggagaaggaacgcgccacacacagaaccatgggagtgccggtcgagaaggaacgcgccacacacagaaccaggggagtgccggtggagaaggaacgcgccacacacagaaccatgggagtgccggtcgagaaggaacgcgccacacacagaaccaggggagtgccggtggagaaggaacgcgccacacacagaaccaggggagtgccggtggagaaggaacgcgccacacacagaaccatgggagtgccggcggagaaggaacgcgccatacacagaaccaggggaatgccg

SEQ ID NO: 77801 - DNA, 989 bp, Heterodera glycines
  Genomic contig location: Contig_ID=SeqID_2091; Location=233..1221; Strand=+
  SCN-specific regions: Sequence locations=1-39,61-871,893-989
atgcagcggaagcaaaccaataatgtaataatcattattcaaaattgtttgttttttaaatttggtcttgttacaagatttgctgaacgtcagagacaaccatgggagtgccggcggagaaggaacgcgccacacacagaaccaggggagtgccggagaaggaacgcgccgcgaacaattgcaagagcgtggcattttcgggacgccaaaagaggaggtaggaggaaaagtgtaatttacttttaaaaggctttcttcatctttcaggcgatggcattggcaatcaaggacctgacgttggcgacgaatcaactcacgatgacgatgcagacgttttcgttggatgtgcgccaaatgaaggagacgacttaaatcgacatccaaacgaagcggcaactgatccgttcggtggacactctggcccgtgacctgaacaactacaacacacgtggtggagaagcacaaggagttgcgcttggccttctgaaccgaatcgacccgcagacgttgttgcttgagttgcttcgtattttgcttcgtcagtgatctgtcgcaatttcaccccgtcctatatattgtcatgtgttctcttttgtggatcaaatgttccctttatattgtaacaacgattacccaccatatatgttgtgtgtgtgtgtattgtatatactaatgttgataaaggaatcgaagctttttaccccagaaaaattcagaaactgattttagccccaaaaataggggtaatagttcagtttgtgtttttgacttttgaaaacataaaaaaattttcgaaaaaggggggggcgacaaactgaactattaccaaaatagggaccacaattctttatcattactgcaatattaaaaatacctaattttgatttgcttaatttatgcttcctgttcttcagccgaccaattgcttacaaattagcattccctcccacccaaacattccacgccaacatgtgcgcaacaattattta

SEQ ID NO: 77802 - DNA, 1184 bp, Heterodera glycines
  Genomic contig location: Contig_ID=SeqID_13854; Location=2276..3459; Strand=+
  SCN-specific regions: Sequence locations=1-427,449-468,500-560,588 -607,629-692,761-763,787-926,948-1184
  Gene Ontology: Mol. function=enoyl-CoA hydratase activity; Cellular component=mitochondrion; Biological process=growth
atggcgctggcgtgccactaccggatcgcggtcagctcgcccaagacgcaattcgcactgcccgaggtgatgctcggccttttgccgggcgccggcggcacccagcggttgcccaggctgatttcgctgcagaacgccctcgacatgatgttgaccggttggtgggcacgggacgagaacaggataaatcgtcgctgcaaaaaatagagaaaaaattcaaaaataaatttctgaaaactggattatttacagttagataccaacatgcaataaattccaatttttttatgaaaccgttttttcctgttgttttttacaccctcccattttcaggcaaagtcattcgaccggacaaagcgaagaagatgggcctggttgaccaacttgttcaggtgaacacggagttacatttaactacaatttcgcattcttatttttacaattttcacaaattcttaacaaaatcgaaaatcaacaatgattttttaaccccttttttgctagaaaaaaaatcagaaaataaaaagaaatttcttaaaacattttaaaaaagtttgtcgcttgtttatttatttttatttgttgtctaaatatggatcaatttcagccactgggcccggggctgagtgacccgatcagcggcacacatcgctacttggaagaggtgcccgcaatgagttggaaattcaaccaattataattaattggttttttcaaaaaaaaacatttaaattttaccgaatttttaaaatttttatttgaataacttttactgttttttattttgcacttcgcaggtcgccatttccgcctgtgagcagctcgcggccggcacgctgaaaatcaaccgcgagcgaccgctgatggagcgcattcagaacgtgttgctgacacgaaaaccgttgctggacgcggtattaacgattttcattaaaatttgcaaaaaccaaaaattcgaacactttcccattttccaacccctctccctcattctcacgggcatagcctttatatctgtctgtattccccgctctgttctcgtttcacaggtggtgatgcgaatggcacgggacaaagtgatgaagcaaacccatggcaattacccggcaccgttgcgcattttggacgttgtccgcaccgggctggtggacggccagcaggagggctacgaggaggagacaaag

SEQ ID NO: 77803 - DNA, 62 bp, Heterodera glycines
  Genomic contig location: Contig_ID=SeqID_13856; Location=429..490; Strand=-
  SCN-specific regions: Sequence locations=1-62
atggcgacattctatgggctcgagtttgggacccaaacgatggtttacgcccgggagacgtc

SEQ ID NO: 77804 - DNA, 446 bp, Heterodera glycines
  Genomic contig location: Contig_ID=SeqID_13857; Location=482..927; Strand=+
  SCN-specific regions: Sequence locations=1-446
atgactcgacctctgatgccccaactcaatgagctgatggccccgatgtacaacattgtggtctccgacgtgtacaacccggattacttctgtgtgactctcattagcaaagtgagtgtctttccttcccacactttgtctacctttttctaacatttcagaacatcaaaatcaatcactccgaagtcattcgcttccccaacactcaaatgggtcgttccatgacagtcatccaaggccaatggcaacgcctccgtctcgcgctggtcaacacccatttggaaagcactcgtgaagtcggcgaagagcgcaagacgcaattcaaattgtgtatggaaaaaattcgctcaatgtccgggaccgacagcgaagagacattggcggtattcggtctgtttttggtggtattccgttttgaaggcaactcccgtttccacaggcggtga

SEQ ID NO: 77805 - DNA, 386 bp, Heterodera glycines
  Genomic contig location: Contig_ID=SeqID_13858; Location=162..547; Strand=-
  SCN-specific regions: Sequence locations=1-9,32-38,63-386
atgaaccgacggtaagcaatttgaaaagtcacacaaattcttcatttatttaactaaactttttcccatttcagttggatttgcaacgacgtttggatggacattttcccctcttttgaccgtgctcaactcggcctcaaattggcacttctttcgccacgtttcaatgcgttggtggacaaacatttcaatggcaaaagtgaattgactatttggagaccaatcgaaattcgtcgcaaggacaaaggaccagaaccgaacctatctgtgcggatggatgacagatttgtgccatttccatggcctgaggaccgtccgttgcccagcaaaattcgctttaaagaccttcggattgagtaatttaaaatcagagttatggcaataaa

SEQ ID NO: 77806 - DNA, 451 bp, Heterodera glycines
  Genomic contig location: Contig_ID=SeqID_13859; Location=196..646; Strand=-
  SCN-specific regions: Sequence locations=1-33,56-451
atgaaccgacggtaagcacaaattcgtcatttatttacctaacaaaacttttttcagttggatttgcaacgacgtttggatggacattttcccatcctttgaccgtcctcaactcggcctcaaattggcacttctttcgccacgtttcgatgcattggtggacaaacatttcgatggcaaaagcgaattgacaatttggagaccaatcgaaattcgcaaggacaaaggaccagaaccgaagctgtctgtacaaatggatgacgaatttgtgccatttccattgcccgaccgtccgttgcccagcaaaatcctttttaagcgccttcagattgagtacttaaaagcggctctattgcagttcacaggccataaaaaaagacacgaccataaattatttttgtcaactttagtgcaccctttttcaagaagcatccaaattaaacattattag

SEQ ID NO: 77807 - DNA, 2027 bp, Heterodera glycines
  Genomic contig location: Contig_ID=SeqID_13861; Location=49..2075; Strand=-
  SCN-specific regions: Sequence locations=1-958,981-1389,1411-2027
atgcaactcggacagccgagccgcgcattagtaaatgcgaacaccggtgagttcttttattttttgtttgtgtttcattttcccaattccatgccactgtcaaaaggaatcgaaaattgagttgtttttaagtcgaaaaccctttaaatttttcataaaaattagacaaaatattttccaaattttatcattaaatttaatcaatatattggttcacaaatattctttaggtgaacaccaaaccagtttccaactgttcactccattcagcgatttgcttcatccgattgatagtgtagaggagggaaacattgtcgtaatcactggcctaaacaacaccaaaacgggcgacacactcgtcaattggtaccaattttgatttattttgccaataagaattggtctcatcgtaatcatttgcacttcgaattggcagcactcacgtcaaacacagcgcaaagaggacggaacacatcgattttgaggcatttgctccttcaaacaaccgggggcttcacaagaaaatcaaacatttggcacttgaaggttgagtattttaaattccattgtttctgtttttaaccaaaatttgagattatttaggcattgactcccctccggcagtgttttcttgtaccatcgaaccaccaaatttgaaaaatgaacgggactttcgggcagctcttgcgcaacttagtccattttattctcccgaattgtcagttttttttcgtttcagcggttgaggacccatcaattcgcgtcatcgaagaagaggagacgggacagaccattctcgaggggatgggcgaattgcacatcgaagtgatgcgagaacgactgctgcgtgaatttgatctgaacgccttttttggccctcttcgggtaatgcaaaatgcaaacggaaaaaacgaaaataattttaaaaaaatctcttttgccccatttctgcataacattttgcagtttaggtcaattacaaagagatcccacagaaacgagcagttagcactgaacatatggaaaatgtaatcgacaaaaggcaatggtgcacaatgaaattggaaatcgagccaattcccttcgtgaacacggggacagtggtccaccaattcagaaaagtgcttggattctctcataagcgttgctttattcctttttttaggtttccattgatttggacagggaggaggacgtcgaaatggcggaccaggcattgaagaaccttttatttcacccggactggttgaagtcgatcaacgccgggtgttccgttgcggtgcacggcggtccaatttcgggctctcccgtggtcaatttgcacgtgaaactacggcaagtgacaaccgaacgtatttttacatttccattagcttccacaacattcaatttaaaccctttcaatttttcatattcagcgctctttcgaccagtggacacaaaattccggtgactttgctcaacgcttgtgccagccgatgtctctcaaaggcacttgagcaggcgaatttggtgctttacgagccgatgatgctagtcgaagtggtggttttgtcggaaagtgccggtaagcggaagggcaagtgaaaatggaacggtgggattcctcgtctacttctgttcatttcaacaaatgcagaaatgcccgacccggacactgtcgtcagagcattgagtgagagacgggcgacaattttggatgtttcaatggacggcgcgaagggtttgttttaggaaataaaccacggatttatatgatcgctccccccacatgagaaaaagtttacaatttgtgagactcgtagacaaaggaaaaatattccatgaaacagaaatgttttaagcttaaattatggggtatttttttttgtttttttgcaaaatcggctccgttttaggccgaatcgcagttgtgcaggcgaacattccgctggcggaaacccagggattgtcccgcattcttcggacagtgtcttcagggatggcctctttccacttacagcccaacggataccagcagatggacg

SEQ ID NO: 77808 - DNA, 1824 bp, Heterodera glycines
  Genomic contig location: Contig_ID=SeqID_13862; Location=709..2532; Strand=-
  SCN-specific regions: Sequence locations=1-237,260-463,488-812,834 -1066,1109-1327,1366-1370,1393-1506,1528-1718,1746-1824
atggcagcaaaggaactgttccttgcccagcagcccgacctgttcaagccgattcaatccgtaagtcactctctcctaaaagcccgacctgttcaagccggtctcccccccccctcccattattttctgtcgcttctcccctatttttcccaattgtgatgccatcaaatgcctctccttcccagatcaatgccgtgctcatactgatctgtctcggctcctccaccgccgtgccgggcattggcgtcctttggttcatcggcctttgctctctgatcgtctcagtcaccgccacggtgatctttctgctgaaccgtgaaaatggcttgtccggcgtcaccatttccggcgcttttctcccctggggcgtcattgtggggacaatttgatgaccacccaattaaagccttcttaattaaaatcgcaggaatttgtctattcgtctgtcctcacgctgctctgcggggtgggcttttggctttcattcggcttcgcctcccacgtgccggacaatggccattcggccggctatattttcgcgggggtaattaagctttaagtgaagaattgaaatttacttcaaattgtgattggaatataacgatacgaataaccactgggggataacaaaaatgccaactaaaatgccgaaatcttggggatggaattgcgaaagcaaaccgtccttccttcccaactgttaatatgctctgagagtcttggttttgtctaattgatgtgccgtgggtcaaacgctaaacataatatgccgtaggaaataccaaaattgacagagtcgcgagaatctcgatgcttcttctcattttcacttcacccactcttttaagattttcctggtggcccaagtggcctgctatgccatccctgtgctgatcatttacgatcggagccgaacggacggtccggcagccgccggacacgaacaaatcgccaacgtacatccgtttggggtcaccacggacggatgtgagcagcactaccagtcaatgcaacatgaacgtcccattgtctgacattgccaaagttccgttcgcattgactcctcccattttttggcccaatttcaccattttttgtttattaattattaaacagtaattgcaattgtttaattatttttattttttgcaaatgtcaaaattattactattgtatatccttcaatcactctttatgatacacactgagccaacaaatttgaatttaaaccaacggttataggactaaaaatgaacacagaaaacagtgttatgtggttacggtatacaatggttggggtgatcaataatattacggtgggcatgtaaaaaggggaaaattatgccaaattaaagggggaggggagaagacagaacagagatgagatcagtgggagaatgttttgcccatccctttgacaaaaacgtgaaacagagaagagaaacaacataaaataataatacagtaggaattaattttgaattatgtaaaaaatacaaattttgaagggatttgcttaaattgctgaaatttggccaaccaaaatggcccaaaaagagtgtgccgctttttccgcagcattaattcgtgccgttccgtttctttctctcccgtgccactttctttcgctgctcatctgtccgctttttcgatcagtgccgggggcggaagccccgcggcgggggcctctgcccaactccaagcggtcgtcgtcgctgcgccggtcgctgctgctgctgctgtactcgtcgctggagcgacggctccgttccggcgagtcgggaatttccaaattgtgttcttgagaaaggaataattaataaa

SEQ ID NO: 77809 - DNA, 917 bp, Heterodera glycines
  Genomic contig location: Contig_ID=SeqID_13862; Location=1..917; Strand=+
  SCN-specific regions: Sequence locations=1-26,49-320,342-347,369 -378,486-697,722-787,815-917
  Gene Ontology: Mol. function=peptide:hydrogen symporter activity; Cellular component=membrane fraction; Biological process=transport
cctctccctccttttgtgctttgcttttccatttttaatttgctttacctcctcccacagcctgtcgagttggtccggcccaattcggtgaacatcctctggcaaatgccccaagtcttcgtgatgactgtcggcgaaattctactgtccgtcaccggattggagttttcctactcccaggcggcgccgagcatgaaaagtgttgtccaggtgccaacaattaagcatatccgctaattagtttaattacacattttcctccaatgttattaaggccctttggctgctgaccgttttcttcggcaatatcatcgacattgtaaataaaactataattattgcagctaattaatattattatgattatgcttttattgcatattttaatatttataatatatttttacgattaaattaattttttttttaattctctaattttaaattttgggccattaataaatttattctattatttttttatacggttaatctctccgttccttttaatcaggtcatttcgcaagtccaaatctccgacccggtggaggagttcttcatctatgccgctttgatgttcgccgtcatcggtctgttcgttctgttggcgatgcgttacaaatatgtggacggtaattaatataattagacgcctactttattactgtaaacacttaatacccgtatcattgcacagtaattaattaatttattaattattcctttctcaagaacacaatttggaaattcccgactcgccggaacggagccgtcgctccagcgacgagtacagcagcagcagcagcgaccggcgcagcgacgacgaccgcttggagttgggcagaggcccccgccgcggggcttccgcccccggcactgatcgaaaaagcggacagatgagcagcgaaagaaagtgg

SEQ ID NO: 77810 - DNA, 800 bp, Heterodera glycines
  misc_feature (487)..(487): n is a, c, g, or t
  Genomic contig location: Contig_ID=SeqID_13863; Location=498..1297; Strand=-
  SCN-specific regions: Sequence locations=1-16,38-72,94-146,171 -173,196-569,591-630,652-800
atggcattcgctgaagccttttcattttttgcttctcacggcatggcattccgccgttggatgaatgatgatcaaacagcattttcggaccgtaaacaaaaagtgtgtgacacgcagcggcgggcggtagcagtacttcgtgtcgtgttccccctcctcctcctcttttgtgctctgtggtgccccctttccctctgataagggaaaatggtggcgaattttgtcggtccgtcccgtccgtcttttctaatcgttcattctctcaacaatttttctcctccattgattaagcaaataataaaaagattgtgtaagaatatatgaaaaataataaattcattggaattgaccaacaaaagttgcttaaactgtgaaaatgccaaccaatccgaattgccttttaatcactttgatcttctgattgtgaatttagctttatttcttccaacaaaacattattattcagggtagccagattacaattttncaaagcctcagttggcatccaaaaaacctcattttggggtcaaaaagcctcatttttacgaaatttattcaaaacacgtttaaaatattcaaatgttacatttgtgatgtccatgatcaatttgggcaattttttattagaaataagcattttatgaaattctaagcatgaaaaatcgaagctgatttttttgcgtcgctttttccaaatacttttggggaacaaggggggggggcagtgccgataggcacctccgggaaaattttggcaaaattaagaattttgaccacattttaagcatattttcattaaa

SEQ ID NO: 77811 - DNA, 139 bp, Heterodera glycines
  misc_feature (105)..(105): n is a, c, g, or t
  Genomic contig location: Contig_ID=SeqID_13863; Location=1686..1824; Strand=+
  SCN-specific regions: Sequence locations=1-71,93-139
atggatgtaaacgccgaactcccgccggacttcgagtttgactcaattttaaggcccattaataatagccctttcttttcccctcattatggcagatggtatcanaatcaaatagcgggtcatctttcctctgttatac

SEQ ID NO: 77812 - DNA, 319 bp, Heterodera glycines
  Genomic contig location: Contig_ID=SeqID_13868; Location=706..1024; Strand=+
  SCN-specific regions: Sequence locations=1-319
gaagtgtgccatctttctggtcgttctccttttctaccgacttccgctgttcgcgccgactgctgagtttttcggccaattcactgatccccagcgggtgatcagttgggcagcgtttgccatgttcttcctccgctacctctacattttcctccatgttttagtggccattaaccgggcaaccgccatttggattcccttaaaatatgacaaggtcattagcgtggtccaaccaactggaacgaaagagaatttatttactctgtccaaaatgaaatcatccaaattttgtgcggatatttcctcaccaatgccataa

SEQ ID NO: 77813 - DNA, 312 bp, Heterodera glycines
  Genomic contig location: Contig_ID=SeqID_13869; Location=1964..2275; Strand=+
  SCN-specific regions: Sequence locations=1-57,89-146,176-251,297-312
atgatctggaataccgtaatagctaacagaatacaatacttcaaactttacatcatgtaaaaaattttaaaaatcaattttattaaaactcagttaaattttgcttatatatttaatagggaaatgggaatttaagtcatatgaaattcacaaagtttgaaaaatattcagttattggtcaaatgacttgaatatccccagccttatttcgagttaggacacaaattttaagttttaatatttcgatctgcatttttatgaaaaatttaaatgattttttttttttgtaaaatataccatagaaatcgagaa

SEQ ID NO: 77814 - DNA, 2068 bp, Heterodera glycines
  Genomic contig location: Contig_ID=SeqID_13870; Location=1089..3156; Strand=-
  SCN-specific regions: Sequence locations=1-5,29-133,160-948,974 -1499,1529-1950,1976-2068
  Gene Ontology: Mol. function=pre-mRNA splicing factor activity; Cellular component=spliceosome complex; Biological process=mRNA splicing
atgtctgaagcggtgaatgaaattgatagtggatttgaagcggaaggagggacaaatgaaacggaggaggaaaaggacgtttcggaagtggtcaaagaaagcaatgaaacggagacgaaggaaaaaaaggctcaaaaaggggaggagggaaagaagcagaagggcactgctggcgacgatcttttggtcgaaattgaatatgttggggaagggcccgagctcgaccagatggacccgaacttttcttacttttcgaggattttcgatgcattcaaggcaaggaaaaaaatactaggaacgaatacacccaaatacttttgcagataaaaacagaagaggaattaaagcgagaagaacaattccgacaagttcggaccgaaatccccgaggatactctcagcaaagctgcgatttccgaacaaattcttcaggaggagttgaaccagagacgggtgaagagtcctcgcgtcgttttgtcctaattttcattttagaaagaagctgaagaggcaggtgaggcgcataaaatgagtcgtaagaagttgcgtctggcgctacaaccatcgatggccgacctaaaggcggtaacgcgaaaaagtcacaatgctttattaatgcttttttatggttttcaagagcacacctcgggccgacgtcgtcgaatgggccgatgtgacctcccgtgacccatttcttctcgtcgagcttaagtcctatcgaaacacagtcatggtcccacgccattggaacgcaaaaaggaaatatttggccggcaaaagaggatttgagcgaccaccatttgaattgccggagtttattaagaggacggggataatggagatgcgtgagacaatgtgggaaaaggaggagcaccaatcgctgaaaaacaaaatgcgcgaacgaacccggccaaaactgggcagaatcgacattgactatcagaaacttcacgacgccttcttcaaatggcagacaaaaccacagatgacgaagatgggcgaactttactacgaggggaaggaattggaagcgcaaatgcgagaaaagaagccgggcactttgtcggatgaacttcgaattgcactgggaatgccagttggaccggtcacccgccaacaaattgttccgagagtaaattccagtgaattttagaactccaacaaatttccgcctccgtggctcattgcgatgcagcgttatgggccgcctccttcgtacccgaatttgaagattcaaggcctcaactgtccgatcccagaagggtgtgccttcggatatcacggcaatttcctgctctttttttacaattgcaatattatttttttagctgggggctggggaaaaccaccggttgacgaatacggaaagcctttgtatggagacgtttttggactgactgtaagtattcggaatcgaattcgataatgtacatttgcagtataaagtccctaactcaaggcgtatcaggggggggaaaaaatccccctcccccccccctcccgaaatgaaaattttaaaaaattttctagcaaataatggaaacttttttcgattccccccccccccaaaaaaaactaaaattttatgggtacatttttgattttacagtcaattttcgtaacaaatagcactcaagtgttcaaaaatttttcattttacactattttttacaatttttccccttaaaacggccaaaattgggttgtttttagtaaaaaaatgcagttttaacccagcaagtaaaaaaaaatttttttattccgtgaattgcaaaaaaacaggtcttcagttgaagagaaaaaaaaatcttcgggtccggtcccccccccccgaaaaatttttctagatacacccctgccctaacttgttcatttctcaggttcctcaagtggctgacgacgttgacgagtcgaggattgaacgtcgccattggggggaaattggaagtgacgaggaagagagtgaggaggaaagcgaagccgaagaggacgacgaggagggcaccggcgcattgccaccgccacccccggagggcggatacgtaacacctgcgccgacagaagggtaa

SEQ ID NO: 77815 - DNA, 878 bp, Heterodera glycines
  Genomic contig location: Contig_ID=SeqID_13872; Location=201..1078; Strand=-
  SCN-specific regions: Sequence locations=1-878
atgagcgacgatgaacgggtgggcgtcgacgaactgttggtcaacatcaaatcaacgaggtagcattttaccacacaaatcttagttttctgtttccgttactgaaacatgggaattgggtttggacaaattcgaaattgggtccaacttgtgttttatttgaactccccgtttttaattcaccgtccaaaattaaggaatgtgaatgccgtaaaggagcaattggaccgcaatcggaggaaaaagacggcggtggcacagcagcagaaaaagcgcacagcgacgccccgccgggtgacgaagcggacggaggcggaagccgagttggaggcggcgctggaggcgcagcagagtgaacggcgcgacaacaaagtgctggccgcaccgctgcacagacaggcgacgattcgcatcgaaagtcggctggcctatcgacagacgaagtgggcaaatattggggtgggaaaaacggatgaacattttgccaaatggttcatttgtaaagactgttttcccaattgtgaagaaaaattcagccaatgtgtatctctttttgaaggggttcattggggcctcatttttaactatcaagaaatacaaatttctttataactcgagagtcactgtccttattttgatttgtataggaactaatttaaacaatgtccaagttctattagttacctgcctattattatagagaagaattgcaaccatgggacccaattgtggagggccttcgtgtcgctgaacaacttcaatttccgcacgacgaacgtcgtgatgatccgctgcgcactttgacagcggaagagcgtgccaaaacgcacacggtaaattttgtttgtttttttttctggaagatttttatcaataaa

SEQ ID NO: 77816 - DNA, 960 bp, Heterodera glycines
  Genomic contig location: Contig_ID=SeqID_13873; Location=46..1005; Strand=-
  SCN-specific regions: Sequence locations=1-253,278-585,607-767,789 -899,921-960
  Gene Ontology: Mol. function=proline-tRNA ligase activity; Cellular component=cytoplasm; Biological process=reproduction
atggtgcaaatcacacagggatttgcctatcaaaatcaaccaatggtgcaatgttgtggtaagatttgctttattttcccataaaaaatgcaaattattcttttccatttaagcgatgggaattcaaacatccgactccatttttgcggacccgggaatttttgtggcaggaaggtggtttcaaaagcatcatgaaataaagtgtaagacaattctttttcctcaaaattaaggacacacagcctacgcgacaaaagaggaggctgaggaggaagtgtacgacattctgaatttgtatgctcgcgtctacacggatttattggccattccggtggtgaaagggcgcaaatctgaaaaggagaaatttgctggcgcagattttaccacgacggttgaggcgtatgtgccggtcaatggccgaggcattcaggtggaaagagagtcggcattttgttacaaactttacaaaaaaattagcgaattcattgaaccaaatagtctatttataggtgtttccttggttttccagttcagttttttcgacaattctgcaattttcagggcgggacttcgcaccatttgggccaaaacttctccaaaatgttcaacatcgaatttgactcactcgtcaaagggcaagtggagttcgtccaccaaaacagttggggtctttccacgcgaaccatcggtgccatggtgatgatccacggggacgacaccgggttggtgttgccaccacgcgttgcggacattcaggcagggatttgttcattttggagactctttcaaaacgacttcaaatcttactaatttgcttttcaggtcgttgttatccccgtcggaattaccgttaaattgtcggatgaaaagcgggtcgaactgattgaaaagtcagaagcacttgtcaaaatgctgaaagaggagcatggagttcgggcaggtttggaccaacgtgacaat

SEQ ID NO: 77817 - DNA, 501 bp, Heterodera glycines
  Genomic contig location: Contig_ID=SeqID_2094; Location=465..965; Strand=-
  SCN-specific regions: Sequence locations=1-399,428-501
atggctgggggatttgaaaaattaaatccttccaaagcccaaaaagctgtgtttttggaactctggggaccggattttgagttttttcctatcaatgcactccatgcactgtttttggcctgggtattcctttttttagacgtttacggtatgctgtgatcagcctaagcttgataattctgtagcctaaaattgagtgataatttagaatttttatttaaataaactgatcatatttcagtgggcttggttgaatgaatgacacattaaaaaaattctataaattcttaggtacgtcgagctacggtgcgcgtctccctgcttcggcgattcaacggattttgtgtgctgttcgactacgtggagagtgcaattggacccgttactcagcgatcactttacgagacagtgaaaggacaaaggcaacgactgactgcggactgtacaactacggacatttacatcgaggacttggcacttttgagtgcagatcgggacaaa

SEQ ID NO: 77818 - DNA, 475 bp, Heterodera glycines
  Genomic contig location: Contig_ID=SeqID_2095; Location=582..1056; Strand=-
  SCN-specific regions: Sequence locations=1-62,86-122,144-150,173 -301,323-417,439-453
gacgataattgatcgatcacatttcatttttcacgtgtatttaatgttcgccatttcaagcgaagtatcttcagtctctccggaataaagccacttatcccagtgtgtccatcaaaggcgggatgggatctctgggcttgatcatcccatggggcccttccttcgggagtttataagttccttcccaatgttccccatctgccctcccaaattgcccagtcccaacgccagcacgtccaccgcgcacggccgcgctactggtagcaccggatggttctgcaatttgtagacttttcatcggcctgggcggacaaaggagcagtagaacggaggtgagtcaaagagggagactgaggatgcgcctgctgacagaggaaaaagcgcttcggcggtataaaaggcccccggggaggactcaaaaaataccccaaaaatgggatgccccgaaaatagggaaggaaataaataccccaaa

SEQ ID NO: 77819 - DNA, 2758 bp, Heterodera glycines
  Genomic contig location: Contig_ID=SeqID_2096; Location=1553..4310; Strand=+
  SCN-specific regions: Sequence locations=1-296,321-401,423-2370,2393 -2758
ctgaaagtcggagttttcgtcaacaaaaagaaaacaaaatttgttgccgacagcggcacggaagtgaacataatcgacgaagaggcctatgacaaaattggccgtccaaaaattcaggaatgcgaagaaaaagggaaactcttcgacggaacaaaggtcgcattcatcggcaaaggaattgccacattccaatttggcgacattgccatcgaccaggagttttacgtcgcaaaaagagggtctttaaatttgctgagcatttcaacgatggacgcatttggcctgctggacgatttaaaaaggaaaatcagcaattccgcgattaatttgtgtgcaaacattaattcaagtgcaacatttacgaccgaggccgccgataaatttattcgggaattaaaggcaactttctccaccacttttgaggaaggactcggactctgcaccaaggaattggcacaccttcaattaaaggatggtgccactccaatttacagaaaggcacgaccaatgccacatcattcaaaggaaatcgtcgaaatggaattggaccgattggaacagctgggaattatccgtaaagccgaacatttgacttgggctgccccgattttggtggtcaagaaaggagacggatcagcacgattgtgcatcgattattccacgggattaaatgatgcactgctggattttcaacacccgctgccaattcctgacgacatctttgcgactttgaacggaggaaaattgttctcccaaattgacctcaaggacgcatatttccaaattcaattggatgacgattcaaagaaaatttgcggcatctccacccacaagggcaattatttaatggagcgcctgcctttcggagtcaaatcagcgcccggcattttccaatcaatcatggacaaaatgctcgcctacaagccatcatagttgacatgcccgcgccgaccaacatttcgtcattgcgctcatttttgggtatggtcaaccattaccagcaattcgtcaggaacatgcgcttcattcgcaagccgctggacgatctgctcaagcacgaagcaaaatggaattggtgcgacaattgtcgcaaatcatttcaaaagttgaaaaacattttgacttcggatttattattgacacattatgatccaaaattggaaataattgtgtccgccgatgcttcggagcttggaatcggcgccgtcatttcccatcgattcgcaaatgggacaattaaggccatcgcacacgcgtcaaagtcactcgcgcccgccgaaaagaattactctcaaattgagaaggaagggctggccttgatcttcgctgtgcagaaattccacaaaatgatttatggtcggaaatttattctccaaaccgatcataagccgttgctctccattttcggaaataaaaagggcattcggcagtgcagcgtcaaccgattgttacgctggtcactcattttgttggcatatgacttcaaaattgaatatgtcaaaaccacggattttggacaggcagacgcactctcccgtctcattgcaaaaggcggagaagaggaaaacgaacgagtcattgccttgatcaccgccgaaccaattttggaagaaattctccattcagcctcgaaaaatttgccgatcaaattcgaagatttggtcatcgccagcaaaaatgactacaacattcagaaagtcatcaaattcattcgccaaggctggccaaatgaaaagaaaattgagaaagaatcggataccatcaaactcttccatcggcgcaaaagtgatctgacaattttgaaaggctgcctcatgtatggcgaaagagtggtcattccgaggatttttcaggccaaaattctccgactttttcacaagggccatccaggaatgaaacggatgaagcagctcgcccgacaatacatattttggccaaaattggacaaagaaattgaggattatgtccaaaactgtgagccgtgccaattggctgcaaaggcaccgataaaaaccgatctccattcatggccaaaaccaactggcccgtggcaacgaattcacatcgactttgctgggccattcttcggcaaaacatttttaattgtcgttgattcattttccaaatacccggaagtatttgagatggcaaattcaacagcatcggccacaatcgaaaaattgcgttatttatttacgcgccatggcatcccagaaacaattgtttctgacaatggcacgcaattttccagttcggaatatgccaaattcgttgcggccaacggcatcacacacttattttcggccccatataatccaatgtcaaatggacaagtggagagatttgtcgacacattaagagaacattcagaaaattaaaaggggaggggaagcctaacaaggagatcatcgacacttttctgatcacctaccggacgaccccaaacgattcacttccggacttgaagtgccccgctgaactgctgctctgtcgaaggccaaggacaacaattgatctgcttcggccaccaccacaccaaccatttgaaattgatttggagatggaaaggcaattcaacaagaaatttggcaccaaaaatcgaagatttattttgaatgagaaagtcttcgctcgccatcgctcctcgcaacattggaagacaggagtgatcagcggcacatctggagtgatttttgaagtcaaatttcccgacggatcattcggccgttttcacgccaatcaattgcgcaacaggaaa

SEQ ID NO: 77820 - DNA, 3437 bp, Heterodera glycines
  misc_feature (38)..(38): n is a, c, g, or t
  Genomic contig location: Contig_ID=SeqID_13875; Location=347..3783; Strand=-
  SCN-specific regions: Sequence locations=1-61,83-675,726-755,777 -821,843-959,1014-1193,1215-1381,1403-1718,1753-1787,1814-1868,1954 -2159,2181-2246,2274-2536,2568-2747,2770-2820,2842-2947,2969 -2994,3016-3226,3248-3437
  Gene Ontology: Mol. function=aromatic-L-amino acid decarboxylase activity; Biological process=dopamine biosynthesis from tyrosine
atacagaaactttataataaaaatatgcttaggatacnccaaaaaaaccttaatgaacgggaataattaaattgaaaaaatgtaataactgttaattacgtcactattttggcgccttgctaatcactattaagtcttttttgtaaaacaaatgcaattaaaataaaaagggtgaaaagacaccgcggggaattcaaaaagtcaaaagaaaattcaagctttcatgtttaatttattccatataaagcacacttttttaaatttcatatcacttttttgccctttttcgccaccgttcgcaatttttgctggtatttagtaaaaatatttttgaatttttcgccattacctaaaaatatcagccttcatttttttgggttaaaaatttcgaaataaattcttaaaatgccattctcaaatttaacgtgccaaactgagtgtccgctgttcagaagccggtcagtcagctgaaaaaaatgttcgacggaggcgaggcgccgattcagcagcaccaccggccgagcacttcgtcctcccaaccgcagcagcaccgcgccagcacttcttcgtccttccgccggcgcaaagaatcgcccgaagcggcgcctcccgagggaatgaatgactaatcaatgggcttggccaagcgtttttttgcgcgcgaattttaaatgctttatttttattttaattattccttttttgtatatttttttgaaaatttacttacgtgttgtgattaaaggagaataaaatgttttattgtttattttttgtctgtcgagcaaataaatggccaatatttttaaggagaataattaatatttgaattaattttatctcaaattgtgcctccctcctttggcacaaattctctcttaataaggccatttttatctaatttacttgatgaccgataagttttggcattctcatattctacatttatccactgaaggatattttaaaaatcaaattgaatttaatttttgttttttttttaaatttaattacgaacaattcgccgtgttaaccgcagattcgccagtttcgcactcaccgagtgttgtcagaatgccaaagccgtagaggatggcatttcggaagttccatgtttggcgccgccggccctccgccgggtcgacgattccgaacagacaatgctcagtgatacgttccgctgctgagatgagagtcggcgcttttgctgctgattcgttacttctgtcttggccattgaaaatgccatcgctgaaatttaagccaatttaattatttcttttttctattttttatatcccgtggctaatttaagaaactacccagcaagcagcttctttgactttaagacaatatttattgcaataaaaattgcaaatgctaatttaattttattaaaaaagtgcctttggtagcgcaaaaagtgccgaatgcattccgttttgcgccgtattaattcgtctttcgcccgctccgattggccacgctcaaaacgcagcagcagaagcccaccgaacatcacgtagagcagcaaaaggccaaaacagcacgcgttagccatcattcgcttgacaaacaacgaagtggccatttggggcaatgatttaaaagttaatttattaattgtggcaattagttaaaacgaagcaatttttatccaatatagtaaagacgaaaaggggaagaatgccgaattaagggaatttaaatggaatcacaaaatttttaattatttaataaatctttttttttggaagttaactaattaccaaattatgcaatttgtattgataaaatattaaatataacataaatatgtggaccctaaaaaatggaaaaactcaaaatgctaaaaattatttggttagtatttttaattatggaatttatttaacaaattaatttaaaatgaaattctttcaaaaaatcttttcaattattattttatttatagattgtgtcaaatttttctttttgtttttcttataaaatctgaattttcggttaccgtatttcttcgattatatcccccccctcgattagaacccccctctcgaataaagccccccttttgaggggggttgaacaatagagcccccgggggctataatcgaagaaatacggtaactcaaaaaaaatcaaaagcctttcttaatcaattagacagaattattggtctacggaacattcaaaatttttaacatttttgaagagcggatttaaattccaaaatattgtttgtcctcgttattttattttttgcattttagggtctccaacggtacatccgcgagcatgtgcgattggccaaatattttgtatcattgatgtctgctgacccgactttcgaaattgttggcgatgtgatcatggcattggtctgttttcggattaaggtgagaaaattaaattacctccgtttctgaattatacgaataaaataatctggggttaaataacgcagaattttcattgtttttttttgctggcattttgtcagtttcacttttctaagcatttttcaaaagtttattccaaaaattcaaaaaatattttatttattttttgctgcaaaatgtgttaagaaattgggccatttttttcttaggcgactaacggcaccgtagaacctcaaaaatgtagaatatttcacaaaaccaattctaattcttatgtgtcaatgatctgctcaaattttataattatccttcttctctgctgaatgtaaattagtttttttttaaatgacatttaattattgcaaagaatttttgtttctaaaaatattgcttacaagttcctctttatttatacattttacatgggttcagattagtgaaatttttttccgcaattttttgtttaactttgaaatttaaagcgataattttatcaaattgaaaatatgtatttttttaatagattttattgcggaaaagcgccttaaaatcatttttctgtttgatattcaattgaagttttaagcattttctattaaagtttttaacatatatttgggaagaggggtttttgcatacatttaatttaaattaatgaattacagtgatttcaatttgtgcaactaattgcggatcccgctgcaattagaactcaaaattttttgcaggaccggatcccgcgggattaatcccacaaatcacgcattttctccaaaaaaaaaaaatcggacttggattccgcaaaaccccgtgccctgctctattttaaattgttttccttccattttgcacaggatggttcggaagaggtgaacgaaaacttgttgaaagaattgagactcagtagtcacattcacgtgatcgccgctgcaccggacaatcgtacgaccatccgtttttgtgtgaacaaagaggacgccaacgaacaggacgttctgtttgccttcaaagtgatcaaggaaacggcactttacgtat

SEQ ID NO: 77821 - DNA, 791 bp, Heterodera glycines
  Genomic contig location: Contig_ID=SeqID_13875; Location=2223..3013; Strand=+
  SCN-specific regions: Sequence locations=1-159,181-347,369-548,603 -719,741-791
atggctaacgcgtgctgttttggccttttgctgctctacgtgatgttcggtgggcttctgctgctgcgttttgagcgtggccaatcggagcgggcgaaagacgaattaatacggcgcaaaacggaatgcattcggcactttttgcgctaccaaaggcacttttttaataaaattaaattagcatttgcaatttttattgcaataaatattgtcttaaagtcaaagaagctgcttgctgggtagtttcttaaattagccacgggatataaaaaatagaaaaaagaaataattaaattggcttaaatttcagcgatggcattttcaatggccaagacagaagtaacgaatcagcagcaaaagcgccgactctcatctcagcagcggaacgtatcactgagcattgtctgttcggaatcgtcgacccggcggagggccggcggcgccaaacatggaacttccgaaatgccatcctctacggctttggcattctgacaacactcggtgagtgcgaaactggcgaatctgcggttaacacggcgaattgttcgtaattaaatttaaaaaaaaaacaaaaattaaattcaatttgatttttaaaatatccttcagtggataaatgtagaatatgagaatgccaaaacttatcggtcatcaagtaaattagataaaaatggccttattaagagagaatttgtgccaaaggagggaggcacaatttgagataaaattaattcaaatattaattattctccttaaaaatattggccatttatttgctcgacagacaaaaa

SEQ ID NO: 77822 - DNA, 1029 bp, Heterodera glycines
  Genomic contig location: Contig_ID=SeqID_13876; Location=682..1710; Strand=+
  SCN-specific regions: Sequence locations=1-298,339-822,844-1029
atgaagaagcattttggcttttcactgttctccgttggtatttcggctgtgctaattataatgcttatgctgataacgatcctgccgccatctattgctgatgattatttggaaatttttgcaaagccgcctattgccgatgccaaccctaaaagcgttaggctgaagaaaacggattctgtggaaactttgaaaaaggaaataggaaaaaaacttggcattactccaagaacactgacacataacagcccatatgcccttcaacttgatgacaaaaaaacaatgcaagattatagcattgaagaaggtgatatcatttattatttcttgtatggtgtgattaaaattccggagggtgaatttgaagtgttcgtgaaaaacggagagaaaaaatacagtattaaggtgaagatcactgatactgtggaaattttgaagaaaaaggtccaaaaagcgactgacattccggcagaaaatcaaacatttgcgcactacccagtacgtggccgtgtgcttgatgaagacaataaaacaatgcaagattacggaattttggaagaggcaactgttcaaatggtgttcccatttgaaattgccgtgtgctgtgctggcaaaacgtacagcgttaaagtgaaagaaacggatactgttgtaacagtgaaggaaaagatcgaaacaattattggcattccgcccaaacgacaattgatgagcaagcaacagagtgatgtgcttgatgacaaaaaaacaatggcttattatggcattgtaaaaggcaaaactgtcgatgtgtgctgggatcaatttgaaatttacgtgcaaaatggagatgaagttatcacagttaatgtgcaggccatcgacactgtggcaactgtgaaggagaagattcaaaaaaagactggcattctaacagaaaaacaaacactgagacccaagcattcgcgtgcactgagcaaagacaactaccgatatggtgagataaatccgaatgctattcttgcgcttggtgagaacacaaaacaatga

SEQ ID NO: 77823 - DNA, 627 bp, Heterodera glycines
  Genomic contig location: Contig_ID=SeqID_13878; Location=602..1228; Strand=-
  SCN-specific regions: Sequence locations=1-191,213-528,550-627
atggcaccgttaattaccttttgacactttgttattttttgaaattcttaccaatttgaccattttttgttcgtttatatctcattttaaattatttcacagtttcaaatttaacttcgatgtttttcaccggtattgaccgactgatcgtattagtttttggtgaaagtgtactgtaattatccttaaagaattaattcaattaatatttataggcataataaattcaaaattcgtttgtatttggcaattgttacaattatttctgcgttctatggctgctttaacagttttaaggggcttaatgatggaaactttcacgctaattttagcttctgtcaatcttccgttttattatatgttttttggtaatcataatgactttttaattatctatttgcttgttggaatggtgataaaatttaaatcagcactggtgattaaggtttaataacatcattaattacccctaattgaggtttggcctaggccaattcgattaacaatcgcgcttttcgagcactttgtttgatcatcactgtaaacattgggggctatttaatcagtgtgctttttcttgcttgatcatgtaagagtccatgcgcagtaatttaaaattgcaataaa

SEQ ID NO: 77824 - DNA, 474 bp, Heterodera glycines
  Genomic contig location: Contig_ID=SeqID_13879; Location=112..585; Strand=-
  SCN-specific regions: Sequence locations=1-27,49-77,99-156,186 -344,366-413,441-474
atgcaaaatgatggacaaaaaattaaagcgcacacattcatcacagcagacgcggcgaagagtgttgaacaaatttgttttaatttcaaactgtttatttgcaccaattttcttgttacggtgaaagcgtttaaatgggaaattgtgccaaagccggataatgatgatgaagatgatggtgatgacttatggggctatcaaattaaattgaaatatgattttccaccggttggttggtttaattatgaaaaaatgcatcaaaagtaaaaaaatatataaatggaaatatttatggaagaaaaaaaattttctatgggcatcattcttggtatgatgatggacaattaaaataatttatatagggttttttatataaattatgacgataaattttgcaaaattagtggaaaactaaaaatattttagataaaaaaacaaacacttttttttgcggaaatacaagaaggtggataa

SEQ ID NO: 77825 - DNA, 704 bp, Heterodera glycines
  Genomic contig location: Contig_ID=SeqID_13879; Location=625..1328; Strand=+
  SCN-specific regions: Sequence locations=1-124,146-368,390-488,510 -603,625-704
atggccaacgaggcaccgtacacgcacatcgtaactgaacaaatgcatgaatatgtaagtgatggatttttttaggtgcacaaaattgacaaaaagaaaatcgagaagaattgttttggaaaatgaaaattttccaaccctttccaaaaaaaaatatctgaatttggcatgttttatggtgctaggttgtttcgtaaaatcccccattttagcgatttttttcgacaaaacatggtataactttgcttataggcaatgaaattttacattctcggtaccattcgatagccaagctttttctctattagcctggcaaaacttcaaataaaattatccaatttaacatacgttatggcagaagtagtacttattttcatagaactttttctaaaatttatcaattaaattttgaatggtaatagagaaaaagcttggctatcgaatggcaccaagaatgtaaaatttgataatttatgccatgttttgtcaaaaaatctttaaaatggcggattttacgaaacgaccagcacgatttttatgtatggttgttttttaataaatcaattacttttaggtaaaaataatcgttccaccagcagtgattttgtctccagcctctgtttcttgtcagttaaaaatttcaaaaacttgttaaatttatgaaaaaacatttttggggggttataaaacataaatgcaaaaaa

SEQ ID NO: 77826 - DNA, 653 bp, Heterodera glycines
  Genomic contig location: Contig_ID=SeqID_13881; Location=275..927; Strand=-
  SCN-specific regions: Sequence locations=1-339,379-421,457-548,571-653
atggcaaacggttcggacaaattcagcaaattgccgcagttggccagcccgtcgctgtaccaaatttgcctcagcgttgacgtggacacgtgtaaattcaagggcaaagagaccatccatcttgaggttagttgacactaaaattttggggcaatccttcggaattagtgtcccccggcggtaaaaaaaattgagacccgaattttgaaaaaagcctggacctggatttcctggacacgaattcaggtccagaaaaacccaagtttaccgataatggccttgacctgctcgtatttacataaacattgattccatctatgattttgcatcaagcaaatgattttttcaaaaaaaaaaattaattttgtaaaatttattggcgttaaaacgtacgtctgaatagtgtagaaatgattagcacattttcttactttaaaaaattaaagaaaatttttatctctttttttgggcaccaattccgaaggatttacctaccccaccaattttggggcaaatttcactttcctcccccctcaccaacctaatttttccctctctccattttcagattacaaagccaacaaatttcctgacactccacgcgggtgcattggaggtggaaaaggcgtcgctgaagttggaggatgggacgg

SEQ ID NO: 77827 - DNA, 544 bp, Heterodera glycines
  Genomic contig location: Contig_ID=SeqID_13881; Location=1632..2175; Strand=+
  SCN-specific regions: Sequence locations=1-108,131-202,225-292,315-544
atgataaatcgactggctcggccgcttcgcggcctcgcatccttttcttggctttttctccaatcgccgagactcaacccaccaacatttcaatcactggaactcaacccaccagcattccaatcactgggactcaattctcctgcatttcaatcactggcactcaacgcaccaacatttcaatcactggaactcactcaacccaccagcattccaatcactgggactcaattctcctgcatttcaatcactggcactcaacccaccaacatttcaatcactggaactcaacccaccagcattccaatcactgggactcaattctgcatttcaatcactgggactcaacccaccagcattccaatcgccaggactcaacccaccagaatcaatcaccgagactcaattctctggcatttcaagcaacgcgactcaaattaagcaattctccgatattcttccggtctctcaatcaccagacaaaaaattgtgccaaattcatcactgcaatataatatcgtgtaattttaggtctatataaaaa

SEQ ID NO: 77828 - DNA, 59 bp, Heterodera glycines
  Genomic contig location: Contig_ID=SeqID_13882; Location=2011..2069; Strand=+
  SCN-specific regions: Sequence locations=1-3,28-59
atggaaaatttgaattttcgactttttgttcggaattgtttgaaatgggtgccggattc

SEQ ID NO: 77829 - DNA, 546 bp, Heterodera glycines
  Genomic contig location: Contig_ID=SeqID_13883; Location=69..614; Strand=-
  SCN-specific regions: Sequence locations=1-338,379-546
atgattgttggtgaggaacctgcgccggctcaagcaggcgctgctgcggaggatgccgccaacaaatcggcaaaacgcgcagcacttgccgctcagaaacgacagttggccctggatagggtatattcttagacgaacgttattatttggagatgttagaatggaaattttattaaagaaaaccccgaacaattattagacagccattatagtcctcatttttaagtagataaataaacctctaattctaagaaagtcagaaatgaaaatttaaatttttcgaacggcgggtggggagcaactgcttcccgtcactatgcccaaatttaataatccgttaaagaaaaaataactaaaaattatcaaaacatttttcttttccattagatgaaaaaactgcagtcgtcgttcaagtctcaacaccctgacttggcagaaggctcttcaaccgccagtggaggcagtggcacaccaaaaactgggcaacaacagcaaccggtggacatggcaagtggcggtgcgcttgacgagtgcgagccggcgtaa

SEQ ID NO: 77830 - DNA, 505 bp, Heterodera glycines
  Genomic contig location: Contig_ID=SeqID_13886; Location=483..987; Strand=+
  SCN-specific regions: Sequence locations=1-12,105-421,443-505
atgttaaggtacaaaaaaaatattttataaattgaaccaaaagcaatcgataaacaaataattaaaaaatattttaattttgtttaattaatttactttttttagtgctattgactttggatttgccgtcagagaacagaccaaattggatggattaattatgaagggcgcttccatatattcgagcagcggttctttttggtgtaacggttcatcaacagctggcaaatcttacggtgccggcgctaccgtaggaattggcttttcatttactaatcgacaaatcatttttacaaaaaatggagtccttttgggtttgttcgtaaattatttgtttttttataaagtttttcattttttacagatttcttcactctgttagacgattcttcattttccacaaattctttgtttccattcgtttctttgtgtattatggtaaaattgaggcgaattttgggccgaagttcaaattcgatttgacgactctctgttaaaggaagaa

SEQ ID NO: 77831 - DNA, 417 bp, Heterodera glycines
  Genomic contig location: Contig_ID=SeqID_13886; Location=1059..1475; Strand=-
  SCN-specific regions: Sequence locations=1-389,411-417
atggctggtcaacagaagattggacccgacttcgttggccaaaaatgcctggtccaaattcaaacagtacaagggtatcaaaatggggtcggggtcgttttcgcgtgggccgttttcgcgtggggcgagtttttgaactataacttttttctttgtcaaccaaatccaataatcttggtatctttcgatagccctaagtgttctctattagcgtacaaaatttggaaaaatttcgttaaggttcaaaaaagttatggtcagaagagttcaacaaaccaaattttccaatttttttggctcgaactttttttatactgaacgaaattttttggaattttgcaggctaatagtgcatctgaagggctttcgaaggatatcaagaatattggatttggttggcaaagaaaaaagttatag

SEQ ID NO: 77832 - DNA, 1278 bp, Heterodera glycines
  Genomic contig location: Contig_ID=SeqID_13886; Location=1855..3132; Strand=-
  SCN-specific regions: Sequence locations=1-92,173-337,359-435,458 -546,568-619,641-656,714-826,893-1061,1095-1181,1203-1278
atgaaaaagattatttattattttgttcttcaatgctgcttaatcagcacattattagcggattttgttgagagaggcaaaggtgaacaatcattaattaataaataattaaaatttgaacataataactaaattatattttgaaacacaaaaatttgaaattttaaaataacagaaaaaattccgttgtattatgctcgtcaatccaatccaaaaagttcaattgcaccaatcgagaaagagtttttggcggattctagcgaaatggacaaaaatgaacaaactatggctgatctgatcactttatatctcaacgaaaagaaaaagccatcaactgaaagtaatgggaaaacaatggccgaattattcaacatggaaagcattgaaaagaaggaatttaatgaatttttgaatgaaataacggaaaatgagcatttgattgacattgtatttgagcctcatcaaactgggcaatcaaacaaagtaattagcaggggaaaatgaaaaaatgttaaagcaaaaattttcggcgtaatttacaaaatgatcgttttattaatttcaaaggaggtttatggttttcatcaggggacaatgaaaaaagaacaaaacatttgctaacaaaaaatttatgcaaatttccatggccttatttgattaaaatatatgaaaaatttaattaattagggaaaaatttatttattatttttttagctagaaactcagcaaaaaataaacgaaaaaatgactgaaaaattgcgaaaattatcagcaatcaaagagaatgacccagtaatgagccaaataattgaaaaattatcaatctttataaaggaagtaaaatcaggttaaaattaattatattggtaaaatatttaaaataaattattttctaatcacattatagggaatgttttgaattcattgaaagaatatctcttattcgtcatcaaaatttgtataatgagagaacaaattccactgtcagaaattataacgaataaaaaatttgaaacaaaattaatggccaaattagtcaaattattattggaggaaaaacggaaaaataatcaacacaaaaaggaaaagaatgacgaaagaacgaataaatccaatggaaaacaaattttgggacttatgcactcggcagtggaaaatttaaacattgcggcaaacatcaaatatgaatgtaaaaataattgataataatatgcgtttgtaagtttaagcaaaattccaaaaccggaaaaaaaaccccaaacgttaattaaaaataaa

SEQ ID NO: 77833 - DNA, 975 bp, Heterodera glycines
  Genomic contig location: Contig_ID=SeqID_13887; Location=123..1097; Strand=+
  SCN-specific regions: Sequence locations=1-20,42-906,928-975
atgaaattaaagaaaatcgcccaaatttttcagaatttttcctctttttacctactacatccacctcttttacaccggcccccctacgacaagggggggggggtaagtgtaggcaccaaaaagtttatatacaatatatttcattacatgccaaacaaaatgacccatcctcggtcaatcccctttttttgatttggcatttttcaacacggtattataatgactgatttgttttttctgtatagatgatgagtttttccgaccgcgcgattcgggcatcagcacaacgacgacgggggaggcggacgatgatgggacggaggagcgggagcagtacatggacaaaaacaacggattggttcagcaaccgcagcaatcactttttgaccaattgtggccattcagcagcaacaaaccgggcgaggaggagttggagcagtacagcaacgacaaagcgagggaggagttggagcagtacagcaacaacaaatcggggacggagttggagcagtacagcaacgacaaatcggggaaggagttggagcagtacagcaacaacgaaccgtcggagggggagttagagcagtacagcaacaacaaatcggggaaggagttggagcagtacagcaacaacgaaccgtcggaggaggggttggagcagtacagcaacgacgaaccgtcggagggggagttagagcagtacagcaacaacaaatcggggaaggagttggagcagtacagcaacaacgaaccgtcggaggaggggttggagcagtacagcaacgacgaaccgtcggagggggagttagagcagtacagcaacggcaaaccggtggagaagtccctttttgaagagttgagggagacggaggagcagcaacagaacatgattgacaggtggttggagggaagagaagcggcgcgcttttccaaaaaaaattttgggagcaagggggttgcaaaatttacataaca

SEQ ID NO: 77834 - DNA, 3274 bp, Heterodera glycines
  Genomic contig location: Contig_ID=SeqID_13888; Location=226..3499; Strand=+
  SCN-specific regions: Sequence locations=1-157,179-936,958-1382,1404 -1685,1739-1807,1830-2460,2482-2590,2614-2988,3010-3108,3271-3274
atgagcaaaaatattgggcaaaacggacgaaatcgcacggaacaactgacggtcggggaagaagccgccgccgcgccgatgggcggaaattgggcccaaaggaaaacaacgccccccggggtgtggagggaaagcggcgaggggccggagagtgtccgacggacgctgaaaaaagaagtggggacaggcggtggcccatcagctggccaagaaatcactggctggttccaacgacattctgtggaggcaaatcgatccgaacaacaaccccgaaagggaaaagcattggaagagtttgactattgctggaggggagacaaagcaaaacggacggaaagcgacgacggcatgggaaacgaatgggtggggagggacagcaaagggcgggggggggggggaaacggcgggggcatttaaagcagcgacatcacgaacctaatcaaccccaccatctcaacagccaaaaaacagcagtgccatcgccactgcttgccgccgttcggccaccctctcccaacttgggcattcaacttccaatcgatatcgactctcgacatcccgactaggagcagtagaagcaaggcagcagagagtggggtcagagagcccatcaatcaacggattggctacggggggtcaaggtaggatcaggaggagaggatcattagggagcgtggtgcagcaacacactcgaggaggacgagctgtcaataatcgaggtacgcgagaactgatcagaggagagataaactgatcagaagagagaggaactgatcaggagagagtgggactgatcaaaggagaggacttatcagaggggagagagaatgatcagaagagagagagaccgatcagaggggagagagagagaagaggtcgaccagaggagagagggatcgatcggataccgtcactatccaacaaacgcttatgctcatagttttgatattattctttcagatactacacgtgccgaaccaattaaatgggacgacgccgaaataaaacaacgccataatcaaacagcgcaaaacaattttccactaattaatcgttcaaaaacgctcccgagcatcaaatttgacgccgatttgcagctgaaaaggcaattcgccgcagaaaatattcgcaaacgcgaaaacgaacaaaaaacggaaataatcgaaaggcaaagagaacgctgtgaaaacggagaagaaaaaggaaatccgtgggattatttgggcagaaaaaacgaaacaaacggagagaaaaagttggaagaggaaattgataagctgttcgaacagctcggacttctcgacagaaagcatttgatgaacaacggagaatttaaaagtattttcgagtcaatgcgaaagcatttgccgacaaaagaaacgcaacaaaaacaacaacagcagagcattggccaggggcagcagagcttttgctttacgaccaatggggcgcaaaagacagaaagacagcaaaatgcgtacaaaaagggacggagggaaactcttttgggacggagcgcatcgaacaatgcattagccgaaaggtatggacgaatcactcactgatcaacagaagtgatttgagacgaattaatgggtcattaaaagtggccaaactaacaattgaccccgaaagtgattgatcaaaccaatgaacagatcaaacattttgcagagcaaatggaacaacaacaacacaatcatcatcatcagcatcagcatctttattattgtcatcactttcaaatggggagaaacgacagcagcagagaaggcaatcacttccaaaaaatcagccgaaatacggcggaaatttggaaaatttttggcaatcggttggcgtgagttttacctccttttaccccaatcactcgcagatggtaaaaacgcgtgcggcggagacttcgccaagcaaacaaaggcttccgctgggattaagttccgtcgaaaaactgcagggcatttgccaatttacgaatcaaacggtggaagaaccaaatcagccaattaatgtgtacccgcgaaggtacggtggagtaattgagacggtggcaatgcggcggaacaattatctgatggaagcggcgaggacggcgagtccgtcgggcacgagcacaccgacgaccaattcgggcagagccacgcccaacttcagctgcggcaggttcggtcccaaccggttaaacggtcaaaatgtgcgtatttcaattcaacagagcattcaaatcggcctctccgtcgatcgccgatcaatcaaacacggactatttggactgggggactccgtccgcaaaagaatgagcaaagaaagagagaatcggaaggggtgcggtcgctttccgaccgtaacggaggaagagaaaggagaagcggtggaagcattggctaatcaaaatgggacaattatcatctcgattggtcagccacaaaagattggcaatgggaaccttagaatggacagccaaaggcagcagaggacaagtcgaagtccggacaatgtttgttgggtgggggagaatggcactaatcactcgggggggggggaagtcgggtcgaggcactaatcactcgccaaaggtcagcgagtgctcccagcagtcgcagtgttcagcagcgaaaccaacgactttgccccagccaacgccaaagcacaatttacgcgataagctgatcagtgccggctttccgatcagttgccagacaacgagtttttttggtggaaacgcaaagaacccattttatgggcagaagcagccggatgatcaccaaaagcagaaacagcagtcaaattcagcgccgaatttcccgctgacaaacactgtgatttcgcgagtgaatctgttcgagagtcagcaacaggtggacaaaagcgccacagacacagaacgggttcccattaagccgacttcggttgcttctgaggttggcaatctgtcgcaacactcactggaaacgaatcgtcagcacttggacattgtgaatggaaccaccagcggaaatggccaattgtcgccacgttcgtcggtgttccgtacaaaatcagtgatcgttttcgattttgacaatttgggcggcactcccacaaaagcaatggccaaagagcaggcggaagaaaacaaaaggaaaagcggaggaaagaccaaagaacagccgaaagcgaagcagcagaaaaaggaggagcagagaaggacaaccgcaaagggagaagagcaaaacgccaaaaaggtgaaattaataaaacaaattgaaaagggaagcaaagaaaagagaaagcg

SEQ ID NO: 77835 - DNA, 1738 bp, Heterodera glycines
  Genomic contig location: Contig_ID=SeqID_13889; Location=490..2227; Strand=+
  SCN-specific regions: Sequence locations=1-92,114-272,321-333,359 -499,554-583,609-670,693-741,818-933,956-1038,1069-1127,1149 -1186,1231-1289,1312-1738
atgataacggcaggaggcagcattcaaacagaaatgcagaacccgaacaacttcatcagcaaaatgtccaatcaaatcaacagaatgccacaagtacaaataaccaagaaataatttttttttgttataaaaggcatgcgctgtgaattgatgtgccggcttaggaccgcttttttctccgatatttaccaaataaatacattatataaaagtgaaaaatgaaatttctaggtcttcagaaaaagcatgggatgatttagtctctctcttacaatattaatttaattttaaaaaataaaatttcttttttaatttatattgactcgttagttaaatttaaaaatttaagccaaaattttcttaaaagaattctttagcttttgctgatgaaaatcataatccgaatttgaacaatgaaaatacgccgccaaataccaggacaaataccagcagcagtgaacaaaatggcagaccgggaagaacaaggagaggtacaatcaataaaaatatttattgaaaattttaaataattaaatttctttacaaatttaatctcctccgtccctcaaaaaagaagttaatcttttaatataaattttaatttttaactgaaaccgagggaatttatttgggttaggacgggaagcacgcttttgaaccggaagccggtacaaaatttaaaaattatcttccagttttatcagcaaatgtataaatgcaattttttcttttcaaattaccaattttttattttatgacatatcaaaatatttttgttattttatttattaaatttaaaaaaaacatttaatttaaagtaacacctgttgcttctccattacgaccaattaatgctaataatgatggtggtaatgatgctgttcatcagccacgtcaatcaacaaatattggcaacctgtcgaacaataacaataattatattgaagaaattgtacaacattatatgcgtaacaatatggaatacatgatcaccacatattccggcctcaatgatcaaacattacaatcagcaatgaatgagcagcaacagcagcagcagcgatcagtcgcaaccacaacaggttggtcgcccagaaatatatgaaatgataggctactgtacttttggtactgtaaaaattgtaaaattaaacggggagaaattgttagtgatttatgctgtaagaaaaatttattaatgaaaatattgttattattattattatttatgtaatgattttgattactgaaatccgttagttttgataaagtgttccttactgtatttttggaaaacttttttggcaaaaaattgccaatttttccaagtctttggatttatgcctttttgaaaaataagagggacaaaaatctttggctttaggccttttttgaaaaatgtttcatgcctcaaaataaggacagtacttaaaataaagacaaccagggaattttccatttttaggaagtgctgacagttcaaattcgattgaatatttaaagcaacagatgcaggataatgagtgttgtgattcggaaaacaatgacggcgagacgaactgtacaatttgcttagaaaaaatcacaccaacatcacatgctaagcaattgacttcatgccaagtctttaaaatatggaaaaaattatttataaaggaaaattaatttttgagaaaaataattgttttcccaaatttagcacacttttcatcgcgattgtgttgacacatggtaatta

SEQ ID NO: 77836 - DNA, 324 bp, Heterodera glycines
  Genomic contig location: Contig_ID=SeqID_13890; Location=1521..1844; Strand=-
  SCN-specific regions: Sequence locations=1-50,225-229,253-324
atgcaacaacattggaacaactcatcaaagcaaaaagacattggaaaattgaaaaagaaaaccaagaagaagaaagaaaaaatggaggagaattgggaaaggaaatcgaagaaaaaaaggaaaaagaaattgaaaaaggaaatcgaagaagagaaaaacaaaattggaaatttggaaacaaaaatcaaaacgaacaaagaaaaagcaaaaagagagacgaaaagcatttgggaaaagttcaaagaaatgaaaaagcattttgccaataaattggaggcaaacaattcgaatgttggtgaaggcggcgccaaagaaatcgcttga

SEQ ID NO: 77837 - DNA, 179 bp, Heterodera glycines
  Genomic contig location: Contig_ID=SeqID_13891; Location=1..179; Strand=+
  SCN-specific regions: Sequence locations=1-77,101-179
aattggagcccatttcaacatcacttctggggcttttctgcaacttttggtcccttctccattcattttgttcattccttttcctttgtttgtttctttcagtcgcttgaccgcaaagaacaaacctcgaccgcccaaattagagaaattgacaaagccaaactcgctctctcagtctg

SEQ ID NO: 77838 - DNA, 120 bp, Heterodera glycines
  Genomic contig location: Contig_ID=SeqID_13892; Location=643..762; Strand=+
  SCN-specific regions: Sequence locations=1-120
ttagccttcgatgcttcgctcattcgtctttttgtgtcgtacttttccgtctttgagttttggtgcgcagttcaacaaaaatctgttcgccgcttcacaaaaaaatgctgctctaacgaa

SEQ ID NO: 77839 - DNA, 492 bp, Heterodera glycines
  Genomic contig location: Contig_ID=SeqID_2099; Location=153..644; Strand=+
  SCN-specific regions: Sequence locations=1-317,341-378,403-492
atggattcttatattcttcaagatcagttctcctttccagtcaacctctacagtttttatcactttaagagagctgaaaatgccaatgccaaaagcgtcctcaccgatgaagcggcgaccaccgccatgcattgtcaggcgcactcattctgctgcaatgagggcgcgtcggttgcgcacaaattggtgatcggagtgagcgcaaattcatttgaggatgagaaaaaaatggcgcacaaaaaattggaggaggaaaacaacgaaaatcgaacaaatggaaaaggagtggtggggacagcaaaagcggaggaaacggcaaaagaggaaaagggggaggaaaagcagtgccaaacggaggaagcagcaaagtgccaacaaacgcagcagcagcggcagcagccattttgcataagattgaacagttcgccaatgtcgccaaaattggaggcaaagaacggtcagagattcaagaaagcaatcagtgatttttag

SEQ ID NO: 77840 - DNA, 520 bp, Heterodera glycines
  Genomic contig location: Contig_ID=SeqID_2099; Location=1094..1613; Strand=+
  SCN-specific regions: Sequence locations=1-189,211-305,327-394,416-520
atgccaaaatcggcggcaaaggaagcgccagtcggaggacggcaacagcacgtgcgtttttaaaccaaatattgccaaattataattgaatttaattgggttttagtcaaaaacccccgaaaattcaatcgaatcaattaatattaaggcctcttgcaaatgcctcccattcctccacaaccgacgcatcactttgctcaccatcagcagccacaggcaacaattaccgtaagccaattgagagagagggggatacgcaatactataatagggaataaaccaccgtacacaattaccgtaagccattgagacagagagggagacatgcaatactgtaatataataaccaaccatacatttgcatttgcgtcattcgatcataatattattgataaaatttttcaaatgatgaattgcttttaagaaaacaatgaatgccaaaaatggaagcggcggcggaagcaccgaattaatgcgattcattttggacgacaaattggagacatcgtaagaaaaagaa

SEQ ID NO: 77841 - DNA, 313 bp, Heterodera glycines
  Genomic contig location: Contig_ID=SeqID_2099; Location=3054..3366; Strand=-
  SCN-specific regions: Sequence locations=1-251,273-286,308-313
atgaaaacaagatcgtttgattgggagccggaaaatccgacactggaaaatccgacactggaaaatccgacaccggaaaatccgacactggaaaatccgacattggaaaatccgacacaagcggaaaatccgacaccggtggaaaatccgacaccggaaaatccgacattggaaaaaccgacactggaaaatccgacacaagcggaaaatccgacaccggaaaatccgacattggaaaaaccgaccccaactaaattttaaaaataatttttgattgtttgagttagtaaatatttaaaatacatataataaa

SEQ ID NO: 77842 - DNA, 354 bp, Heterodera glycines
  Genomic contig location: Contig_ID=SeqID_2100; Location=1366..1719; Strand=-
  SCN-specific regions: Sequence locations=1-293,315-354
atgacgtttttggtaagaaaaaaaagtaatcttattgaagaatttattttagtgtgaaaactgcgagtttgtgtgtgctgtgcattaatttcgatcccacattcccgcacattattttactgatttttttatcatttaattactgattttaattattaatctgtagagtctaaattatatggactaaaaagctaatgaatcaatcccaaaaaataaaaaatatatactcctaaaaattgaccaaacttcagaaatattcactaaggaatgaaaaattctcaaaaattcgtctcaaaaatttatttatttattttcttgaccagttgcacttgtgttgtcgaaattgataataaa

SEQ ID NO: 77843 - DNA, 66 bp, Heterodera glycines
  Genomic contig location: Contig_ID=SeqID_2100; Location=902..967; Strand=+
  SCN-specific regions: Sequence locations=1-66
atgggtgctctatccacccaccaaatttcatttggaaatcccacggacacctggggaccttccttt

SEQ ID NO: 77844 - DNA, 1524 bp, Heterodera glycines
  Genomic contig location: Contig_ID=SeqID_13895; Location=1123..2646; Strand=+
  SCN-specific regions: Sequence locations=1-933,955-1118,1140 -1492,1514-1524
  Gene Ontology: Mol. function=phosphatidylinositol-bisphosphatase activity; Cellular component=integral to membrane; Biological process=lipid metabolism
cgttggcttgattccgattgtgcgagttcggatggaaatggctttcacatcatttgcattgcattgcaagtaagaacaatgaaagaccgcttttccaatttaatccgttgactctttctctcttttaggaattgccttttgcccaatttttacgtgtgactgacattaacaacacttggtctcttcacatcacttcttggatgaatgcacacaatttggctctcgcaagtgaactttacgtcgcttccaacgcccttttgatttatttttcgtggaatatgctaaacatggtgctgcatataattgaattctattactataaatatttatatagtactaatactgattttcccccaaaggttgacagcattgaagaccgatggatcagagacagtattttcggtaaaggcacaatgtctaccaaaatcgcttttcgcaacaaaactgtgctcgtgttcgttaccagtcacttttttgcggatacaaaattccacatggagcgcatcaaacaataccaagtcggacgccgctgcacattccccgaggaaaagtcggcgaaaaaattcgtcatttggcagggcgacctcaattcgaggtgattgaacagtttgaaattgataaaagcagatacgaaaagtactacggtattgtttattttcagtaaagttcagaatagaaggcattgccaacgcaacagaactgatccaaagattgaattccatggaagagggcgacgaaatgaaagcggaaattgcgaaactgctccaatcccatgaccaactcacaaaggcacgagcgaaacgggaggcattcggcgaatttaccgaagcagaaattggattcaagccgacttatcggacattggtaaagtgcaacaatttaaaaactaaaactccaaaagtccattcactgttttaatcccaatgcctctttttctatccgttttccttttctttcaggtccgttctggtgcctacgactcactccgtgtcccttcctggtgcgaccgaattctgtgcgaaggtgacatggacgcacttcgcatcacaaaatactcgtcctgtccttccataactttgtctgaccattttcccgtgtcggctcaatttgaattgcactttcaaaaagaaaagcggcaccagctaagcgaagttgaacaaagacttcaaacattatctcttatggaagctgaacacagacaatcttcgccttggctcatccgagttgagcacattccaacttgggaggaattcataccgctcgtgtgccgaattgcgattccaaatgacatctgggcagatttgtgttcttatcgtgattgggtcagttaaatctctccttctccaccttttcactcattccagacattttcagatcggcatttaccacaactcgttgaattcgattacgaaaccgttggaatggatgtacactttctcatgtccaaccgacgacgaacgtaggattgatactgagcggactttgattgtcgaattccaaccattgaaaagtggtttctacaga

SEQ ID NO: 77845 - DNA, 1610 bp, Heterodera glycines
  Genomic contig location: Contig_ID=SeqID_13896; Location=204..1813; Strand=+
  SCN-specific regions: Sequence locations=1-162,185-682,704-1399,1423 -1556,1586-1610
atgatactgatcattgcattgcgggacgaattcaccgatctgaggcaaaaatgccttcagcgcttggaagacagtcgaacgagcggacggtcaacctcactgcaagagcttggagaggagtgccgaaaatatcaaatcctaaaggaaagcgcgctctccctcggctcaaatccctgcagcaccagtgccatccgagccaaaccgcagcaaatccgggacaagcagaagtccaaatcaaggccacagcaaagccagaaaggacatttccagccgaataattcaacggctattgaaaaggaagtggacctgcctgatcagccctgctattcatgcggaggcaaaaatcattggcaaaaagactgttggttcaaaaattcgaagtgcgaaaagtgcggacgaatcggccatatcgcaaaaagatgcaaaaacggcacagaaacccgacgtgttcgtgccgtggccacaaattctgggaatgacatgcacattcacaccgtttcacttcagccaacatgtaaggctattgaaggaagtagtaacaaatggtggagaattgtcaccgaaatcaatgggatggaaaacccaatgaatgtcgacaccgctgcacaaatcacggtgatcacaactgattcgtggcaaaagcttggcaagccaaagctgggcaagaccaccatcgcagtcaaaaactgcaacgaaaaggcattcgcaattaaaggaaaattcaattgccaagtttcgtacaacggacgaacagcgaaactgattgcgtacgtcagcgacgaaatccatcaggatttgctcggcatgccttggatcgaagagttggaaatcattccgaaggagcttatgtttccaaattcttcgcaaatcaccaattcggtgccaatgaagcatcagaaaatgccgccagtcaatttcaaaaattttggtaaatttcaacagaaacaccaaaagatgaaacggcaattcaacgacaaaaacggcgccaaaaccatcactttccaaaatggagaaccagttttcatttggaatttgaaaggcaataaggcaaattggttgccggcgacgattatcgagagagttggcaactctccgacttatcgagtcgacgttccgacgctccgttgcgcagtccaccgccttgtcaaccaaattcgccgccgtttcccaatggaaatggagacatcgcaaattggccaagcaaatggaaatattttggctgggaaccaaccaaatcggaccccccattaaggagattgaaaaagccaaatccccaattggccaaaatcaaaatgcgccgcgaagatcagcacgcgccaagagggcacctcagcagctgaacatggacccgtcgaagcggaagtacgatgtattccggccatgatctcgcgcagagggatttttccaaagaagggaggtgttggataagggaacaactctattgattatattttccctttcactccctctcttattgactctcgccccgccccttgaccagccccataaatatgtctccctttccctcactccgggcattctccctttcattccaccatttcattattttatttatttattccctgctgtcctccatatttatttgttta

SEQ ID NO: 77846 - DNA, 2146 bp, Heterodera glycines
  Genomic contig location: Contig_ID=SeqID_13897; Location=467..2612; Strand=+
  SCN-specific regions: Sequence locations=1-98,120-307,336-856,878 -1130,1177-1224,1246-2146
ttgaacaacataagctctcgtcacttccacttgagcttctgttccatttgttcgattcggcaaccggtcctttttcactttacaaacttttgtgaacaatttccatttcattttcagttgccgacttgcagaatataagccttatcagccacagtcatctgttcaaaatgctcggctatttgacttccatcaatttcagcaaacgatttgcatctttgctgaatgcatcatttgtctccagcggaggcactgacaattccaaaaagcattgcgaccgtatcgagaaaagtgtcagcgaatatggtccttttttatttaaatttattaatttttaacttactattaattggattgtcgtcctttttcagcacgtctcatccgaatttgtcatatttttcgaacacgcgaagaatgcatttgttttaccgttaatttgttctcaaaacttaactatgtcatcaaccgtaagggatttgaatgctttggagcgatttggggaatactcataacagaagtgaatggattggggggaggatttcgactgagttgccctttggtttcgcagatatccgccaattggtctcagaaggagttcttcactttgatgcaaactctgatcaactctttcgggttggctgaacgagttgaccccgttttgcgttctgaggtggatttgattaaatttccaatgtgttcaattgtttctttctcaaaggacactctgtggggggaggagttgctcctccgccgtttgctccgtggccttttcttcgaccatcgctgtccctcgtcgtcagtgtccgtcccctgccaaactccgcgtcgtttctccccccataacgcgtcattccgtctctctgcgcttctccgtttgttggcgcctgattctctgctcactgcccaccgtttgctgctcattgtcggtgctccaattggcgtcagtgttgcgcatggacaaataaacgacacggaaaacaacgaaatcagtgcagggaaaggtaaacggaccataagtggacaagagggaagttaagaggggggattctgtatttcgtacgggggtccgaagaatttcataaggttttcgaagaaaagcgaaaaaacaaatattctttgtcaataaattgctgaataatttataattttcaaaggtaattaattattattttttaaaatgcattcaaagcaaacggaacccataattaaactttgttatttgtgttgtattacattagtgcattcaatcacttttcattttcactttgttctcagaattcgtggattaccaacgcatttacacggaaccaattggcgatttggacagtgctcatgcaattcttggtgaattgccatcgatggtctctttgctgttggaaacatctgatgccgttgaatctgaggagttgcgctggaacgacttggaagtgttcaactgtttggagatgcttacaagtgaaaaagcaaaaatattgtttttgttgcccaatactttagtcatttttttaattttaaagcattttatttatcgctagaaatggacattttacctgctaattttatcaaatttctcccttccattagcatttcccgagccttgggtgcttcgcaattttgccgctttgctcataatggcccctggcctcgcccgtgtggcggtgcaaacgcgcgcaatgcatggaaatcctggcgaagcgggcagcacatttgtcagttgcattgaggtaattgggtacaattctttaacaaaattttgattcgttcttccataaaataaggcattcgaaatgttgacataatataattagttggcggcgcttctttaggccagcattctgctcaaataccaagcgtccattctgttgcgtgacactctccactctttgctgaccaattgcgagccgtccgtctgtttggtggtggtgcgtgaggccgtctcctgcatgtaccaacacacattggagattctgcccaccaacgaacaaaactgtgtgtaccctttcccttgttttttctcttttaggcaataaccgaacgattttcagtggccggccaactctttgacatggatttgttgcgaattgcgctggaaatcagtcgtcaggtcgccgagatgtttctctcccatttgcacttcattttggtctga

SEQ ID NO: 77847 - DNA, 393 bp, Heterodera glycines
  Genomic contig location: Contig_ID=SeqID_13897; Location=2971..3363; Strand=-
  SCN-specific regions: Sequence locations=1-137,159-393
ctgtttcctacggcatttgtgccgcacttttcctctggcaattcttcactcggtttcgccacaatgtgcttttgtccgaacatatttccgctggtttctcatcggagggatgcgtccggtaaattgggcgatgggaaagggcacttttttgataattcatttacttagtatgtgaactgtcaaattcccaataatcccttctccccatcttttccaggttgggcttttccttttggcttttgataagcgcagttttggcacaattcgccccttgcgttttgttattttgggcattaaaggggagaaaaaagcaaacgaatgaagaacaaaaatcgaaagagcaagacaccgttttcctttattaacgaaaaatataaaacagaaaaccgagta

SEQ ID NO: 77848 - DNA, 393 bp, Heterodera glycines
  Genomic contig location: Contig_ID=SeqID_13898; Location=267..659; Strand=+
  SCN-specific regions: Sequence locations=1-393
atggccatcagcagagcctacttcatggcacgacaaatttgccagaatgaggagttttttctccggcacgaaatcaaaatagggttgaacccggatatttctctcacgggaaattccatcggggcggctgccatgttagcaaccgtatcgttagcaaaaaaacgaccggtgcgcatggacacaattgtaaccggcgctgttgaacataatggcgacattgatggcgtcggggaaataataccgaaagtggagggggccgtccagcatggattgagccggattgttgtcccgctgctgaatggccatgaagtcgccgatttggccggcattgaaatcatccccatagtggactgtcaagaagttgtggacgaaatgatgtgttgaggcatatta

SEQ ID NO: 77849 - DNA, 1163 bp, Heterodera glycines
  Genomic contig location: Contig_ID=SeqID_13898; Location=826..1988; Strand=+
  SCN-specific regions: Sequence locations=1-386,409-497,520-543,597 -670,711-1163
atgtcgggatcaacaaggttgggatcgggttgggagccgggactaggattttaattgtttccttatcgcgaatttaaattttcgcagtcgcgaatcgtggatcgcggcaaacacggaaatttcactaatttaaaatctcgttgcgtcttaaaaagcgaacattttcttgccagctgaccaaacctttaattacgctttcgatgcccctgcaaaaggcattattctcgacgtcaatcccgctcttggcaccaccagctccggcactgatcagttgacagatcaatcaaccccggagaaaagacccacccattcttccgccggttattcggctgttgttcttgcctatcattgctgatcagtagggatgggaatttttgggatctttctacatattacatatgtacatatttttatacatattttggactttttcgtacatattttcattttttttacatattttgaggatttttgagaatttatagaaattttttgtgaaaaataaaaaataaattttttgaaaatgtatccctcctaaaatcgatttttttttcaaaaaatgatatatcaaaaattaatttttgaaataatataatgtgattataagcctattttgctcatttttatggcattttgtgcctatttcactttttacgaagaatttttttccaaaaaataatcatttaaaaaatttttatttacatattttagtacatatttggggatttttgtgcatatttcataaatatttcaccattttttatacatattttatttacatatttcgcgattttaaagttgtcttgccagcgacgacgttccaacgttttgcactggcacaatgggggcgcaaccggacggaactgaaacagcgtgtcggttggcagcgactgctcgtcaggccctccttgacgaaggaagaattggcggctgagcgggagacacgtgaacaaaggcggatgaattatgaagaaagcaaaaagaacgaaatggtgacgacgcggcgtggaggcaaaatggaaaaaaacttttgaggtcacaaaactttctcaattgtttttactttaactcaagaagttttgtaaacaaaatggatgagtttaggcttttacttttagaaaataggtataaaattatcgcaataaccgaaagctggttgaaca

SEQ ID NO: 77850 - DNA, 480 bp, Heterodera glycines
  Genomic contig location: Contig_ID=SeqID_13898; Location=2563..3042; Strand=+
  SCN-specific regions: Sequence locations=1-458
atgatttatcgtcggcaactttggaaagacattaaaaaagaaaaaactagagaaaaatttatagaaacctctaaaaaacttgaatatgaaataaagaaataccttacaaatcgtgaaaataaatttttaagtggtttagaccctaaacaacggtgccatgtgatttcgtcagaagtgatttcgccagtgattgatttcgccagtgagtgatttcgccccgggaaatattttgaaaatttcggcgtctgtatttgatttcagattatgtcaaaaaattgtacacattttggggtccggtggtgccgataggcaccgccgtggaaaattttgaaaatctaagtgacattacgctataaaattacaaattttctgaagaatttttaaaaataagaacaattgcccgaaatcagagcagcgcttaggcggtgccatttgttagtaccattaaaggtgctaaattaaaaacaaaagagaaaaaca

SEQ ID NO: 77851 - DNA, 900 bp, Heterodera glycines
  Genomic contig location: Contig_ID=SeqID_13901; Location=605..1504; Strand=-
  SCN-specific regions: Sequence locations=1-219,243-564,592-690,712-900
tttctcacaatcagtgcccgaagcttctttcttcgaggctaggcctcacctctcgaatttcgttgtaccggccaaggaatgtagtcgagccagccacgggcaaaaaagactcgcaagccataaaccggttgtcagattcagcaaaattgaactgatgagcaaaaaatggccaactatttctaactggtgtgtttcacgatatcttagaactcaattcaatcatttcaaaaaatgtaaatgaaccaatctgcattttttattatcattagtctttcatttttcaataatccgtttgtcatgtttttgggtgtctgttataatatttcttgtaaataattctttttttcaggagctcaaggacatgatgcgcagatacgctgaagtaacttacgccgatgcgcacaaaaaaccgaacgaaggcttcgtttgctttgctaatcgtgatgacatgcgtcgcgcaatagacaaatttcagggtatttttttttatttgttaaatatcttggtcaattgcattgctttaggaaaagacatcaatggacgtcgcataaaactcgtggatgaaagcgaaggaggagggggaggagggcgccgaactcggaggtaaatgcatagcatttagatgagaataattgtggtaactacggttaaaagtgtggtttattgtcatgaaggtgcattcccatgggcactctttccagcttccattcctttagacacgcaaagggaaggcctaaatccagaaaaaactcgagggatgaaggaactaacggacaaaacgaacatcttttttcagccgttctcgttcgccgcgttctcgttctcgctcacctcgttcccgctcgcctcgttctcgctcccgctcttctccaccttctcgccgtgactcgcgttcgcccg

SEQ ID NO: 77852 - DNA, 1777 bp, Heterodera glycines
  misc_feature (1343)..(1343): n is a, c, g, or t
  Genomic contig location: Contig_ID=SeqID_13902; Location=272..2048; Strand=-
  SCN-specific regions: Sequence locations=1-239,292-331,353-779,843 -980,1019-1226,1250-1507,1539-1712,1734-1754,1776-1777
atggcggacgtttcgcaggacgacattttggtggtggagggtgccattgacaacgaccaagtcaactccattaattggcacactctaatgacttgcacaattaagaccctgaaaaatttggtcgaacggacgtacaataaatttggccaaatcgatgttttggtgagaaaattgccaaaaatggcggaattttaaaaataaaagtaaatgccaaggtgaacaacgccggcagcattcttcagcaccaacgatcgcggcagaacagcaacagcaataacagcaccagcagcaataattacggctacgactacacaaatgggcaaaacggagccgaggaggaggacggaggacgcgggaggtgcccttgggggaaggacccaatgttggcacggattgggaaagtgccgatgccaaatccatggaagtcgtcggaatttaatgccttctaaaatcggaattcttaatcccatcccctaccccgggcaatttctccattgatgccgtccaatcaaagcaaattaattgcttaaaacgatcagagagcagcagctgatcactttgatcggatcactcggagatttgatttaattgggcctttgcgatgcttttgctgtgaatttgccctctctttttcggtaccacggcttccgcggctttcgaaggacttcttcctcagcaacggcaatgaccagtcgccgcacttgctcaatttttggagctttggacaacgattttgactttttgtttaacataaatttgaagaggtttttattttttgcaaaaataaaataaaattgttttttttctcattataatttaaatattttatttttttaatttatcgttttcattattttcgctttctctctccccacagtatcgccaaattgacccgtttgtgcgcgccttatctcgaagaaacaaagggtgccgtagtgaacatcagcagtttcggcacacagcgttccgtaatgtttttgaatttaaaataatttattttatattattttttaattttccttttttcagctgtccgactacacttattacagcaccataaaaaatgctttaggttgcgaaaagcgtaaaatggtgtgattttgtccactgacaatgaatgaattcagacaattattgccgctcaatcgctgttaaatttgcaaagcgcgacattcgagtgaacaacattaagtaaaatacctaacaaattggccaatcgattagtcattaattaattagttaattaattggtctgattaagccccggttttatcatcggcgaaactttggacgaagacgacaacagagcgaacaaagtgagtgagtgaacactccactcaatnttgatcatgcaattgttgaagttcgagttgaattggatcaaaaatcacgtgccgatgggtcgcggagggacggcggaggaaattggcaaagtcgtggcatttttggccagcgacgacgcctcttacatcaccgggggtgttttggcatttgaataatttaatcgttttatttattccatttttaaatttcaaattcgcactaaaaatattaattacttttttacgatttttttaacatttgccaatttcagcaacgataactgtggacggtgccgtctcaatctcttcaaaaccgaccgattttttctaatccctcttttctgtcaattgtttactcacaaaaaccgtgtttttttaatttttcaactattttgaattaattaattaaaagctttgctccatttattttcaaaaagattcagacaaaaaataaa

SEQ ID NO: 77853 - DNA, 770 bp, Heterodera glycines
  Genomic contig location: Contig_ID=SeqID_13906; Location=133..902; Strand=+
  SCN-specific regions: Sequence locations=1-186,227-405,427-433,460 -681,703-738,761-770
  Gene Ontology: Mol. function=succinate-CoA ligase (ADP-forming) activity; Cellular component=mitochondrion; Biological process =succinyl-CoA pathway
tccgagttggacttgaagattccgattgtgtgccgtctgcaggggacgcgcgtggaagacgcaaaagcgctgattgcaaactcgaaaatgcggatattggcatgcgactcgctgcaggaggcggccaaaatggccgtaaaggtaggcatcagctcgttttcctcccagacagtccccccccccagaaaattaaataaaatttaccaattttattaagaaaaaatcttagtttttttacaagaaaattccagaaaaaaaataaacttcatgatgaatcaatcactaagatttttcgaaattttttcaaaaaatcgctgaaaaaattttcaagaatttttttcttcgaatttccttacaaaaaattttctaagatttttttctttggacaaattcttagttgataaatttttcaacaatattttccccacattcactgtgcttcttcccctcccccttttcagctcagttcgattgtgacgctggccaaagaagcggcggtcgacgtgaaatttgaactgtcaatttgattaggctttatttgaccgactgacgacgtgtagaaagaaatggacacagagaaagaaagagatgtagaaattcgtaaatttgtaagataaaaaaagcaattattcgatcattagcattaatgatcgccggtatttcctagtgcaaatgaaatgtaacaaccaatcaatcaatccatacggcatacatatgtataaaacgatggacacgctcaattattattattattttattagcaattaaaa

SEQ ID NO: 77854 - DNA, 1033 bp, Heterodera glycines
  Genomic contig location: Contig_ID=SeqID_13906; Location=1103..2135; Strand=-
  SCN-specific regions: Sequence locations=1-128,150-196,218-639,667 -812,855-1033
atgaactgctcgaatttgtggagaaaccgttggcactttgggtgcgcttttgccatgtgttcccaaaagcgatcactccgtccagcgaggaatgttccgccaaaaaggggtaaaaatcattttcacgcaatataaaataaataaataaacattttcaatccttattaaagagagaaattaatatggcaattaaataaactttttattgcatttttatgaattttcaacggacagacagacccccaggggatgcgattcccatggaaaaagcgctttgagttttgtcccaaaaaagttttattatacgtcccaccatcgacattttttacatcgggtcttaaaattaagacttcttaatagggtttgagtcaaaatggctaattttcgagggcgcttttggattaaattctgaagaattattagggagaaaagccagtcgacggtgccaatgagcgaatccagttgaaattttgattaattttcaatagagattttgccaatttatattaaaaaaaaactttatgaaattcttctaatttaaactttaactttttaagtaatggcagcggaaacgcactttgtacgaggctatggcttgtgggcattgaattggagccaaaaaggccgaataactcatttaaaggcaaaatgaaggccaatttgaaaaagaaatttgacgaaagggttaaaagtgactttcaaaacggactttttcaaaatgtttggctaaaatcggaaatcgccgagcgcaaagatttgcaaaaatggtgggcaaaagcgtaaataagcacataataatcgtttaatttagcaaaaattcaatttttacaaaaaattattattatatatttattgagtaagaaaaactttgaatttttacgaaaagttttatttttacaggggaattgacccaaaactatgaagaaaacaaccataaaagaaggtcaacattgtttttgtacaattcaatgttcttaaatgtttgatacttttaataatgaacaataattgttttttatctatgtataataaa

SEQ ID NO: 77855 - DNA, 1113 bp, Heterodera glycines
  Genomic contig location: Contig_ID=SeqID_13907; Location=1137..2249; Strand=-
  SCN-specific regions: Sequence locations=1-503,525-623,645-1032,1054 -1113
ctacttcgatcattccgtcatcacttttctcaatgccaacaagcaaatttttgacagaattggcaccaaattggaattgtgtgttacaaatgcccagcaaagtttggatgctttttcccgtgaagttttgcccatttttgcgccgaccattcgccatttcattttcaacgatgttcatgatttggtcaatttgcgcagtctcatttcgccaacaattctcaccaatttcactcggctgagtttcatcgaatcgatttgtctgtgccccgcgggtgtttttgccgatgattttggtgggccaaatgcaacttctgctggccaaattctgtcgaaatggttgcacacgccgagcaaagatggtcagccgaagcgaatgcgttgcagtgattatttggatggatcaaagcttgcatgggtcaacaatttcaaggaggtggacggcatggacggtcccaggattacggcctgggggctttaccccacccgggagacgaccttttcttttttcatattccaaaaaacttttggtgaatccggcggtgccgatagacgccgccgggaaaatttttgtaattttaatgcgatttgttaacagattttgtccaaaaaaagacaaaatttgcatgtttttccatcaaaaattgcctattttgtacattttcagaaaatttttgcgaaatatatgtcttggagggagacaaacaaaaaaaaagtgaaatttatctgacaaatgagtggggaattcgtttgcttaaagggaaaaatgggtttcgactggatcaaatccctgacaattgatttggaaagccaaaaataatgacatccgtttattttttcattgtttaggcatttcgccgtgccaccacttctgtcagttacaatattcaaattactgtttataaggaaacaacgccaattgaacaatttaaattgatgaacgaacggaccaaagagaagctgacactgagcaaagaatcatcagaaaataattggatgttgaaacgatgccaaaatattgggaagacgaatcagaaacagcagcagaagaaagacgaaaatttggagcatttgaaccgagtctacatccgtctttatgaaaattgcattgggtga

SEQ ID NO: 77856 - DNA, 1133 bp, Heterodera glycines
  misc_feature (1130)..(1130): n is a, c, g, or t
  Genomic contig location: Contig_ID=SeqID_2102; Location=549..1681; Strand=+
  SCN-specific regions: Sequence locations=66-109,178-263,305-345,408 -458,499-651,674-711,733-1041,1063-1133
caaaagaaagctaaagagccgctgaaagcaatgcctactcagaaagcggaagaggcatctacaggtggaacgaattgaatggacaagaaatatttattgagcaattttaagggagcgagaaaacgggtcaaagcgttgtttctgttaggccacccaatgtgccgacaactgctccaggtggactactgttataatgttattttatatctaacctttttagtcgcttcaaacccacccatcagcgcggaacagaatattgcttctattacacttacaccttcagatgtgaagacacctgcaccaggtaaattaaatcaacaagaaattatttattaagcaattttaagtgggcgggaaaacgggtcaaagcgttgtttctgatacgccaccaaatgtgccgacaactggtccatgtctactgattattttttgtttttttagtttatacaacctttttagtgacttcaaaaacgccgatcaaagcaggacagaatgctgcttctgttaggccaccagtgcctgcaaacacatcaagtagaacaatttttgaatgccgtcaaataatactcgttttagcaagttcaaagcatgtcaaagctcagggcactgtttctaaaaaaccttcgaaagcatcgtcatcacatacctcacgtattgatttctcagatttagcaaaataaaccttttggtttttagtgaaggtacccgacgacctggtttctgcaataaaatcgcatgtgccctcgtttctccatgatctagcatcacaaattactggaaggatggaccaaagcagtgcttctgccatgtcaagtgattcggaatcctcaacagaagagtcgtcgtcttcaggtggagcgaaattgtattatcggttggcctcgtcttttcaatttagcatcagaaatgactgaaaggactgatcggagtgctatttccgtgaggcattcgagtgtgaagaaatctgtaccgggtaatttattttttttgagtaccggtttaataaattattttttgttttagtgcctccaagacctccggtcaaagcaggacagaatgctgtttctgttaggcccccgaatgtgaagacaactacgccaggtcgactgaatcaacaagaaattatttantaa

SEQ ID NO: 77857 - DNA, 710 bp, Heterodera glycines
  Genomic contig location: Contig_ID=SeqID_2102; Location=1775..2484; Strand=+
  SCN-specific regions: Sequence locations=1-520,543-675,697-710
atgccaccaaaaaaggaccattcagtagttcaaaagcctgtcaaaacggatcaaagcgttgcttatcgttctacaactgcatcgagtttaataatatttttgcgcgaaagaaatagaatcatttcagcagttcaaaaggccggcccttcggacctcagcgcggtttttattcagaattctctgcaggtgtcggattcggacggctcgcgtagagagaaaggtataaatagaggttggacttacgttcatagccggcgccgaaaacctgtatttttgcttctgggtccggtgttattgtaagtcgggtgactaaaaatatgtcaaaaaaacaaccttaaaaacaaagatttttagtttttttcactattaatttattccttttgatttatagtaaacgaccctaactatgagacacttgaactaattgaccatggcatttttatgggggagaatacgaatgataccgaccttaaggcagttggaggtatgtgactagaaattgtggatgttctaaccaattaattttcattttaagcacaaaatccaaactacgcaactcttagaaacttggatctgaacatttttgtgcgtggaccgactccgagtaaaccgaaatgagggaaagactaaaatgtgaagaatatcagggacatttatatattgatgctaatactcattctttgttgttgtatttaatacactaaagtgca

SEQ ID NO: 77858 - DNA, 1115 bp, Heterodera glycines
  Genomic contig location: Contig_ID=SeqID_2103; Location=1177..2291; Strand=+
  SCN-specific regions: Sequence locations=1-125,147-454,476-850,872 -1115
atgcttcttgctttgacttctgtggacactcgcaacgcacttttgtgcgccgccgttccttccattggcgccttcgtgggctcgacgatggccatcaaagatcaggaattggttcaattcctcaaggtttgctgacaccagagatggggaatttaactccattcagcttttagaaacaaaattttccttctttcgcacgttgttgcaaatacaattatttgctggccaacactgccgtcaccattccgttcggttacgcttcttatttggtctacaaaattggaggaggtgtcaggttttttgacagttaatggatggaaaggaatgattcaggattcagttgcaccgactcaaaaatcgcattgggactgtacggtgcgacgctgctcagcggctgttttttggtgcccactctcaaaaagcatgacattaaggcggtaggcaacctacaagttcatcttcctcaggtccaagtccaaccctttaagctgactgccaacgctgttgtccttgccggactttccgtcgctacttcagtggctttctacaacatcgataagatttccgcttattggacgtgagtttatttgagagtcgtgccggttatatttgccaattcagcatgcccttcactctttgggccattttttgcgctggacttacggtgaaggcgaactgctgcgccgggacgaactcaaagcttatgaccaatgaggcggcttcgtgtgcttctgaaaaagggacgaactcaaagcttacgaactatgaggcggcttcgtgtgcttctgaaaaatctgagaataagaatgagggctcctgctatgtttagatacgatgatgatcaatatttctctttttgatcgattgtttttgctaaatcatcgcttgtttgattaggaataatgttaatggtaaaaatccaactcttactagggtaagtactgccccaactcgtatttttcgacaaaaaattcgtcataacttttgttgaaggcgaccaaattaaatattcttgttatcattcaatagcccttaagattcgtacgagttgggtttcatccgtatttgatagcaagaaaaattgtcttgtcatctgtttatttcgttgtaatgta

SEQ ID NO: 77859 - DNA, 383 bp, Heterodera glycines
  Genomic contig location: Contig_ID=SeqID_13909; Location=2149..2531; Strand=-
  SCN-specific regions: Sequence locations=1-60,98-105,129-227,260-383
atgaataaaaatgatagcaatttcggatggacaaaaagtaaatagacagaatcaaaggtgaaaaataatttataattacaatatgaattaaaaaattgcttttcgttttttacctctttattctttttgttcccgggacaagagcctccctcataaccttcgtgtatgtttacatgttaatttgctatcctccgtgcaacttcggaaatcaaatcattactaaaatattataaattattgtttggaaaaaataacaaaatttacttcatcttcaaaaccattatacatattgagaaaaacaaatataatatatagaagaattcactgcaaaatttaaactaaatgaaactctttacaaaggagcaatttattaactaaataaa

SEQ ID NO: 77860 - DNA, 437 bp, Heterodera glycines
  Genomic contig location: Contig_ID=SeqID_13910; Location=373..809; Strand=+
  SCN-specific regions: Sequence locations=1-437
tgaaccatgaagacgggagaagtgaacgtattgagctcgaggcactaaaggtatttgaagaagtgttttgcggcacattggaggagtttgatgggttgaatcgggagttgaatgtggatgaactggcaaaagcatttgaagaattgctctgtggcacgttgaaggaatttgatgggtttaatcgggagttgaatgttgatgaactggcaaaagcatttgaagaagtactctgtggcaatgggaaggtgcctgatgagttaaacccggcggaagttctcgaaggatttgacctcaaaaaggtgtttctggattggaatggtctacttgatgaaccagaagccatcgacggttgttggtccaaaaatgctaacctcattggcatagagcctacgttttgtttcaatgtattactgctagagttgagcggtaatcggtaa

SEQ ID NO: 77861 - DNA, 681 bp, Heterodera glycines
  Genomic contig location: Contig_ID=SeqID_13910; Location=956..1636; Strand=-
  SCN-specific regions: Sequence locations=1-85,109-504,527-681
atgtaccatcagtgccctcctttttgcgcttctcatctttttgacatcatttgccacctttgccactgcgcgaaagatgggaaagataaacagaagggagaaaaaatcgatgttgaaatgttgaaaaagttaatggacgataatgaataccttcgactctcggtagaacaacaatatagtgtatataaatccgcaaaaagtggtaacattatgagcagtaattagggttgagcggtaccggtaccggtactggccggtattcgtcatatcaatcacaaattcaacttcaattagcttcttacaaggcacatggaagaaccactattgagactgatattttcgtgtggtggaaagaagttggggctcaattccctgatttgtttttactggcccggattattcattcaattcccgccacatctgtgtcatcggaaaggctgttctcgaaagcggggctcatttatggcaactcattaagaaatcggtattttcgatttctgatttctgtaaaaccaaggaatttaagcctgagcggagaaatggcacaaaaaattttactcatcaaagcaaatatggaccagttgtttttggcaccatctactgagcccgatgcagaaggaaaagaattagaaattgattatttggaaataaatgatgatgatttttgttaaaagtaataaa

SEQ ID NO: 77862 - DNA, 283 bp, Heterodera glycines
  Genomic contig location: Contig_ID=SeqID_13910; Location=2020..2302; Strand=+
  SCN-specific regions: Sequence locations=1-114,178-228,250-283
atgtcggctattatatgtattaaagcacacgaaattgaaaaagctgattttcctattcatttggtaagttcgaaaaaatgttacgttagattttaaagttataaaaacttcttaaaaaatgtacaatgtgtgaaattttttcaaattttcagacaaatttctattaaagtattttcatgcaagttttcatgtcattctgtcaactacggaatgaacaggaaaaacggctttttaatttggttaattttaatttcattggcattttctgcgccagttttgacaa

SEQ ID NO: 77863 - DNA, 2079 bp, Heterodera glycines
  Genomic contig location: Contig_ID=SeqID_13911; Location=692..2770; Strand=+
  SCN-specific regions: Sequence locations=1-203,251-424,446-1148,1185 -1201,1224-1301,1323-1679,1701-1859,1891-2029,2052-2079
  Gene Ontology: Cellular component=cytoplasm; Biological process=cell organization and biogenesis
atgggtgccaatgagagtgtgccaattcctggcggaggttcagaaggttaccatgttctacgggtaattgtttttttctttctttattttttaattgttatttgtttaggtccaggaaaattcaccaggacaaatggctggtttagaacctttttttgactttattgtggccatcgggaacacaagactggtaaaataactccattaataaaaaaaatttatgagtaaaaaatcattaaaattatttttaggataaggacaacgattctttgaaggaaattttgaagcaaaatatcaacaaaccattggaattaacggtttataataggtgagtaaattcggacaataattcgagcaggtgctcatattttaatttttgcatttttggttaaaatgttttaattagctttactggataacgatgaatttcagttagtttcaatgtatttaagcatgttttttaactaataccacccaactcattcagtaagacacaaacggttcgcgagactcaaattgtgccttcgcagaattggggcggccaaggagtgttgggcgtttccatccgtttttgctcttttgagggggccaaccaaaatgtttggcatattatttcggtttctccgaattctcccgctgagttggccgggcttcacgccaacagtgattatgtgctcggtgctgagtcagtgctgcaacaagcggacgatctcatcgcttttgtgcaggccaacattggaaagccattaaaagttagtcttaaccgtcgtaacattccgtacgcctttaaacgagttttggtttattagtgcaatatttttgcactatgtaaattaattctcaattttagctgtacgtttataatgtggacagcgacagtgtgcgcgaagtgattctgactccgaatggctcttggggaggcgaaggctgcttgggatgtgacattggctacggttatctccatcgcatcccaatttccgttgatcggtccaaaccgtgtggcgatatgcagccactgcttccttcgcaccaaatggaaatgccgaagcaatcgtcatcgtcactgcctccgccacaaactgggattccgcaaatggaccaactgatcagcgtaagttgcgagcagtaattaaattgggacgatgggcatataatttaaagatttcaatttaattatattttttgttccccatttttatactttaggcttctcaatttgttgtctcttcttcgactgatgttaagcgttttccggacccaaatgaatttgcgcttcctcagcagtcactcaatggggtttctgtgccaacaattcccagcagcagtgtccctcttccaccccaatcgcaacaattggtttccccgcctcttgttcctgtcgattattcgtctccacaacatcaacaagttgtttatcagtatattcgacaaatatttttgctgcaaattttcagagtcagtcctacgactcgggtaatgccgccaaatttgagcttcatggcttgccacctcatcagccgacacctcggcaggtcgacgaacccattggtcctccttcgtttggccaattgagagagacaccaatttcggctccgaccccctctgtcatgtcaatggttcagccacaactccactcttcctcattggactctgtcccactgtcggttccgccggtgacgcaccaccagcaccaagaacagcaacagccacaaattcaaccacttcatcaaacaccaccgccgccaattcacaccagcacttatcaaccgtatttggcatacggtgcgccaccgatgcatgcctttcagccacctcagcaacaacagcaataccaagtaggtattttgagaaacattttagttgttttctatttttaatttaggctgtgaatcaaacgtctgcttcgccttttatgtttccggcgcaaaatgtgcaacagcacattcaattgggacagcaacaatttcatgcgccaaatcagccgtcttccttttaccatccttcatatccgccccaaccgcaacagaaactgatgtcttcaagtgccttttatcaatatctacttaattcatttttcaa

SEQ ID NO: 77864 - DNA, 1673 bp, Heterodera glycines
  Genomic contig location: Contig_ID=SeqID_13912; Location=602..2274; Strand=+
  SCN-specific regions: Sequence locations=1-329,388-1331,1353 -1433,1455-1673
atgagttccattgaaattgaggcggctgatgttgttcgacttgtgcaacagtatctgaaggagaacaacttggtacgtactctacagactttgcaggacgagacgaacattactcttaacacgggtgggttcggatgcttttgaaagcccatatttttggaagtgaatgcgtttagttgacagcatcgaccaattctgccaggacatcaccagcggtcattgggacactgtgctcaaatgcattcagccattgaagttgccggccaagaaactgattgacctttatgagcaagtaaaatgttggcgatggtctctcggggggtcgccgcaaaaatttttttagattttttttctaagtttgaatttttattttttttgaaattttttcggcagattttgtctcggcgagattttggggtgtacccctctcacgggggcatcgtttaatccacaaaaaatgcattaaatttacgctattattacccatttgaacagatcatcgtcgaattggccgagttgcgtgagttgggctccgctcgtttaattcttcgccaaaccgatccgatggccttgctaaaacaggccgaccccgagcgttacacccggcttgagaatttgttggccaaaacatatttcgatccgcgtgaagtatatcctgaagggggctccaaagaaaagcgtcgcgcggccgttgcccaatcgctgtctgctgaagttcacgtggtgccaccatcgcgacttctgtctctgttggcgcaggcactgaaatggcaacaacatcaaggacttttgccgccagttgggtgacaaacccatttatatcatccaattttgtttccgtttattcgagtattttcagatgatcatttttaggcacccaaattgatcttttccgtggcaaagcggcaatacgagagcaggaggacgagcgtcacccgaccactttgacacggacaatcaaatttggggccaagagtcatcccgaatcggcccagttcagcccggacggtcaatatttggtcaccggatcagtggacggttttatcgaagtttggaatttcaccaccggaaaattgcgcaaagacttgaaataccaggtcggaataatcaacaagtcatttaaacatatgctagcctaattaaggcacaagacaatttcatgatgatggaaacaacggtgcggttttgccaaaccatactcattgtcaattcgtatttcggcactgttttaggtcctctgtttggcatttagtcgcgattcggaaatgttgataacgggctccaaagatggcaaaatcaaagtggggttaaaaacaatcatcttttttattcagaaacgaattttatttttaggtatggaaaatccaaactggccaatgtttgcggcgttttgaaattgctcattcggagggtaaaagcggatggaacgatgggaattttatccatttctttttatgtgtgaccagtgtttcgttttcgcgtgaccacagtttcgtcctttcctcctccttcgacaaattggtcaaagtgcacggcatgaaaagtgggaaatgtctgaaggaattgcgtggacacaattcatatgtcaccgatgtcaaatacacggaggactgtcaccaatgtgtgagcggatgtgcggacggaacggtgaaagtccgcgcgcggggcatata

SEQ ID NO: 77865 - DNA, 828 bp, Heterodera glycines
  Genomic contig location: Contig_ID=SeqID_13914; Location=148..975; Strand=+
  SCN-specific regions: Sequence locations=1-92,114-256,288-324,346 -382,404-601,630-728,753-828
  Gene Ontology: Mol. function=protein binding; Cellular component =nucleus; Biological process=transcription-coupled nucleotide -excision repair
gtccaatctcagttttgggagagttggaaggagtttgaagtcaagcatggcaatgaggacacaattcgtgaaatgttgcgcgtcaaacggtccgtccaggccacgtacaacaccaacgtgaactacatgagcggtgagggaaattgacggggagggtgttactggacaaacgtgcaaatttgtctttaaattaacttgctaactaatgggtctatggcaactcgtacaaacaattagtacaataggcaactcgtgcaaaaataaataatataaaattctaaaaaatacgaaagcaacgacttttcgttattatgggttgtcacgaatttattaaaaatattttatcttaatctgactgttttctatttttttttaatcacaaatttgtatttttaagtgttttatttacctttactctctttagcccaaatgatggccacattaggcagccagactgaaatggccggtgaactcagtgctgccgactcaatggcacaattggaggcgcgcgcagcacaaattgcgcaggaagaggcattgattgcagcaaaaaaagtgttgccggcgacgggtaagcagtttgatagtaatttgaccacttaaaactttaaaaattgctaattcacagacggacgaatttcgtttgtacgtggcgaaggtcgcacaacgacagaagcacgggctgaaaatccggaagaaattgacattgatcaaattgttgatgatgagggcggggaggaagaggacgatgaaaacgccatggatcacggggatggcacagcggcgaaaagtgcagacgatggacagagggaaacggcggaggcgtaa

SEQ ID NO: 77866 - DNA, 125 bp, Heterodera glycines
  Genomic contig location: Contig_ID=SeqID_13915; Location=931..1055; Strand=-
  SCN-specific regions: Sequence locations=1-98,120-125
atggaatacgtgcttaaactccgtggattgacactcaattatgatgtgatcaacaaccaaggctttagatataaaaacagcaagtcaaacgttatgctcaaacaggagagattgaaccaattaat

SEQ ID NO: 77867 - DNA, 367 bp, Heterodera glycines
  Genomic contig location: Contig_ID=SeqID_13915; Location=1281..1647; Strand=-
  SCN-specific regions: Sequence locations=1-367
atggctgagcaatctgcatttcaatcgaaattaatgttactacggttgaagaaggttacccatttaccaattgatactgacataaaaggaaatggtgagaaggaagctgaatttgtaagagagtgcaaagagaaattagagatcttaaccaaacaaagatagctgtgaaccaagaagagtaggattgttaaactatgcttgaacaatttgtgcgacatatttctttacgaaattacagcctttaacagactttacttcaataatgatgtacttgattttggagaatatttgggataatagttcaatagacgtaatggccatcgaggattgaaaggtgtatcatgttttgatcacctacgaaaataaa

SEQ ID NO: 77868 - DNA, 714 bp, Heterodera glycines
  Genomic contig location: Contig_ID=SeqID_13915; Location=2144..2857; Strand=+
  SCN-specific regions: Sequence locations=1-291,313-453,550-554,663 -680,702-714
atgctaaacatatccgcttacttctattgcagttctctctgtttccaactattcatccacagaataatgatcaatttgccaagtgttcagttgaaaagttattgatctagaaatatcacaaacaggccttatactagtcatacattcctttagtacatcaatgggtactaaaagacgctgccttctttaataatgccttagttcctttgagacatcaaataattccctcctaaacgataccagcgctgtcattaaaattttcaatgtcattacattttttctcattaattgcctctgtaaatacaaattttccagttgagaagatagttgtggtagaatttgtacctagacccttcattatatttgaaagatttatgtggttgtttttagtggatggggatattaaataaattgaggagaaaagttttactatttattgtcagtaacaccataaattgaatttaattttaggtataatttacttaattttaatcaatactattgtatttattatttttattatattttaatacaactttaatttaattttttaatttagttttatttatttttatttttatttaacatttattttcttttaattttaatcttatttttatttttattttactttttatttgaattaatttgaattttattttactttatttattattcagttaatttaaaggagttgttcagaacctctatcca

SEQ ID NO: 77869 - DNA, 2020 bp, Heterodera glycines
  Genomic contig location: Contig_ID=SeqID_13917; Location=49..2068; Strand=-
  SCN-specific regions: Sequence locations=1-384,406-646,669-824,846 -1622,1647-1662,1684-1737,1763-2020
atggtcctacaacaaaagattaaccctacggaggaactcttggggggtgagattgtccgagatgttggagaactcctgacggattccattttcttggacaagtgatctaagcatttttcacgaatttgaatcagcctgaaaaggggcaagcgcacacctaattctatttttcaaacccatttcgaaccttcttacatcgattctgtccgtttttaagcatttttgagtttggggcctatgatcaatatttatttacctatttgacaaatgccaatgattcaggacgtggaaaagcaaagaattgccaaaattttttgggcacttctatttgatggagacactggcgggaatgtgctttttctaaattaatagtcaaaggaagctaaatctttgaatttatatacctatttttcattttgaatgacaacaaacaaagtggactttttctgactgcagagtcggcatataaaagcactcattttgcccatattttacattccttgtcaattgtgtatccgtcaacaatgcccttttcccccgtcttaaatcagcagaagggagcgccaaatgcaaacgaaatcgcgggacgtggcaacgcaaaaggagagaattccgtcagaggtggagccgagcaacattcattttgataaaagcttatttttactctttttcagtgaaccgttcagtgcaatcaaacggagacgaaggaatggaaatggttggaatgaccggtaagaatggacgaagcattgaaaccgttgaaaaacgattgacaattttcattttcagagattcgctacgaacagaagcaacaggtcgccgccgggggtctctgctgctgctgcataccgtgtggctttttcaaagaatcgtcgcacgaggaaccgccgaaaatcttcaaattcttcatgacaaaaaagaagactccacaaccgcctccagcagcagaagtcgtgcaaccgcaaaactccgttccatcgccgccaaaggcccttcctgtcgaaaactacacactcaacgcgacgtttacgaaggaagcggcgcgtggatacgcaaaaagtgaaaaaaataatgtctaaattgaatgtttcccaattattattttcagtgacttttaagaagagcaaaaagcgtgcagcaccgaccaaacagccgaaactcgtcagaatttcaattttcttcgcttttcccctcgcaaaatttccacttcttttaggtttcgtcctccagtcagcccagcgaaacttcggtgttgggtacggctttccgtatttgcagcaggtgtcgttgctccgcataaaaaacaacaaatattgtttttttttcagcaagcatcagaagccctcagtcaatggcaagccatgtcggttcgtcgaaaagcaaacacgaaatggattctccctccgtaagacactcactacccacttatcgtccgctattatatttaaaattgtttagaatccgacttcaaagggcagcgcatacttttaagaaggaaggcccatcccatttcaactgtgagagatgatcaaagaaagcgcgaagaattgccgataattattttgaagatgatgatattatatatatatatgtatgtgttcgatcaaatatgttgttccttcgaaaattaatctgtgtgtctgtttcacgtcccagcgaaaatgaatttttgcatttgtttttatgccaaaatgctaaaacatatgctgaattgtttttttttcttcatcgtcaatgaattcagtataactgctgctcctccggcggtttatcgtcgtccccctccgcccaattctctccttcgtcgtttgccctcctttccctttgctcctccatcctccgtcggattttgttccgcttcagctgatcatcattcttaatgcccttaattagcatttttactttgcctattttggactttttgtgcttaatgccgatttgcctatttttgtgcctatttcgccattttttacgccttttttaggattttcggaaaaatagttaacaaaaatgcaataaa

SEQ ID NO: 77870 - DNA, 144 bp, Heterodera glycines
  Genomic contig location: Contig_ID=SeqID_13917; Location=185..328; Strand=+
  SCN-specific regions: Sequence locations=1-122
ggcattaagaatgatgatcagctgaagcggaacaaaatccgacggaggatggaggagcaaagggaaaggagggcaaacgacgaaggagagaattgggcggagggggacgacgataaaccgccggaggagcagcagttatactga

SEQ ID NO: 77871 - DNA, 696 bp, Heterodera glycines
  Genomic contig location: Contig_ID=SeqID_13917; Location=2515..3210; Strand=-
  SCN-specific regions: Sequence locations=1-63,253-297,320-368,390 -663,694-696
  Gene Ontology: Mol. function=protein binding; Cellular component =axoneme; Biological process=centromere/kinetochore complex maturation
atattcggaaatgccgacaaaattttgactggaaaacttgggcgaaggaatggacaaagcgacgatgagaaagaggaggaagaggaaaagcaggaggctgaaggagaggagtttgttggagaagagaatgaggacgaagaagaagaggaggatagaatggaggcacttttggaggaattggaagggacaacggatgaaatggaagaagagggagaggaggaggagctatttgacagtgaggaggaggagaagcggacgacggaagaggaggaggcattgggaggaaagaagggcacaattttgttgagcaataataaaaccacaatgttgccaatggccaaaaattaaaaatgccaatggccaaattatggccctatttttccagcagcgactgacggcacaaccgaaaatggcaaacggaaaacgcttttcatgcactctttgcacaaagagctttgaccggccttcatgcttgaaaagacatatgctcatccacacgggcgaaaagcctttgggctaaacaaagatatagcccaaagtgtaagcgatggattaaaattttgggatttttttcacatcacttttttgtggcgcactttttcaaaaaaatttgtgaaagtggacggggtccgcgccggaaaatttcacaaattttgaatgaaatctgcatgaaaaaataagtttaactttaataaa

SEQ ID NO: 77872 - DNA, 742 bp, Heterodera glycines
  Genomic contig location: Contig_ID=SeqID_13919; Location=427..1168; Strand=+
  SCN-specific regions: Sequence locations=1-3,35-63,86-108,290-658,685- 742
atgaaaatattattattatattttcttttattttcaattttccaattaaatcaaagtgaatccgaaaataaaaaattgcaacaacaaaagtcatttgacgaaatatttggagaaaaatgggaagaaaaagaagaagaaaaacgaaatgaactcaaaaaaagagaaataattggaaaattttataaaataaaagaaaaaatcaagcaaaaaggaagaaaatattcaagaaaagaatggaataaaattgaagaaaaaatagcgaaaaaattggagacaaatcgaaagaaaatttatgaatggattaaagaattgggattaaatcaaaaaatacagaaaagctacaaaagaaaaactgatgaagaaaaattagaaattgtgcaaaaatttattggaatgtcaaatgaatataagcaaaaagaaagaaattattcgccaaaagaatggcaaaaaatttatgccgaaatttgcaagaaaattggagttagcctttcagtaattaagaaatggaagaaacaatttggaatgagtaaatttataacggagaaggaaaaattggaaaaaatgaaaatttactggaaaataaaaagagaaaatccgaaaatgagtgacaaagaaattgcaaaaatattgaaaattgatagaacgacaatttcaaaatggaagaaacaatttggagaagaattgttctaagaacagtagaagaattttttttcccgccatttttccttcaattattttacaa

SEQ ID NO: 77873 - DNA, 308 bp, Heterodera glycines
  Genomic contig location: Contig_ID=SeqID_13920; Location=348..655; Strand=+
  SCN-specific regions: Sequence locations=1-225,252-308
caaaagaatggcaccaaaattatgcggaaatttgtaagaaaattggagtaagcaaagggacaattatcaaatggaagaaacaatttggaatgagtaaatttataacgcagaaggaaaaattggaaaaaatgaaaatttactggaaaataaaaagagaaaatccgaaaatgagtgacaaagaaattgcaaaaatattgaaaattgatagaacgacaatttcaaaatggaagaaacaatttggagaagaattgttctaagaaagtagaagaattttttttcccgccatttttccttcaattattttacga

SEQ ID NO: 77874 - DNA, 126 bp, Heterodera glycines
  Genomic contig location: Contig_ID=SeqID_13920; Location=2438..2563; Strand=+
  SCN-specific regions: Sequence locations=1-126
atggcaccacgtgatgactccagtaacaataccaatggtcagccagtcattcaatttgatcaacaaattcgccaggaccctggactaaatgccgtttttgactttgttcgggaacagggcgcacgg

SEQ ID NO: 77875 - DNA, 803 bp, Heterodera glycines
  Genomic contig location: Contig_ID=SeqID_13921; Location=735..1537; Strand=-
  SCN-specific regions: Sequence locations=1-62,85-122,216-590,612-803
atggcggcttcatcgtccctttttttggctgttgctttggcatgcttggtgacctcggcttacagtgagtaattatagcaaatacagagagtttggatcaataaaattaggaaataatactcttaattattgtattaattttttttttttgcaaaatgttcaaaataaaattattttaattttcaaatttaactttttaaaatgaaaaattttaagcatatgactccaaatacgtttaaattttggttgtttctaaaaaatggtgaatttttttgttgttgaaaaaaatggtattttaaataattagacagtaccctgatttagcactgaagtgttggcgcagtcatcctgattatttcacgacagcagaacagtgccttcctgggactgtcctctgcaatactgtgtactgccaggataaaggtatcaagaaagtacttaaatattccatccttttaaaagtctcttttgtggtagtgcttgctactcgagaatctcggtctcaagaaaagtctcgtgttttttatttgtctcgagtctcgacttttctcggttgcgtggtcggttgccggaaaatgcgtcagtgaaagttttaaagtcataaaaatttttcgaggtcactgatcacgaattctgtatccatttcggccaattccgaacccctggcaatacttatgctactgtactttattttaaagtacatatttgtatcactgacgcatcttccactgacgcattaagttgcgtgggtttcgttagatcaattcctccccctccaaatacatagtattttttttaataaa

SEQ ID NO: 77876 - DNA, 324 bp, Heterodera glycines
  Genomic contig location: Contig_ID=SeqID_13923; Location=1034..1357; Strand=+
  SCN-specific regions: Sequence locations=1-88,221-221,244-324
  Gene Ontology: Mol. function=protein binding; Cellular component =axoneme; Biological process=eye photoreceptor cell development
atgggaggcgatgaacagcagcaaaaacagcgattgggagaaggacaaaaaatgatcgagacaaaaaaggaggaagaaataggacaaaaggaagaggaagagaaaaaggagcaaagtgaagagaaaaaggaggaacaaagggaagagaaaagggaagaagagggagaaaaagaggagaacagagagaaggaagaaccgaaggaggaggaggagaaggaggcacaaaaggaacaatgggaagagaggcagcagaagaggcgcttcgtcaagcaaagaaaatgccaaaattcggtgccacttgcgaactgggcatttaacatttaa

SEQ ID NO: 77877 - DNA, 486 bp, Heterodera glycines
  Genomic contig location: Contig_ID=SeqID_13924; Location=1171..1656; Strand=+
  SCN-specific regions: Sequence locations=88-146,209-209,259-259,317 -388
  Gene Ontology: Mol. function=purine-specific nucleoside:sodium symporter activity; Cellular component=integral to plasma membrane; Biological process=purine nucleoside transport
atgtccgccccgggctcattggcctgtgccaaaatgctttaccccgagacggagcagtcgcaattggtcaatgtggacgaattggagttgccagcggggtcgttctattcaacaaattgattttcccacggatgccaatgtgttcagagaagaaagcagtgccctcgagtgcatcagcaacggtgccatcatggcagtggaattggtgctggccattgtggccaatatcattgtgttcctggccctgcttgctctgctcaactctgtcctgtcctggcttggccatttggtgggccagtcagattggacttttgaggtgatcagagtggccattggcactgatcactgctgattttgtgctgtcgttttggtgtgattcctcccgttcagctgattctcggctatttgttcttcccgttggcctttgtgatgggcatcactaatcccgaggagacatttcgagtggcccaactgatgggcacaaag

SEQ ID NO: 77878 - DNA, 822 bp, Heterodera glycines
  Genomic contig location: Contig_ID=SeqID_13925; Location=610..1431; Strand=-
  SCN-specific regions: Sequence locations=1-189,218-250,281-640,662 -694,719-750,773-822
atgacttccgccggttttcttcaaattttgcgcttgctgctcgctgtttcgctcctcgtcacctgttgccatggtcagaaggagagaaagtgagttgtttcatcgctcttttttgctattgttaaatttgtaccatttttttcccaatttcaggcctaaaacgggaacgaccaaaacgagcacaacaacgacgactaccaccaccaccactacgaccactttgccaaaaatgactacgccgaacaacaccgctgcaaacggaggcggcggcagcggcaacactctcctgttcattttgttaggagttgggtgcgttttgttccgaattctgtcaactttttgttgaataaatgatgaagtctgcaataacttttgtctccctgtttcagcgtatttgtggccttggcggttgctgtggttgtggcggtcgttgtgtggcgtcggcgacaagcgcgcactgattcctacgccgtcgatggtggtgatgcagcgaagggggcgccggcggccgctggtgccaatggagcgaagaaagatgcggcaaagggcggatcatcttcatcacaaacggcgagtgtcgagaagttttcggcggtgtcgagcgtgccgtccagtctgaagtcgacgacagcggaggacaagaaatgatgccattggagggatgtcaagcgccattttgatgtaatcgtattgtcacatatatatgtatttgtgtgtatgtcaagccttttgttgttgtgattgtagccattcttgcctgtttttcgtttttatcattattctctgtgtaattatatataatttttcttcatatcaaataaa

SEQ ID NO: 77879 - DNA, 761 bp, Heterodera glycines
  Genomic contig location: Contig_ID=SeqID_2105; Location=313..1073; Strand=+
  SCN-specific regions: Sequence locations=1-651,716-761
atggttagagttgagcgggaccgggaatttgggcaaaaccgggacctcggaggaccgggaatttgggcaaaaccgagacctcggaggaccgggaatttgggcaaaaccgagacctcggaggaccgggaatttgggcaaaaccgggacctcggaggaccgggaatttgggcaaaaccgggacctcggaggaccgggaatttgggcaaaaccgagacctcggaggaccgggaatttgggcaaaaccgagacctcggaggaccgggaatttgggcaaaaccgggacctcggaggaccgggaatttgggcaaaaccgggacctcggaggaccgggaatttgggcaaaaccgggacctcggaggaccgggaatttgggcaaaaccgggacctcggaggaccgggaatttgggcaaaaccgggacctcggaggaccgggaatttgggcaaaaccgggacctcggaggaccgggaatttgggcaaaaccgggacctcggaggaccgggaatttgggcaaaaccgggacctcggaggaccgggaatttgggcaaaaccgggacctcggaggaccgggaatttgggcaaaaccgggacctcggaggaccgggaattcccgtcccggtcccgctcaactctacttatggtgataaaaactgtttataaaaatacaataataataattttgtaaaatataatgatttttatttttttaattaaaatgtctaattccttgcaattcaaattcaaattcataaacttaatgaaa

SEQ ID NO: 77880 - DNA, 1544 bp, Heterodera glycines
  Genomic contig location: Contig_ID=SeqID_2106; Location=15..1558; Strand=-
  SCN-specific regions: Sequence locations=1-53,77-934,956-1076,1101 -1161,1183-1259,1299-1544
atggcggctgacacggagaacgaagtgctggccgcgtgcccgcaaattgtgtttgccaagctgctctatgtggacaattgccgtttcctttttgccgaccatttggacggcgtttcggcactgcccgaggcgcaattgcgcacaaaattggccaaaattcaatggcccacccgcacattttggaacattgaccgccagagacgactcactgaaaatggtgtgagagagcgaaattttagggcattttgagtaaaaaccgaaaatttctcgaggccgagacttggcactcgagacggggactccaaaaattggggaacgatgcctaaaaaattcgagatttctcgagtctaggctcgagaccaagacctgacccgagacaagatacccaaaaaagtttactgagtctcttgacaccgggacttagtgcatgattgaggcctcaaaaaattaaagtttttccagtcttggtactatatatatagattaagacttggccaggagaggttccgacaaatttttcgagacttgtcaccaagacaagacagtactgagcaacccaatgattgtttggccccgacaataaacgctaatttgtaagacggaaaagcgccgttctcagttgaaaatcgaacagcaaatgccgaatatttgaattacttcatttctatgttttgcacaacacattcaggcaaaattgacgagcattttttgcgccaatttgtcctctcggaatatcgtggtcaaatttcgttgcaaaaatttctcgagaaacgtttcggcattgtggccgattcggacgaaatccggcacagcacattgcgctcgttgggcattggggtcagtttcagtcaggttacggtaggaagtcaatgccattataccatcaagtttagaaacttaagtttaaaaaaataaacaaaaaaatgaaaaattgtcatgaaaataccgtattttgaaataatgcacccgagggtgtttattttcaacccccctcagaagaagggcttttttcaagggggctctaattcaggggggtgtaaatcaaatttaaaaataaaatctgattactttcttagtattaaaaaaattattttttttttgcataatgacgtcacaatctcaagcttttccatatactttttcactatatttgaaaacgcattttaaaatgtacaagttatttaagtcacttgaagctgccgagctcgcctttttgttgcaacacaacaaacgccgccgcaccacactaattgcccctaatgatgatcataatgaggatgatgatgacgataattatgcggttgcaacgtttcgtttcttgttggacgaacggcatacattggaccaatttttgtgccaattttcactaatgatcgatgaaatgccgcaaacggaggcggagatggtcaaaatgccgttaatgatggaggcggtggtcatgatgatttgcagttgcaaatttcgtcaacaaaattcgacattgatgagaaatgggcccaacatttggcaaatgcattgacggaacgccgatttgccatgacggg

SEQ ID NO: 77881 - DNA, 909 bp, Heterodera glycines
  Genomic contig location: Contig_ID=SeqID_2106; Location=2253..3161; Strand=+
  SCN-specific regions: Sequence locations=1-295,317-331,353-393,415 -417,454-909
atgtccccggttggcgttgccgccgtgccatcattattgtactgctcgaaattgatggcacaacgccggccatggaccaacagaatgccgtcggcgccaatttcgagccgagtgcccatcaacggctggccaatgggcaccaaattgtgcgggtatttacttgaaaaacaaaaaatattttatttgaaattgcccataattattaggcatgagaatttaggcaaaaatctcaaaagatcgccactcaaaaacgtagcctaaacatggttaaaccttagtaaatccgctgtttatcaaaataattttaaataaattacaaacattttgttttatttttcaacaaaaaactttcagattccgttacggtcttgatgttgtaactttaaaagacaagaaatttgaaaatgaacattaaacaattaaatttttaaaaataatttaactaaatttttacgagtgtcatttatgtaaaatgaatttagaattggttttgaccgggaatttacggtattttttggcaaaaagtttacaaaaaatccccatttttgtttggtttttgaaaaaaaatgagggttgaaaaataaagcacctcccccctaaattagaacccccccccccctctaaaataaagcccctcttttgagggaggttgaaaaatagagccaccggaggctctattttaggaaatacgataatatttaggtcctcaaatatttgttcacactttatgtcggcgcgttcaaagcgatgaacggatgcccagcagctgacttcggtcagtccgtacacattgaacaccgccatgggacacgtcttcgtcaagtgatttttgaccaaattcaacgggaaattgtcgccgccgatcagcagcgattggatgggcgaatttggcccgaaaatgtgccgtaa

SEQ ID NO: 77882 - DNA, 98 bp, Heterodera glycines
  Genomic contig location: Contig_ID=SeqID_2107; Location=2027..2124; Strand=-
  SCN-specific regions: Sequence locations=1-98
aggtgcgctgttttacgatccggcaaccgaccaaattgtggccgacggcacgacgacggcacaatttgaggcgcctgcggcggcagcgaacccacggc

SEQ ID NO: 77883 - DNA, 388 bp, Heterodera glycines
  Genomic contig location: Contig_ID=SeqID_13927; Location=1269..1656; Strand=-
  SCN-specific regions: Sequence locations=1-110,132-305,327-388
atgaaaaaagttataccgtatccaaccccgacctcgggggtacaaccctttgagctcaaacgtgagggcccaactgacggagtccgatcgattcatatgtattttgtagcattttttgcatttaaggcattggatggttcagtcccaaaggcatttggccacttccgttccgggtctgtaactcttcaaggattggtttccgcaaaaatattttttcggattcttcaattacagaccgagcgctatcaaatgatatatatgtcggccattttggcctcaggggcatatgattgatatttagcgaaaaaactttaaaataattgaaatataaacaaaatcaagttttttgataagtttttacgtgatttgcttcctaagcgttaataaa

SEQ ID NO: 77884 - DNA, 1345 bp, Heterodera glycines; identical to SEQ ID NO: 13930
  misc_feature (1262)..(1262): n is a, c, g, or t
  Genomic contig location: Contig_ID=SeqID_13930; Location=1..1345; Strand=+
  SCN-specific regions: Sequence locations=1-332,354-583,609-858,880 -947,981-1249,1344-1345
  Gene Ontology: Mol. function=potassium:chloride symporter activity; Cellular component=integral to membrane; Biological process =embryogenesis and morphogenesis

SEQ ID NO: 77885 - DNA, 2445 bp, Heterodera glycines; identical to SEQ ID NO: 13931
  misc_feature (2334)..(2334): n is a, c, g, or t
  Genomic contig location: Contig_ID=SeqID_13931; Location=1..2445; Strand=+
  SCN-specific regions: Sequence locations=1-224,246-332,582-605,645 -1141,1165-1216,1514-1516,1548-1563,1598-1614,1658-1940,1965 -2160,2238-2445
  Gene Ontology: Mol. function=potassium:chloride symporter activity; Cellular component=integral to plasma membrane; Biological process =embryogenesis and morphogenesis

SEQ ID NO: 77886 - DNA, 289 bp, Heterodera glycines
  Genomic contig location: Contig_ID=SeqID_13932; Location=1122..1410; Strand=+
  SCN-specific regions: Sequence locations=1-9,31-142,190-289
aaattttcgtttcatttttatttttagaaaagataaatttgacttctttacaatgactgcttcatcccgtcgtttgcaaaaggttgactaattacgggcttttaactttattaccatatgggatcagaacttgaatctcttggctgacctaaaatctcacttcagtgcttttttaaaaattctttttcatgattgaaactattcttctaccttactaaaatatttaactatatttactaacaggaactttccgaaatgcgtgggaacaattcgggcgctgttcgagttc

SEQ ID NO: 77887 - DNA, 716 bp, Heterodera glycines
  Genomic contig location: Contig_ID=SeqID_13934; Location=1299..2014; Strand=-
  SCN-specific regions: Sequence locations=1-73,95-287,327-410,432 -590,614-716
atgagacacaaacggcagaaatttgcgaattcaattctacacatgaaatacggtgggacctgcacattttaccaaaaaatttaatatttttttagtgaatctgaaaccttggctcgttaaatagtcgctttgtcagaaacgaaatattgccatgagacaattagtgactgactgattaatgtagaaatgtaaaaattaacaagtcagtgacactcttaaacatccaaaacaatactttaaaaaaaataaaattatcattctccttaccactttgaacccaatcaaccatataaataatttattctcaaaaaaaaattttttttaatctggacacagataatacataagtaccgaatttttttatgtacaaaaacgaaattaagaatttgattatttgagtaacaactggccggaaatttttgagaaaaactcgaaatgggacttaccgggcactgaaaagccagggcaagaaaagacggagccagaaaaactgggatccgaaaaaccggctccgaaaagtcgggaccgtcttgaagccgggaccgaaaagtcggggccagaaaagctgtaacaaaaaagtgccggggcccgagaagtcgggatcaagacaggattttcaatcggaagttaggaaatttaaatttttacattgaaaaaatttacaaaatggtgaaaaattttccaaagcataattgctttaaaaattatttaataaa

SEQ ID NO: 77888 - DNA, 1891 bp, Heterodera glycines
  Genomic contig location: Contig_ID=SeqID_13936; Location=516..2406; Strand=+
  SCN-specific regions: Sequence locations=1-407,429-1358,1529-1891
  Gene Ontology: Mol. function=sodium/potassium-exchanging ATPase activity; Cellular component=integral to membrane; Biological process=neurotransmitter uptake
gccggccaaagacgcggcaaagtcgcagctacgagacagtctcagttcggtaaagagacggacaaaacggaaaatgaacggaaaaagaaaatggcaataaatggaaaaaatggaaaaacggcaaaggcgattctttgtccttcttcgttttagtcgccggagttatttccctttttttctgttcagtcgtacgttgaacatcatctgaccctcgacgaacttcgcgacgttcaccccgattcgttcattgacgtaaccagcccggagaagagcgacggactgtccagcgaggaggccaagtcagacacactttttataccgtaccctttcgttacggtaggaagcgccttttggacggaggggcaaatgttctggcgccgcccaagcgcatttccaacttgcagttgtttgccaaacagtttctgtacaagttttggcttctcctgatgggtaattagctttttctcatccctccctaattaattcctattaattgctcattaattatttgtcaggtgccgctctgtgcaccattttcacttattttatcaatttgtaccacgggacggaagagttgctcaatttgtactgtgccttcattctgatcgtcatcgtcgtggtgatgtcgttcatgtcattttggcaggaacgcaaggccattcaggtgaaaaagagacgaacggaattggaaattcgaaattcaaatgcacaattattctcagattctttatgattttgggcttcacatgccatccaatataagtgccatttattagcaattaatccattcattaatcaactaattatttgttcactttactgctcggtgattcgagactgtgaggagaagagtctgcagccggacaatctcgtcgtgggtgacgtcataatcatacggtaagcggagaagcacagtccgtatacggtggatgaccccgggaggacggacatttcgccattgaaacaaaattaaacaaaatgtaaatgttttttcaaacagatcaggacaacaagtgcctgctgatattcggtaaggcttctctttatcttaaattatctttcattttgtatataatttaaatttccctaaattgaaattcttaagcattctccagtccacaggggtcaaaattgaatcctccgcaattaccggcgaaccccaacccgtcgactacactcacgaacccgctgctgctcacatttcgctgtttgatgcacggaatgtcgcactgaggggatgttactgtacggaaggagaagctgtgggattggtgatacgagcgggaaagtatacggtgggcaactgtaatcctcctgtctgatcacttctcacttctgctcaccaatttggttttacctctctctttgcattactttttcctgatctctcacttttttttgtccgatcattcttttctttctgttcactccttctcctctttttccctttctgatcactctttctcttcttttttcctttctgatcacttcttcttctcctctgctgctgatcattccttctcttctcagatgctcggcaatttcactcacctccaatcgaccgttaagctgaccgagactcttctgcagaaggaaattgccaagttcgtgcagttcgtttccatcgtcgccttgtcaatgggtgtcattttctttctgatcggttgcatcgttacaaagttagcagtcatttcgcttttcttactcagtcattgctcaatttttggtttgaaaatgtgctctaccatttcgtcaccggctttctcatcattatgtaaattgatggctgattgaaagaaggcaaacccaaactttcctccttcgacagagttgccaatgtcccccaggggcttccggcgatgctaatctcccaaatggcaatcatcgcaag

SEQ ID NO: 77889 - DNA, 1199 bp, Heterodera glycines
  Genomic contig location: Contig_ID=SeqID_13938; Location=2288..3486; Strand=+
  SCN-specific regions: Sequence locations=1-448,471-1199
atgtctgggccaatacaaaaagggatcatcaatgcactcaaagctctggataacgccaaaagcgccacctcactcattctacaccccgacccggacctatcaaactgggaaaatgccgtcaacttggaggctcaatttgatcgcgtcgtcaaggaaatccgtacaatggaaatgcagatggacagtctacgagactcatccaacgcttggattgaacttctcgcccgcctgaccggagacgacaaagacaacggcgaaaaagaatacatcaaattcgacaaaaatgagaaaatcgccgaacgatacgacgcagcatcaaccaaacttcgggatttgcgagatctcgaagcaacactcagtgccgcagccaaactgcacagaggcagagccgacagagaagcaaaggcggatcaattggccaatccacagcaacaaccgcccatgccaccagcaatggcagcaccaatgacaatgccaacattcacagcaccgctctaccaattccagccaattcaactggataaattttttggccaaaagcgaaaatggcccgaattctacgaatccttcaaatcggcaatcggcagccaatcaatcagcaaagcgcagaagctgaacttgctccgcaatctgctgggcggagaagcgcgagaactcatagcgggcttccggctggaagacgcaaactacgagacggtccttcagctgttaaaggacacgtacggagctccggaggaacacatcagaagtcttcacttcgaactggccaatctcaagccgtgccgaagcctccgtgagaccaaagactttctgcttcaacttgagcggcttacaagggagctgaacaatgccggagaggacatcgagggaccgcaggtgttcctcatgctggagaagaagctgactccaccattcctacgaagcatcctcacaaagaaaggagaggatccggcaaactggacgacaaccaaattccgggatgtgctaaccgaagcagtccggaaagaagtccaaatccaagaagtgatgggagaatatggccatcactacgtccaaccaaaagcagaagtcgtctcagcagcacctgtacaagcaccgagaacaccaaaccaaaggtcacgaaggcctaaccaaccaatggcactgcgtgatatgacatttatcgcctcatcactggacgagggtcacagacatcaagg

SEQ ID NO: 77890 - DNA, 505 bp, Heterodera glycines
  Genomic contig location: Contig_ID=SeqID_13938; Location=232..736; Strand=+
  SCN-specific regions: Sequence locations=1-31,53-126,155-295,317 -427,449-505
caaaagttttttacaaccacatattgccaatctaatttcttgcagattgaaagccatccattgcctgccggttctcggcacagcaaagcactaatagggtgtttgactcacttcaaaaaataattcattacccaaaagttttttacaaccacttattgccaatctaatttcttgcagatttaaagctatccattgcctgccggttctcggcacagcaaagcactaatacggtgtttgactcacttcaaaaaataattcatcacccaaaagttttttacaaccacatattgccaatctaatttcttgcagattgaaagccatccattgcctgccggttctcggcacagcaaagcactaatagggtgtttgactcacttcaaaaaataattccatacccaaaagttttttacaaccacatattgccaatctaatttcttgcagattgaaagccatccattgcctgccggttctcggcacagcaaagcactaatagggtgtttgactc

SEQ ID NO: 77891 - DNA, 610 bp, Heterodera glycines
  Genomic contig location: Contig_ID=SeqID_13939; Location=1682..2291; Strand=+
  SCN-specific regions: Sequence locations=1-390,435-504,541-610
ctttgatggcgccgacgaattgtgccgtcccatcgatggcactccgttccacgagcattgccggcactcggcggtggtcaaacataagggttttgtgccgcgccatttgcgttcgccatggcttaattcgccgctttttgacgacaatgaactgagcagcggagaaaacacgtgctacgcatgttataagggaacaaaagcgagcaatggcatggcaccgggggaagagtactgtgcttgtacggtaggcatttgatacggtaaaactgttaagctgtgccatcttttagtacaaaggtcaagtgccgaacgagaaattcggcattgtttttggcacattcaaccgaagtcggccgatttgtctgagggaattgcaaaaatttgcatttgtaaaaaataataaaaataataattgtatttaaattttattttttgtacagatgccaggctgcggtaacaaatattatgaccatgtgaagcattgtgccatggtatgccaatatcatataatttgtttatttatttatttttacaattttaggtcaatttctatgaaaatgaaccggacaaaaatcctaaagaagatcctccaaatgaacgtcgtaattaa

SEQ ID NO: 77892 - DNA, 267 bp, Heterodera glycines
  Genomic contig location: Contig_ID=SeqID_13939; Location=675..941; Strand=-
  SCN-specific regions: Sequence locations=1-182,206-267
agtagcgcggccgtgcgcggtggacgtgctggcgttgggactgggcaatttgggagggcagatggggagatggggaacattgggaaggaactcataaactcccgaaggaaaggccccatgggatgatcaagcccagggatcccatcccgcctttgatggacacactgggataagtggctttattccggagagactgaagatacttcgcttgaaatggcgaacattaaatacacgtgaaaaataaaatgtgatcgatcaattatcgtc

SEQ ID NO: 77893 - DNA, 934 bp, Heterodera glycines
  misc_feature (323)..(323): n is a, c, g, or t
  Genomic contig location: Contig_ID=SeqID_13939; Location=2404..3337; Strand=+
  SCN-specific regions: Sequence locations=1-157,186-934
atgagacttttcaattgtccaaatgctattggggagaaagtcgccaaacagcttttgagggcacgtaagtcgtaaaaacccagttttaattaccgtaaatactctaattatctcccccctccacgagtgggagatttttcgaaatcctcagaaaaacttttttatataaactttttataattaaagattttcgagttttatatcattgattacaggttgtccttaatcaaatcagttttttagggaaatgtaattcggagaaattgaaggttttgataattaagagattccttaagttgcaggggatgaacgttacatgattntagttcgaactacccgaaaaatttggagggcataccataattctggttaaaccaatttttttatttttacagtatccaaatcaaagcatccgttgatgggtacggtatgagtggcgcttcaccgttcacttttcccgtggtttttgaaaaccgacacttgctgggacccgattaattactacacttcaccttttttcgcgaatataacgatcacattgagtggcgagtaagtctataaaattgaaaaatgaagacattttaaagaatggaccttgactcggcaaatgatttgttttctgaactatgatcaggaatgaccagcagagtctctgatacataaaaaattttgaaaattcagtggacatggattaaggaaacgaatccataaaatggttttctcctgctgatccgagttcattttcaaaaaaaaaaatccagacaaacccataggtctttattggcaatttttgatgatggttttttaaatagatgcggcacagcaaaatacgagctaacgtggcttgacgctaatcgggttggttcaaattagagagaagaaaaaaaacactttttgaattctgagattaaaaaatccaacatttaattgaaaa

SEQ ID NO: 77894 - DNA, 3782 bp, Heterodera glycines
  Genomic contig location: Contig_ID=SeqID_13940; Location=539..4320; Strand=-
  SCN-specific regions: Sequence locations=1-169,191-649,671-1439,1461 -1629,1653-1702,1724-1944,1968-1974,1996-2294,2316-2977,2999 -3221,3250-3782
atggatgaaatcctgccccttcgtccagtggacttccttcaaccggaagtccaaattaactgggacacgaatggtgaagaattcgatccatcggatcgaaatctttcatcccaccaaaaattagttgccctttttcaggcaactaaagaatcccatgaatttttctgggaaatgtggcaaaaagaatacctcctccttctgcgggagagaggtaaatgggaccacaagagtccccgtcttcaggacaaaacagaaccaaaggagggaatgatcgtcctcattcatgaggagttcactccccgaaaccaatggtctttgggaaagatcattgagcttaatggccgaccaggggccattagaagcgttcagttggaactcccaattcatgggataaaatcaaagaggtatggaaccatgcctcggaaaatcattatcacccgtccggtgaataagattttcccattggaagtaggattagataatcctatagaaaatgaagaaaaatttgaagagagttcaaatgaaactcctcaaataacaaatgagaaagaaatctctcatttggaagctccaatggatgaaaaggagactgaaactcttcaattggttgatcaaccaattgaccaaaaccggcatggcatgatcactcgcagcaaagcaaagatggggacagttttgaactgtctttccatcctttttgctatgtttgcgttggtaggagcttatccaaccaatcattgcaatgaatgcaaacttctttgctttaacaaaggcgttaaagcaaagatccaaaagaaatcaataaagttgagctctgctgtgcagagaactgttacattcatgagaatgtaaagaagctcacttacgagctgcccaaggagatcctcctaaatgacttcaaatgcgaaggtcatttctggatggattcgaaacacatgttcaaaaaagacattttatgtccagcagttgatgagtgtgaactcatcgaatgctatttttgcattgaacagttagcgaatccaacctgttatccattgatttcatcaatgttagcagggggactttgcttatcattcatgagcataagctttgtggctttttccatattaaaagtcctgttttcaggactttatatggtcatttggctgataattcaatttatcaggccaataatttatttagctggcccaaatcgccctccgaaagagaggaggccaagggcaacagcttctcaaaattggacatcacgccgtgtttacagaacaatggcgtttgtggtccttatggctaactctctccaggatttgactggagcagagaccatcgcagtaatggccaaatcggaaaaatgcattaaaaatgcgacaagcatgagatgcattgtcgaaaactcggcaacgctgacgttgctgccagttggccaaacaaacactcttcttctgaaaacagaggaaggtgttctccttggctcaataaatgttgtgcttaaggctttagctttggaatgccaaagctttactaaagcctggctgcgttcatacgcaattaatgtgttggccggcaaaaggtgccctaaaatgggctcctgcgaaggaaagtattgtggagaagttcgccacaatacttcaattcctgagctaaaagatgccaacgattatcctggcaattcattttgcctggacagcacagccttttggggcaacaaatgcctcttaggcggcagtgcctgcctattttatcgttggtttgctcgaaaaaaatccaagacagtctatgaaatcatgggctgtaattcctgggaatttattgtctatacaataattcgcctggaaactttgggcgaaaaacccaagtcaactcaggtgtttctttatccaggaagaaccctgagatggaacaacatcagccttactccgatcggagtaacttttccgcccgcccccgtcttaaactcagattttgtttttgatgggagcaacatggctctaaccagagagccattaacaattgactttaactgtaaaagtcgacaagaagcaattgatttcaattgcagtcttggcgttcaggcatgcactgattgcatacctgaccattcatcaggtttagtgaactgcaattgccgttcacataaccttgaaaagttaatggaaagtcctgagaggagacttccattaaacatcaaaaattaccaactcagaaatactgggagaaaggtaattgccttgacaggatttagtcctgtccaattaaaccttcaaatagaaggtctccaaatggctttggaacttcaccaaagcctttgcacaattttgccgttgaacatatctgggtgttacagatgttcaacgggagcacaattccgttatgtgtgctcgacaaattttggcaattctcttgccgaaattaattgcgacgatggaacacatttttcaacaaaatgtgattccaatgcatcaatttaccaaacaattttggcttttgataaagccagaattgagacaaaatgccaaacaaagtgtttggctggaaacacttcttttgttctcagggggacattacactatgtccaacccgaacaaatagaagattacagtccaaatcactctgaaagagtgataaacagccaatccagttggcctaactggaattttgattggaaggcgaccctttggtctttgattggcctccaatcatcactcatcttcataatgattatttgtgtaggcattgtttgcctaacaattttcatgaaactttctcctttctatagactttggaaatttatttcctggtctataacgagaaaggggtacggtaatgtgcctatagtattggcaatactgtacttggccgggggaggatccttcggatgtggtgttgaatcacgtcctatcctctcggcagtcaaaaaattttgtgagtcatcccttgttgtggggaatgattcatcgcttccatcgaatggtggtataaaagggtggcggatttgccacccaaacacactcttcaaatcatccttccacggaatgcctattcccataagagaagggccgtacttctcggctagccgggttgtcatacccgaaaatgccgagattctcaatgatcgcctttttggcgatgagaatccccaccgggacccatggtttgaggaagactgggagccagtcttaccattggttcccgatcatgttgatcgccggctacgcgatccaagattggaagaggaggaagaagagagagcgaatgacgctcatctccggcgtgaacgtcgagttcatggccggattgagcctctgagttcgtggattgagcgataccatgaacccagatggtacgagacagcacttgaccgccgtgctgtcgaagagcgacttcgtggagaactccgcgaaggggccacattgttttcagagcatgttggtccaattcgtgacatccattttgatggattcacatgttatggaccggaaaatctctacctcttccgaggtagatcggtaatggatcattaccaacgaatgggtcacgaaatagacccattcatgccttgcctacaagaatatgtaggcttcagccctcacgaaggagggatgctcgtcgacctctacctggtcgaattggtcaacatccgaaaccgagtcggagttgcctggagagcgcctgcagtggtggaggaaccgcatcttcctccacctgaccaagcacagctaccagatggacgtttggagaatcgtcctccaagggtggctcgtcgacttcagatgaaccgacgatga

SEQ ID NO: 77895 - DNA, 633 bp, Heterodera glycines
  Genomic contig location: Contig_ID=SeqID_13940; Location=1982..2614; Strand=+
  SCN-specific regions: Sequence locations=1-24,46-344,366-372,396-633
gtaacacccagatatgttcaacggcaaaattgtgcaaaggctttggtgaagttccaaagccatttggagaccttctatttgaaggtttaattggacaggactaaatcctgtcaaggcaattacctttctcccagtatttctgagttggtaatttttgatgtttaatggaagtctcctctcaggactttccattaacttttcaaggttatgtgaacggcaattgcagttcactaaacctgatgaatggtcaggtatgcaatcagtgcatgcctgaacgccaagactgcaattgaaatcaattgcttcttgtcgacttttacagttaaagtcaattgttaatggctctctggttagagccatgttgctcccatcaaaaacaaaatctgagtttaagacgggggcgggcggaaaagttactccgatcggagtaaggctgatgttgttccatctcagggttcttcctggataaagaaacacctgagttgacttgggtttttcgcccaaagtttccaggcgaattattgtatagacaataaattcccaggaattacagcccatgatttcatagactgtcttggatttttttcgagcaaaccaacgataaaataggcaggcactgccgcctaagaggca

SEQ ID NO: 77896 - DNA, 1403 bp, Heterodera glycines
  Genomic contig location: Contig_ID=SeqID_13942; Location=422..1824; Strand=+
  SCN-specific regions: Sequence locations=1-25,98-100,160-175,197 -280,314-350,416-477,514-782,804-825,862-896,926-1290,1313-1403
atggatttaaaatgctttatccatctcccatgtggtctagtggttaggatttgtggttttcacccacacggcccgggttcgattcccggcatgggaagagattttttcaaaaaaaattaatttaattttttttataaagctaatttcaatttttattttggcattaagatcttagtaaaataattttaaaataaaacttaaccatatataaaagtaaatctcaaagaatttttcaaaaccttaggccaaaaattcaaaaaaattcctctacccctccaacatttttaattaaattaaaaattattttatatttgaaatctttggcgaaaaaattcctcgacaccaccagcattttaaattctattaaaaattattttacatttaaaatctttgtcaaaaaaaaatttaaaaaattcctcgacaccaccaacatttttcattataataaaaattagttttagcgtatttattatttcgatattattatttaatttcatatatcaaaaatattttcccacatacatactgatgatgatgcaattttttgttttgcctttttactccgtaatgagggtgaatgaatgaatgttttgtttgtttgtgcaaaataacaacaattcccatccgtccgtcaaaacaggttttatgtaacacaattttcgtgtgccaatttcgcctcattctccgctttatagtgcacacataaatcgaaaacaaacaacaatttaacgaacaaaagaaaaacagtggaaaacggacggacggacaaatggacgacggacaaatggcggaaaatttgtgggacaaaacaattttttttaatgttaaaacacaaaatgccaacaacaacaatgtttcgaaagtgtattgatgttgatattgttaaataagaaaagaataaaaattattaaattattatttttttgtaaaatcggacaaaaagcgaaccaaaaaaatcagtttttttcaagtgccatcggcctcgtgctgggacgtttcctaaattccgccatggagtaattgaaaatcaaaaataaaaatcataaaattgcttttatgccatagaaatgacggaaataaaaaaaactatttaaaaaggaccgttcaaacttttaaaataacggaaccataagcttatttttgtcaatgcacctgatttgttcctcatttttcagcttggctgctccatcaacaaaaagcctaagggcacgactattaattgatggcctgagggggtaattaattaattggaaaactgtagtaatttacagtacaggacagggaggcgcaaattttgtgcccaaattgtaaacacaaaattgttgtttttgttcagcgaacccaaaattgccagcacactgtgtgagtgtgtgggcggggagaaaatcgagaaatacctcaca

SEQ ID NO: 77897 - DNA, 799 bp, Heterodera glycines
  Genomic contig location: Contig_ID=SeqID_13942; Location=2187..2985; Strand=+
  SCN-specific regions: Sequence locations=1-18,40-773,797-799
atgtctcctttccgcttcctgatgatgttgctggttgcgctggtcgctgccatggccatgggcagtggtgttgaggccgctgcgccagccaaaggaaaagcgccggcggcagcagcaaaagctgctccggccaagggagccaagaagccctaggcaggcaccagcagcaggtagggaggcgtgggtaagggatttacatttttggactcaacgagaatttcgaattttccccagaatttattttgaatcgtaaaacgaaatcgcactaaaatccttgaaaatttcggctccaattaaatagtttttctaattattactgggtttaagggctgttcgagagtcggattttttctccaaaaatttaagtcgaactcaaaaaagagaccaccaaaaaaaaccaaatttgtcggttcgagaattgaaaaagctcggcaacctaggcattcgctaactgttactatgctctggagtccccatgaattattgcttccgcatttttggtcactcacgaatacagtaaccatactggtcaaaaagagagataataaccgtatgggaaagattttccgtttgagaaatttcgtttttttttaatctttatttctaatttaggtgtagcagaacaactgcggacatgtgtgaagaatgatttagaatagatgaatgttgatgaaaaattcggtgattgttttttagaaagaacaaaggcattggaaattttttgggttttgcggaagtaaagaattcattcaaattcggattgattaattttgaaaataattaaggaattaattaaaaa

SEQ ID NO: 77898 - DNA, 138 bp, Heterodera glycines
  Genomic contig location: Contig_ID=SeqID_13944; Location=1817..1954; Strand=+
  SCN-specific regions: Sequence locations=1-7,30-138
atgacatataaaactgagcaaattcaaaactttcaacaatttttgcaaaaaaaagaaaaacaatggactaaggtgtgttttaatttctatgcaccctccaaatagataaaattcttacaaattcagcgttcaacataa

SEQ ID NO: 77899 - DNA, 1334 bp, Heterodera glycines
  Genomic contig location: Contig_ID=SeqID_2108; Location=1353..2686; Strand=+
  SCN-specific regions: Sequence locations=1-52,81-162,185-419,441 -477,521-674,696-775,836-1015,1038-1158,1196-1334
agggatcctgctgtgatcaatttgaaatgggtgcttcagatgatcagcgcggtatatttgaaaatattatattaataaaagtgtaaaaacaaattcagagattggctgccacatctgcacaggtgagagaaagagacttggttctattttggcatttttagtgaaatttttaaatttgaaatgggccaagaaaattcgaaaatccgaggtctaaaaacggcggacctagccgaaaatcggattttcggggctaaaaagcgaaaaccaacagcagacaggtgttagaaaaggcaccgaaatgagacgggtacctagatttttgcttggaaaagcacctactggagtttcttaattagaggtactaacagtgaaatttcaattttccggttacggtatggttacggtacaaataaacagtatgaaaaacggacccacggattttttaattttcagccgcttaagcctcaacacctgccgaaaaatatttatttattttaatttaaaatttgtataaatttttcttttcgctcgcagcgctttatggtggacattgtgccagaattgtctttcattttcaaatcgaatgccttcaaagcgggtgatcattgtcaacgattggaggaatttgatcggaaggtgaagcccaaaaaaaaaatattaaattggcacaaattaaattaaaattgaaacaataaaaatgcatttagcacaatgttttattcgccttagaactgttcatttctcaggaacatcagctgctcggtgaacccttctcaaatttatattcaaaaaattatataaattaaaaaaaataataattttgaattaaattttactaccgaagccctccctgaattttcaaagccaccctcttttgaagggcttgttgaaaaactaggcccccaacaggaattttttaaggaaatacgaatttttttttttttttgaaaatcaggtccataacatggacgcattggatgccgatttccgaaatttttgaaaactctaatttatgatttccaaaattttttgggccgttggaaaaatttcgtagaattttaaaaatttcacataacgatacctttaaaaagaatttctaataaaaattttgtttgcgattgaaatggggtggtcaaaaggggggcttaaaaattttgctaaaatatatttttgtttaatattttaatttaaaaaaggaaaaaatattttccatttttcagaaggcagttcctccggtagctcattttcttcaccctcatcttcttcttcctcaaaagccaaggaaaaggaagaagcgaacaacatttcacgcggatttgtacgaaaataaatga

SEQ ID NO: 77900 - DNA, 1109 bp, Heterodera glycines
  Genomic contig location: Contig_ID=SeqID_2108; Location=2835..3943; Strand=-
  SCN-specific regions: Sequence locations=1-154,177-245,267-480,502 -505,529-1109
atgcggttggggcgagtgcgtcccggcgcaaggccgttcgccaagcccatgttgcgcccagcactacgctttcaagtgttgcgaaaaagtaaaatggatattttatttgaactttttctcttatgccggccctcctaaataattagggtcttctttccatcaatcaaatacatttttcaagagtatttttgcggtgcttaaagaaatgccacaaaaggataaaaagctgagatgttgtctatgattttttgtcatttaaaaattttagtctttaatttctgctctaattatcagggctgcaaaaaatatgcaaataggtttcactgaatttaaaaatctgatttttgtgttcgctccgtagtgtcagaattagttgaatttttgcaggaaaatagcttactataagggctttctgcatgccaaatttcaaaggattttatacattcaaattttttatacgtatcatttcaaacaacctatttgattatattttttgcagccctgctaattatatatattataaatttagcattggaaattttcgttgaaacattatcattttttagcctccaccggtgcgtcgacagtatgaaacgtttggcatatatgtactgtaaacgcatttacttaaaggtgaaaccagcgcaactcatccaaattgatgattgcgaaaaagccgcgaaaagttgtgactgtggctggtacagctgcatcccgcacccgggccaatcgtcaactccatgttgtgctgagcactacaatttcacgtgctgcgtgaaggtaaggcggttgtttttgccattgtatagtgtttcagcgggtcggggtcgttttcgtacgggccgttttcgtaggagcccaagtttttggctataacttttttctttgtcaaccaaatccaacattgttggtatcattcgatagccctaagtgttctctattagcctgtaaaatttggaaaaatttcgttaaggtccaaaaaaattatggtcagaagagttcaaaaaaccaaattttccagctttttttggcttgaacttttttttaaattgacgaaattttttggaattttgcaggctaatagagcatctgaaagagctttcgaatga

SEQ ID NO: 77901 - DNA, 940 bp, Heterodera glycines
  Genomic contig location: Contig_ID=SeqID_2108; Location=4426..5365; Strand=-
  SCN-specific regions: Sequence locations=1-29,52-157,187-688,710 -765,787-940
atggttaatttggttgactttgacaaaagttatggacagttttttgttgaaaatttccatttgatggttttttatttaatttgcccaacgaatggtgccatttgaaaacccaaaaaaatagacatatgacaatgactggatgtggaagacataatacttttttttctttatttatttttttattaaggagggcccaactcacgggataagcgtcagggagaacctggaggaaacactggcggagacggaaagaaaacggatggaaagggagggaagaatccgaaaaaagcgggaaaaggaaagggtggagatggagcatctttttcacttggtaataaaaattagattcaaaattttttatttcttcaaggctataagcttttttattctgagtttcgaatctataaagtctttgttctcgggtatcacttaacacgaatacaccatctcatacacaggtgatgccagcgtctttttgccggacggaaagcttggcgatactatgtgcaattatcatttgtccaagggcaagagcatgcttcttggaccatttgagaatgcaccttttattggcactgcttttgattttgtagtcagcgctgcactaccacaaatgccacacagtggtgatgagaatgacaaagacaaacttgctgggccaatgtgcaaagcagaccatggctgtgattggggaaaatgccatccaagcgctggcaaaacggcaagcacttgctgtgcagatggctttgtgttcatctgctgcaaggatgtaggtggagataaggacacgtgtggataaaagcacctcacttcataattttggtctttagactgtaaacttccaaagcattttttcaaaaatatttcgtgcaaatccatgggctaaacgacatcacagaaatttgtcactgaatattttcatggattttgaaataataaa

SEQ ID NO: 77902 - DNA, 764 bp, Heterodera glycines
  Genomic contig location: Contig_ID=SeqID_2109; Location=240..1003; Strand=-
  SCN-specific regions: Sequence locations=1-150,183-465,487-547,569-764
atggccaaaattaactcgctgtccactttcagtctgttgatcgccctgatcagcgcgctggacagcgctgttgtgcgacaacagcgcgccgccgacgctgccgcatcgaaaccggaaccgaacaacgaaaagccaggtaaactaaaagactttattaaacaattaaattaatttaataatttgatttaggaactgtcgactcggacaaagcaaagccggacaaaagccagggagcggacacggaagaaaaggaccccgaaaagccaaaggaaagccaggaagtggaagaggatggaccagatccgaagaagccaaaggaaagccaggaagtggaagaggatggaccagatccggaggatccaaacaagcaggaaagccaggaggtggaagatacaggaaatgatcccgaaaacccaaaaattctgaattaggaggaagcggaaccgaaaaaatcgagtctgacagagccaaacaagctggaaaactccgaagtggaacagtcggaagcgaagccgcaagggcaagagaaacaggagacacaggatgtggaagaaccggcaccggaaggctcaaatctgccactattgaagcccgacacggatgcactggcaaacggtcagcaaatgttttggatgctgatcaaaaatctggaaattttgagtgggcctattagaaaatgcacaaaatgctctacaatatgcaaatgaccacaattccatacgattatacccactgagcagggatgggccaaattgaaaaataaa

SEQ ID NO: 77903 - DNA, 331 bp, Heterodera glycines
  Genomic contig location: Contig_ID=SeqID_2110; Location=275..605; Strand=+
  SCN-specific regions: Sequence locations=1-105,137-232,254-279,301-331
atgaccaaagattgcataccagggatgacatccgagcagggattcacgcaactggatttcaattacggaaatccgtcatccataaaattggttaagagtaatttatgatcagaataaaagctttgaatgattttttgaggcgtaaaacctcaatatattggccgaaatcaagagaaaaatagcaaaaatagggcaaaaaatgagcagattcagagttgcggtcgaaaagttcaatttttttaaaattaattttcaataatctcaaacttttagaagcccttttaaaataaaattaaaaagattgtcctggtttggcggtgccgaaaggcaa

SEQ ID NO: 77904 - DNA, 309 bp, Heterodera glycines
  Genomic contig location: Contig_ID=SeqID_2110; Location=964..1272; Strand=-
  SCN-specific regions: Sequence locations=1-274,296-309
atgtcagagttagttcagtgcaaatgtcgtaaatcatttttaagtgccctccatatcagctatttttagtgtatgcaccagggatggcatgaaattccgacaattttaggagcctcggaatcaggtctgcacgcaattacggattacgggttccggattacggaaattacggggttttttgagtaacggattacgggttactgatttttgggatttttccgtaattttgttccgtaactgggacttgtggattatttttcgagacgatttcttgttaaattatttttttataaaactagttttattaaa

SEQ ID NO: 77905 - DNA, 364 bp, Heterodera glycines
  Genomic contig location: Contig_ID=SeqID_2110; Location=2161..2524; Strand=+
  SCN-specific regions: Sequence locations=1-82,122-225,266-364
atgggctttatgattgctaatgttttcatttttgttctaacgtcgtcgttctatgaccattctgtcaacgccgaacggtaaattgtttttgaagaattgcttttttaaaaagtgatttaaagtttctatctgacaaatggcacagacggaatgaagctaattcaatttcgagcttttgaaaaatgtagtgcaaaaaattgtacggatgaagccacggaagagcactttaaattaattaaaaataattatgatttttattttaaatgcatttgtttgacttgaatttgagttatttagtgatttgaaattggttgaaatggatgttacattcgtaattagtgacccccacgaccctcgtgaataa

SEQ ID NO: 77906 - DNA, 268 bp, Heterodera glycines
  Genomic contig location: Contig_ID=SeqID_2111; Location=555..822; Strand=+
  SCN-specific regions: Sequence locations=1-66,88-180,202-268
atgcagatagtttggattacggtatgaattttccgtaatttaatccatcactccaatttaagttgatttccattaatcattggaaaagttaattacggacggagtgagaaattgattttgcaggtcgaggccatgactattaaagcatgtaaatgaaggaaattaattgttaattcgtgacatttgtaacacagttttcagagagtctctgcctttttatgccaaacatttgacagtaaaatattccgataaaatttttcacagttca

SEQ ID NO: 77907 - DNA, 1788 bp, Heterodera glycines
  Genomic contig location: Contig_ID=SeqID_13946; Location=39..1826; Strand=-
  SCN-specific regions: Sequence locations=1-200,234-260,298-394,416 -639,668-782,835-918,980-1060,1104-1155,1195-1588,1701-1788
atgaaaatgaggcacgcaagtgcgaagcaaagcattatgagtaagttttatatataattatgcacaataatatttatgtaaaaatgaaacgaaattttatcagtcagtttaattactttcttctattttagctgctactcaacgtgtggcaggcaacaagcaagcagattgtgatgcggaaaatcgcatttgctggaatgtatttaattgatattatattattttaaaaatttcacttttttccatttgagtggtttgcgaaaataataactaatttaaaaataaattaaaattaaacaatcaaaaaaactttttaagaaaagcccacccaagcccgataataattgccccttcaacacaacatatgtttttgtaccatcggagggatacgagaaaatgcaggtaaatttttctcaaatttctctattaaatctcacttataaacaaacaagaaacaagatttattgattggcttaaaacatatttaacgaaacagcagtagtaaatcgttagaattttctcaaaatctttctttttcaaaatttactcttttccatttaaaggaaaaagcctgcaaaaagcagaagaagaccttcaaacaaattccagccgatgatgaattggttggttttcaattagaaaattaattatataaacataattaattcatttgttaaccacaattgccaatgtttttttgccggctggaaattctgttcaatttacagtaattttaatctccgccgacagttcccgattatttcaccggcggcgcttataactaatttattaagaaaattgaattttttttttgaaaatttttaatttttatttcgggagtgattcctcctctttcccccactaaaggcggggctggatgaggtataattttaatttgactttttccttgaaagcctcattttaaaaaattaagaaattgttaaaataataatgttaaaaaaacattcatttttttattcaaaacatttacttatgtaggagaagcccgaaaatggtcagatggagaagagtgttggagtgaattcctctgctgatggtgaatttaaattcatttaaaaaatcaatgttaaaattttaaattagtcattttaaaattggaaattagctttgcatataaaataaccaaaattagcgattaaaataaaaataaataataaacatatattttaaattcgttttcagtgtcgccaaatgccacaactgattcatgatgcaattccgttcccctgaagcttaagaagaatgaagaaaagggacaacaaatccaagtcaccaaagccataatcaaatccaaatccgccataaccaaatcccgagtccgccataatcaaatcccgagtccgccataatcaaatcccgagtccgccataatcaaatcccgagtcagccataatcaaatccctgtccgccataaccaaatcccgagtccgccataatcaaatcccgagtccgccataatcaaatcccgagtcagccataatcaaatccctgtccgccataatcaaatcccgagtccgccataatcaaatcccgagtccgccataatcaaatccaaatcccccaatcatttatatcctattttaattattattttttatttattatattcagaattattttacgtttttaatttcatttgtcttttattgtaaattttttttcattcaagttttgatcttattagcttagtcattattcatttaatcaatttatgcaactaatctttctttattatatgtttttctttcggatatttttttaaataaa

SEQ ID NO: 77908 - DNA, 289 bp, Heterodera glycines
  Genomic contig location: Contig_ID=SeqID_13947; Location=2204..2492; Strand=+
  SCN-specific regions: Sequence locations=1-289
atgaattcaaaaactgctgaaaaccaaaaggttttgatttttttacacgcattttactaagagagtttagccttcgtcgctgataatgcgtttacatccttgtgcgaaatccggcggctacaaaattgttcaatcggtaaatttatttacagttaattgtttaaaatttttttaggtaaatgggcggccgaatggcaagagcaagaaaataaataggccgaaaaggaatgcaattggaaaagaaaatatcgagccaaatggagacacaaatcggtaaaaaacaaaatga

SEQ ID NO: 77909 - DNA, 557 bp, Heterodera glycines
  Genomic contig location: Contig_ID=SeqID_13947; Location=2596..3152; Strand=-
  SCN-specific regions: Sequence locations=1-557
atggcaacgcggcattttcttggttagcttggcacccagaaaaattcgtactgcaaaccccaacaacagtttgcgcatttgtggctccttggttcctatttcagcgcacggtggatacatcatgaggaattggtcaaccaacgcccgtgccgtcgtccaaccattgataattgcatttttgtcacggtttgcagcgtaccaaaactctttcaagatcgaccttgccatgatgtcggtgtaagaccttcggaatatcagaaatagaaactgctttaagacaaatattttgtcatagtatagtaaagcagcttcgtcgggtttcaatttctattccatggtttatgtctaattcgatgtcaagcaaatttggatgatactatcctaagcccataaaaaggctacaagaagccacaatttttgatcatttacgatcgtctaaacttttcaatcaaaatttcactgaaaggacgtggtcgtaaatatctaaacatattcgcatgaatatgtttaatttttaagcacattgcggcttgaactcctttgtttaaacaattaaa

SEQ ID NO: 77910 - DNA, 423 bp, Heterodera glycines
  Genomic contig location: Contig_ID=SeqID_13948; Location=236..658; Strand=+
  SCN-specific regions: Sequence locations=1-384
atgtctactaccgatggcgtctttacacaattttacaaggcgatgaccgtcaaaaatggcggctggagaagttcaaaatgtttgaaggagggagttggtggcaggttgtagtaacataactttccttatgagacacatatttacagccaccaccgcactcgctttttgagcagggaatgccgccacaactgtacgacacggcgtatgtgccaaagagacgtcgtgacaaaccctatgaaaagagggttggcacctttgtgtttccattggacatcatagaaccttgcaggtcattgctccccgacgccgttcacgcagacggagtgacgggccgagcagtgaagaagaggaaaaccgaagagtggaccgaaggcggagtcgcatggaaagagagagggaacgagagcaaaagcgaaaggaaat

SEQ ID NO: 77911 - DNA, 886 bp, Heterodera glycines
  Genomic contig location: Contig_ID=SeqID_13949; Location=479..1364; Strand=+
  SCN-specific regions: Sequence locations=1-191,213-254,277-439,461 -718,740-829,876-886
atggacatcgatggagagccaatggcggacactggcaaaaaatacaatccgtcggaagaaaacatagggatatttgcaggacgagaagacattgatggcataccgatggacggagcggaggaagccgcagcggaggaggacatcgacggagtgccgatggaggagggcgaagcggcgatgtccaaaagcgaggcaaccaaagtgaatttggagagcgacgatcgcttcactgttcgatcgtggaacacagtaacgcattttctttgtcaaagataattcaacgttattttaaggttgaaattgaagcgggcactactgctgatacaaatttagccgttggtggagagattggcagcggttcggacgtaaagtcaaagtgggagtccatcgacctgcacagtcgctgggaacgccacgagggagtggcacgcgaatttgtgcagcagcagcagcgggaagatgaagacggggagaactcgccgagaaggaagagacacaggtggaagagcaaaacattgttttgaattatatatgcactctttgaagactgtctcgtttgtctcccgacgacgagcattcaaagccaaatggagcaacagctgctgattctgtcacgtcatcagctgtctcaactgatgacgaggatcgccgaaggattttgcgtgaaattgaagtcaatgggtggaaaatcggcgaaatttaatgactcttgttaaggtgaaagtgatgaagctgcaggaccaattggagacggagggcgaaatgccatcctcagagattaacgcggaattggcaaaataccgacaacgacttatggcgaaattggacgaaaagacaacaaaaaccaaaggagaacggaaaaaggcaactgaacagaaggaaaacg

SEQ ID NO: 77912 - DNA, 693 bp, Heterodera glycines
  Genomic contig location: Contig_ID=SeqID_13951; Location=1397..2089; Strand=-
  SCN-specific regions: Sequence locations=1-431,461-693
agtaacgctacggcaattttcacaaattcgggcaccaaaagtgaagtggaaagcaaacggacgtcggaattttgtgccaccaaaagcggccatcggccaagttttcgtcaaaagtggaagaaggttgaatggacaccaaagaacatcccgcccaatgtggagaaccaaattatcagaaattgtgatgagaaagggcacaaaaagttcagcccaaaggaacaactgggaaagaattttgaagtgagaaagggtggtggtgaaaattcggaaaaatgtggacgaatttttcttggcaaaaaatcggaagttcaattagggacaattgaaattttggaaggtggggaggagttgaagagaaaaaggatgaatttggacagaaagaatcagcaagaaaaagtcagactaaatgtctccagtggcggatctcaatcgaattttggggaaaatggcaaaaatttgaattcgtttcgacgaaaatgtgttttctggccaatgagagcggaagcggaccagatgagccgtgaaactttgccatttgatcggggttgggtcgagttgaccgcctcgtgtccggattcaacttcgacttctgctgatcgacaaccaatgatgcgcggacttcggtgcaatggcagtgagctgatcccaaacggacctcacctttcgacagccggatgcgggatgtgcagctga

SEQ ID NO: 77913 - DNA, 98 bp, Heterodera glycines
  Genomic contig location: Contig_ID=SeqID_13952; Location=559..656; Strand=-
  SCN-specific regions: Sequence locations=1-98
gcctctggatccaggtctcgaggagcctggatttttcctggacctggatttttgtccaggaaatcaaggtccaggtccaacatggaatccaggtccag

SEQ ID NO: 77914 - DNA, 929 bp, Heterodera glycines
  Genomic contig location: Contig_ID=SeqID_13953; Location=1279..2207; Strand=+
  SCN-specific regions: Sequence locations=1-124,150-195,218-248,271 -426,450-906,928-929
atgaacggagttggacagagaaacggggcgacatttgccaaggcattcgccctttgtgaattagcgcgtccccaggtccgtgaccaggggggggcaaagggtgcagttcccccccccccccccgaaatgaaaaaataaataattttccagtaaaaattggcaatcttaaaaacttgttcaacctattttcttaacaaagtaaatgtacaaaaatcccgggggcgcctatcggcaccgaccccacttaacctgatacaaattcctgttttttgctctctggcgctcacattttaattaacatcggagaaaaaaagctattcggttgcccctcccggaatttgtttctggctacgggcctgcgcgtcaaggtccatcttccatgtcccgggtacaattaccccagacaatttcaaaaataataatttcgaaatttttaagacaaaaactcacgggttggaaaaacagtcgttttaatggtcggtgccgcggaagaaaccattgccacaggacaaacactgacagtcggcgaagtgacgtcagacggagcgacgacggaagtgtcggacaaatgatccgaaggagtggcgacttgcgactgtgagggtttggaggagacagaaaccgaagaaagggcattttgtgggtcaaattccgacggattatttacagcttcggccaaagtggcggcggaattctgaagaccgaaatgagagtttcaaagaaggagttagggacgatcccaggatttcggctgggagattaacgacaaccctttttaatttgaagaaatgaattctacaaaatttgtggccaggggtcttggaggagatacgaaaaagaaaaatccaaatttgtaacaaaaaaaatgcttctcttaaaaattttgggtggggggggccttaaaaccaagattaatttttacatcgaca

SEQ ID NO: 77915 - DNA, 315 bp, Heterodera glycines
  Genomic contig location: Contig_ID=SeqID_13953; Location=1010..1324; Strand=-
  SCN-specific regions: Sequence locations=1-75,97-315
atgccttggcaaatgtcgccccgtttctctgtccaactccgttcattgtggacaggtccgtcctcgccacttcttcagcccacgcccattctttgcgccgtctccgacgaccgtcagcagcagcagcagcagccccaacagcgttcactttcctcctgctcccccacgcacttcggcaacaaacaatcgccgcatttgccaccggatgagcagccgaacttcattagtcgggctgagttcgaccagtacaaagaggagcaggagcgcaaattggcggcacttcaagacgagctaaaggaactccgtgataaaatg

SEQ ID NO: 77916 - DNA, 442 bp, Heterodera glycines
  Genomic contig location: Contig_ID=SeqID_13955; Location=675..1116; Strand=-
  SCN-specific regions: Sequence locations=1-128,198-259,282-309,367 -390,424-442
atgggtaagcaaaaaggcgccaaatactctaacatcttttatttgcgttccaaattaaataaaattgttattaaaaatgatctttaaacaatttactattttggattataaattttgagagaaaaaacataattattttatacattattatttttaattaataaatgtatcttaaatttaaatgtaaaattaattaagcgccatgtttctttcataattgttcaatataaaagtctcatggaattttggcattcgaaagttttacattttattttattattccctgcttcttttatggacaaatcaggctaaattttaaattaaataaaaataaaagtctaatttattttttattaaattattattgtacagtaagccatagagccaatgattttcttgctaatttgtttgtgctctcaatttaatttttctctcaaataaa

SEQ ID NO: 77917 - DNA, 2346 bp, Heterodera glycines
  Genomic contig location: Contig_ID=SeqID_13958; Location=1301..3646; Strand=+
  SCN-specific regions: Sequence locations=1-286,310-798,820-954,976 -1023,1061-1243,1267-1523,1545-1775,1798-1910,1934-2268,2300-2346
  Gene Ontology: Mol. function=transposase activity; Cellular component= nuclear chromosome
atgtcaaacttaaatcctggtaattggtggtattattttgagcgtcaaggcaaatcaactgctaaatgtaaagccgatggatgttcctactcaaagacattaaatgcttctctcagtacaacagttcttgcttctcatctcaaaaatcaccacccacaactttacaaacagcgtgaagattttgttcaagaagaaaagcaaaaaaccgaaaagaagggacaaagtggaataaacccattaaaaagggcttttgcaaatgcattttgtggttcaagtcaacaaattactgatgatgaagaaaaggaagagccaatttcatcaaaatcacctattttaattgggctaaatgcaaaaagtatgatctgatttttctatccgttattacattttgattaaggccagtggagcacggacggagatgcaacaattggcgcaaatcgcgcactaatggaaatgctggccactcaattactgccatttaatctcgttgacggtgttggatttcgacaattcgttggaaaattacagccaaaatacaaaattcctaggcgcaatcatttcgctcaatatgaattgccaaattgttttaaagcgatgaaagtaataatcaaatttgcgctttcataattctaaaatttagaaaatagtcactgatgaacttctgccagttaacaaaatcgctttgactgctgatgggtggacttcaaaggataatcgccattccttgatttccgttactgggcattttttggaccaaaaattcaagccaaaattttttgtattgagcacaaaaccaataagaggtaattactaaatctggagtcgaaaaaactaaatttttaggacgacacacagctgaagcaattgtgtcatttattagagaagcattaaatgattttcaaattcaagaggagaaaatttcggccttgacgcgagatacagaaaatacgatgaaaaaggttggaaaggacttgggttttgtgtcggtggattgtgcagcgcacgttttgcaattggtctgacaaaataatataattaaatattaaaaacaaaaattttagtgcattaaagagggactgaggtcaattgaagaggaagaacgtttaaaaaatcttttggaaaatgtcaaaagatttgtaagaaaagtgcgaaagtcaagagtgttgacggaacaactcgctgaactccaacaaaaggaggaagtaccaccaacagttttgattaaaaatgtcgaggtgcttttcttctatatttcactattctcataaaggcaattaatttcaggtgcgctggaatagttcatacaaaatgattgaacgttttatcagaaacagatctgcggtgaatttgctgtcaattgaacattaccagcttccaaaatttaacgctgatgattggttgcttttgtcatcaattagcgtactttcaccaatttacgaggccactgttcttttacaagatagaaattcttcttgttcaactataattccgctttttaaagtcagcattaattttttccccaatttattttaaaatttaggcaatttcattcggtttacgtgaggacaaggacaatcgtttttcaaatattaagaaaacaattgcgaatgccatcgaattgcggcttaaacaagccgaagaacaaaaaaacttagttcttgcgactattttggacccacgttttaagaccatttaccttgacagcagtcggctaaatcagtacaaagactggttgataagtgaagttgagagttaccacgcaaagacagatgtgattttattttttctatttctgtaaactatttttttaggaaattgatttacaaaatgacgtaagagactgcagtggttcaagttcgggggacattttttctcgctttgaaaaggacgcagaatttgatcaactaattaataatgtaaaaaactttatttactgctcaaatgattaatttaaggcaacatcccccagtccatctgcattggagacaagacaaaaagccgaagttgaagtgaatgaatatttacgagatcaaaaaatcaaatccagggccgatccatcattatactgggaaattaattcacaaaaatggccaatgattggtgccgttgtacggaaatttctttctccgcctgcaacaagttcagaaactgagaggcttttctcaacggccggtctaatttcagatgacttgcgaaagagtttattaccagaaaatcttgcaaaacttttgtttcttcatcacaatttgcttttaaccggtttctcaattgaatgattttgcttttataaatttgctttttaatatgcttttaaattgctttaaaagatttataggattttttaaa

SEQ ID NO: 77918 - DNA, 666 bp, Heterodera glycines
  Genomic contig location: Contig_ID=SeqID_13960; Location=543..1208; Strand=+
  SCN-specific regions: Sequence locations=1-195,217-543,566-666
atggagcacgacttgaccagctattcggcaaccaaccgcggacaaacacgcacagtgatggaacttttggagttgttggacaaatttcccggcagcattcgcatcatttccttgtatgccggtcaagcggcacaaattggaatcgagctgaaagagcgtggtctcgagtccaaaattgcatcaatggcgtctgatgcaatgcaggcgcacgatgccgacctcaccatcattatagctacagtctcgagacacttggaccgattggcagctatctaaccatgctaaggaccgtaaaagcgaattttgggtgattcccagagggttaatgttgcattaagtcggggcaaacatggaatgatcgtgataggaaatctgcttcagcttggtaacagtgaaatttggtctagattcttggagaaggctctcaattcacagtcgtgacttccccagaggtcattagatcattgaaaaccccaaaatcaaggtatatgcgcggtgtgctggttgacaactttggtgaaattccgtcagtgggcaatccgtcagtgaaggacaatccgtcaataatggacaatccgtcagtggataatccgtcagttggacaattcgtcagcaaattttttttgagcaatgatcaaaaatctacaaaaatgattgttaaattta

SEQ ID NO: 77919 - DNA, 1662 bp, Heterodera glycines
  Genomic contig location: Contig_ID=SeqID_2113; Location=1241..2902; Strand=+
  SCN-specific regions: Sequence locations=1-53,77-223,271-423,460 -546,568-1662
atgctcagagagatggaagaggagcgcgaagaggacgaagcgcaagagattgtgctggtggaggagggcacggctcggagacggaggcgccgcaggcaggcacagacggggcacgactttccgcacaaccaatgggatccggcacgaccggtgtcattcgtattcgatgccaaaatcggtgggtaaaccgatgaaaaatgcaaaacggaaacaaattaagaaaaatgaatcaattaattttaattgggggaaatactttaaaatgtttaatgtgccaaaatgaaagggaattcggcacgaaaagccgtgagacaagctgttcgcttttggactgaccacacttgcctaactttcgtcgaaaacggcggcggttttccgcgcgtgcgcattttttccggcggcggatgcttcaggcggagaaactaattaatttcaaaaaattttttttataaattttatcaaatggaattattaaaattcttttcaatttcagtcaagtgggaaaagtttttcaccaaagagagcaagtaagtgagcacaaaaagtatttattgtttaaagttttaattcgcttgaaaggttatttcgctgggccgtggctgtgagcaggtgattttgtggaagaaacgaaacacaatttgctgctgatcagagcagtgatcaagcccttgtgcctgattctgagctgatcaaaggattgatcaatgctttatctctgaattttatttttctcacgcgcatttctgatcagcgatcaattcacctgtctcatttctttggtcactttcattgtcttttagtttggaattgcggctcatgagcttggccatacgcttggctttttccatggccaagcccgtgccgaccgtgaccaatttgtgaacattgtctattccaacttaaggcaaatttggctgaaaattcctcggtcactttttcacatttaaagcccacaaatggcgggacaattcgtcaaacaaagcaacgaaaacaacgacaattttggcgtaaaatatgactacggaagtgtaagagggaaaagcgaattcaaagcgaatttaattgatcagataatgcattattcggacacggactcggccacgagtcgagtgacaatgttggccaaggaagtgagtgaaagaggcggacattttcataatggatgagtcatgcccatttgtcactcgcctttccctaattaccctaattaccctcattaattattaattaattacctcccgccttccaattttggccgcctaccaacacacaatgggcaacaatgtgtcgccctcttttctcgacgttttggaggtttggcagagtggccaaatgtgcaaaatgaccaattttcagatgaatctctactacaagtgcacggacaaatgcaaactaagcggggcccagtgccaaaatggcggatatcggtgggaaaagtgccaaattaatgccgaaatacccctctcctcgcccgttccgcttgacagtcatccgcgcaactgttccaagtgcttgtgcccctccggcttcggtgcctttgactgttccggccgcggaccacctgaaaatggcgcaccagcggactgcggagagaccgtacaggtgaaggagaaaccatcggcaaaaggcaagggggtggctgggcaacatttaggcccatga

SEQ ID NO: 77920 - DNA, 1167 bp, Heterodera glycines
  Genomic contig location: Contig_ID=SeqID_2116; Location=4960..6126; Strand=+
  SCN-specific regions: Sequence locations=1-707,742-1167
  Gene Ontology: Cellular component=endosome; Biological process =intracellular protein transport
atgcagcggatttttggatcttcaaaaccaaaagctccgccacccaatctcgctgatgcgattacaactattgatgctcgtggcgaatctgtcgaaaagaaaatagagaaattggacggtgaattggtgaaattgcgtgttcaactcaaaaagatgagagatggaccagcaaagaatatggtcacgcaaaaggcattcaggtaaaatctgagcaaaagtttatgagagtcattttcattttagaattatgaagcagaaaaggatctttgagaatcaacgcgaccaactcgccgcacaatcgtttaatatggagcagagcaatttcgcaattcagggcatgaaagacaaccaagtaagttacctagatgcaatttcaaaactccgttttgaaaactaggactacctattaaaaaaaagggaaaacatcggtaccttttcaatgcaacatttagtatttttattctttttttatttcaccggtttttaggtgaccgtcgccgcaatgaaagagggtctcaaatcgatgaaacaggaatacaaaaagctggacattgacaagatcgatactcttcaggatgaaatggaagaaatgctcgagatgaattctgagattcaggatgcactttctcgccaatatgacactcccgacgtgagtttttttaaaatttataaatggagaaaaatatttctaaaagatttttcttggctttaattttttataaattataaaacaaaaaataacaaaagacatgtgaggaggggcttggcaggaatacttgacagtttcaacaggcatcggaaaaattgacaaaattttggtctctttccctcttaaacacacacattcaatacggacgggggtaaacgtcggttgtactccttgcaaagtagggataattctaaagtttttatattgaagatcgatgaagctgaacttgaggctgagcttgaggcattgggcgacgacctgcaattcgatgcggacacaagttatcttgacgaagcaatcagtgcccccagcgtgccgactcgtgacccggccagcgcttctgtgactatctttatttatttattttcatttgcttttttctcttcaattttcagactgtcactgatcagggagttgccgttgatgaatttggtcttccgaaaattccagcgcagtga

SEQ ID NO: 77921 - DNA, 1148 bp, Heterodera glycines
  Genomic contig location: Contig_ID=SeqID_13964; Location=121..1268; Strand=+
  SCN-specific regions: Sequence locations=1-21,43-109,131-138,160 -211,233-238,260-393,415-482,504-523,547-684,729-845,903-1060,1082 -1100,1122-1148
atgttcatttatttgggcataacaaagaaaatattatgcagtgaccgaacgtggagaaggtcaatggtattttatgcaaatgtcaaaagagacaaatcagaaagggattaaaacatatgtttatacttttgcactaattgtgtttgattctcatatttttgctggttttcaacgacaatttttcagtaaaaggcatttaatcgttaaaattcaaatttcaataatattttttgaaatgggatttgtccttttttgcctttaacaatattttcgatttgaactcttcctttggtcacaatgcttcttcaattcgcctttcgataattttaaattattcgtttttcaaaggctttctttaaatttaaattattctaagtttgattaattgcgaacattaaaaatttatgtaaaaaatacgatggaattggctgatttggcacataaatttcagaaatatcatttttccgtcatttgaatgactgaaaaataaaatttacatttaatttggtatgtttaatttgcgtttttttaatttaaattaaaaatgattgccctgaattaaaatttatttgaacagcttcactgtaattatgctgaattttttttttttttttgctattttggtaatgaaaaccatccaatcttttggtaagtccaaaaattaaaatttaattggaatttgtctattttactatttttttaataaataattaatttaattaattaatgttttgccatttgcaaatgtccataatgagaatcatttgccatttttttatgttccgccattttttgctgtacaattgtcggcacatccatcagcttcaaaagggaaacaaggtgtcattaattaattaactaagtataattattctgttaataaataattaattaattaattacttttctatctttattaccccttttaagctttatgccattgttcgcgtgaagcgctttgagccgtcacaattggcgggctcacaacttggccagcaaatggcatccaaaatgggccaacagatggccacacatattagacaacaattggccacaaaagcgggacaacaaatggctgccgaaatgggcaaaaaaattggcacaaatttgggcaaaaatatagtgaaaaaaggcacttaaaattgaaa

SEQ ID NO: 77922 - DNA, 2173 bp, Heterodera glycines
  Genomic contig location: Contig_ID=SeqID_13964; Location=1658..3830; Strand=+
  SCN-specific regions: Sequence locations=1-51,74-75,97-257,314 -316,389-555,594-609,718-895,917-1182,1237-1246,1281-1577,1617 -1637,1688-1824,1851-1853,1900-2041,2074-2125,2150-2173
  Gene Ontology: Mol. function=poly(A) binding; Cellular component=DNA -directed RNA polymerase II, holoenzyme; Biological process =regulation of transcription from Pol II promoter
atgaccaaaatgtacttgacaataaacaccatagagacaatagtcaaattgaggtgaaactgtaaattttgtgccaattaaaaaaaaaatttaaaaggaggattacgatagtgttgtgagagagcgcaatggttaccgtaaccgtcgcagaaaatcgcttaaaaatcggagaaataaaaatttacgtccaaaaaagcgacgaaaacctcgaaaaagccgcagaagaaacggaagtggagaagaagaaaaatacaacgaagaaaagaaaagaaacagaaaaaagagaggacaaaagcagaaaaaggaaaagaaagggtaaaataataaataataattaaaataaataaattaattaaggaggaaaaatgtatggataaataaataattaggaagaatttttcagcagaactcatcggaaagctcggcatggcaccaatacagatgaagaaagcgatggcacagaagagggagaaaacagtggaagagaaaagaacttgaacaatttacggaataaaaaacggtgagtcgaaaaggtcaataaatactaatcattggttaaaataaataataattacgaataataaattaaattagaaaccatttagagatgaagaggaggaggaagaaacggaaggggaaaaggaagaggatggtgatgaaaatgatgaggaagatgatgaaagtgatgaggaggaggaagatgatgaggaggaggagcatcgccggaagcgtcggccaccagccctttccgacaaagaggaggacaacaggtcatttgatgagtttaattggtgggagggaatgaaatagcattgggaaatgaccagaaaacaaatggactaattgatttaagcatttaaatgaaaccaaaattattaatgcgaattgcatgaatgtttaaattttttggttttagtgcgccggcaagtgccccaaatgctgacaaaagcgaagtgatggacaatgaatttgaggaggacaaaagtggaggagaagaggaggaggaagaggtgggaagaaaagtggaaaacaaattaattagaagtaattttcaatttagagccccaaaagaaaaggcaaacgtcgacaatcgtccaaaaacggtaaatttgttggagaatgaggaaaggttttgtagggataagttgcttaagataattcgggtggtgaatcgaagccggcggaagaagaagaggaggaggaggaggaagacgaggatgaagaggaagaggaagaagtgggaaacattaaaaataattaaaaaataatttgaaaatttagcgccccaaaaggaaaggcaaacggcgaccatcgtccaaaaaaggtaaatttggagtgaaaaacaaaacaaaaagaccgtcgcggaggaagatcaattataaatatttgataagcatttgaataaatcttgacacaaaaagagcaaatcccggcagtcgcgcgggaccccgaaaaaaagcctcgggattgaccgggatttggacgggatcccaactcggttatccctccggtctcagttgtccggtttctattgtacatgtgcttaagatgattcgggtggcgaatcgaagccggcggaagaagaggaaaaagaagaggaggaggaagaggaggaaagtgaagagcaattcaaaagcatttaaattatttattaatttatttgatttatttaatcaaaatttattttcagagcccaaaaaggaaaagcaaaaagaaaacgacggaggaaggtgcatactgtaacaattgccctactgtatgcatttaattttgtattgtaaatcgaagattcgaacggagaatcggagccagaagaagaacaatcggaagaagaagaggaggaggtggacaagaaattaaataattaagtaatttaactttatgtaattaaatttaattgtttagagtctaaaaaggaaaagcaaaaagaaagcgtcagcggcggaaggtgaactttatctattttagctataattaatatatattatgttttttgataagatgattcgaatggcgaatcggggccagaagaggaaccatcggaagaagaggaggaggaagaggaggaggaggtgaaaagtgtgacaattaggggttaattgaattttaattaattgtttagagcgaggaaaggaaaagcaaaaagagaccgccggacaaaggtaattttgaa

SEQ ID NO: 77923 - DNA, 254 bp, Heterodera glycines
  Genomic contig location: Contig_ID=SeqID_13965; Location=3124..3377; Strand=+
  SCN-specific regions: Sequence locations=1-1,37-45,68-254
ctttaaaaaatttatcaatcatttaaaaaataaaatcttgatgcgttttttaaaataatttttggttcgaaatatctattttaatctgatttcacggttcctcattttccacttggtcttcttgagaataatccgaaggctttccttaagttagcgggcccctcccaatagccattgagcaaaaacatccaataaagagaaggcatccaatagcgcttcatcagataggcaaatctgaattaaaaaaaaaaaaa

SEQ ID NO: 77924 - DNA, 1257 bp, Heterodera glycines
  Genomic contig location: Contig_ID=SeqID_13965; Location=1726..2982; Strand=-
  SCN-specific regions: Sequence locations=1-396,422-531,553-594,618 -655,678-698,721-837,894-1257
atgttcaattgtcaaatttgcatcagtgagtgcgttgccaatgcctccaattcgccggtaagtttccgctgtcagttggccatttttgcttggtcttttagcgattttcttcgtttgatcagttggaagcgcatcttgcggctgatcacttcagtctgttgccctatgagtgcgaacattgccaattcgcaaagtttcccaccgaattcgctgtgatgaaacacaatgaattggaccacgacagtcgtaattattctgtaatttttggcttcaatcgctcaataattaacttttgtttagtttcggtgtcgaattacgccagaagtgaaggaaaaacgcagcaaaatgcgagaatttttgaccagggaaaaacatttaaatgagaggtgaggaaacgaaaattgtggggggagggaggggctttgaggcgagaattacgctttttaaataagtcagccccataaaacttcagtaattttcaaagtttcagagcggaaaaagaacagttcgcttcttcaccaatggaagtggaaaagaagcgaaaagcaaaagatgggcagacaaaaaatgcccaaatcaaaggcaatgacggaaaggaggaggaaaagccaaagcgtaggcaatgccaagcaaacggcgaaccttatgaatcagcaaaaaaataaattaaataaattgcccttgcgcattgttgttcctttcctcaatgtgtttggattatggttttggtcaagattaattttaggaatgtgccttcgtccgcgtccattcaattctgatggtaatacgacagcgaagaatttcgaaagtgcgaatgaaacgaccgtcgtttcatttggaggggaagaggaggaggacgacgaggatgaggacatggagggcgaggggagcagtctaacggacgagctgaaggaacaacaggcaattggagacggacagaccgaaaaccgaaccaaaattcaggccaacgtccaagagattctcagggccactgcggcggcggtgtcccaatttggtggacctaaaaagcaaatcattcccccgacaaataagcgacgatctgccaacaatgtttgtccctttgctcgccaatttatgtgcgctttccttcccgttcagagttattctcttcgtcccaaccgcttcaaaccgtacgctttgcttcacaatggtattcccattctcactgattgtgagaatgacgtcctccaaaatgctgaagactcgcccgaaatggaaccatcgccggtcaattaa

SEQ ID NO: 77925 - DNA, 526 bp, Heterodera glycines
  Genomic contig location: Contig_ID=SeqID_13966; Location=5..530; Strand=-
  SCN-specific regions: Sequence locations=1-32,55-88,110-202,225-526
  Gene Ontology: Cellular component=mitochondrion; Biological process =sulfur metabolism
attgaaggtcttccatccgggacagaatctgttcttctttctccttccatcagttccatttattttcccgatggagcaaaaaagacattagaagagctcaaaaatttttcaaccggcgaggcagtttttacctttccatcaacgcatataaaatgcgctggagctccactgaagatttgctttttggcggaagaagtatgagtaattactgtcttttaaaggggaaaatgaattgaatttcagattttacgaaggaagggagtccggtcgaattgttccgtgcattattacaccgcacttggtcggatattcggcgtaccaaagtaaagcgacgaacaacacttatcagcaaatcaaccaaatgcctttcagatatgccgcttcccttgagcgcattgtgaaagaacgtggggttgggcttcacccgcgccacaatttagtgaaagtgaaccccgaaaaacacgaggcggagttcgaattgctcgacgaaaaagggaaaggcacggggcaacggcaaattgtcgag

SEQ ID NO: 77926 - DNA, 2450 bp, Heterodera glycines
  Genomic contig location: Contig_ID=SeqID_13967; Location=318..2767; Strand=-
  SCN-specific regions: Sequence locations=1-575,597-929,951-2000,2023 -2241,2263-2348,2370-2450
atggcactgctgatcatgctcatcagcattgtcggaacgttcggctgccaaccatccattcgagcatcgggaatggacccgaaccttccatttcgagagggcccaagagttccatgcaccacggagtgtgcagaacgaggagtcacaaatgtgagtgggcgggaatttaacaaaatcgagattcgttgcgatgacggatgctgggcaacaatgccaaagtcgacggatgtgaactacggactgccagcgaaaaagctgatgcatggctatccttgccatgacaaatcctggtgggggagcaatgcccctttcaacacaacgaggcgcaatgccaatcggaaaacgggttcgaaaacccgttgctacaattcatggacacacgcttcggagcttcaactgtcaaggggcgccgcgggcaatgtcgccaattttttcattggcgacgagaaggcgggtcaatccccgcctattgcacaaatgaacgggacgggactcaatcgaagcaaaaagaatgagggatgttcttggagaagatcggggcgagtcccgattcatcaattcattcaaaattgatcattcctaatttttgccccttttccatccaatttctcatatgcatttctccatttcgtaccattcacatttgtccgttcctttgtcccatttttgccacatcgcatcccttcacaattcaaatcttttctcatcggttggctcatcttcggccaactttgtgctcagatttcctttcacaatttctcactttttacatctgccaattcacattcaatttttgtgcgcccatttcctttgttcgcaattcgcttctagaattttctgtccattttttgtctctctcacaatttgtccacgtgcatggccttttgcccgcccccttcgaaaattgtctatttaagcgcccccggccaaggggtcgctctcttctcttccttccactcccctccgcttcatattcggtctgcctgtgaccactcttcctccttttcttccgcttcattctttgccaagggatctgtcccttcgcttcatattcggtctgcctgtgaccaattcctccaattcccccgtcccatcgcccaattcgatcaattcgtcgcttttattcattattcgttttgctttaataaattcgtgctgaaacggcttggaggactcggaaaggagggaaaagcaccctccacactccatcacattcggcaaattctcgtgcggggccaaacggaggcgcccattcacgtcttgaccccctccctttcctggcagccctcgtcgttctcccccaatcctcccgatcccagttcctttccctttggcattggagaatccgggagttggcccggagcgtcagcgaatttcaagcagttcagactcccgcagccggagtctcgcggatcggtgtcagtctcccgccagccggagcagccgtagggacggggcgaattcccgtcgtcgacgaaaccaagcagggcagagaaggaaggaagagccgagcggtgccaaaccgtccaccgaagggcaggcccgttcgtcgccgctaatcccaccagccggagaagcgcgcatcgccggagtcagtctcccgccagccggagcatccacaggaggagacgggagtcgaaacccgtgctcatcaagtcgagagcgaacgtcacgaagttcgagcagttcagattcccgcagccggagtctcgcggttcggtctcagtctcccgccagccggagcatccgccgcaggaaacgggagtcaaaacccgtttcatcgagtcaagagcgaagagcaactctcgcccgttcggagcagctcaaagggtcggacaagcccccttcacaaccaatcttgtcgagcaactcccgcccgttcggagctgctcaaaggggtccgacaagcccttcaccaaaatcttgtcggtggtgccgttaagcaagcagcaaatcgctgtataacatccaacagtaccagttcaattttgtcacccctcccccctcccattctcgtccccctttggcgctgatcggatcggtcagcagcatcagacccatcaggacgaacggcgaaagagggggccattccctttacggcacagcgagcggagtgagcagaggaaaaagggacgagagcggtgaagaggagcgggaaccaatcccgcctcagctgggccaagccacacacttggcccgcccgagtaaaagattggcgacaaactggtgccgctaacagggggcaactgcagccaccaacaatcggtctacgagcgaccaatcggtctacgagcgaccaacgagcacgaattcgagaagctaacggcaaactggtgccgttagcagggggcaactgcagccaccaacaatcggtctacgagcgaccaatcggtctacgagcgaccaacgagcacgaattcgagaagctaacggcaaactggtgccgttag

SEQ ID NO: 77927 - DNA, 609 bp, Heterodera glycines
  Genomic contig location: Contig_ID=SeqID_13968; Location=1395..2003; Strand=+
  SCN-specific regions: Sequence locations=1-70,93-307,335-386,408 -568,591-609
atggaagaccttagaatgaggcataaacttcagttacattatttggacacaatcgttgaagaattggagtaagaaaagaaatgaataattaaaattagattttacaaattcattttaggaggcataaaattgagtggaaaattgtccggcgtcggcagtattcggatgcacttgctcaatgggctgatttaatcatttccgcgggtggcgatggcacttttctcaccgcgtccaaacgaatttcggatggccggaagccggtgattggcatcaacacggaccctgtcgggtattctttttcggttttgattttaaattcaataaaaacttatagatcctttcagttcctttacttttcttgtaaacgagtttttaatcaactgctgtaaaatgtttgtattttcttaggtccgagggttttctttgtcttacgggcaaatcgcgtcggccggcggacgaagtgatcagacaatttctcgaggagagttcaaaaccgaacttccaatggatgcatcgccagcgcatccgggtgaccattttgaaatcgatgggagcccacgacgaacggtcactttcctcctcatccatcaaccagcaggtgaactcacg

SEQ ID NO: 77928 - DNA, 1100 bp, Heterodera glycines
  Genomic contig location: Contig_ID=SeqID_13969; Location=442..1541; Strand=+
  SCN-specific regions: Sequence locations=1-310,342-596,619-1100
atggcacagtgtgagcaaatggaattgccaaggaaagattcgatttgtgatgaccagggagaccaaacggatgacgacgaggtgtcgaacatgtccaaaaaatcaaaattcaggtaattgaaaattgttgggtgtttgatgtaatacgtgtttgtgctttattttagttctgacgatgaagaacaattgaacgaaagagccgacgcttacataaatggggaaacttcgcacagattggcactgaacgaagtattcatcggtgaaagccatgcggcccgagtcagctattacgatgttcaggtaattttccaaaattaattgttaaaataaaatttaaaaaacttagaaggcaatgaaataagcgaaaggcttttattttgcattaccattttatagattctgtttcagtttacataatcaaaattaatgactgcttaaaactgtgcaaagccataataggaaagaggctcttactgattgtgaaaataggccattattaaagcaaaattcgatttgttttcagggggggggagcacactcattgtcgataaataggacggttttcggacaagtaatttgatgaaaatgccaagggcatacacattaaaaagcagaaagaaccatctccaccccttttcaggttgacaacggaccactgacaaagcagaaaagttcggggatgacaatttgtaccggcaccggctcaacttcttggtctgcgattttacgtaaattatttcaaaaaactccgttcataaacacaggcattacaacataaatcggctgaccgaacaaactttgggtgaaattttcacggagatgtcactgatgggcatttcactggacagagaagtggacaatgaaatggtcgaggagatttgtcgccattttaatgccaaactcaaattcggccctgagcagaacagttcggactttatcatatttattattactctaattggatcaatcgctcaatttgttgctaaatgggttcgtttatcccattttcagagatggcgttcagtgttcgtgaccccgtgttcaatgccactttcccaaagacacttatccgtggatttgctcacaaaatttttttaaag

SEQ ID NO: 77929 - DNA, 155 bp, Heterodera glycines
  Genomic contig location: Contig_ID=SeqID_13970; Location=122..276; Strand=+
  SCN-specific regions: Sequence locations=1-155
atgattgcacgtaattgccgaaaaaattcgagaccaatttccgaatgttgaccgactaattgcaagacgaaagccgtctttgtcaaagcgccttaccgagtcaaaaaatttggaaatgtatctcatatgcaatttcaaccaataaatttgaagaa

SEQ ID NO: 77930 - DNA, 315 bp, Heterodera glycines
  Genomic contig location: Contig_ID=SeqID_13970; Location=1264..1578; Strand=+
  SCN-specific regions: Sequence locations=1-252,275-315
atggcattgaaatgccataatttgttttttaaatgtcatctctggcactttgagggccttttggaagtggcatacggacttggctatgtgcttgggcctccgttgggcagcgctttgtttgaattcggtggcttcggactgccgctgtactcagttggcctttcattcgttgtcgtgctcgtcccgtccatcattttgttctctaatcgacggcggcattatctctccattggcatgtgtttatccataattatgggatgggaaggccaaaaaatgcaaggatatgaaaatctggcgacaaaaatgccgggataa

SEQ ID NO: 77931 - DNA, 300 bp, Heterodera glycines
  Genomic contig location: Contig_ID=SeqID_13973; Location=1089..1388; Strand=-
  SCN-specific regions: Sequence locations=1-300
atggcacgggtgcctttgccatgccaattaacggaggcattccatgccgaggcggaggcgaaatcggagagaaaagcagtgattttggctgcgaaagaggcggctgagggaacaaaggctcggagtcgaggagagaagcgggctgagagccgttggagtggcaggcactgccgtggatttggccaacgattggcctcaatcgcgtggggatgggccgttggatctgtgagtgatcttttcatctttggacttccgactttctttgtgctccttggcattctcatcggcactttggcttga

SEQ ID NO: 77932 - DNA, 790 bp, Heterodera glycines
  misc_feature (3)..(4): n is a, c, g, or t
  misc_feature (22)..(22): n is a, c, g, or t
  Genomic contig location: Contig_ID=SeqID_13974; Location=6..795; Strand=+
  SCN-specific regions: Sequence locations=1-121,143-790
gtnncatgaggaaatgggaccntgaaaccaaaacaaaaagccattcattcgtacagaaaattgcggcattgagcagcacttccaactgcaaccctttgtttttccaacggagtgcagctgcgctggagttgcaccattggctggacgagtgtatggagcagtaccgcctgttggagaaggagcgcaagaagacggaggccgagttggcccgtcaccacctgggcaagcggatcagttcggccaattctcttccaatccctcggcttccgcccgccccttcgcgcgtcgaccgcctcatcgtcgactttttccgtgagcacgcacgcgtggtaacgcttctcgccaaaatggaacagttgagaggcgctccgatgtgcgaagaagtgcaccgtgtgagtggcgtttgcccgcggcgtttccttcactccgtccctccctcagatccatcgccaattcctcgactcaattcgcatgctccagcagagtcgtctcaacgaacgcacggccattctgcagcaattgcgcggcgaagtcggccgatactccgaggacagaggcgagcacaatccaacggggtgaagaagttcaaaatgtgttttcagaaactgccaatctgaccaatgcgttggtttgcgtgtgtaaggccgtgttgcgcagtcgcagtgccaattggtgctctttggcgtggacagtcgaggcgaacggtgccgagcagcaggtgcagttgcagcggattgtggccagcggctttgagttggcaccgccggagattaaacttcggcccatttga

SEQ ID NO: 77933 - DNA, 2028 bp, Heterodera glycines; identical to SEQ ID NO: 13975
  Genomic contig location: Contig_ID=SeqID_13975; Location=1..2028; Strand=+
  SCN-specific regions: Sequence locations=1-483,506-809,872-1431,1461 -2028
  Gene Ontology: Biological process=growth

SEQ ID NO: 77934 - DNA, 276 bp, Heterodera glycines
  Genomic contig location: Contig_ID=SeqID_13976; Location=787..1062; Strand=-
  SCN-specific regions: Sequence locations=1-117,195-276
atggccaactcggcacttaagccgtcgagagaaagggtcaaaagggagtgggagagacggagacgcacttggccccaatggccaggacaaatgatcaatggaggaagtgaagaggacgaggaggagagagaagaggaggagagagatgggggggaagagagagaggaagaggagagagaggacagagagagggactcattcgacggagtggagccgtcgaagagaaagtcgaaatggacacgccatttgaccagatggatggacagtgacagctga

SEQ ID NO: 77935 - DNA, 897 bp, Heterodera glycines
  Genomic contig location: Contig_ID=SeqID_13977; Location=306..1202; Strand=+
  SCN-specific regions: Sequence locations=1-406,439-897
gtttccggtgttgtgctcttcagttttgctttgtggcttcaatttgaccctgcccgtgaatttcttctccgtctcgtccacttctccgagtccactccctttttcgagatcgctgtttacttaatgttgggcacatcgctcttcatttttattgccgtcgggattggattctcgggaatttggaagttggagcggtgtttgcttagcggagtgatttttttattgcataattaacaattgccataaatttgagttaattgtgttgcctttgctgagaagttgggctttgataacactaaaatcactcttctgaattcagttctctgtgcttcttctgctgttgatacattgcaaattgctcatcctttttcttttggttgcctatcgttttaaggtgactttgtctctttgaatctcaatttttggtttttagttccctgatgacactgtaatgactgagtacctcagtaaaatggcccaacatcactaccatcgcgacaaatgggtgaactcggcaattcacacaaatgcattcccacaaaatgttattttaggcgacacctctgatggattccatccaattctatgtaaattttgtttatccatttcaaagcatattttcatgcacagcacaaatgttgcggaggaaacggtgcgcaagactattcggagtcattttggtacaaagcgaacgcccaaatgggaatgccaacaaacggtgagttcttaacatttactagagttgtttttttcttcagttctcacttattttaagtgccttattcttgctgtctccaggcgcaggacgcccgggcttggcacttgcagcccattgactcgatgtgcaatcagtacaaatacggaagtcgcccattcaacgactcagtgaattggacg

SEQ ID NO: 77936 - DNA, 978 bp, Heterodera glycines
  Genomic contig location: Contig_ID=SeqID_2117; Location=2834..3811; Strand=-
  SCN-specific regions: Sequence locations=1-631,674-945,967-978
atgaccgtcacatccaacaccgaattccgactcatcgaatgtgtgccaatccttgaggaagttgctcgtgaatttggctgtattacgccactaccaaaccttgggtatgtttctttcgttttacaacactaactccagcatacagtagccatcgtgactatcgtgtaagcggatgtatgatgattcgcacgctgacatcgttgaatcgactctacattttcgatgctgaagactgtattgaggttaatggaaaatatgtttcatattttattgctattttaggtgaagggtttttaaggtaagaggacggcacgagctaaaaagtggtcaacgaatattatgaaaaatatgatggactaaacggatttgctgaatttattcggaattgggcctttacttttttctgtttccatgcctttgatgatgatgacacatctgatgaagactaatttcgttaatatttattctatgctctttgttacaaaccgataaacaaatccatcagggttatttgaacgattcaaaatttgcataatattttcgaaacccaatccgacggacataaaataaacgaaagtaattacatagtgaccacaaacattggacaacaccgattgaaaccgcctcttattatagtaaatctttttaaaattatcggataaatattttttgatcaagctgataggcatctctccataagagtcaaagaagtaggcaacagcaggagactgtgcccatatcgcacaccaatgagttcccggcatacctgcagggtcctgaatggaaatacgatgagcgaatgaagcaaaaaataagcgtaccaggttaacaatcagactgcacggaaatcttgaacaccttggcaacccatctgcgggatatgtgccgctgaagtaccttttcgtcgcaggattctcaaagagaagtctgtcgatgaatctgttgtccattacgaattcttctctctcgcaggaataa

SEQ ID NO: 77937 - DNA, 278 bp, Heterodera glycines
  Genomic contig location: Contig_ID=SeqID_2118; Location=633..910; Strand=-
  SCN-specific regions: Sequence locations=1-278
tacgctcaaatgcttctcaacaattttagcgcatccaattccttctacaatcgcctttatacatcccattatgaacgctaaaattatcagagtgccgaaaatcgcatgtgatctaagcctagcaaaaaatggtgtaagtaaaaatcgtaattacgctcaaaaagcttctcaaacaattttaacgcttccaattccttctacaatcgcctttatacatcccattatgagcgctaaaattatcagagtgccgaaaatcgcatgtgatctaagcctagaaa

SEQ ID NO: 77938 - DNA, 1008 bp, Heterodera glycines
  Genomic contig location: Contig_ID=SeqID_13978; Location=845..1852; Strand=+
  SCN-specific regions: Sequence locations=1-51,73-73,104-316,338 -352,374-428,455-548,582-1008
atgtctggaagtgaaccagtgtctaatgagatcctaaacaagtcagtaataacagttgacagagaagaatggcaaatttttaaaattttataactaatattatcgggagaagtgccatttttattcggaagttttttcagaagattttgggtctcgatgatgttaaaatttatatccgatataaagcattgatcaatttctataatattacccaagcatggattgcttgggtcggtttcactattattaaatgaattggcaaataaggtggcaaataattcacatttctcagcactgttatgatagcatttattttcataaattagattaggtatttcaaagggattgacattgaatttttgtatatatttataaattgaatttcttccctttgaaatagcctttttctcaatttggctatggtatttatttgtttgtatttttatatgtaaagaaatgctatcgtatagtgcttttttggatgggtcagttttagctagcctgaataatttagccttatcacatcgaatactgcaataacacccttctataaataatttatgtaataaaataataaatttggtaaaataccaaatatttaaagcactttttgcgctgactacggaaacactcgaattggtaacaaacaggaccgattggagtccgcttcacattggcaaataggcagactaatggcacgaaactgatcagctcgttgttcaattcagccggcaggagtcgacgaagttttggctttttctcactcattggaaggttcaaaggattagagcgtttcatttttccagaaattgaattaagaatgatttcgatttcttgctgggaataattttggtgcgcaagtgggcgtggccaaagtgcgcgtatcgtacaccctgtcattttccagattcattttaaaaattttgcactttttttttgcacatctgctgtttttctgcgctttatgggcaccgtattatttaattgggaatttagggaaccgtataa

SEQ ID NO: 77939 - DNA, 3226 bp, Heterodera glycines
  Genomic contig location: Contig_ID=SeqID_13978; Location=1..3226; Strand=-
  SCN-specific regions: Sequence locations=1-741,763-1017,1040 -1128,1150-1352,1380-1801,1835-1928,1955-2009,2031-2045,2067 -2279,2310-2310,2332-2499,2522-3226
gaccgcttgcagaagcctgacagcaggtgatgctggtagcagccgttgttggtgaattttttgttgcactctttacactttttgatgaagccggcagatgatggacatggaaacagcggtccaacacgtgagcacagcatacagcgcgctttacatgttttgttgtgtgttgacattttgtcgtatggccgttcacactccaaacagtacggttttccgaacaaaccgccctgcttctgcacaccatcgaaatggtcttcattgaagtacaacagcagcggagtgtcgtaggtgttgtcaatgtacttgtagattggtttatactgtcccaacgatccaaagatgaacacagcaaagcggtgttgtcgctgcgcgttgttccagtagtcaacgacttgaggcacaaatgtgtccgcgtcgtagccaaccaaatccattggtgcattaacctgctgcattagctgaactgcatcatgtgaagttgtccctgctgtcattttctgtcgttcacatagtcgaaaaacttccagcgaggccaattgcacgttttggcgaccattgttgcctgcagcgcgtagaacaggcagtattggttgtcgttattacgaattttaatcaggcattggtcgttaattcggtgatggacagccgttttgatagggcgacgagctcccccgttgactcgacgtttggatggtagtccattacggtcgagagtcgtgatggtgacggtaaatggctccccccataatgacacatttttctgttgtttggactgcgccacttttttgaactggttgagaatggtgtcgagagtgttgttagtcatctgtcgcactggagttgggatgtcgccgccttccaacataggactgctgatcatacagccgaggtgtgtaggttcgatgttgcgctcacgactgtcagcaaatgcctcctcgatataatgtttgaaagtccaggtccacattgcctcaggcgtgctcggcaagtcggtaatgatgaattttgacttgactttgacatagtggaatttggccatatgctcgatgtttttctccaattttttaacgtagtctttgaccactttcgatgctccttcggcttggaagtgtactatgccatgttcattgatcagcaagctttgtcggggttttttgggctcggagagaatatggtcaatggaaaagttagtgaagcgctttcggggatgattgtccatatttttaaatctgtgcagggattgaggaggagtgaacaaaatttcggtatttatatgcgcaaagcatggaaatagtgtgaagaataaaggaggtgaaagacggaagatgaataaacatttaggcatgctcatataattttaataaaatttaattatacggttccctaaattcccaattaaataatacggtgcccataaagcgcagaaaaacagcagatgtgcaaaaaaaaagtgcaaaatttttaaaatgaatctggaaaatgacagggtgtacgatacgcgcactttggccacgcccacttgcgcaccaaaattattcccagcaagaaatcgaaatcattcttaattcaatttctggaaaaatgaaacgctctaatcctttgaaccttccaatgagtgagaaaaagccaaaacttcgtcgactcctgccggctgaattgaacaacgagctgatcagtttcgtgccattagtctgcctatttgccaatgtgaagcggactccaatcggtcctgtttgttaccaattcgagtgtttccgtagtcagcgcaaaaagtgctttaaatatttggtattttaccaaatttattattttattacataaattatttatagaagggtgttattgcagtattcgatgtgataaggctaaattattcaggctagctaaaactgacccatccaaaaaagcactatacgatagcatttctttacatataaaaatacaaacaaataaataccatagccaaattgagaaaaaggctatttcaaagggaagaaattcaatttataaatatatacaaaaattcaatgtcaatccctttgaaatacctaatctaatttatgaaaataaatgctatcataacagtgctgagaaatgtgaattatttgccaccttatttgccaattcatttaataatagtgaaaccgacccaagcaatccatgcttgggtaatattatagaaattgatcaatgctttatatcggatataaattttaacatcatcgagacccaaaatcttctgaaaaaacttccgaataaaaatggcacttctcccgataatattagttataaaattttaaaaatttgccattcttctctgtcaactgttattactgacttgtttaggatctcattagacactggttcacttccagacatctggaaagaatcaattgtttttccgctttttaagaagggtgacaaaaataatcccgaaaactataggccaatttcattaacctgctcactctgcagggtaatggaaagaattttaagcaaagatatttacaattttctattaaaaaacaaaaaaatttcggaatttcaatttggttttgttagaaataggtctacaacgagtcaattaataacagttgtggaagattggtacgaggcaataataaatggaaaaaatgttgattgtatttatattgattttcaaaaagcatttgactcagtgccccatgaattacttttatacaaattggaaaaaataggtataaggggcaaacttttgatgtggataaaggactttttgagtaataggactttgtgttaaaattggggatgatttatcctccagtaaaaaagttacctctggagtcccccagggatctgtccttggacctttattatttttgatttatattaacgatcttcctgatgctttgccatcaggagtaagaattaaattatatgctgatgatgttaaattgtatatttgttataaagcgagagttgacacagaaattatgcataaagcattgcataatttatcagaatgggcaaataaatggcaaatcagaatctcaattaaaaaaacttttgtactttacttggggaataaaaaccccaaagaaatatataaaattgatggaaatataataaatgttgtggatacaattagggatttaggcataaatattgataataaattgcaattttccaatcatgtcgcacaaataataaagaatcatatttacgtatgcgttctttatttcgg

SEQ ID NO: 77940 - DNA, 1292 bp, Heterodera glycines
  Genomic contig location: Contig_ID=SeqID_13978; Location=2005..3296; Strand=+
  SCN-specific regions: Sequence locations=1-73,95-183,206-460,482-1292
atggacaatcatccccgaaagcgcttcactaacttttccattgaccatattctctccgagcccaaaaaaccccgacaaagcttgctgatcaatgaacatggcatagtacacttccaagccgaaggagcatcgaaagtggtcaaagactacgttaaaaaattggagaaaaacatcgagcatatggccaaattccactatgtcaaagtcaagtcaaaattcatcattaccgacttgccgagcacgcctgaggcaatgtggacctggactttcaaacattatatcgaggaggcatttgctgacagtcgtgagcgcaacatcgaacctacacacctcggctgtatgatcagcagtcctatgttggaaggcggcgacatcccaactccagtgcgacagatgactaacaacactctcgacaccattctcaaccagttcaaaaaagtggcgcagtccaaacaacagaaaaatgtgtcattatggggggagccatttaccgtcaccatcacgactctcgaccgtaatggactaccatccaaacgtcgagtcaacgggggagctcgtcgccctatcaaaacggctgtccatcaccgaattaacgaccaatgcctgattaaaattcgtaataacgacaaccaatactgcctgttctacgcgctgcaggcaacaatggtcgccaaaacgtgcaattggcctcgctggaagtttttcgactatgtgaacgacagaaaatgacagcagggacaacttcacatgatgcagttcagctaatgcagcaggttaatgcaccaatggatttggttggctacgacgcggacacatttgtgcctcaagtcgttgactactggaacaacgcgcagcgacaacaccgctttgctgtgttcatctttggatcgttgggacagtataaaccaatctacaagtacattgacaacacctacgacactccgctgctgttgtacttcaatgaagaccatttcgatggtgtgcagaagcagggcggtttgttcggaaaaccgtactgtttggagtgtgaacggccatacgacaaaatgtcaacacacaacaaaacatgtaaagcgcgctgtatgctgtgctcacgtgttggaccgctgtttccatgtccatcatctgccggcttcatcaaaaagtgtaaagagtgcaacaaaaaattcaccaacaacggctgctaccagcatcacctgctgtcaggcttctgcaagcggtcgaaaaagtgcaaagattgtggtgctgtttgggatgttgtcaacaacactcagaagggcagaaaaggacat

SEQ ID NO: 77941 - DNA, 253 bp, Heterodera glycines
  Genomic contig location: Contig_ID=SeqID_13979; Location=2104..2356; Strand=+
  SCN-specific regions: Sequence locations=1-155,179-179,201-212,252-253
cagcgggtagtgccatgcaaattggcgatcaattagtggaaattgacggcgaaagttgcattgggatgagtcacgagcgagccattggcatgatcaaggagaggcaatgcgtgaggctcacattgagccgacaaaagctgtaacatttgccggacaaagaaagaaaggatggatgaatcgacgaatcatcatcatcaatcacgcgaacactcaattttaataataatttatataaataaatcattaattttca

SEQ ID NO: 77942 - DNA, 1022 bp, Heterodera glycines
  misc_feature (1014)..(1014): n is a, c, g, or t
  Genomic contig location: Contig_ID=SeqID_13981; Location=39..1060; Strand=-
  SCN-specific regions: Sequence locations=1-469,491-639,661-972,994 -1022
atggttcatgggtttcagaagagacgcaacctcctcaaacactcgtgcactcgttgcgagaaaaccatcggtttcaatgtcatttatgtgaaatgcacgcggtgcaaaggtaagctaagaaattggatttgggatgaaaacggattttttagaagtttttcacgagtcgtgccgccattttgcgcctttgccctgcgtccgtcggcacaacacgccgaaagtggctgggaatggcaacaaatcggctggacgtcctcgccttggtgggtctttgtttagaatgccttgccagtcaaatgtcttctcttgcgttttttggttacatggcattttacgcgttaaaattgtcaaactgattttaatgacgcctttaaaagccatgtaaagacgcataaatcaaagaaaactcaaaattgccaattttacaagaaatccgcttattttcaggtgatttctgtcccgactcccgcccgatggttcctccgctggtcattttctgcacttacttcttggaccactgcaaaacatacatgccgtacagggacttgtaccaaattgaggggtaattctttaacgaaacgggcaaaaagaaatttggagggcaaattgatgaccatttgattattttgggccttaattgaaaatttccaaggaaaacattggttccgataggtgccataagtaaaaattgcattttcgacaaatcattagtggaatttcatcatttttagaagccccgctgaagtggaggccgtcacaaagcaatttctcgccccaaacaaaagctacccgaaattggtacaatgcttgcttaattatactaattattatttgcccctttttaggacgcttttcctcccgctgtcatttccgcttgtgtcaacaaatttttgatgcaaatccgcgacccgttgatcccctattcatatggcaaggagatttgtgcacttttggaccgctgtttggccatcgatgggcccattttggagggatttgccggcattgtcgaggatntgccagtg

SEQ ID NO: 77943 - DNA, 64 bp, Heterodera glycines
  Genomic contig location: Contig_ID=SeqID_13982; Location=50..113; Strand=-
  SCN-specific regions: Sequence locations=1-2,29-64
atgacctcacaacccattcgcgtattggtcactggtgcgggctggacaaattggctattctctg

SEQ ID NO: 77944 - DNA, 2749 bp, Heterodera glycines
  misc_feature (2713)..(2713): n is a, c, g, or t
  Genomic contig location: Contig_ID=SeqID_13982; Location=1843..4591; Strand=+
  SCN-specific regions: Sequence locations=1-666,718-742,773-1544,1570 -1759,1838-2063,2095-2175,2205-2379,2401-2749
aagaatagctctactttatagaccaccaaacacttctgctagtctcactaaaaagattctgaacatcatctgtaattatttagaagaaaattttatcattatgggagattttaacctaaatgcaaaagatataacctggaccagtggaacaccttttgctaaatcggaaaagggaaacattttttgtgaattttttaataagtatggcttattccttatgatgaacggaccaactcgaggcagtgcttggcttgatctgattttctcctctagtcctgattttgttaataatgttttaattgaggatatttttagttctgatcatcttaccactaacttttcccagtaatagaactaaaacaaatacatttacagtacgcaattataattctacaaaacttaatctattaaatttaaacttatcttcaattttaccctacaaattactacaaaaatttactattgaagataagtttaatcatttttaccatctttttagagaatatgtagaattatacttgcctaaaatcactgtcggtcaaaaatccagaaagcctaactacccattgagccttaaactgtcaattaaggaaaaagccagactttataaactacaaaaaataaatcgtgataaatataagcatttgtacgatagcatttcattacatataaaaattcaaataaataacttttttcaaaaaatgaaaataattttttgaataaaggaaaaaatgctatctacaaatatattaataaatttacaaaaaattttgaacaaattcactctattaattacgagaaccaaactatttttgatgattacttaaaagcagaaatttttgcaaacattttccaagaatccttttcaaattcagatgttccacaaattagcagttgtccttcccaatggaccatttatcactgatgttgaatttaatgccaatgaaatctctaacattctaaaaagcctaccaaatcgagaatccacatcccccgatgaaatttcctttaaaatcttacgtaattgccaccttacgctttcacctgtaatttccgaacttttcagaatctcaatggacacgggcaaaattcctgaaatctggaaaaagtctattgttatacctctctctttaaaaaaggtgaccgaaatgacccacataattacagacctatttctcttacttgctgtctatgtagagttatggaaaaaattattgcaaaaaagcatttataacttccttcatcagaataatttaatatccgaacatcagttcggttttgttaaacaccgatctactaatactcaactaattacagtattagaagattggtacgacagcatatacggtaagaaaaatatcgactgtatttatgtggactttcggaaagcttttgattcccttcctataaacattttaataaataaacttcataacattggcattaagggaaaactgctaagttggtttatctgaatttttaagggataggtcttacagagttaaaattaacaataaatcttctaatttacatccgattcagtccggtgttccacagggttctgttcttggcccactgttatttttaatatacattaatgacctcccgcaggtaatcccttcgggagttagcatcaagctttttgctgatgatgtcaaaatttatgtctcttacaaaactcgtgatgaaagaagcaaattaaatattgcattagaaaatattggaaaatgggctaatgcatttggtttaaacatctcccaaaataaaacatttattttatttattggcaaaaataattcaaaacaatataaattatttaacaatattatgtattaatgaggttgaatctattagtgatttgggcattttgattgataataaatagggaagcaacttttagtgaaaaaacttttttttgctcaattgtttgaagaaaggagctcaaaaaacgcatttctgcgttaaaattttttcattcggacgtcacttttcgtcactagaaatcactatttcggcgtttcgtcatattttttcatttcgacatttttcggaaaattctttaacaaaaatgcaataaaaccaaaaaatacacccctaagaatcgacaaaaaaaatttcaaaaagcactcctaagaaatgaaaaaaattttctcaaaaaggtattttcgtggcaagaattttaatttaaaaaattatttttttatgtacctattttgtttttttcgcccttaaaaatcccagccctactcatttgcaatgcaatcagtgaataaaaattatttttgcttaatttttggctgaaaattatgtcactattcgtcactaatttcggactttttgtcactatttcttcactcattttggcatttttactcactaattttagttaactatttcgggatttttcgtcactaaaagttgctaccctaataataaattaagattttctaatcattatactaaaattactaaagctggcttatttaaggattcgcaatatggccaaaattttaaaatcccgtctaacggggagaatttttttttgtttgtggcggaactatttttgggggaaaaaaattttttgcggcgccaacttcttccggcgcccagtcaaaagaactcttggcggcgccgacacttgcggcgccagtcaaaaggacatttgcggcggcgcaaaatcaacgaccccaaaaatatttcaacaatttattanagttaacagaattgttattttaatagtttatatttt

SEQ ID NO: 77945 - DNA, 1008 bp, Heterodera glycines
  Genomic contig location: Contig_ID=SeqID_13983; Location=903..1910; Strand=-
  SCN-specific regions: Sequence locations=1-35,57-346,368-411,435 -710,756-1008
aaggaaacaaagagaacatggaaaacgctgaagtgtcacaatgtttttcaaaattcgacaataaattcctatttataattggtcatgataatcaatatcgaaaattcaaaaaaacaaatgaaagaacggatacgatttatctctattgcatgaactgtgagaactataataagcagaattctgctgggttggtttcagttatttagtgattcttctatataattagattatagagttattggaagtgctattattagagagggccaattagatagaactcatcaaatcatgcaccatcttcagtgcaaaggtgtgccactagagcaacttactgctgaacaaattgataggaatcaaagaagagaattaattcaatgttcagcagattctaaatctatttggcgagaagtgatttgaatatttcataaaaactaatccaattggtacgataaatttaggggtctgacagggctagagagcatgatacagctgaggatatcgaaattgatgatcccagtggaatttcatttaattatccaaattggcaaagcgtaagacgtgcctacaaccgacgaaaaatgaaccaaataggggattgttctgatccatttaatgtgcgagaaaaatttcagctaactaaacgcggacaattaaattaattcttcaataaaagctgacttctgaagatatgtaagagttagttttatctgataatttttgattaaaaaaaatctaaaaaaaattcatattttaaagatggctacggtttcgagataaagatatgggtgttatgctctttatgacacatacacagaaaagagctgtcgctaattgtaaagtcttggtttctgatggcacctttgaattagcacctctgaattttcagcaaatttggacaatccatggattggtcagattatatttatatttctacttaggtattcttaagatagaaacaactagtggcgccgaatgggcaccattattaatggctttgatgaaaagacg

SEQ ID NO: 77946 - DNA, 605 bp, Heterodera glycines
  Genomic contig location: Contig_ID=SeqID_13986; Location=175..779; Strand=-
  SCN-specific regions: Sequence locations=1-605
atgcgtcgccggtcaccgccacctttgagcgggcatttgactttgaccgaagttctgaaaaacgggatacggtatttggtgggtgctaggcatactgttgaattacccaaaaaatctaggtttagtctgggcgcctattttttggtcaaatgtgagaccgtgactctcgattttaatcgcaacgcccaactcagtcccaagctatccattagcaaattatgggccaaattgagatcaataatcatcagtagatttgtgacaagagtttgctcagctcaagactctcgagtctcagtgccctgccccaaattcagtgccaaaacccctagcttccaatttagtggggccaaacgaggttagagactcttgagatcttattcagaataagaccgagactctcggttttaaaacgcatcgccaactcagtcctaagctatccaagggcaaattatcggccttggccggctcaagactctcgagtctcaacaccctgccgcaaattcaatgccgaacatgccgttggacaaaccctccgcttagcagggcccaaaaaaggctcgggactcttgaggtcaaactcagactgggccaactgtgcgccaagg

SEQ ID NO: 77947 - DNA, 489 bp, Heterodera glycines
  Genomic contig location: Contig_ID=SeqID_13986; Location=845..1333; Strand=+
  SCN-specific regions: Sequence locations=1-141,163-219,241-257,279 -380,410-489
atgggggagtactgtaaaacgaagattacggtattaaacgattttgtagcgcgactcaaagtgagtgccaacggcgcactgcgcattttccacgcaacgctttccgacgcgggcgtttacgcgtgccgaacggcggacggacgcgcgcagggaaatgtgacgcttcgctttaagccacaccagcagcaaaaaacggaaaaagtgaggggaaaagcatgattaaaaaactgaaatttaaatgctaaaacctcgagattcagtctggaaaaatcgaatcccggcaaatggcacaaaattgagtgaatttgaaaatgcaaaattattgtggaatgccaaaaatggaagttaaatccgtaattacgaaaatgatttttttggggaaaaaattatgaaaaaataaattaaatttcagattccatcaactgaaaatcgaacaaaacaacaacgaaagggcattgaattgctgcaggcaaattaatatgcagatga

SEQ ID NO: 77948 - DNA, 401 bp, Heterodera glycines
  Genomic contig location: Contig_ID=SeqID_13986; Location=2183..2583; Strand=+
  SCN-specific regions: Sequence locations=1-109,131-158,181-401
atgcggctgggccctgccggccgagcactgcttcagcgcatgtcctcaatcactgatcctggccaaatccggctcgactatggcacctcgggctgggccgactgtcgccaagcgcaatgcggccatggcgaaggcgttcaagtacggcacggcggatcgagaatttttggcttttttgtcgagagtgaaatagttacatccgatagctgtgggatttgtttcccgcccgggatttcggagcgctgtaatttgacgattcgaaaccgaaaagccgggaatgttcgagagagaaattctgaaaattgaacccaaggggggtgccatggaatttcgtacaatggaatttcatataaattaaaaaatattgcataaagacctgctcgaaaaattggaaaacccga

SEQ ID NO: 77949 - DNA, 446 bp, Heterodera glycines
  Genomic contig location: Contig_ID=SeqID_13987; Location=165..610; Strand=+
  SCN-specific regions: Sequence locations=1-446
gaaggatcgcaaagtgtgcaattggctgatcgccttcgattcgctgtgccaacttttcgttgtcgcacctttcggcgtcaatttggtcggcgtcattttccagtacagtaccattgactaccgtatctgtctggccactctcatgggcgctaccatagcctcgtatgcctcaataatggcaatgtttctgatttccgtggagcgattgctgatcattctgtacccgatcaggtgactctttatataggtatgtatagttggaatatataaattttatgtattattgtagaatgaattcgatcaaaaaaacgacagtttgccaatgttcgtttgcttctgccattctatgtactctttttggcttggtcatgaatttggaagtgttcaatgtttggacaattatcaacatctcttacgataggcgattaacatttgaaataaattaa

SEQ ID NO: 77950 - DNA, 790 bp, Heterodera glycines
  Genomic contig location: Contig_ID=SeqID_13987; Location=881..1670; Strand=+
  SCN-specific regions: Sequence locations=1-258,310-347,369-558,598-790
atgttgcgctctgtgtttctgctgcttttggtccttctgatcggctggctgatcgcatcggctgcacgcaaccaaatcaccgattttatcagttttatcacaccgcttattgtaaatttgttcatcgctgaacctgtggctcattcggttatgtgtaccaacatcaaaagtgtactgatcggcattgtcacttgcgtgccaattttggcatccgccagtggggcgcccatccttttgctgaacaggtgtaaaaaggacaaaaattcaattaaaaaaatattattaataattttatttatatttaatttagcagcgattatcggactgcgtacaaaaaggcgattatgcgaagaaaaggcaattcttctactgttggaccgctttttcgtccacgccaaattgtggtggtttcgaatgagcgaaaatgatctttttgggcacacaatttttggacaaaatttaacccaagcttaattttactgaatttattgattttcagaaaaatgattcgcttcaaaattttgtgatttgttcgctaagatttttgttgtactattttttaaacatttatcatttctttcaatgtcaagaatgtttaatttggttgactctgacaaaagtcatgggagtttttgttcaaaattttcatttgatgatttttcatataaccctcttattcgagcgtggtggtcgcattctgctgactttaacattacctttacatcatgaggaccggtaaattggacaccaaaggaaaattggacaccggaaaactggacaccatcctaaa

SEQ ID NO: 77951 - DNA, 1448 bp, Heterodera glycines
  Genomic contig location: Contig_ID=SeqID_13988; Location=880..2327; Strand=-
  SCN-specific regions: Sequence locations=1-108,132-212,234-336,358 -366,402-402,424-616,656-1308,1332-1390
atgacaacaaacaacgcgataattcacgatcatcccccaacggcacgcacaaaaagtgagaaataaataaaatgagaattttttcaattgtctaacttaagtttttctattaaaaaatattaaatttgtttcaacactaaaaaaattttttccaattttttattttcaaaaaatccgagaaaatttcaagggaacattgaaaaatttttcagcagttgtttctctgctccgtctgagtgcccatttcttagccggtcttcatgcattggaacggctctgacaactttccatggatgccaatgccatcggcggaggggcgaaagacaacgcaaagggcggagagacggcagacgccgaggcaaatttgttttaaaacttaaatttaattttttgtttctgcagctgcctctgcgcagtgcttccctcgaaaaattggatctttcatccaatgccttgcgcagagtgccgaccaaattggtggcccattaattgcattccctcaaaattttgagtttggcggcgatttcaatcgaacggatggaaccgaaattaatggccaatttcagcgcattaaaacaggcaaaattaggaaattgaacttgaatagacaaaccaattatgtaatttagccattttcagttggacttttcccaaaatttcctccattttttgccctttggaattttcgatggactctacgaattgcaagctctgctcggattggcctcacttcaatgggttaatgtcagcaaaaatgcaatggaataggtaaacctgggaaaagagaatggaaccaaatgaaatccaaataaaaattagttggaatggtgcccaattcttggcattgaggcgaacggcaacgaaatgttcttacgagatgaattggctgctgaacgccaaggcctccgccgttggcacggatttttcgcaggaacaaatcaatgccgcaaagggcggcgcaacggacatagaaagtgccaaatatgtggtgccattggatggccaacggaaaaggattattgatacaacggtgggcaggcagtatttgctaattatcagagggtaattaggaattgatttgctaattgtcgccatttccctttccagccatttgactttctgtgtccctattcgattttctgtgccgtcggctgtcagtgctgccaaatcaaccacgcagatgaccacctcttctcaatgccaatgctcgagtttctgctatgaaaattggtatcgtgcgcaggccccagacctaaaaaaattccggagggaagatgaagatttttttttttgctcttcggtcttgaaattttttctcttatttaattttaatatgtccagctattttcttccccattctcctgattcctgaattttttgagtctttgtctatatatttttttttaaattaaatatttctaataattcaaaaattacttttaaataaa

SEQ ID NO: 77952 - DNA, 459 bp, Heterodera glycines
  Genomic contig location: Contig_ID=SeqID_13990; Location=1611..2069; Strand=+
  SCN-specific regions: Sequence locations=1-437
atgttcacagccactggtcccccaaagggattcattaatgccgatcccttccgttcgccgttctctgacagttttgctgcatgtgccggatggaaggtattggcattagcaaattgtgccggattggctgagtaatgcggcggtggctcattgcccgaacttcgtccgccgatcgtttcctttttctttttcaccaccgtcactttgtgcgccgttcgatcggtgagaaaaacgatcagctgaaagagcatcaaacaaaatttgagtaaatgttgtttctagtcgcttcacctgtatcagactaagcatggacagtcccaaccacatgccaatggaaccgccgatggcggcgatgaaagtccaaagggaccacacgtaacactgctccaactcgaggtactcgaaggcgccccagatcaacttgacagaagtgaccgctggggagggcaaaaacaatga

SEQ ID NO: 77953 - DNA, 893 bp, Heterodera glycines
  Genomic contig location: Contig_ID=SeqID_13990; Location=361..1253; Strand=+
  SCN-specific regions: Sequence locations=1-256,285-455,478-506,529 -766,788-893
atggcaacgccgagtcgggtgagagttgctaacgaagcgaaggataagaagcggaaggcatccgttgacccgtgcagaaagagaaaggcggcccaaacggtttttgcgcaccgaaccctttggccaactccgtctgctgaacccgtaccttttcgccaaccaaatccacgacggtgcggtgctgcgacgagtcgcactttcgccgcgtgcgttcagttcctccattctgtcgcccgagtttgggcaggtaatgccaattttgttatttttatttaattttgttgctcatttgtcagctcgaggtgctcagtcctcgcgcttttttggccattattttgtcgccccgtgctgccattgccaacattttgtccccttccgcgttctctctgcgcctcctttccccgcaggcgtttatggccgaagtgctcaacccgaaggcgttcattgcgcgggaatagcactttttcactgtttgccctgcgtttctctgctactgatgctaattgcatcctttttccctttgcttttccgatcctttccccccgggcgatgtccgccttcgttttgtctccccgggcattgatcaccacaattttgagtcccaaaatgttagagcttcgcattctttctccgaccactctcgccttcactgtgctaagtccaagtgagccaatcttaccagtgttttgaccaattgttttatttgactgatggccaatattattttgtcattatttgcagcgattggaggtgctaaagttgcgtctccccaaagtttttcgatgtccgtcctcagtccgagcattttgtccccgtctttcctcaacaaaggcaccggcaatatcaaagtcagcttattgagcaatagcagcatttattcacatttgagctga

SEQ ID NO: 77954 - DNA, 357 bp, Heterodera glycines
  Genomic contig location: Contig_ID=SeqID_2119; Location=684..1040; Strand=-
  SCN-specific regions: Sequence locations=1-57,147-159,181-186,210-357
  Gene Ontology: Mol. function=calcium-dependent phospholipid binding; Cellular component=synaptic junction; Biological process=synaptic vesicle targeting
atgagatcttcgggcgtacgtgcccgccgccgtgccgcacatccaccgctacgccctccaccaccgtcgccacgccctccaccaccgtcgccacggcctccaccaccgtcgccacggcctccaccaccgtcgccacgcccaccacccccgccccagaagagccatggacatggcaatggcccgtattggtgctgttggtgacggtggtgatcgccgccgccgcacttggtggtaagaaaatttactattttggttaaatattttatggtaaaatttaacttttcagtgggtttgtggtgtcggtatcgccggtcgcggacggggcctgacgacgtggagtcgcaggcgcctgttgcg

SEQ ID NO: 77955 - DNA, 432 bp, Heterodera glycines
  Genomic contig location: Contig_ID=SeqID_2120; Location=533..964; Strand=-
  SCN-specific regions: Sequence locations=1-65,87-432
atgccgtgtaaaagctgcacacattgccgaaaaggaaaacttcaacaacaggccaaaaaagttgctcaagaagaagaaaggcagaggcgaaaaatgctgcgtgagaaccgcagaagcgcaaatgaatgtcggcagcgtgcgctgtgccgccttcgacaggattgtcggactctacgtcaagcgatccgggaagggcgatttaccgtgacttacaatggaaaatcatcctattggaacatcacaagtccgtctgtcaatttggccgtcgatcaaaatgggcaatcaacgaatagtagcagcggctttggttgttcaagttcttccagcggcatttctgaactgaattctgatggaagctggccaattccggattattatcctggaggtttttacgtcgagcacgagactgatcgcaatgaatatgaagaatga

SEQ ID NO: 77956 - DNA, 1058 bp, Heterodera glycines
  Genomic contig location: Contig_ID=SeqID_2120; Location=2160..3217; Strand=+
  SCN-specific regions: Sequence locations=1-195,217-392,430-467,530 -885,907-1058
atgtctttaagcccttaccaaatgaaatctgcaaaacgaaaaaatcttaaaaatgatcaaagtttgcccgtttttgttcaagtcgacgacatttcatcatcggttgatcttggaaatgacgggataaatcctgaacaggtgggaaatgcgtgaatcgaatgcatgagaaaaagctgcttttctttacaataagctaaaaataattaattctgatttcctcagcattctaacacgaactcaatggagagtaactcgaaggaaatggaaatgcgtgaacatttggaggaaattgaaagccaaacgacaactcaaaataaatccgtttttgtgagccgttttcggcaggaattgaaaggtaattgacctatgaatcctttctgaaattacgtcagtttatagtttttgacatatttatatatttgagttttgattaagacgaagagtctacacttggaaccaaaagcatgaatttttaaaattattttagaataagaaaataataaaattctaaacagtataatttttaatacgcctttcaaaacaattgtcatttaggcattaattcattttaaccaaaataatttacctatcaatagttttttttgtatgtttttgaagtgtaaaacttttccgtttttagtattagaagaaacacatacaatttgaatggatacataagaagtaaaaatttgttactttatttctaggctattactgatcaaatatatttcccacagaatggcacatttacaagcagttttgtatttacggcacaataacatttgtgcgaaccttcccaacagcatttcgggttgattttgctcataaaagaatggcggcaattgcaatccgtgcaatgaacggtcaagattatggcaaggatggaaaagtttttatttgtgattggtggtcatggaaaaaggccaaaaagggaaaaggaaaaagtagagcaacaccgaaaggaattgtaaaattgaggattcggttaggggagggtgaagtgtttggttctcaaacaaaacccatgtaagaatatttaacattgaattcagagaaaa

SEQ ID NO: 77957 - DNA, 798 bp, Heterodera glycines
  Genomic contig location: Contig_ID=SeqID_2121; Location=61..858; Strand=+
  SCN-specific regions: Sequence locations=1-146,169-304,327-798
  Gene Ontology: Mol. function=calcium ion binding; Cellular component =plasma membrane; Biological process=regulation of action potential
atgaatgctgccagatccgtagtttctgctctaatcggtcgaaaattttctgagattgattttgacaaaactggtatgatcacctcattgaagcttcaaagagctttgtcaaacggtactctacgaccgttcaacattgacgcatgccgtctgatcattttccaatttgatccaatgagacacggcttcgttggcattgagagatttgaatcgctttggaacgtatgtgttttttattgtttggcatataaaactattttctagtatattaacgactggaaatttgagtttgtggagttatcagagaatatgggctttctgacaatgcgtcaattacaaagtgccctgacaaaatatggtatatttattttaattcttttcggtattttcattaaggatttactttcaccacgcctttttttcacatactaatacatcgattcgaccggtcgcagactggtactattttaaattattaaagagactcactttttcttttcaggatgcttatattttgacgactttatatatttatgtattatgctccagcggattacaccgccgtttcgttatttagatagaaatgcgaacggtcgtattaatattcgtaaggttgaatagtttaactacactatatattttctattaatttcagattttgaagaatttgtaataatgatattatcagcgcaaatttagttgtttttttgctttaccagttttttcagaagtgatcgctcgcactcttactgttataaataggccctcgatatgccaaatcttcatttaattacttga

SEQ ID NO: 77958 - DNA, 518 bp, Heterodera glycines
  Genomic contig location: Contig_ID=SeqID_2121; Location=991..1508; Strand=+
  SCN-specific regions: Sequence locations=1-200,222-518
atgagtggccttaatcggttccaaattgccgcatcaccgaagaagcgtttcgccgatgaatttccgccgtcgtgcaaagatttgcacgacgtaaaaaaattcaatgcgccgggaattttttacgtgcgcgcgaaagtgacggatttacagttcgctttgtataaggtatatttggaaaatatttacttcggctgattctcgaaattagttaattaatagtttaggcgtgccccaataaaatcaaggggttgccctgtaaaaaaaagcttgacgcagaaaaccattgcgttaattgcgggcaacgtgccaacttgtcgctccgcggcatgtatatgcgcttggacctccaggactgcaatgatcctgaaattaatcagcaagcgaccttgtttgctttttgtgccgagagttatctggatataaaggtagagcaattcgccgcaatggtgaacaacgatctgaaaagctcgaggctctgcttcaatcgaaaattggcccaaacgtttccgtcaaactaa

SEQ ID NO: 77959 - DNA, 408 bp, Heterodera glycines
  misc_feature (38)..(38): n is a, c, g, or t
  Genomic contig location: Contig_ID=SeqID_2122; Location=3..410; Strand=+
  SCN-specific regions: Sequence locations=1-408
atgaaaaggatagaagaaccaagatcagcggctgtaanccaagggcagcacaaacttgaggcggagacgaatgctcaggatggtggaggcggcgaagctactatcaaacgggcgcgccgtaaaagttgggacttcaagacgatggcgcactttgataggggagaaacggaccatcaacagcaccaaaaagcaccactgtttgagcagaaacaacattatgtgcaccgggtggaacgttttgctctgcaacgccatgtaaccgaatttgtgttgaatgggcagcatgatgagccggaggaggcgctcttcctcgcctttaagcacatcatagatcgtgcaatacggaacgcagaaaactcgccgagtcatcagcagcagaagcagactagcggtggtgcagaattctaa

SEQ ID NO: 77960 - DNA, 1132 bp, Heterodera glycines
  Genomic contig location: Contig_ID=SeqID_2122; Location=499..1630; Strand=+
  SCN-specific regions: Sequence locations=1-861,883-1132
atggctgagctggataagcttggtcaatcggacggtgatgaagacgtgcacggtggcggaatcagcaaacgcgcgctattgctcagcgagccgattgaagttgttgtcacatgcattgcacctccggttggtgcagcgccacgtttccatcattaccagcattggggctatgatgagcgccatatgattcgcgtaatgaatatggacgacaatttttgcctctttcatgcgctgattgccactcgagcctacacggaccatgagtttttgaagttgtcttcgcgacgggtggctgatgttgacgcggatgatggcacactggctgacgtgccagctgaaatttctcgacgagtgattaccagggcagatttttgtgcaggccacgaggcgctgaaccgacttttgtcaagtcgggaacgcatgaaagcagctgtgacggagctgatgcgcgatgcaggtattccaacaaatgaggacgcttatggtatggagcatatcgagcaaatccagcagctttgggtgggttttataacgcgaacagttatttactccatatgaaaaaacaggaccaaacttacgccggtttgtatcgaattgttctgttcgaggaccgctccgagaaattgctgcgcccaatttggaagggtccgatggggcgtcgcctctgtgtgtcgctgtttgtgtcagaaggacactattatggtatcaaaagaataaactgcttcttcaaacttggcagaaaatattgcctggactgcgaatgtgcctacaaccgtgacactaaacatacaatatcatgcaaaagtcgttgtcctcaatgtgctaaaggtcgtttgtaaattactttaatgcatttaatgattgttatcacatttttgtttcggttaagttggtccccagtatccttgcaatagggtacaaggtgtacaccttcactgccagcaatgtaaccgattctttttctcccaatcatgctttgacggtcatcggcgcagccagacctgcaatttgcttaaacgttgccctaaatgtagccgtaccttccagcaggatccgaaatgtccgcataaatgctacagtactttttgtgcacgctgcagggtatttttttgtcaatattagactgccagaa

SEQ ID NO: 77961 - DNA, 216 bp, Heterodera glycines
  Genomic contig location: Contig_ID=SeqID_13993; Location=213..428; Strand=-
  SCN-specific regions: Sequence locations=1-216
gaacgaaaatgcaaacgatttgaactatgctttgaaccttttcgactacagaataaagcgtgactatttgaggtataattacgcaaaagtgtcagccgatggaagcgcagaaaaaccgtacaaagcgatggaagcggaagaaatagaggggaaaatggagcagctaaaggttggactcaagtcaattgtgacgaacagagaaggactgactgattt

SEQ ID NO: 77962 - DNA, 171 bp, Heterodera glycines
  Genomic contig location: Contig_ID=SeqID_13994; Location=80..250; Strand=-
  SCN-specific regions: Sequence locations=1-171
atggctacccgacttttggggatttgcaacttggggacccgacatttggggacccgacatttagggatcccgacatttggggacccgacttttggggatcccgacatttggggacccgacttttggggatccgacatttggggatcccgacatttggggaccgaacgacaa

SEQ ID NO: 77963 - DNA, 2087 bp, Heterodera glycines
  misc_feature (1206)..(1206): n is a, c, g, or t
  misc_feature (1266)..(1266): n is a, c, g, or t
  Genomic contig location: Contig_ID=SeqID_13994; Location=1205..3291; Strand=-
  SCN-specific regions: Sequence locations=1-95,118-198,220-411,436 -807,829-884,911-1037,1074-1172,1195-1244,1285-1417,1439-1545,1567 -1737,1766-2087
agaatgaagaaatcagtcagaacccatcagaaaatgaaacaattttgtcgacaattgttgaggaattcaacgatgataatggcacaaaatgtgaagaaagcaatggaaatgatgaagaaatagaaaatgatgaactgagtgttgagcataattcagcagaaaaaatttcaataaatattagcgcattaaatggtaaatttattaaatatttttgtatttgtgcaaaattaatttatcgataattaagaattccgtaatgaaacatttctgcatgagaaatacgaagaatatttcgaaaatgaaaatgatgcaaatgaaacgaaatttctgcttgatgccggcatttttgtgtttgaacttcaaaaacgtttaaaaatggttgacgaacttcgaaaactttcatattttgacaatttaaatttaataaaaaatattgaaaaagaaaatgcccaatttttattgtattgtatgcaaattgaagaatttgatcaaaacgaattctttcagaagacttacaaaatcctaaaaatatattccaaaaatttggaaaaggataaaaatgaggaaattccatcggaaaagcaattaaagcaaataaaaaggcaaatgcatcaaaacaatttgtcaaatttaattgtaacggacaaacaatttggtgaaaaatggaaaaaatatgatgaagaatggaaaaataaaaaatttatcattttatttggtgtaaaaacttttgagctaaaacgatttgaaaagataaaaatgcgatggaagaaactaaaacagcaaattacgcttggtaaataaaatatgtgaattatttaaagataataaatgaagacatattttaaggttaattaagcattttaaataacggaaagttaaaactgtataattaaaaataataattaatttagacaccgatttatatgaacaatttttgaacaaaaatgaacaaaacaattatttaagtgcaaatttttctgaaatttctcaacaaattcatttccaccactcagattcagcttacgattcaaatgaggtaatttttttaaaacaaaattttttttatttaaattgtctaattaagattgaaaaattgctaaacgaaaaaagaagcgacggcttaaatttaagccaatttgataagcgaatcacaacagttttaagcaaaatcaatgcactcattgataaatgggtgagcttcattanatcactttttaataagcaatgaaaacaattttttgaggaatatttaaatttttcttttanttaatattatcattaattgcatgcacttaataatttagtccactggccatgctcgagttggcatttccggctcacttttgcttggcactcatacagctgactctgatgttgatttgatttgcattgtccctggccaaacgatgggagtggaaaacttttttggcaacaaaaatgcaatttgtgaaaagaacaaatgttcagatggaaccaatgactcattgtattgcaaactttgcgaggtcaaaattttatgaaattttattttgatttaagtgccaatttaaaaaataaatagtattttcagaataaaagcgtcgcaaaactcttgaaattaatgcacagctcaatctttctgatcaaatttcacatggacaatgtcgaaattgacatcacttttgtggcaattcctggcaaaagtgtgctgcaagcagagcttaatgagcaaatgctcactgattacataaactgtttgacaaatgaaaaagaagagcacagaaaaatgctacgcacaatttcaagtcagtcaaaaaaagtgggaattaatttaaatatgaaagttttcaaggtgtaaattaattttaatcattcgcacaaaaaatcaaaaattctaatgatttaacataaaaacaaatttaaaaatgtttttgtgtaaaaattaaattgaatttaggctatcggtcaacgctttatattgcaaccctatttctcgaaaaaagaatatttaatagcaaattaacagattttctaaagcctgggaaagttaattgccaaaatgataacaaaaatttagaaaatctgcgatatttaattttgtcaataaa

SEQ ID NO: 77964 - DNA, 1128 bp, Heterodera glycines
  Genomic contig location: Contig_ID=SeqID_13996; Location=284..1411; Strand=+
  SCN-specific regions: Sequence locations=1-168,205-277,301-541,563 -742,767-904,926-971,993-1128
atcatcttgggtccagaaaaaagtccaagcgttcacgtgttgtcagcagcatttcgcaagcatccaccataccaacaacaacaacaaccacaacgattgtagcaacggcagcggcggatgtcacaaccgcatccaacttcatttcttcatccggacactcgtcgttgtacaactacaccaacaataataacaacaacagcatcataaagttgaatggtgccgaactgaatggtcattgtggcaccggcggaggcgtcagtagcagcaaccatctgcaacaccaccaccaccaggaaacggacaacaaccacaacagtagtaatgaatgtgcactgttgcgcgagaatgctcaacgccttagtgagatcagacagctgcagaaggagcgtcaaacgtacgcaatacaatatacacttatacattgctattttcaggcacatgtccaaaaaaattaattttcttttttgtgcaggcacccgaagggcttttttccggctcaattttttttgtccggtgaatttcaccaaatttataaaaacaggaatctgtatttttagtgtttataatcgcaaaacaaacccaaaaatgctataaaaaaagttggaaaataattttccaataataaatttttaaacccccctcaaaataggtgcaaaaaacaaaacaaaaaccggtcataaaaaactaatattttccggctcgggtaaaaaatatccataacctttttaacccttaaataataccatttacaattttttccaattgctcagtttggaactgtcgcttgacaagacgaaggtggagctgaagagtgcacgttcagcggagaatgagttgcgcgtgcagctgaagaatgtgcaacaacgggagcaaagctgtcgcgaggaatggaaacaatttgagcgggaacagaaacaacgggtggaccagctggagagcaagtgcaaacagttggccaagcagaacgattattacaaaatgaacacgcaagcgttggagcgacgggtgggcgaactgcagctgaagaagtcggaagttgagcgtgaactgaccaatgagcggttgcgcaattcgacacgcgacgaaccgccggtgggaagacagcagcaacagcacaacaacgcgtaa

SEQ ID NO: 77965 - DNA, 642 bp, Heterodera glycines
  Genomic contig location: Contig_ID=SeqID_13997; Location=554..1195; Strand=-
  SCN-specific regions: Sequence locations=1-296,319-642
atgacccaagaaaagttgacactgacgaaggacgaagagatttggctgttgaaacggtgtccaattgttggggagacggcggcggttcaatgggaaaaagacgaaaatttggacaatttgaatggagtgatcttccatctttatcatgattgtattgggtaagcaaaaagattggccttacttttgaatagagtgccacgggaccgggaattttgggcaaacccgggaccgggaccttttcgggttgaaaacccaggaatttttgcctgggaaaaccgggaatagtcccaggggaccttggtactcaattgtactcagttgtccgctaccaggtcccggtcccgtggcactctagttttgaatagagcatggacaggagggtacagtaagtagtgtcctccgtacagtactttaaatgttcattcatttcaaatttggtttatttaggccgctgtctccgcaagatcaaagcgatgaaaaagtgttctcgactcccgggcccagtgatcagcggaaggagtgataatttgagagatgtccgactgttttatttgatgataattttgtttcctgttctgatgaccattttggcgatgaatattaaaaataggaatttgagttgggcggatagcaaaaaataaa

SEQ ID NO: 77966 - DNA, 2489 bp, Heterodera glycines
  Genomic contig location: Contig_ID=SeqID_13998; Location=39..2527; Strand=-
  SCN-specific regions: Sequence locations=1-222,276-379,453-570,592 -809,833-1248,1274-1646,1669-2192,2214-2489
atggcctggttcatactgtcggtcgggcgaatgccgttgtgccaacaaccagccgccatttcgaacccgggatggccttgtctgtcttaactacggcttttgtcccctgaatggtaacaacccaaagtttcgaattgaaaatcaggtaaaatttgaacaattcttatgctaaaggaatttatgctttgaaattttcaggtccaacagtgttatggtaaatacaattaaattaaatttcaattttaatttaaaaaaatattttaagatttaattaacgcgtaggtaaaatatttaggtggcgcagatgctacttgtgaggccattggtgcattggcatatgactgcatatgcgacagtgaagattgcactgtaaaaatggaataaaaataaaaatcaaaatttttaaaaatactttaaaaaataatttatacaaaataatattaaatttaattgttgaataaatttcttcaggttaataacccaatcagtttctgttgtccgtcaaggggtaatgctaatattttttgctacttaagggttatgccacccctcaaaattgctcaaaaattttcaaaatttctttgggtttcaaggatgctgatcaagattttgagaattcagggctttggataatttaacccggatgaatccttttgccgttttcattgtttaaattttcagcttttgcttgtattcaaccacctaatgagggctttacacccccgggcggtggatcaagtttgaatcactggtaccatgatccgatcacaggtaagcttaaaaagcattgtgccgaaatcccaaagcccaaattttattttaaaataaaatagaattctacatcgactattttaattattttccatttattatgtcaaatgacccctccaattattatattttaaatctaattcaatctatcaaaatagaatttaaggcgagtgccgcgaacttaagtaccagggatacggaggaaatgcgaacaattttgccaccaaagaccattgcgaagtagcttttatctcatttacgatattttacccaattttaaaattttttagagttattgtaaacaaagtgagtgctttttttgttgaagtaagaaaaattaaattttcagcttgcagccgaggccttcctctgtatagggaccgtaccatgggtgttaaacaagagccagtatactgtcagggtgctgacaatggttgtacaagtccaaactatgtgggatttgcaaatttgaaatacaaaatttaaaattattttaaaatttgaaggtttgcacggcaatgggcacccttcaacagtgctgtccaactttcagttacctaattaggtgtaataaaaaaaaacaaaaattattaagtgcatatttgttcacgaaatggtgcaattccaaccgaagtgtacaacactgccggtggccttcctacagaatattttgatgttggagtgccggacggtagcgaaaagttaccgtatttcctataataagcccccgtgggttttattttttgaacccccctccccccaggaagggggctttatttcagggagggagcactaattgaggggggggggggctttatttgtcaacctctctaaaagagtggtattcagggggctctaatttaggaaatacagtattgaaaataaaattaaaaatcatgaaatttcgtattttttaaacttttctaaggaagcggtcaaacatatccacgattttattatgatgccagagagggaagatgcattcaattttctgtgcgttttgctcatttttttcgttttttttgggatttatttcactgcttcagtttcttggccaaggcggtaacttcaacaatttcttgtcccaagatcattgtgaaaaattctgctcaagaagtacagaaaatttttagactaagattttacattaactaaaaaattttgaagtatttcagttatatgtgttaaaataagttgtaaaaaaggcattgagtatttttaaatcattcccattaaacaaaaatattccatgaaaatattttcggtataggttagcgctagagctgctcgagactctcactctctactctcgttgttgatcaattctcgttctcgggtctctgggtcatttatcggtctcggctcaagagtctcggaaaattttgaggctcaagcagccttagtgtagagcacgatgggtgtgcttgttgtaaagggaaagtgcgggacggatcaatttggcaaattcgctaattcaaaatttactactaattaaatttcgtctttttttgccctgatcatagtctaatgccaacgacaattaaattcagtcttatgcagtgccggcgagccgttgaaggacagtagcggtgagcgaaacatggaatgttcgccgaccggaagtggcaccaattcgtgcccgtcaacacacagttgcgagtcaccaccggctcacaacatttggtggaatttgctgtcacggactcatatgtttgcaa

SEQ ID NO: 77967 - DNA, 250 bp, Heterodera glycines
  Genomic contig location: Contig_ID=SeqID_13998; Location=4888..5137; Strand=+
  SCN-specific regions: Sequence locations=1-41,63-116,138-250
atggcattgagtaggaaagccgcaaggtccatgttcgtcctgcaaattgatgttttaagtatgtttgttatacacattggcaaattaagcaattaaaaatatgatgattaattttatattttaagaaattaccaataagaaaaatgtgagcgcaacattgcccaatatccgttcggcacagtgcccggttgaatctaaaaaaagagacaaattttatcataagaaaaaagatttttcgaacaattttatg

SEQ ID NO: 77968 - DNA, 761 bp, Heterodera glycines
  Genomic contig location: Contig_ID=SeqID_13999; Location=584..1344; Strand=-
  SCN-specific regions: Sequence locations=1-607,635-761
atggatttagaaggtgggggattactgttacagtagccaaaaataccatgccacaaatgttgtctcctaatttcaggattccattttgcacttagaaatgctgccgtgggcggcagtttggaggtgtgccgtctgctggtggaggagtgggccgcagatgtcaaccaacaaaccatccaagagcaatacactccagtgatttgcgccgccagtgaaggacatttggccatcggtgggagagaattgtggcaaagtgccaaaaatgtaatctccctaattttcagtgaatttcctcgtcgaacatggcgccgaccttcaacatgttgacgtggacggacacaatgctttgatgtgggcagtgaagaatgggaagattgaaatggcacggcatttggtggccatcggcgcggacattaaccaacggaacatggaaggtgagcagcagcggaagtggccaaattgttgtgctagcgagcgttttattcgcccatttcaggcaaacgggcacaggatttcgcggaagagagcggaaatgccgaaatggtggccatttttcgtacgacggcgacggacaatgggcgacacgcggcggagggcaccgatgggtaaagaaaaatttgattgtttttgatcaataataattgttttttccattttcagacagcaaaacgatcaacagcagatgtgacagcacagagagagcgaatcaatggccaaaagcggcggatggatttcttcggaagacattaattgatcactaa

SEQ ID NO: 77969 - DNA, 373 bp, Heterodera glycines
  Genomic contig location: Contig_ID=SeqID_14002; Location=576..948; Strand=+
  SCN-specific regions: Sequence locations=1-113,135-163,185-305,335-373
atgcagtcgtgcctcatggatagcacgacacgatgtatcggaatcttgcctatcgtctgctgtctagccagatcacagaaggtaaagctaaccgacgacaattgaacacggtgttttaaatattttatccatttgatattgtttcatgctttatccaggtggtggatgactgcgtggtgctcaatccgggccgcttcgacagagggaagggcaccggcacattttccgttctcgacttggacctttcgagtgccattggcgccacttcggtctcaccgttttgcgaagtctcactcttttcaacccaacaacaacaatgacaaaaatcacatttttgagtgtcgcaattgcccattttaacatttttgacaaa

SEQ ID NO: 77970 - DNA, 1350 bp, Heterodera glycines
  Genomic contig location: Contig_ID=SeqID_14002; Location=1304..2653; Strand=+
  SCN-specific regions: Sequence locations=1-37,59-559,608-935,957 -984,1007-1029,1059-1196,1223-1240,1265-1350
atggtattagaaatttcagttccgtctctaagattgactgattttcggaatttttatcacaaaagtaaattttgccttaaaaattgtaaaaagtcacaaaacgcaaaaaagttaaaaaatcccaaagtgtaaaaaagtcaaaaaaagtcacaaaaaatgtatgttagaagcttcaaacaaagtgtagaacacttttgcagtcattttaaggtcatttagagtcagcaaaaaaaaagaagtcatttgacttaaattcccatccctagtcattaatagggctggtaaaaatatggatataaaagcgcgaaatatggccataaaatatggaccaaaaattgcaaaatatggacataaaatgccaaaaatatggacataaatttttccaatttgaggtacaatttctcaaaattcttcaaattcgctaaatgcaaagtaaagctttttaaaatggttaaatatggtattataaatcattttaaaagaaaaaaacacgatacagctaaaaattactcattttagcgaaaaatcgacttgaaaagcgaaattttcgcttttttgcttatttttaatataaattaattaatttttaagaaaatttaaatttaatcagtattttcgacaaaattttgctaaaaatgcctttttcggaaatttttgcggtctttaggggtcaaaaatgccaatttacctgatgggggccgttggttttttggaaaaatgccaaatatggacataaaatatggacttaaatgccaaaatatggaaaaatatggaaaacatggatataaaaatccatcctagaagcttctaaccaagctaaaaatatgtttttcgtgcgtttcaggcctcccacaatccaggaaaaaaatatggatttccatataattaattaccagccctagtcattaattaaacgccatcaaaaaggatgttgcgtaaaatcatcaaaacaaaaattgcttataactttgctcaagagttacctaattaaatatttttaaagtttgaaaacaattaatttctttgctaagatgctattttttaaacattgaaaatttcaaaaaagttattgccagaagaaatcaataagttttctcgaactgccgtcgaagtcctccagcagcgatggaggtttagttgggcattgatggcgacacaacattctttgtgcgcgtcgaaagtgatgaggaggaagacgaacagcagcagcagcaacagttcaattcggatatggccaagtgcagcagcagcaccagcagcagcacgcatttgcacctcccccggcacctctgccgttgtgtgatgttctgcaaacggtagcctaaacccccttttacctataaatgtgaa

SEQ ID NO: 77971 - DNA, 440 bp, Heterodera glycines
  Genomic contig location: Contig_ID=SeqID_14002; Location=3399..3838; Strand=+
  SCN-specific regions: Sequence locations=1-10,32-128,222-256,293-310
atgattggcttattcagtgttttagtttgtaatgcttttgttttgctgccatttgcaattcatttactcgtactattgattcacaactgtttggtacgtatgcttagtacgttggaagagtatgacattgaaatgaaaataataaaataaaaagacaacaattaaaaatagattataaaaaaataaaattgaaaatgggaaaaaaattaaatcgaataaaaattcatgcatttatgaacaatgatatcaactaatcaaattattaaaaaattacatttgaaattaatatattccatagaaatattcgacgaaaaataaacaattttttagttttataagaaaataataataaaattaatttgctattagattttaagtgtattttatatgattattatagaaatattctaatttctataaatttatttaaattaaaaata

SEQ ID NO: 77972 - DNA, 545 bp, Heterodera glycines
  Genomic contig location: Contig_ID=SeqID_14003; Location=120..664; Strand=-
  SCN-specific regions: Sequence locations=1-51,81-91,123-205,227 -268,330-420,472-515
atgctgaggaatgctctactgatctccattttggcactgtttggtgattgcatggacaagggaaaaagaaaattaggaggaataagtaaacataaaaatacaaataaattatttatttatttcgtaaaatttaggtattaatgagccaagtgaatatggaaccaaagaaaaagaagccatcgcaacaagtaaatatttgtaaataaaaagtgaaattttaattaaattaacatgaatttaggcagaaaaggcaaagaaaaagtcggcgaaaaaataagtaaacatttaaataataaataaatttattatttattttttatagatttaaacattatggacacaactgaacacattgcccaaatgggtaaaatttgaaacataaatttaaaattaagaaatacaattgtggaacccggaaacaaaaatttattaacataaaaatttataaacctttatacatatttatttatacattgaccaagtcaaagctattatgggtaaaattgttttctttgatattttaaatatatttttgaaaaattaaa

SEQ ID NO: 77973 - DNA, 2175 bp, Heterodera glycines
  Genomic contig location: Contig_ID=SeqID_14005; Location=36..2210; Strand=-
  SCN-specific regions: Sequence locations=1-95,118-246,317-525,565 -713,756-763,788-1518,1551-1573,1595-1720,1758-1841,1882-2175
atgctatacattaaatttattacaattgaaaagtcattcttttcattttcagatttgtctgctctcggccttccatgtaagcttttagtgcaacatttattaaattaaagaaaattatgcgaaaaaagtagggagcggatttatatggaaaaaaatgcaaatgtggacaaaacgctgaaaatttgccaatatatggataaaaattcctcagaaatttggttcaaattttcacaaaactcttaagccattaattaaaatgaaaaaatatatatttgattctcgaaatatcaaaaatattatataaatttaaatatttggtgtctgaaaaatggattttcttttcattgggaaaataaattgtcaactaatcttaaatttaataggaatatgaatgtaaactttgagaattctctgtgtctttaaaaacgtccagaggattctggaatcaaaacgaaaaatgatttataatggatttttaagtcgaaaagggggggggggaagtggaaacccataaaatcccctcccaaatttataattaattagcaaatttaattattattttttcatttctgtccagcgaagtactacccttcttggtacactccggtcgccaaaaccactccgtcattcgctgctcgtctccgcgtcggccaattgtctttatttgtggcatttttggtgccattggcaattggtaaattttcaaacaataggaaaaatatatttaaacattccaagggaaaaaatatgaaaaagtgtgcaaattgtatatatttttataggaaaatttttccaattgttttcaaaaacaggtactgaattctcgggtgcccaattctctgaaagttagggatgtgcgagagttgctattctcgattcgagaagtttctcgggtttttgcttctcgatattggctttttagtctgggaaagaaaaattatatacactgtaatcgctgcaaatattataaagtgataatggtttttggccaaatccttttaacaacactcactcaaattgtcgaatattttcggcggggataaagaaaaaaagagaaaagtttttattttttgcacaaatctcattcaaaagtccactttgaaaattctttgttctcgactctcgactcaagaaatttatcggcttttctggggtatcggtctcggttctccggacgatttctcggtttaggttctcgtttttcgctaaaaaccatttctggccatcattatagcgtatatactgaacgggtaaaacaaacccacaaaaatgaacaaattgttgaaaattcatttgtaataataaacacacaatttcagttcatgtgacgaccaccacacttttcaatggtcattaggccaacaaatcaagccgaaaatggacagaaaaaaaaagtgaattcgaaatgggtgattgaagaaaaaaagcaaaaaaaaaagagtaaatgaaaggacggaaaggaaaggaattgtcacccaaatttatatacaaaaacatgtattatttgtatatttgaataaaatttgagaatttaaaacaaaattcaattaggcaaatagcataaaatgaatcagcatttgccaattttaatttagtgtgcctgattcatgcaggcgaagactaaaatttgtccagaatttttaaattttttcatttttctatacttttatctactctaattgtcttttttatgatgatcaatgatcacagatgccgccagaaaaatttcaaaattaaactaatttatatatatattaccataaccagaattcgacatttttcaaaagcctggacctgtatttttctggacaaaaatccaggaaacccaggtccaggaaaaacccaaggtttccaaaaatggccttggcctgaatgcaggaaaaccaagcctgggccgaagacctatagatttccctattaacaatgcctttcaattagacactgaattggatacccgcccgacattctcgggtttgcctacccagcccgggaaattgtagacccggtctcttgattaattttaatcaaattttgatatttttgtcctcccttttttccaatcattttctccttttcccccacatttttagcttttgttattcaattcctttttgggttgctttgtcatcgcacattctcatctccatcaaaaagcaaacgcctgctggcaataaa

SEQ ID NO: 77974 - DNA, 759 bp, Heterodera glycines
  Genomic contig location: Contig_ID=SeqID_2123; Location=383..1141; Strand=-
  SCN-specific regions: Sequence locations=1-73,104-357,401-462,484 -620,642-759
atgtggttttcgtgcatttctcgtcgagttaaagccgcagaaaaaataagtaaaaacttaaaaatccgcgcccttttaataaatatcttttttaaaaatttaacccagtaaaaatgaatatgacatttaatttcagtcaaggacatttttggattattctaatcaattgaaatctctgacgtcgatcatttttctgattttatgtttcttagtcaatttgttgacactaattgcttataaacggcaccgaaaagcgactgtcacgtcacaacaaactgataacattgagcggaaactgttaatttactcgctgcttacttttgctggccacgcccttttggcggtgttttttgtatgtaaatttaaattttaaaatatttttaatttaaatttttattaactacaaaataaacttattccaatttcagctttccgtcagcgaattcgtctggccattttatccccagtacagtgccatcatttacatccaatacccatgggtcaccgatctttgcactttggtgttgtccagttggctgctgttgtgcacaagcgacaaatttcggcaccaattaattggcacttttttgccaaaatgccttttgccgtcaacgagggcacaaaatgttgttgttccattggacaaaaacaatgtcttaattacagtgcagccttatcattcatcaaaatgggcagcgagatgacagaagcggataattgattattgaaaaagagatgcttattttaattttaaataaa

SEQ ID NO: 77975 - DNA, 520 bp, Heterodera glycines
  Genomic contig location: Contig_ID=SeqID_2124; Location=4354..4873; Strand=-
  SCN-specific regions: Sequence locations=1-137,160-165,187-353,376-520
atgatttggataagcaatatttatggacgaaaaatcaccaaatttggacataaaacatggacgaaaatcaaaaatatggccatgaaagaaccaaatatggaaaacaaaaaaatgtaaatgctgacgttgttttatgcttaaaaataaaagattttgtaaaaagttgttcaaataagaattttctaaattttttttgccagcttttaaaaatagggaaaagaaaaaaaatttcgaaaagtggataaaaagcattaaaaaaatttcctgcgtaattttattcactgcaaaaaatatatttcatttttttcaatccaacttacattttcgagaaaaaggtgtaaattgattttgggcatagaaattttaaaaatttatttgatctttttttaccactctgaaatgtgaactttgcactttttaacgcagaaatatgtacacaactttctttataggatatttatgtatgagataaaatgtgtaaatccatgaaaatatcattttgttttatgcctaaaataaa

SEQ ID NO: 77976 - DNA, 1939 bp, Heterodera glycines
  Genomic contig location: Contig_ID=SeqID_2126; Location=52..1990; Strand=+
  SCN-specific regions: Sequence locations=1-301,323-806,828-836,858 -881,945-956,980-1165,1205-1361,1385-1589,1611-1939
atgcatttacataaatactggtgccatttaactcaggtaatttcaagtgccatgatcggtctttcgctgttcattggcatcgtcggactgttcgccttggcactgttggaccgtctttctgttgttgaacacccctggtactcagctcaacgggaggaccaactgaggtcaaagttcaacaagaaattgttggcatgcacagcgctgatcaaaatggtcagttagagtggccagcagttgagctgcttgagcttatcagtgtcgagttgagaaattgctggaactttccgtttcgagcagttcaggaattttaaatcccaataatagtgtcataatcaatcccctaattgatcctgttaggatacataaaatcaaccgtttacccctggcattgtccatacattttgctcattgtcagctcaccggcattgcctctctcgcacttgcggcttttctcgagttcgagaacgcgcaattggcactccgtcaagagtactatcgcatcgttcttgaccaactcagtgccgtgttggccattggcagcgcaattgccgatttgtacgccggttacaacaaagtgcacggcacattaaatcttaaggtaaacggggtccggacaatgcgtcagtggacgctccgtcaatagacaatccgtcagtaaaagaacaatcagtcagtaatggacaacttgtcagcaaattttattctgtgattgttcattgacggattgacaataactgacggattgtcccggagcctaagagccttcggctcccggacaatccgtcagtaagtggacaatccgtaagcaaatttgttttttaaaacacccaaatttatttaaaatcatgtgaaaattaatttaaatcgctaaaaaagtgaattaatttattttataaaaattatgaaacaataatttttaaaagaattaaatgataatttttcgagatggtcaattaattgaagtataaagtaactagaaatattaagaatgtatgaaattatatttattaaattgaacaatcattttcgcatgatttttgatcattgctcaaaaaaaatttgctgacgaattgtccactgacggattgtccggaccccggagcattccatcttcaaattttttcatctcaatgtttcactgtatatttgcattttatatcacaaataaaatttagaaaattaaaaattaaattgtaaaattcgctttttcaggtgagcattgctttgtccaccctcgccgccgtttggtcattcaaatcagtagacaacaacgcgtttccgttttacaaaatggacatcaaccaataccgagtggccgttcacacatcccgtaaacattttgttgattggtttttgacaaaaaaaaatatattttaaaattggcatttgcatagccgataattcaaattttaaacagagactacttttgctaccatttcgcccccacaatatgccgtggtgatcattcacggcattctgatcggtctgctcgcccttctcgcgttgctatccgcttgcactgcgattcttgcggcaaacgcgctcagagaatgcatcgccaaaagggaagagctgaccgagctggccatgcagaacaggcaagaaaattgccgaatataaacaacgattgccacatttttcaaaaaaaaaatgacggcactggtaaaagcaattctaaactaggcaataattgatagagatttgtccatgagctcttctaattaaccaaaagaacttcttcggtttttaaaggattccccccccccctaccacaatgcccgtagccagaaaattgggcagggcacccgaaattttttttttctccgttgttatttttcaaaattttgagcgctgagcgcgaaaaactggaatttatagcggttttgtgccagaaaaggacccatttttgccattttgggttggggtcaaattttca

SEQ ID NO: 77977 - DNA, 932 bp, Heterodera glycines
  Genomic contig location: Contig_ID=SeqID_14007; Location=1..932; Strand=-
  SCN-specific regions: Sequence locations=1-159,195-226,258-283,323-932
  Gene Ontology: Biological process=protein modification
aagggtaccactgcgtcctcccaacttgagaaagaactcagtgcggaccacgtattttcgaacgagcatttctatggtctcataaatgtaggcatgcattattttattactttaatttgaagattgtttttcaatcattcacttttagttcggcaacacttgttatgcaaattcagtgatccaagctctgtatttttgcaaacagttcagagaaaaaattttggcgtacaaacaaacacacaaaaaatcaggttttgtgcattagtgaaaatgccatttagaatttttcagtttagtcttttttaatttgtaaatgtttaagggatgcaacgcgataatttgctcacttgccttgccgatttgttctcaaacatttcgagtcagaagagaagggttggaacaattgctcccaaaagattcgtcacaaaattaaagcgagaaaatggtagtttcaattaaaaaaagaccaaaatttaaacggttctaagattttttgcttttttaagaattgttcgacaactttatgcagcaagacgcacatgaattttttaattatttgttgaacgcaatttctgaagttttaatggaggagaaaaagaaggagcaattgggcggaagcctaaggaaagccaacagcgcaatggcaccaaacaaacggtcgttttccgcgaatgcaaaaggccaacccaacgatttgtccgcaaagcaattgaccaggtactatttatatgtaaaactatgttgtatacatgttatatcaaaaaactaaaaaatgcataaaatttgttaggagatttttttttgcttttttactgtttatttttgcaaaatgtcgattttcaagaagtctttctttttaatgggtttttgttaaggcaacatccctaaaaggtattaaattacgtgccgagcattatgcattattacaaaaa

SEQ ID NO: 77978 - DNA, 2577 bp, Heterodera glycines
  misc_feature (1826)..(1826): n is a, c, g, or t
  Genomic contig location: Contig_ID=SeqID_14007; Location=1960..4536; Strand=+
  SCN-specific regions: Sequence locations=1-210,232-251,335-1443,1465 -2119,2141-2577
atgctgctgtcccaagaaacagactcattaacgcctttctcggggtccaaatatccatcacttcttgtgcaggcgacaatttgctcaatctgttcttcaaattctgctaaatacaaatgtccgaagtgtttagttcgcacatgttctgttccgtgttttacaacacacaaagagtcgggaaaggtaatctggaaaatcattgacattttccatagctttgtctaatattgatgttgggggcaaatatcaattttagctttgtcttatttttacttacttttattagctttattttgttttgtttttttttacttttttcctttcagtgtgtttttcaatctgaccaatggaagaaaattgaaggcttttccgagtttaatgacgaagtcagcataaatgatcaacaatttattcacagaattgacgaaaaaatgaaaacggacaaaaaaagagaatttattccaagaggttagaggttacaaaataaatattgccagcgtttatgtttagaacaaaacattccaaccaaaattcaactctcaagtgaccaacgatttctcttgcaaaatgccaaaatgcgcagaatttggcttcatttggacgaaaaaaatagtgcatatttcgttgattatgattattagctgtaaaatttaaggttcggccgggtcgcgtcatgaacgtttttccgacacaattttttggacttgtactgtgaaatttgtcagtcggtgctattcaaagggacatggactttgtcaaggaccttctgataaagcagttctggaggtctatttgtagttttcctgtggctatactggccaattcataaaaagactttttatgcaatttcgaccctaaattctaaaatttcatattcgcgtttgaataattagataaatcaaatgctcacttttatacattgacctagtaaaaagtggaaccccttctcccggccatgcggcccatccgtgtccaaacaaattttaacttttcccgggttttctacaaaaaaatatctccagctctcgaatgcggactctgcgcttacttcgccaactcttgtgcatttcgttaagcctattgtcgattataacgggtccgatgatgaagaaatggaaaaagatgcggggaatgattttgacgtgttgcaagccgagtcctcccttaaattggggctgagtcaccacgacgatggcattggtgcggaaactaacaattcggatggctcttctgctgacagtacaggggatgaagacgaacagcaaacgccgttggaatgggtggacttcactgtatgttttttgtccacaatcggcttttcctatttacaattgccaggtggaaaatatcccggaaaacatacgagtcgcaactcttttacgccaatttctacgccctaaaccccacgggcccgtggtcacgctttcgcaaattgacatggtcaaaatggcaccattcatcaggtaagagtacctgctattttttcattagaattttacttaccatcacgtttatttgagtcataaataggaactgaatttttggggcgcactcttacgggcctggttatctgaatgcgtcagaaggttttctgacaatgggtcttcggctacaaaaggatttccgattttcccattagcccgaaaatacttattcattattatttttaattttttctttttagtgcatcaaaatccctgctttcctcgccaccattcgcttcaacttcgtccgataaagaaactgcagacaaaattgtggtgtattggaggtttctctaagcgatgaaattgaaaataaactgaacgatgaccaatcagaagatntaaggttcataaaactaataggttttatagctaattattcatttctaaggtattatgttgttgacccgaatcggactattttggataatttgcgaaacagacacgtgagtcatccattgtacgcataaagctaaagcgattcaactgacaagggaactgtagaatgggtataattttggaatcattgggtacgtgatcgatcctattaaattttaatatacacgcccccaatatcataaattaaaaagttatgagtctcgaaaatacaaaaacaatcattggaaatgttggagaatcattaaaaagaacaaaattggaaatggaatggccacacaaagtcaggcaccaattttggattttttatgcaccataactatttggtttctcgatatggaggcgtaatattaaaaattgcgatagaatagactatttattctctctatccaatggaaccaatttatactcattttccgttcgggttaaggaaggagtagatgttcattttatttcaaagggttgtttggattgcgtatttaattcaatttttatttgcttttaggtcaatggccatccatgttttgtagttgtgctcagcagacacacagaatttggcgagttggaattgccattaatatgcgaggaggaacagaaacatctgcagaagcgaaacagcgaaagagaacagacaatgaatggtcagcggggggagggacattgggatgatgccgaaccataccaaaatgggtggctg

SEQ ID NO: 77979 - DNA, 342 bp, Heterodera glycines
  Genomic contig location: Contig_ID=SeqID_14008; Location=53..394; Strand=+
  SCN-specific regions: Sequence locations=1-308,330-342
atggaattcttcctgattctcaagcagaagcacatcaaagtgcaggtaatacctgtgagtgaatccattttaaatttaatttcctaaatctcaattgctttaatcctccatcatttttaggagacgtacgtttccgagttgttggtgaagattctcgtcgccgcggacatgttcaaccgtctgcagcagttgctccaatattcggtgatcgaaaaatccaaatttttggcctacgaactgatcgctttgtcctcgcgctgtcccccgctgtaccaaattggattggacatgttgaaaaggcgtaacgactgggaacaaattgtggaggcaagtggaatttga

SEQ ID NO: 77980 - DNA, 1771 bp, Heterodera glycines
  Genomic contig location: Contig_ID=SeqID_14009; Location=397..2167; Strand=+
  SCN-specific regions: Sequence locations=1-230,271-341,363-674,696 -798,893-940,962-1103,1125-1140,1162-1164,1216-1531,1567-1771
ttttccctcctttttctctttgtttattccaccgtatatctaccgtattccgtggccaccatttcaccagcattcagcgactttcttaccgtggcatacggtgacaaaatcgaagaatcaatcgcccgcagggacctcggttcattgggcagcttcggaggtggcaccaaaatgccaatgtttacgcgaaaacggccgattgtcatggtccacgggtgcgaatcgtttaaaattaattaattaattaaaaatcaattagcgaaataattatcattttctaaaagacaatagaaaaatcaacagattgagcacttttgcggcagagtatgagaacattcgacagtactttctgatgaacaattacaccgatgcggaagtgtacgcaagcagttacggacatggcccggtgaattggactcatgacgcgatgaaatgcgaacacgtgcagagggcaagtggggcaaggaaggcgccggaagggggggggcgggggacggcacaatttgctttgggaattaacccattagcggtggtctctttcagttccgttggctaatgctcgccgttgccaattacacaagttcgcaaattgatgtgatcggctacagcatggggtcgccaattgcgagaaaggttttcaaaaaagagaaacagttctgattaatctgagcccctaaaattgacatttctttttggtcggttttttcaaatcgctgctaattattggtttaattacccgtgcaaatgcttgccgtgctgagacgaagtacgaaaagtgcaagtgatcaaattaaaagcaaaataattatttaaaaaattaataatcaaatgttatttaatttaatttaataatttactatttaaaacattctttacataatttaaattttatgttaatcataaacgtgtgagtcgaagtttaaaatttgaattttcttatattttagctttgttgactttggcatagaggctatgaacacttccttaaaatcaatatgcatttataaattttgctataaaatcggatatcgaaatcgaggtttttcagtatttagaaataaaattaacgcaaaatgtgaaaagttatttgatgctatttggtatttaaataaattaaccattaaataagaggctcagcacaatatgattaatataaatatagcgaatattttaaataactaatcatattaaatttaattaactattttttaaattgatcacttgcacttttcgtacttcatcattacaccaattcttgctgctctgacaatgaatttttgaatttttcaattttcggcaatttcgggcggcgtttgcgtcgacaccggcgaacatttgggcgttccgctgactccgttggtgcacactttcgtcggcgtcgccggtgccaaccgcgactgtgtgcatttgtgccgctttttgacaaatgtcaccggcgatgcgccgtgcaattcgatcaacggaatggcgtgccattcgcggtttcttcgcgacattaacaacgcaccccgggggtaaaagagggcgattgaaataaaatttatttttaaaatttactaaattaaagtcaaatatgcatttaattattagccattataaactgctgtctaagacgacagcatttcgaggccactcatcgcgtgtacacaatttactcccgccatgacgacgtggtgggctatttggactgcgatggacttttggtcagctccatccctttgcaggacaatcacattgaggtggaaaaagttcattaatgacctgccaggcc

SEQ ID NO: 77981 - DNA, 1557 bp, Heterodera glycines
  Genomic contig location: Contig_ID=SeqID_14010; Location=732..2288; Strand=+
  SCN-specific regions: Sequence locations=1-476,514-567,589-1557
atgacccacactacaaacaaggatcccattggtgcgcgatttatgccccttcgaagacggaggaagcggtcatatattttgatagtctcacaaaaacaattcctcctattgtaaagacatcatttatggataaatttccaaaaggttttgttacaaataagcacccgtaccagtccccacttactaccacatgtgcaattcactgtatcgtgttcatctatcacatgtccttaggtcacccatttgacgcatttctgcgtatgttagacgctagtgaaagccccgacatgtattctttgtgcattttgaataaaatgattaatccgtatttatgtgtgtgtgccaattttaccaccctttgggaaagggcatagggaatgattgattaatttattataccacggcgcacatcgcgcgctgttggtgcctaccgcatatatacagcgagctcacgcgggaaaggctcacttttttcgtaaaaaataaattaaaatattaataaataataataatgtcgttggaagatcacaattattgcggcgagttgggcggcaacgaagcgcccacaaagagaagaaaaagaaatgatgatgtggagggagagccgaaatttcaaaaaaactgcattcgcactctgagcgccgacaaacagtacagccaaaagttcaaagtgcagagtgtaaagtcgactttatcattgaaaatctgcccgccaaccccgagtcaatgctgcgcgcattgttcgctcactgcatgtcaaccgccctggacgagtcacagcagaacgggatcacaccggatcaattgggctctacaatctcttcagatctgctaaatccgagcatatggattcccatacgccgcatttccgacaacaccgccgactcaattatgaaccgcttccttgaggtggcacagtcaaaatcgcgggagggctctctgtggggctcgccgttcactgtgaccatcacaacgcttgatgttgcgcagctacctcagcggcaacaggtgcgtggcagtgggaaaaggacaacgaattcagtacaacatatcatcaaagagagtgctcttctgcgaatcaacaacagtgatgatgcctattgtcttttttacgctttggagacaagcaggaagtaccacagcaaagagatgagccgacagaccttttctaaatatattaatcggcagaatgggcgacgactggaagacgtgtttggactgatgagcagcgcaaacattcgcaccgatctgagagaatatgacgcggttgtctatgtgccgatagtcgtggactattggaatcggaaatacgccacagcaaaccagcgatttaaagtgttcatttttggcgcaacaggcacctatcggccaaaatttcaatatgtgccggacaattacaacgtcgaaatcccgctctaccatcacaacggccatttcgacggaattcgatgcggggtgggcaaagcggtgtttgggcgtgactactactgcttttcgtgcgagtgcccctacgataatgccaatgatcattcttgcagtgtaaagcaaagtgcataa

SEQ ID NO: 77982 - DNA, 923 bp, Heterodera glycines
  Genomic contig location: Contig_ID=SeqID_14012; Location=698..1620; Strand=-
  SCN-specific regions: Sequence locations=1-140,162-219,244-247,269 -284,307-517,539-894
atgaaagaggttgatttcaacgaaaaatctcctctgagtgaaattggagagctttggaagctctatcgagtggtgaactatacgcctagaaaatttgaaattttcgagctaagccccctaagcaattgtcgaaaattttttaggccaaagaggaggtgaaaatattttactggtatattttgaagtacttagcacgaaatgaagctaattttaagtctcataaattttaaatttttttaaattcttgaaaaattttcaatttttgggtcgattgaaatttcgtaaaacatttgaaaattcatatctcacttgaggcgaggtcaattttagtacaatttagcttaaaaaggaaaaaaattattatatttggtttgccaatgctgaaagttgcaaaatcgatgagtgattgcaaatcaaacaaaaacaattgctgtgataatatattgtgtagtgcctacttacctaaattgtcgaaaacgaaatactttaaaacaaaataccgtatattctctaattatcccccggggggtttatttttcaacctcctcagaaagggggggggataattagagacgggaggacaatggagaagggggattatttttcgacagattactttagtgtaaatttttgaattttttcaacatgttgcaaaaaatgtcatcgcgtcaactcactgcacgtgctgggtcgtttcttaaattccgccacattgggcgtttcttaaatccgccacattgggcgtttcttaaatccgccagggcgtttcttaaatccgccaaggggtagtaaaacaaaaaaaaatgtaagacatataaattcataacttggcttaaattcaatcaaattaataattcttggtatcattcaatagctctagatgttctctaacggaatattaattttaaaaattttttaataaa

SEQ ID NO: 77983 - DNA, 673 bp, Heterodera glycines
  Genomic contig location: Contig_ID=SeqID_14013; Location=69..741; Strand=-
  SCN-specific regions: Sequence locations=1-142,164-312,334-368,391 -441,481-529,562-673
atggcgtcgttggaaaattttgttggtaagtaaaatttggcggaaatgacaaattgctttactaattaacgcttaattattgttcattattctctctttgtttagttgacctgttttctcaaatgcaaaatgctcaacaaacggaaatttatgcaaaaattgacgaggtgaaaataattcttaaaaaaaaattgaaaaattgctttattaacaattttttttcaaagttcgcgcaccaattgaagatggaaattgatatgatggcaaatgccaccaaaacaaaagttgaagtgttggacagacagcaaaagaaaatttgggacaaattttcggtgttggacaattttattggcattttgaaggacagatttcaaaatggtaaaataaaacaataaaaatatttcaaataagtaacgtaaaaatttaggcgttgaatatttccatagatttttatattaattttttcaattttcagaacttttaacggctgtccattcggatgttcgtcagaatatcgctgaggtgaaactttaataaaattcaaattatttttaaaaaattcagaagtttgccaacccgcagcaaaattgctgggaagacaccgcttgtagcaacgagctcgaaatttttggcaacgaaagcttacgaattcactacaaaggcgatggaagcg

SEQ ID NO: 77984 - DNA, 244 bp, Heterodera glycines
  Genomic contig location: Contig_ID=SeqID_14014; Location=200..443; Strand=-
  SCN-specific regions: Sequence locations=1-66,111-244
atgtcgatttcttttaattcaacaagtaacgacgatttcacaccagcagcagatgagggtaaagagaaaattaaaataaatattgaaaattaattaaattaaataaaattcaaatgtttaattgtatttcagaagaagtgaaaggtgaggtgttggaaaacaaagaaacattcgctgaacggagaattggcaaattggaaagagagaaagtgagtttggaggacagaaattaaaatggaataaa

SEQ ID NO: 77985 - DNA, 1658 bp, Heterodera glycines
  Genomic contig location: Contig_ID=SeqID_14016; Location=98..1755; Strand=+
  SCN-specific regions: Sequence locations=1-58,80-184,206-276,306 -602,624-1179,1227-1286,1319-1549,1571-1619,1641-1658
atgccggtgcccgagtttgggctgtccgcactgtcggccaaacaactgttttggcacgagattgaggagaaggtgtcggcacggaacagtgaccatgtgttggtccaccggtggacgggcacaacggacgccgacttttggacggagttgggatgtgacatggatacaccggtggtgctcacactcgaggccattgaggaggacccgaaccatatcaaggtttaattggatacggaatttacagggttaggtaggctcttatatgggttgtcccccataaattaaaaaaatatatgatttttaaagagtcgcatagaatacttttttccttaggtttccgtggtccgctaatcacgaatacggcatctgttttgacccatttctctagacccgaattcgaattgaatcgctttgtgcaaaaaatttgaatttaattgaaaatagagtttttcactttttgttcgaactcgggttcggagttcgaaagagaggaaatggatgttggattcgtggtcagcgacccccgaaaacctaagaaaagatgtactcaaattgcggcttttatgcctcctaaataattttttttgcacaaaacttgcgcttttctcccttttttttaatttgggggggggggggcggccgcataatggaaaagtaaccaacaaaaaaaattttttttttttgaattgtccatctttcaaccaatgcgctagcatattccatgaattcgttatttaggtatatttttttaatcatcaatattttgcagataatgttcagctgcggctccaagcattcggccttcattttcaaactttgtcccatcatcgaggatgcttacctgatattctttgtgccctaccaaaaattcgtaatttttttttgttattgttgaaaaacaaccattttttcattccaaattttcaaactctaaatttgttggaaaattcagagatagttatttggctagagaaggtggcatgggttcaattggtttgagcattttatctttcacggaacaaaattttttttttttgttgcgcagttgcgaccgttcacgcaaaaatttgcaggagaggggaaaatgatattgtttcgcaactcgagatccaaaaatgaaacaatttataattgcatccgaattatttgtttgctttatgcaccttgaaacgacatcgcaaaaaaaaaattttttttttaaattttttgaaaaacaaaaatatattgtactagtaaatgaaaacaaaattgctaatttcaataaataacgagaaaaaaaaaattcttttctctttaaatttgttttttctaaaaaaaatgttttttttttgcgggagattcattttgtctttttggcatgctccgctaaccattaccctgtttcctccattttttttctccagcgtgacggccacctgagtctgctgtcctcgctccactttctggaggagtacatgggccgcatgcgcagccgcacgttcgtcgccgagcagaaccaatgcatcatctgccaaaagctcaccgagctggtgttccagccatgcggacatgcaacatattgcaaaaagtgtgagcgaaagtcggccaaggacccgcgctgtcccatctgtcgtctgcacggtttttatttttgcatatttgttttggccaatgcctag

SEQ ID NO: 77986 - DNA, 744 bp, Heterodera glycines
  Genomic contig location: Contig_ID=SeqID_14019; Location=35..778; Strand=+
  SCN-specific regions: Sequence locations=1-280,310-529,551-744
atggctgacgaaatgcacaaagcgttcaccgacggagtgccctttccggtgcttaaagttctcgaagtgagtaaaataatagtagtgatttctcgaaaatatcatgcaaatgtcaatagttacgtgatttaattttaatcaaaatttgtgtcgcgggacaaaaaaaaagcatttttagtagatttttgccaaaaattaactagttttaagcatatgtatccattttttcaatttaatggaatttggtggttcggcaatttcaccggggaaaattcttcaattttaaagaaattagggaacattaaaaaatccatggaaatttaacaattacgagttcgtcattggatgccaacaatatccacgtgaaataaaacttaacatcttaacattctcaattacataaaattttcaaagtaaggacaaaaaaaataaaattctgctttatgccaatttatgcattttgcatccaatttcagtacttttctatgggccaacaatcattcgcatggggacgacagtttcggaacgcaggcaacttcactggcacaatgctttggttcgattaattttctaatacatccggacaatccgtcagttaaaacttgatttttcggcaattaattaaaaatgccgaaaatttttttaggatgatatgccattgagcagtttcattgaaaaaaatatgcagagaaaaatatatgacattctcactcgttaattagtttatcataatttaataattaa

SEQ ID NO: 77987 - DNA, 695 bp, Heterodera glycines
  Genomic contig location: Contig_ID=SeqID_14020; Location=600..1294; Strand=+
  SCN-specific regions: Sequence locations=1-69,91-337,363-600,625-695
ccattctcgagttgctcttctctgccactctgtgttctctgcaatcacttcgtctgtactctctgaacaccgttctttctgcttctctggacaactctgtcggcccaccaaagtgccgtttcggcggtggaagacaaagcatcgacgccgaaaatgggcaacaccgcggcggtagtcaaaagcgccgctttggccatattttgtcgccgatcactccgtgcccgtctggcaaaacgtcgttgactctgtcccactgttctctgaacaattcatcgccagccgtctcgtcacgaagcactgcccggatcagtcctggccgccaccagcgcacgttcgtctcagccccgctgtcctcctcctccacctcggacgaagggccggtcagcaacagtgcggacagcaacaagcaatccgttgcttcgtccatcttttccatctctggcacgtcgtttggctcgacggcaccgccgacaatggcgccggagagcgacggcaccggcagaggggaagtgaccaacagaagaagcagaagcagcctgatcagcagtagcaggagaacaaccgcagctgatcagcaacaacaacggattgatatcggagacgacgaagaagatgacagtgatgagctgatcagtgacgacataaagcatttcacaatgagaagtggggcaaaaggggaggactgttggcactga

SEQ ID NO: 77988 - DNA, 1122 bp, Heterodera glycines
  Genomic contig location: Contig_ID=SeqID_14021; Location=1004..2125; Strand=+
  SCN-specific regions: Sequence locations=1-10,32-96,118-164,232 -258,282-368,390-395,445-587,609-668,690-696,736-867,917-1028,1051 -1079
atgtccaatattattttttcacatttcccatgggaaaaattgaaatttgtttttgttttgccgtctttgatgtttctttctgttatttataaaaattacagtttttcatatgacaattcgacgttattcaggtcattcaattaaaattattcgtgtttaatacctttttaaaattctaattaataacttaattagtttttaaaaattattaattttagaaattaattaaaagtcaataattaagggccccactaacaatcttttcctttttggtgccgaatgtatctgttcaaaaatggcaatattctaaattcttataaaattttttgtcttatgtgtaataaaactggtgacttttacattccttttattggattttattaagaatttgacagaaattaaatatataaactttagtttatttttaaacttaaatataaaattggccaaattaagtcaaaacactcaccgaaagattttttgtatcataaatttttttttcgtttttatccaaattaagcatttatagtatgttcgatagctcaatgtgttattattattctgccaaactttttccaacgcccggaggagcaaaaatgcattcttataattcatttcataattaataatttagctttgcctatttgcaaaacaatagcggtgaattatcatcagaagaatgctttggagaaaaggtatttaatttaataattttcaaacaatttaaattattaagatggtttacactttgaaaatgaacgactcgcgaataattcgtggcaaaaagtttaattgctcattaacatggcttttggagcgctacaaactttcagacaaatacgcaattaaagagaaaattgaagtctgttttttaatttatttttaatttatttttattaattttaatcatttttatgtcaaataccctggccatcccaaatttgtgttcgtgacagccgcaaataataattatttcccttatcttcggacgttcattgcaaatattaaagaaatatttggatgccaacagaaaatcattgcttatgatttggaaacggtgacaaaaaacaaagaatgggtaaaaaaatgtttaattttactgtaatttaaattatttttaaa

SEQ ID NO: 77989 - DNA, 417 bp, Heterodera glycines
  Genomic contig location: Contig_ID=SeqID_14021; Location=4804..5220; Strand=-
  SCN-specific regions: Sequence locations=1-260,305-358
atggcaaatgaatataaacaaaaaagaaaatattcaaccaaagaatggcgacaaaattataacgaaatttgtaataaaattggagtaagccgttcactaattgaaaaatggaagaaacaattcggaattcgctgtaagagaataatggtgaaagaaaaaatggaaaaaatgaaaatttattggaaaataaaaagtgaaaatccaaaaatgagtgataatgaaattgcaaaaattttgaaaatccatcaaaatagcattttcaattggaagaaacaatttggagaagaaatttaaagtattaaaaacagaaaatgagaaaagggatcaataattatttcgatagaaaattgaccaattcttttattttataaaattattatcttggctaattgaattatttaaatttatttaaataaa

SEQ ID NO: 77990 - DNA, 384 bp, Heterodera glycines
  Genomic contig location: Contig_ID=SeqID_215; Location=1229..1612; Strand=+
  SCN-specific regions: Sequence locations=1-55,77-271,293-313,338-384
atgtatgtcaacacagtggaaagtgaatccgtgacacgacagctgggtcatggtaggaataatttaattaaatcaagaaaaacaaaaaaaatgctataataatttttaaagagtatataaattcaagtatcagaaacaaataattttaatttctttctttgaaaaaatatcataaatgaaatcgcgtgttattttctatgaaaaagtttattaattgcttgacaattaatcccaaataatttagctaaacaaaaggaggagtgattcatttaaacataattttgtataaaaaatcactttatgaaattgtaacaaaaaaaattattatatatataatccaattttataaacaagaacaaatgaattgcatagttaacaattaaa

SEQ ID NO: 77991 - DNA, 3083 bp, Heterodera glycines
  Genomic contig location: Contig_ID=SeqID_216; Location=121..3203; Strand=+
  SCN-specific regions: Sequence locations=1-204,226-274,296-311,334 -652,692-1678,1700-2368,2390-2570,2592-3083
atgtttattgccccattcactctaattctgtcaggggccactgggagcggtaaaacccaatggctaatgaaattgctgagaagctacgctgaacttatcgatcctccgcctgctaaagtattgtattgctactctgagatgaaccaatcagtcattgagctgatgaagcgcggaatcgagacacataatggcgttccggatcaagcactgatccagagtcagccgaaaccattgcttcttgtgcttgatgatttgatgcttaatgtagggaatgattttttggatttgctgttcacacgcggttcccataattggaatgtcagcgttatttttgtcacccaaagcctgtacggacgtaatattaagaccgcaagggcgaacagtcattatctggtactgacaagaaacccgtcgggccaacttcaagtcagaacggtcggctcacaactttttccaaaacgattaaattactttatggaggcttacaatgaagcgaccagtcagccgttcagttatttggtgataaatatgcacccaaatgctcctgaaaatgagcggctgaccagcaaaatatttcctggagagaaccgtgaggtgtatttgcctatagaacagtaatatacgcgtgcatgtgcgtgttgtaagcaataaactatttaagaaacagaattttcccatcaaaagtagaatagtccatacattcgcgataactcggattttcttaaaaaattacttccaccaaatcggcaaaaagaaaaacgatttgcttcgcggtgcttcagcagaacaaatactaggcttggtggaaatttgtgctaatattctgaagtttaatttccgactaaacaggcgtcagaggaggcggttggccgtgtacgcagactactaccgagcaatcgcacgttcacgcagtgagcccacagccagacagcggctacaacaaggcagcggaattgctttaggagctattttggcaccaataattagcgttttggctgagcagttgatccaaaaaattgttacagccgcaccggcgtcaacaacaaaaacaacatgaagcacactaaaaaaatggtccttgtaccggagagtgaatatctggcgcttattaacatgttgaaaggaggcgccggcagatctgactcacttctgaatgagaaagctgctctcgatgcccaaatacaaagcaaccttagcgacagcaaagcgggtgcagatgtcaaaatcaagcgacattcttggttgtacaaacaaaggcatcagttgaaggatatgattgagaacaagccacaaaaggtgatagtggaaaatgcaacgggcacagcgccagcaaacattgccccgtatatgggcatacaaaaacccacggtcaacaaactcgacgcagtggacagtcaagatgatgacaaaaaaattaagggccctaaaaaggtcagacggaaagcgatgaatgctgctacttccagaatacgaatgtccgccggcggcattacaagttacggagaagaaactgatgattacacatctgcgccagagaccgatctgttgccgatgagcaaaaagagacaacaaaaatttcttgaactgaagacaagcaaggaacattacgctaaaatgatgagtatgatcgcaaaagaccctgacaaatttggtgtcgacaaaggaacaggcgaaatcttaactaattttaaaaggccaatcctacgttccaattatatggattctttgttgtatattacgggacagagaagtgaagcgcccaaaggtcaccgcttctttgcacaaaaactggctgctgatccgcggatgatgaaattttttgaaaccaatcaaaaaggagaaggtaaaggcactaataggaagcgagaccgtacaatgaaaaagaagattgttcttgtgagagcaaacgctataaaaacggatggactcagtcgtgtggtggcacaaccagacaaagggttggctactcgtaaatttaagccgactttatgggcaaaactttagctgcggaaaagttgttggaacaagtgtattatgaccttcggtcgccagcgagttacgctggcattcaaaaagtgttggcggaagcgcagaggcgaaacccgagcattacttataaggatgttcatcaatttttgcataagcagcgcacctacacgttgtttaaacctagaaaaaaccgtttccgtagactaaaaacagtgcccagcgggcttcatacggactggcaatgcgatttgtgtatcatggatgcactgaaagagcataatgacggatttcgttacatcctagtgtgtattgatgtgctgagtcggaaaattctcactgccgaggttgagtcaaaaaaaagtgagcacatgattgaggcttttgagaagatttttaaaaaggcgggcgtgttgcccaacaagctgtacagtgatgcgggtcttgagtttcaggcgaagaaaatgaaggactactggattcaaaaacaaatcatcaaacacgtgatgtatagcccacatttgcacgcaggagtcgttgaacgtgctaaccgtacgatcaaagagcgactttacaaatattttagcgaaaagaacacaaagcgatgggttgatgtcttggaccgcattgtacacaatctgaacatctccgcgaaccgaacaacaggaataaggcctgtggacgtgaactttaaaaatgctgccgcactacgcaatcgcctatataagcatagtgaagtggataaaaattctgcaaatagctcaaaattacaactgggtgacattgtgcgaattagcaaggaaaaaggtgacttttccaaaggttattttccaaattttacggacgaactgtttcgcatttctaaagttaacccaaccgacccaccttcatatagaatccgcgacctcgacggagaggacatcaaaggaattttttacgagcaagagctggtaaaaacggttgcagaaacatcacatagggctgaggtgttgaaaactcgacgacgaaacggtgccaaagaacattttgttaggtggattggctactcagacaaacacaatcgttggattcgagacgaagaccttgtgcgaaattag

SEQ ID NO: 77992 - DNA, 2450 bp, Heterodera glycines
  Genomic contig location: Contig_ID=SeqID_217; Location=2745..5194; Strand=+
  SCN-specific regions: Sequence locations=1-116,138-753,775-848,871 -882,905-929,951-1071,1093-1330,1355-1764,1787-1834,1856-2020,2064 -2301,2347-2450
atggcgttattttccatactactaatgctgctgctactcctgctccatctgtccggcggagaatggatcaacgtagagctgagcgttgacccacccaatttctttgaccgcacctttcgctccctttccaagacatcacccatccaacattggttcggctacaaccggaacaccgcgtgtcacgttgagcgggaaacaaacataaatcgactgtacaacagtgctgatatgtggaacattgccctcactgatgtggacaacttcatgagcatggggcggcaaactatcgagttgttgtccagcgccttgccgtgggcgtgttttggacatgaccgccacagttttgtgatttttgaccttcgaaatgacgcaaatgaagtggcagttgtgcgcggtcatcagcacaagatagcacgaaatttgagtgcatatggacgcattttgttcgaccatatttccggccggttgtacatggtggacaagcacgagcgccggatccatgagctgctcatcaccgattttgtgcgatggtggactctgaataacactgacggaggtggtggtggtggtggtcataacggcggcggtgagaacagcacggcaacacactcgttgaggagcaactttgtcgggtttttaccagaacaaaaaacggattttttcattgcggccgaccatgtgtacctgatttggcgtagacgtgtatacaagttccgtgttgggcactacttcaatgatccttcctcgcagctacagtttttgaccaactccagtgacattcgcttcaacttcctcatattcgagagagatgatgacgccaaattggaagacagcactgatcgtagaaacagcagagcagcagcagaagcatccgcaggactaacaccatcatcacagatgatgaacagcattgagcggctcctgctcgctttgatgtacctctttgatgtggcagtcatctgcattgccgtttgtgtgatccgaatactgcgccgtacaacatcaaattcgggcccggacaacaccagccaagctcgcagcaacgatgtagtacacactacggaaatgatggcactgacaagtggtgaatatggtctgatccagtcactttcgttacctaactcggggggcggagctttcgcctctgtctacaaataatccagtgtacactgtgacgcttttgtcgacagcgaagctatgtctaaccagtcaaccactatttaagccgagcattttgtaccattgacttgctggcttgtttgatgattgttagtatttgttctgttgttattatttttgttgcctttctttctattgctgccgcggctgctatttaatgcaaagagcaataaagcattttctacaaacatttgcgctccaaactgttgaagagctgtacgcatattttaaagaggaaattttgagctccccgggcgaatattacccgaacccgctcgcagagttcgtttgtgtgcacattgccaacgaggatcacgctgaccaaccggtgcttgtgaacggcacacttgacctgatcgaaggcgtagaactctactccacatgttatccgagaacggaaacggggaccatcgattggtaagtttgtgggagcgcacgtgtgcgtctgtgttttaactgaagcgtaaccaaccagccaaccatttaaacttcttctaactattcaggagcgagccgatgtacgtggagctgaaagacctgcgcatttgtccagccaattcgccgcgatgtcattgcgtacaaccagcgagcaacaacaaccaacagcagaagctgccgcaggaacagtatttgaccctttggatgggggaagtggacgaggtggacgaccatcaccctcacatcaatcgccgcctgaatttatgctggcgcgacaacgtcgacgacacagaaggcggcagcgaaaactgagcaatttggtgaccgcgctgtgtgatttcaacaaatgcggaccggcccgactgccgatgttgctccgaaagcgacgagcggaaaacctggattttctctcgcgtctctgtctgcagactgtgcacttaaagggcgacagaaacgtgcatttttcggccgccgcattgtccaattatggtgctaatcgcacgtttgcctaccgcggccttctgtccataacggttgagcagcatttgttcactcggcaccgtgtccgcctcaggcacccatttctgccctgtgttgtacaagctggaggcaacaatcactgttatttctaccctcttgagctggtccgcgtttgccagtcgccttcgtctgggtcacataccgacaataacaaaaacaacatcagcaacaacaacaacaacaaaacaatgaggaggatgccaatgcagaggaatcaacggctctcgcgggatcgtcttcatcaacagccgaagcgttctagtgtttgtttgagagatgtgtacgatccataa

SEQ ID NO: 77993 - DNA, 544 bp, Heterodera glycines
  Genomic contig location: Contig_ID=SeqID_217; Location=5697..6240; Strand=-
  SCN-specific regions: Sequence locations=1-16,41-156,184-457,488-544
atgcaccgctcggacaatcaggaaagtgaggataataaaaacggggggcgttcaaatgaaatggagaagggaggcggcaaagagggcggaggcgatgctggagtaggtcgggctgatgaagacgctggtgatgctctgaaaacttcatccccttccgtctcctcctcctcctcgtcttccagcggtggcccagatcaaccgtccacaagcagcggaagtaggaagagacgatatggcccgccacctggtgttgtgtcagcgtcctggctgctgggggctatgaaggcgcgagagcgacagcgctgtgaatggtgagcaggcgcgcgcgcctctttctataataaaagctacagtgcttactacgattattgctctgctgcccgttagattttaatattgatttattggcaggcttgaagcgctggaggccaaatattcgagaatggagcgggaattgggtgctgaagatgatgatgatgatgctgtggtggactttgcacgagattcactggagactgttgttagcaagtgcgacttattttaa

SEQ ID NO: 77994 - DNA, 354 bp, Heterodera glycines
  Genomic contig location: Contig_ID=SeqID_217; Location=6476..6829; Strand=-
  SCN-specific regions: Sequence locations=1-159,194-218,240-354
atgacaaatgtgcggagcggtgaagtgaaatatgttcaaaaaattcgcggcatcaccttcgatgtgcggaacagtcaatcgctacaatttgagtgcttccgcaacaaagtgctcagctacggaggagtagaaggaagacgtgccgatcgcggcggaggagatgatgatgatgatgatgatgaggacggtgatgtcgccgtgcagcaaagtgcagctgtgttcacatatgacaaaatacaaccgacaagggagagccgaattatcacacgcaagcaaagaaagcactatctgcccgtttgtcagaagggcataatcaacgaacagctggaagttttaccctttggctaccgataa

SEQ ID NO: 77995 - DNA, 1258 bp, Heterodera glycines
  Genomic contig location: Contig_ID=SeqID_217; Location=6897..8154; Strand=-
  SCN-specific regions: Sequence locations=1-312,335-338,360-643,673 -1258
atgaagttggatgaacgtctattgttcagctgctgtcatcgttgtgcgtctcagttccgtacgttgaacacgcgatgccggcacgagtgcgcacattcggatgctcagcgagcatacaccggcaattacactcacattgagctggcaatggcccttcggtacggctaccgtgtggaccgtttctggagagcgtggcactatgagcagtggtctgccttactgagcaattcttctcaaattggaaacaaaaactgtgcttttcaggagcgaccaaatcttcaaggaatacgtacgtcttttactcaagctgaaggttggttggttggttggctgcaggtttcttgttctttcgtgttttcacccgtttcccgaaccattatccaaacaagcacattgcacatacatatatgttacgcagattgaggctagcggcttcccagatgggattacaactgaggcacaaaggcaccaatttattgatgcatatgccaccgtgtatgccgtcactctggacgtgggaccgtgtgcataagaatccagggcttcgcttcatcgctaaactaatgttgaacagtctttggtaagcaaaaaaaaaaattatgcaaacagtcgcctcattctttttttggccactatgatcgcatccatctccaatcaatcaatcaatctgttttcaggggaaaatttagcatgagaaatgaactaggaacaaacaaggtcatcacaagaccgcaggaattctactcattggtgctcgaccataaagtcgaaatttctgccatcattccgctatccgacacagccattcgagtgatgtaccggcacaaaaaaagtttcgtggaggagcattcgtcaagcaacatagtgctcagcttatggacaacaagtaaattgtcaattcattcagcaaccaggattctgtataacaaacaaaaaaaaatgtttgtttgtttttttctactccaggtcgtgctcgattgaagctgtttgagtacatgatgcaagtgcagaatacggatggagccgagcttctttatacagtcagttatcgtaggcgaacatatgcatttgtcacagtggttggcataagagttaccttttcccgttgtgtctccaggataccgacagcgtgattgttttgcacaaacgtgatcgggtgccaatcctcacgggcgaatatcttggacaaatgtccgaagagtacgcgggatttgaaatacaaaccttcatatgcggaggtatgcgctatgccaattag

SEQ ID NO: 77996 - DNA, 4231 bp, Heterodera glycines
  Genomic contig location: Contig_ID=SeqID_218; Location=262..4492; Strand=-
  SCN-specific regions: Sequence locations=1-7,33-40,63-121,143-200,232- 362,390-393,415-1046,1068-1555,1577-1596,1618-1690,1712-1881,1915 -2091,2115-2326,2351-2492,2515-2597,2619-2966,2995-3323,3345 -3543,3567-3752,3774-3967,4002-4231
atgcagccatcatcatcatcatcatcatcatccaaaagaggggtgacacaggctggcacagcttcgagcgggggccaaagaaagcagcaacgccggaaaatcggtgatgcggatgatgatactgcagctgctgctgctcctgtcacagcaacgcccggtcgttgggatttccgctccatggcctactttgaacaatacataccgccgcctcctccttctcctccgacctcctcatttgaggctgcttctttggcttcaaattttggcactcagcagcagcatcgccatcgcacaaaacatgtccaatttggagccggccccactaccgtggcagcaccaattgatgaatccgatcatgaacgtgatgatgatgatgatgatgatgatgagcagcatcagcagcagaaaatgttccgtgagacagcaaattacgtccacaagctggaccgtttctcaatgacacgtcacatcagcgaatttgagctgaacgttgagcacgaggagccggacgagcagctacgcaacgcgttcagccaactgattcggcgagcactcagaaatgctcagcagcaattggacgggcgctcggtgcaaaaaataggcattgcgttgcatgggaaaggtgcgtgcgtgcacgcggcacggatgctatatagctttacatgatttgcgcgttcaggcctttatgatccgattgttctcccactgcgcccacctgagcaaaacaatgccgacgttttgatgggcgagcttgataaattgggccagagcggcacagacggcggcggcgatgacgaccaaggtggaggtggagcggacccggacgccggcatcatggacaagcgtacactgctgttgtccgaaccagtacagatgaccatcacttgtgtggcgcctccgcagggcagtgggccccgctttcatccataccagcactggggctacaacgaccggtatcggatccggatccggaacactggtgaagcggagcgtcgcttttgcatgttctatgcacttgttgcggggcgtgcctaccatgatcggactctgtttattggactgaacaacgacaacaacatgaacaacaacatgatcatccaaatggcgctgctaatgcccgatttttgccgaacacatgagctgttcaaccgtctggttgccagtgacgaggcaatgcggatggctgccacgcgtctgatgagagatacgggcatcactgccgacctgccggcatatggcatggatcatctgcagcaagtccaggcctattgggtttgctcaaaaaattttttttgttgttatatgtactgttgttgctcaggatgaacgttttcctggtctgtaccgcattgtactgtttgaagaccgtccggaggaactgccaaggccaatctggaaggggccgatgggacgccattttgacgtaccacttttcctgtccaacagccactatgacgcactgacgaagatcaactgtttcttcaaactggcaaggaagtattgcgtagagtgtgagtgtgcttatacggtggacaataaacatacgctgcactgtaaggtcaggtgcccacagtgcacaaaaggtaatattcataactcatttgttgttgttgtttaccctattcaattaatctataccactcccgcacagttggacccaataggccctgtgcgaagcatgatggcgtaaagattcattgtgcggaatgcaatcgctactttttctcccttcaatgcttcaacgaccaccagggctcgacatgtgcgctgctcaaacgatgcaaattctgccaacgagtgtaccagtgtgacccgaaggaacagcacaaatgtcgcacaaaatattgtagaagatgcaaggtagccaattttattcaaaaattccagcctctctgttctctttctctcttcattgctctgtgtttacttttcgtatgttcttttatttgtcatcgataggtttaccacgagaacaaagcggggtcatgtttcatccgaaagctgaatgttccggaagagcgaaatcgatatcgaattgtctgctgggatacagaaacgcggctggagccgctggacgatcgcggtcatcgcgtgcacaaagtcaattatctatccgcgcgtgtgctgtgcaccgactgcgctgatgccgacgccggtgcgataggtcagcctgaggaccatcggttgccagcggaggattgtgaaatatgcaaaaatattgacggcgtggtggaacgagcgaaagattggttagcacagcgctaagagttagaatcatatttatgttattactatgtcaacataatctaagctcattcattatctgatcaacaacaacaaaaacaactaaaccataatttatgctctctctctctctcaggtccgaagtggacgggcatgagccggtttccgagttcgtggaatggattctttacgcttgggacaagcgctttacgacctatgtttgggtaaaacacaataaccgtagtaaagtgtgtgtgtgtgtgtgtgtgttccaggcccacaacgcgtcccgttttgatggtcattttgtgctcaaatatcttggcgaaacacggaggcgacccgatgttgtgatgaacggactgaaaatattcgaaattcggctacaaggttcgcgcgtgcactcaatgctgatttggcgtgactcgtgcctgatgatgccaatacgtctcgaaagcctgaaaaacacctttgacctcaactgcgctgacaaaccattttttccttacgcgttcaacaaaaggttggatgtgtgatgggcaccgctgactatgcgctgtttgtattgtttttttttgctgtagggaaaattacaatgttcatctgccaaatcttcctccgttggtcgactactgtcccggttcaatgagcaaagacaaaatggagaagttcatggcatggtagtgtgtctgttctcacgctgcacttgaatttttttgcagcaccaaacaaacatacaaacaaacaacctctccaggtacgaggaaaatcaacacacgccattccacctacccgacgagctgcgggtgtactgtcagaatgacactgaaattttgctaaaagcaatactcaaatttcgtagccttctgatgtgtaaggtgacgagcgggtacgatgtgctaccggtcagctgtacgattgcgaggttttttaagcatacacgggcgccgaagcatagtaatctgttttcccattaagcgcatgcatgaacctatttcgtgcccggttcatgaaggagaagcaattggccatagtgccagaggcgggctatgagcgaaacgatcgggccagcgtcatggttctgtttattaaaattgaaaatatcaagaaataagaaatgttaccgcatttccaggccattaagtaccttgactggcgcgcaaaaagtgaagggctccagatccaacatgccggaaatgggggtgaaaaacgaattcgtaaccacaagctggacggctggattcaatcacaaaataagtgtattgaagtgctcggatggtacgttaaataagggtgctgctataataataataacaataaatgttccaagctattggcacggttgcgagcggtgttttgacccttaggataagctggtcgatggcaaaacatgtcgagagcttaatgaggccacccaagatcgactacaccagctccgagaaccggattgcacgggagagtgcatgacggttgaagagatttgggtatgttgtgatggttgatgacccaacaatatcaattctaataatgattcatttcaccgtgtgcaaaccaaaaaaaaaagtgaattaaggagtgtgaaattaacgccttgctgtctgatgcagccaatcatcaaatgagagccttcttcggcgacataggcaacgagcgaggcccaattgatcccagatcggcatattttggaggtaggtgtggtacacatttgctgaggtgctctcatgtcgatcggtcggtcagtgggtcggtcgtttgatgttcacaaaacaattcaggtcggacaggaccgttgaagctgtttgccgaaccaaaagaggatgaaaagatatcggtatacgatattgtcagtctttatccgtgggtaggttgtcatccgaatcagcattatgatatgctttttctgaatgttctgttttaggtaaactacgataccgagtatccaatcggagtacctaaaattatatacccgtctgctgtacagatgttg

SEQ ID NO: 77997 - DNA, 1410 bp, Heterodera glycines
  Genomic contig location: Contig_ID=SeqID_2128; Location=1016..2425; Strand=-
  SCN-specific regions: Sequence locations=1-120,142-307,333-550,605 -658,682-702,732-1126,1150-1155,1186-1410
atgatcgggctgaagtggcacaagtgttcagcaaaatgctcaaaagtgccgggtgattcaaattggcacaaatttacattaaatgtcatcattaccgatgccgggatcgttcaaaggcgtagccaggggggggctgagggggctaacccccccccccctcccgaaatccaaaaaggcgcctagtggcaccgccggacccctattttaccatatttttggaaaatggagacaaaaaagacctcttcattggataatcctaagtgttctctcgattagcatgcaaattaaaaataattaagttagggccaaaataattaaaataaatattaaatgttttggccataatttttgatagtaacaattttttttttgaaattttgcacaccaatagagaaaacaaacaaaaaaatttattagttgcgcaaaacaatgtcggccgcggcggcgttcacggcgtgacggcgaaacgaaaagctacgcattaattatgcttcaaaagacgggcgaaatgtacaagctgacagttcatgtttttgccgttttaataggcataatttttgtaattacttttacaaaatcaatttttataattattattaaaatagggacaagagatcattatcatcagcacaaaaaatcaacagattaatagtttaggattaaaaattaagttggaaaattgaaaaattccgtttttggcactttttaaaaattgttaaatttaaaaaaaacattccatgttttcgagcagtctcttcagcctgaattttccatttatccctctaacaactgtacttagataccacattttcaaaaaagccataggcaaagatttttccattttttagcccctcaaaagaagggctcattttttgggcttacagtaatttagcgggcggtgggggaaggccctattttaaggaatacggtagcatttgccaaaaaattccaaatactctaatgctacacttagtatacatattttctaaagccatgggcgagtgtttttccaatttttttccaaagcttgaggggctcaattttgggcctacagtaatttcgtgggcgacgggggcatatttgaaggaatacggtaatgtgtttttaccatttttaattttgccaaaaaattaagccctttttactggaggcgcggccggccttgtgctgtccctcatctgctccctggccggcctggtccaatcatgtgccaacatctgttgcggatgcccaagcaaatttaagccgaacgaaggctgcctgagcgggctcatcaccggctttggcctcgttggttacgcggcactttggctgatcgaagtgccattcacattcaacagtccgatcagtgatcacaaggatttgcgtgaaaagctgcaggaggcgcttgatgatatcattgactattga

SEQ ID NO: 77998 - DNA, 1352 bp, Heterodera glycines
  Genomic contig location: Contig_ID=SeqID_2128; Location=4804..6155; Strand=+
  SCN-specific regions: Sequence locations=1-240,291-322,363-760,782 -960,984-1159,1197-1235,1257-1277,1299-1324
atgccgccattgcctgccatgggattgccaaatgtggtgccaaagaatgtggcgaagacgccgaccaacggaattatcgccgtgccgcccattcccgccactgtgccggcggcaaatgtgatggcatttggaatgcgaaattccatcgctcgggtattccatttttttatttgtgaattaaatttcgcaatttcgttaactgaaatttcgtttatgccttggaattcaattcctaacatttttaggccttaaaattccttttcttgaaactttttggagttttgtgttttcccaatttttttgagcctctggtttgaatttcctgatttttaaaaattttttaggccttcaaatttcctttcctggaaatttttgagtttcatgtgattccgatttcccatcgaaaaccccatttttttcttattgttgtttatattgtctggcgtaatcaaggcgtgccgatggctcagttggtttgaacaaaaatactcgtcggtatggaagagcgccatgggttcgagtcccatcggatgaatttcattttccacacaccaaaatgttttgtataccattcacgttggcatccaatgagaattctgatcagttttgcatttgattgcactgcactgatcagatggttacggatgcgcaaattgtacggctgtacttttaccgacgggattttccatgaaattctgttaaaatagcacagaacaattttttaaatattagtgagaccgtcaaaaaaaattttttttgcaatatttcaatgctttcatcaaagcaaaaaatttcaggaattttttttaaccgatttttagaaaaatttttgagaaaaacttgttaataactcatccttgacttatgaaaaaagcattgaaaattttttcaaaatttttttttcttgcaattttcgtataagaaatttcctaaaatgcaccccaaatttgaactctaaagaatttttttattaaaaaaaatttcgggcattgaaccactgcaagtttaaaaaaacgcattttttcttgttgcctcaccctctaatttgaccatcacagaaaggcacaacggcggtgcccggaatggcacagcgccgcggcgcactcaccaaatccgccgcggctgctgcgtgcgcacacggcgtgtgcggcatcaacgtggcccgcgctggcggcggcgccgctgcgcggccggccaacaacggggcggcagccaagacgtggcagatgatgcaccagcggcgtgagcagcggcaggcgttgtcaatgcgtcgtgcggcggcgatccccccaagtgccgcttacttatccgccggttccaagctgtaccagcaacaacagcagcagcagacg

SEQ ID NO: 77999 - DNA, 806 bp, Heterodera glycines
  Genomic contig location: Contig_ID=SeqID_2129; Location=1523..2328; Strand=+
  SCN-specific regions: Sequence locations=1-229,253-674,710-806
  Gene Ontology: Mol. function=ATP binding; Cellular component =membrane; Biological process=glycolysis
atggagctggacttcaagaaaggccttgacccgttgacaggtggtcgtcgtactcaaaatgttaaaaaattgtcacggtttttgttgggataatttgttttttggagggggggggggaggaaaattttttgaaaatttatttggttttgacataatttgtttttatttggatatacattatcagagatggtcccagtggtgggcaaaatacgcagggtatacccctttaattatttttcctaggaaaatattaaattttttttcagaaatttttggttactgtttttttccgaattcaaatcctgttttttccgtacttctgctgtttgtttcgggtgggtggccgcaaatttttccatttattcccctataaaaattccaaaaaatttcggtaattgtaagtttcaaaaataataattatgagcaataatgctcgaaaaacaagtttttccggtttttttggccgtaactttttttaaatgcacaaaaatttttgtaattttaagactaataaaaaaaaacaattaggggctctcaaaaatgtatagcaaagattgagaaaaattttgtccatttgtatttacttctttttccatttttcagcgccgaccgcttccgtcaaaatgttgcccacttacatccgtgccattgcggtcggtgaggagcacggcgaattcttggcactggacctgggcggcaccaactttcgcgtgctgctcatcacgctggagggcgactgccggtcgacgatgcaaagcaaaatttaccgtgtgcccgaccacatccaaaagggcaccggcacggcg

SEQ ID NO: 78000 - DNA, 163 bp, Heterodera glycines
  Genomic contig location: Contig_ID=SeqID_14023; Location=2530..2692; Strand=+
  SCN-specific regions: Sequence locations=1-163
atggccaaattgtggctgctttccctcgcctttggcattggcatcgccccctttctttttgccgtgtccctccaaaaggccaaagggacgacgcgaaaatggttggccgaacacatggacgaagtgatcagcgaaatggacttggccaaagcatacggagcac

SEQ ID NO: 78001 - DNA, 921 bp, Heterodera glycines
  Genomic contig location: Contig_ID=SeqID_14024; Location=258..1178; Strand=+
  SCN-specific regions: Sequence locations=1-766,788-921
  Gene Ontology: Mol. function=phosphoric monoester hydrolase activity; Cellular component=cytoplasm; Biological process=MAPKKK cascade
atggcaccgctttgtttccaagtgaacgaatattacgcgcagatttcggagttggtgcccggcctgtacatttgcggggtgaccggactgacgccggccaacatgaaggccttccgcatcgagttgatcgtgaatgccaccagggaggtgccgaacctgaagagtcttggccatatccagcggatgaagctgtgggtggaggacacgacggatgaggaccttttcccgcactttgacatcgtggcagatcaggtagagtctctatgatcagcagcactgatcgctggattgatcacccatggccgttgcagatccatgccgtcatccaagaccgtggtgccgttctggtgcactgcgtcgccggcgtttcccgatccgccgccatctgcttggcctatctgctcaagtatcggactcggtctctgagagccgcctaccatttgatgtgctcaaagcgtccgatggtccgtcccaatcttagcttttggcgccagctcatccactacgagcaggtcactcgctcaatttgccatagaatgaccaaggcatttggggtttcagcaggtcaagggcaatgtcggctcggttcgcatcgtgcgggacgaagcacagcccgacaaattgctccccgacgtaagtctcggaagcggcactcgagaatccggacatttgttccctttcaaggtctatctgaagatcgtgatccccgaccagctaagccgccctctgtcgccgaccaatgccaccgatgcgtcgtccccccaatccgtgccaaagtctcccttttccgacgagccggcaccagtctcgcaactgccgctgagccggcatcgcaggaacagttccggcgggtcggcgcgtgtcaaatttgtgcccgtgctcgaagtgctcactgaaatggcggctgagtccccggcgtga

SEQ ID NO: 78002 - DNA, 1155 bp, Heterodera glycines
  Genomic contig location: Contig_ID=SeqID_14025; Location=198..1352; Strand=-
  SCN-specific regions: Sequence locations=1-68,91-405,428-842,864-1155
atgtttccaaaatggacatttggaaggccaatgcgacaaggtgcaggaatggagacggagaaacaaattgccaattccaaaaaggaaaattggaaatttacgaattggaacggccatgaaagtgaactccgcttccttttcaaaaccgacgtggcggtagatggcaaagacatcaaattcgtactcgacagcggggctgaaataattgtgatcgatgaactatcacatgaagtcatcggcagcccccgactccgcaaatgcaccgaaagtggatgcatgttcgatggaacacaagtcaaattcgtcggaaagggagtcgcaaatttcaaattccgcgatatttgcatcaaaagcgaatattatgtggcaaaaaggggatcgctaaatttgctaagcgtgcaaatgatggatgcttttggactgctcaacgaactcaaggccaaaatcaatgcgccggtaaatttgtgccgagtcggagaagagacacgaggtttcactaaaactccaaaatcgccacaaaattcgacagtccaatcgcacatcgaccatctcaaagcgtcattccccgaaattttcaaaaacgaattgggccgttgtatgaaatttaaggcgcatctgactttgaaagcggacgccgcaccggtctacagaaaggctcgcccagtcccatacaacgctcaagaagcgattgatggagaattggagcgatgggagaaaatgggtgtgattggaaaagtcgaatacaccgaatgggctgctccgattttggcggtgaaaaaggccgacggaagtgcacgcctatgcattgactactccactggtctgaacaacgcccttcaggaccaccaacacccgctgcccttacctgaggatattttcgcaaccctaaatggaggaaaatatttttcgcaaatcgacctcagggatgcatatctccaaatcgaattggatgatgaatcgagaaaactatgctcgatttcaacccatcatggcaattacgaagttaagagacttccttttggcgtgaaatcagcgccagccatcttccaatcggtaatggaccaaatcttggcagaatttgaattcgccacagcttacttggatgatgtgatcatcgtaagcaaaagcgtcaaagagagcacgctgatcacttga

SEQ ID NO: 78003 - DNA, 421 bp, Heterodera glycines
  Genomic contig location: Contig_ID=SeqID_14026; Location=4..424; Strand=-
  SCN-specific regions: Sequence locations=1-58,80-334,356-421
atggcacaagccaatattcaacaattgctggacgcaattagtcaactcgtcaccgcacagcagcagcaacaaaacaatcaaccgaatccgaacaataatgttccggtgctgcctgacatttcggtcttcgaaccgaccgacgaaaagggacgaatttcggaatggatcgaaaggttttcttttgcaatggactgttcggcaccaaacgcaactgacgcagtgaaagtaaaggcattaatgaacaaattgtcggaaacggcattcagtgaatattccaaatcatgcctgccgtcaaaagtgaccgacttcgacttcacccaatcaattgaaaggctgcaaaagctttttgcaaagcctcaatctgtcttcatcgatagatatgagtgcttgatggcctcgaaaaccgaaggagaagattttc

SEQ ID NO: 78004 - DNA, 1409 bp, Heterodera glycines
  Genomic contig location: Contig_ID=SeqID_14027; Location=1304..2712; Strand=-
  SCN-specific regions: Sequence locations=1-949,971-1174,1198-1409
gaacaatatgaggcgaaaacgctttcttggacattggcatgtgccggagacgagcacaaatgctgctccgatgtggtcgtggccgacttggacgccgtcctggaccgatcaggcatcgggctcacgaagatagaaaatccgctcaaagcgctgttggcaatgtttctgctgaagtctgaagcggtcgcatcggcatctgctgccaaaaagctcatttcgcaaattctggacacggatgccgattgggaactcgcaacatattgcagtgcccgagaagacgacgtcaaaaacggcacatttccatccgaatcggacgtggaaagcgttttgcgaatttggatcggccactgccaaattgcccgaaaagaagtcgaaaaatcggcatttgggccaatttcaattgagctgccccaaggcctatcacttctgcccgaaactgaaagagaaggcatgaggaaatcgctcgaaagtgcgccatttttgctggagaagctccgtgccacagaaatccaaaagaagacacttgtcaccgccgaaagagtgattttaggcgattcaaatgcctaccaattgaagaagctatggccaagatcagcatttgttggagtgcaagaaggatcaactgccgaagtgatcagacaatttgatcaagtggggctggcctcaaaagtgaagtggctgattgtgatggttggaaaggactcaattttggctggcgattcggtggacagtgtcatcgaaaaagtgaagagactgcgccaactttgcctccgatttgcgcatgtgaagatcttctggctgttgccgccttttatctacaacaaaaaggccgaatctgaagaattctgtggaagaatgagggcgctgtttcggaagaaaagcgaaattgagctggtggcagtgacagaagaaggaagaagtttgctggagatttggcgtttcgggaagagttttaacaatgaacatgttaatcataacggatggatgacagaaaaggggctgaaaacgctgaatgcctggctcacatcattggttccgaattttccgggcgatcgagagctcgggatcagaaccgtgaagtcgaaagtggtgaaaattggtgccgtgaagggtggtggtccaggagacccttccttaattcgtggcaatgcaccagagagaaatgtgagaggagaaggcccaggtgacccctccccatctcgaacgattggcatttctgacaatggccccacaggttccgcccgaccaatgaccaatcaaaatcgcgggtttgagtttggacgagtcggcacaggttaccgctcggtccctcctccgacgttccgtggcccgtcttcacgtttccatccatatcagcaaagtcgtggtcgtccggcgttccatccgactccgatgaatcgtcgcaatcg

SEQ ID NO: 78005 - DNA, 355 bp, Heterodera glycines
  misc_feature (314)..(314): n is a, c, g, or t
  Genomic contig location: Contig_ID=SeqID_14028; Location=36..390; Strand=+
  SCN-specific regions: Sequence locations=1-355
atgggcaccccccccactgaagttaaaattaaatatccaccagattatttgtaagggttaagtatttatattatatatgtaactacctccatccttatgcagattattacatatattttttagcaaaactaacaaagatagtcaaggattaagaattccgtctctaacaatgattttttatatttttaaactcacaacctctaacccgcgttctccagacaccctggcgtttgtgcgcgaaaatcatttcgcgctctgcgataagtagggtgggttaactacttatgacccttcaataattctaatcaatgagncctggttaaactccagaaatacggtagacgcggaacttaca

SEQ ID NO: 78006 - DNA, 1224 bp, Heterodera glycines
  Genomic contig location: Contig_ID=SeqID_14029; Location=570..1793; Strand=+
  SCN-specific regions: Sequence locations=1-288,310-590,612-992,1014 -1075,1121-1224
atgccactgatcttcaagccaactaaaacgtcaaatagccgtgctctcgttgagccttctcgtcttctgaccgatgatgaaatttggaagcaaattcgtagtgccagtcgtcactttgtccgaccgcaagcgcaaaatgccgtcattgtgagcccaccaagtgcccctcaaatcgtagaggaaagtgaggcggcaattgatcagggagggtcaattcagaatttgggtcaagtttcactgtcgcctgctgtcaattcggtccgcgaagtgcccaaggaatatccggcgctacatccgcgctacttttccccgaatttccgcggtcgctctcccgtccgtcatcgctcgactccgattcgtgctcctcctccgcgtcgccgttggtcgccgccgcgtcgtcgtttgtcgccattccgcaagtctccgcgtcccgcccaacgccatggtcccccgtctcatcgctctgaaatcgacacccgccactcttcggtcacccgcttttttccgcctccgccgatgcctttgaaccgcgttggatcttcaaaagcgcaaatgattccaccgtttttgacccctgagcaaccaccatcccgaattcaaaattttgaaatgacctataaccattgcactatgacccaaaatttttccaaaatgtgatcagtgattatttttgaattgttgtttatgtttgatttaaattttttgttggtgtggtgctgtttttgggtcaaaaacttggttctcattagcgtttttcctagttgttagtcgttttggcacttagtcattgttcatctccaattagtccacactcaaataccaaaatcattgcatcgagcggttcgggcaccgtatttgttgcatttttggattgttgtcatggttacaaagtaagtgccaaacattgaaaatcgtataaaattaagtacaccgtacggattcgaacttgcccctcccccctcataatccccatttacgccatttctacagaattttaaaatttttatttacttcgaatgccgaaaaaactaaattaattcttcattttgtaatgttctttctattgactttaaggtataaaaatctaaaaaaattttttgtaaaaacttatttaaaaattctttcttcatctcgcacaactctttttttgcttggggttgatgattcgcctcagatggtcgctctgtgctaaaaggattccctgctttataaatttctggtaaa

SEQ ID NO: 78007 - DNA, 2140 bp, Heterodera glycines
  Genomic contig location: Contig_ID=SeqID_14030; Location=182..2321; Strand=-
  SCN-specific regions: Sequence locations=1-149,171-243,265-275,298 -356,379-445,468-503,554-602,633-775,799-1480,1504-1513,1552-2140
  Gene Ontology: Mol. function=7S RNA binding; Cellular component =cytoplasmic exosome (RNase complex); Biological process=rRNA processing
gaatttacggacaaaaaattgggtaggaacagaaatgtgagtaggaatacaagggagtggaaggaggaacgtgatcgcatcatcattatatgaaataaattgaaaatcctaaaaaatttgcgaattaggatttggaattaatgacgaatcattttttagtaaatttaaaattgctcctaaaggttgggctcgattacaacgatccaaaatctaggcccaggtccaaattggatttttcttggacctgaattttgtcccgaaaagccaggtccaagtctaggcttttaaataaaattaatttacggatattcaggttttactcaaatcgttaaaaaccaaaagctataaatgagtgtacaaacaaataaatgtacatatatgcatagagcataggtaaagcattcaagcgtgtttgttcttgtgcttttccttgctttacgcttgttcgcttttcctttcttcctgcttaataacgaaaaattaaaatttgttttggcattatgttttattcaaataaataaaaaattaagttttatttcaacttttaatttttcaaaaacccaatcccgtaattcccagtcactgcacttggcccaattgaaaaactagttttattattattattttagtccaaaactctttttttccatttttcgtcgcaaatgccagcacggaaagccaccaaagtcatcgccgacaaaaataatgccaatgactctgtaatgattgtggacaatgacgatgatggtacttcgcctgacaatgttggcatatcggcaacaacaacaaaaatgccaaagtatgctgcctcgcaacggcaaaaattagtcgcaacggcacctccatctacggcgtttgtcgcttcaattcgaattggcagtccgccgcccgggcgtcgggtgctcgctgttgccgatgcagttggcatcagcaatgccggcacgtcatccgctagcagttttggccaaaatttgctccaactaacagtgccgggtgcaatgatttgtccggaggtgggcgaaaatgctcgaaattttaattgatttttcagaaatttgctattttttttttgtttgtttaaaaatgaggggaaaagtttttttgatttttttatccagtgtttttttcaaaaaattcagtgacgtagcgaaaagaaggattttatggccgtttttgaccaaaaatgaccaatttttcccatttgtggtcaaatttcaaaaaattattgtacaatgggatccgcgaaattttttttggtaatttttatgaaatttgtccattttttcttgaaatttttttagtgcttttttcaaggcatcccagcccccctccccttcccatttttaggccggttatatgcgtggccatggcacatttccgcacgaaaatgcgctccattcacaattggccggaattgtagtccaaaccaacaagttgatcagtgtcaaaccgatcaagagcaggttttgttttgttttttattcattcattcgcccattcaaaaatcgaggttttttgggtctgttttttaaaaaattcttggaaaattttctggatgatcttttcgtccaattctaccatggttccagtccaaaatccggttaataccaatgatttacaggaggaaaccattcacagtaataccctgaagaataacgcatcttaacacgggctggatgcatttttcgtaaaaatacccgaaatcctgttacctcatacaaattttttacaatttattaccagggagcagctcccctcgaaaaaatttttagatgaaaattttatgacgaattatcaagttcctcaaaaaaaattttcatatcccgaactttaaaaaaatttcattgttttcttataaataaaaattttggcggtggagggaaacgtacgtaatacacccttattactgcctcccccttcctaaaaaggtaccacggcgatgtgggtgacgtggttgtgggccgtattgtcgaggtgcaacagaagcggtggaaggtggacatcaactctcgccaacatggcgtgctgttgctgaacagcgtcaatttgccgggcggtgagctgcgccgcaagtccattgaggacgaactgttgatgcgcgagtatttgcgcgagggcgacttggtcagcgcggaggtac

SEQ ID NO: 78008 - DNA, 358 bp, Heterodera glycines
  Genomic contig location: Contig_ID=SeqID_14032; Location=1553..1910; Strand=+
  SCN-specific regions: Sequence locations=1-40,245-255,285-289,311-358
atgcttattttggaagtcaaacccgcaaatttttatggtaatttattaatcaatatatttttttaaaccttttctagcaagttattaattttattagtttctgttttttatattaatttttagttttttaactcaatttcattttattatttattttcttttttattaattttaattaatttattgcgtataattttagcattagtcaaattaatttaatttctctgtttattttatcttttttctaaaaataaatatttgtttatttagattttctatttattgtgacaaataaaggaattaaggatttctgaactaataattttgttatgatttttttattttaaactttttatga

SEQ ID NO: 78009 - DNA, 2891 bp, Heterodera glycines
  misc_feature (25)..(25): n is a, c, g, or t
  Genomic contig location: Contig_ID=SeqID_14033; Location=1..2891; Strand=-
  SCN-specific regions: Sequence locations=1-153,176-197,226-310,354 -451,483-874,904-962,989-1030,1057-1062,1086-1230,1284-1322,1344 -1681,1703-2093,2116-2132,2178-2506,2528-2549,2571-2688,2710 -2762,2784-2891
aattatttataataattaccaattnatgattattaagctctccaaacggtgttcacttttgtgattatcccggcttcaccgtctgttgtgtttcaaaatcgcgttgcttaaacatttcaatgttcactattccggcaattttcgcttctctcgtcaatgtgttacttatggttttgctggtgacattttgccagaataattaaaaaataaatgcataattaatgtcaaattcaaataattttttaggtaatgcgctttcgagaaagtcatgttgggataacagagcgcaatgaaaacaaagtgaaaattcaaaaaaatattttaaaagttaaaaattcattaaaatttttaatcaaattcagacaaatgtttcgttaggtttgaatgtgccgaaagaattgcctccgtatgatcgttgatattatatttccattttttaagcaaaaataccaaaatttttaattaaaaaaaagaaaatttatgttttttgatacatgaattttttttagcgatgtatattgtgaaaatcaaaaattttagtacacaattttggcattagaacaggggtgcgatctgtccttatttgtaagatttgtccttacttattttttggtcttgatgttcttattttgaaaatttttcgatcgcacccctgcattagaactgttttttattatacaaatcttaataatttgaaccttttcatagcattggtacggcttttgccatgttgatgttcaaatggtcacctgttgatgtggtgttctatgattcattggcacatgctgtacgcggtgttgttgcactgcttgtctatgtggcatacattatttttgattgcgggaaaaagtaataattaattaatcggttcaagaatttttaaaaaatatttcaataattaaagctgcaaattttgcttttggcaattttgaattttttgcacttatttgaaaaacattgtgaaatttattaataaaaataaaaaatacacccataaaagtcattataaaggtttttctgaaaaagtcacttttatttattaaaattttaaattttgtgactttttgaaaattaaatttgtgtggcccatcttatggcactttcgcttagattgaatgatcgaattgtgtgcctattctcattggtggcactgtttctgttccatctgctcacatattcttggccctttctgtccaatcaagttcaacttatgcatcataaaacgactggtaatttatatcttttttattttatttttactatataattaataaaataaaaatgagcaattcctttgaattaatttttttttcaatttatacgtaaataaataaaatcattaagttctagttatacaattttttcggtcctttagctgtatgaataagaagataaaaggtaacccgcccgccggtggcactcaaacccaggcccttccaaatcgtggaatgcttttaaccaactgaactacgaaagaggtcctggttttttccatgtccacattctcattccttatgacatcaccacacatataatccggaaaagtatgtgatcattgagcatcgggtcgcggaatcatgggccgaaatagaagttttaagcctaaaagttttagcatttttcttacctcagctaggttattggagggggatgtaacactgaaattttcatataaattttcagaaaattctactacaaatttgggaggctgtgacttgagcaagtacgcctggtgtgccggcttgacacgggtaaacccgtggctttattacggcgccattgtgctgctgattggaccggcctttcccaacatcaatgtggccatgaacacactgttctcgcgcatcatcgggccacggatgcaatccacggaacaaggactgttggaaatgcatggcgcaattgggcggctagttggcccactgctaattaggtccagttttgttttttttctaaattaagattttactggtcaagaataaattatcagataccgtattttctctaattatatgcccgtctccaattatctacccctttcggagtaggttgaaaaataatctctccgtctctatttatctgcccggggggataaatagaatttttattttttcgaaaaaaaacttctattctatttttataaaattaatttattctaaatttaaattcatttaaatcaggctcccagttatgaggctttagcttcatttggtggttttttgatgggtcaatgaggcttaattttcaaaatgaggctttgaggctttttttgggtttttgagaaattttgaggctttgtggaaaaccgtcagaatctgttaaattttatgattaattttgataaattggcataatgtttgacaatcatttaataatttgggtttttaaaggagtgtcaaaacgaaaatctcacccaagttttccaaaaaatttgttaaatttttcacaaaaaccagaaaataaccaattttccgaaaattcacaaaattaagaatttttatgcttatttataacaataaattgaaaacacatataacattttaaacgtgtttttaaaaaaatataaaaatgaggctttttaacccaaaatgagtcttttttgcatgccaaatgaggcttttaaaattttaatctgggagccctatatatttaaaaatgaaaattcccgtcttcattaatctgcccgattctgaattttccccctttctgagggggttgcaaagtaatatacccgggcatttaattagataaaatactcccgattttctttatttttaagctttattccactaacattgtccaaccctgaagtgagttttgaatttccaaaaatttgcataaatttcccgggctcaaaaaaagaaaaaattttcaaatttaaaaaaattcca

SEQ ID NO: 78010 - DNA, 228 bp, Heterodera glycines
  Genomic contig location: Contig_ID=SeqID_14036; Location=174..401; Strand=-
  SCN-specific regions: Sequence locations=1-228
atgtcattgaaccgtttttgtgccatttgttgttcccaaatgtatcggcgccattggtcacaaataattagcaaatatttattggcaattattcttttgttcgctttggcaattgctgcaccaattctttggcattctgtgtgctttcgattgtctgaagtgagaacaccgcttgggcaaggacagcacaaaatggacggccccgtgttcatggaaattccaacacaa

SEQ ID NO: 78011 - DNA, 534 bp, Heterodera glycines
  Genomic contig location: Contig_ID=SeqID_14036; Location=1437..1970; Strand=+
  SCN-specific regions: Sequence locations=1-288,312-435,457-534
atggtaatgataagtagggttgtaaattatatggacaaaaaaacggtaaatatggacataaaatatggactaaaaaagcccgaaatatggactaaaaagctcaaaactgtccaaatgtggaccaaaacatggactaaaaactgccaaaataaagttttaaaccccaaaaaattccaaaaaaggtttatatattcaaatttgcttaaataaacttaaaaaataataaacaaccaaaaaatggatttaattaaaatgccaaaatgacgacgaaagcacaaatttttcatattttttggggtgtaatttttaaaaatttccaaaaagtcgaattttaggggtgtatttattgcttttcttgcatttttcttgtgaaaattcgccaaaaatggccaaaatatgggaataaaaaagcaaaaatggtgaaatatggatttattcccgaaaacccttaaaatatggatttatatggactaaaaacattcaccaaaccaaaaaattttaacgcagaaatgctatttttgagcccctttccta

SEQ ID NO: 78012 - DNA, 918 bp, Heterodera glycines
  Genomic contig location: Contig_ID=SeqID_2130; Location=1742..2659; Strand=-
  SCN-specific regions: Sequence locations=1-266,289-697,719-736,760-918
atgacagcgttcccatccccagtgtgtgactgtcgcagagaacatctgatcagttcagcaaaatgccaacttcgctctgtgcaagaattggagagacaggcagatcagttccagcagctgacacaaggcggcgacaaagcaacggcagaggctcgggctctgacgatgggcattgtttgtgcacctcttctgccgtccatcaattttgagcagatgctgttggccccattccatgtcttccagggcctcggaaatgcgttgatcaaggagttggaaactggagaaaatgccgaaatcgcccagcaattcttcagacggataggggcaaggagggaagcgttcagaaagcgagacatgacggggaacagcatccggaaaatcctcgtccatgccgatcaaatggaggcccttttcgagacggaatgggccaaaacaatttgccaaacaatggcacatttggggaaaatccaaattttcaccaaagtaattggtttcatttttgtattgtttgtggaaatatttttttaaatttaaggcccagccattgtctccaggtgatttggacggattggagacggcggttgatcagttcaaggcatttatcaaccaacaaccaatggtgcaaaaccttctttcaaaaaagacaaaggcccatttgctgctgcaccattttgttcaatttgcgcgccaacaccaatttttggggcttttggatgagcagggttgggccataacattttgggggttcaattttaaatgttgtgattttcaggagatgaggcactgcactccgtgtggcggcgacttgagcaactgtggaagacgatgccggacgatgaacaaatgcgccaacagctggagcatcatttcgtctcgaattggctgctggacaccggcagactcgacgaattgaagctg

SEQ ID NO: 78013 - DNA, 526 bp, Heterodera glycines
  Genomic contig location: Contig_ID=SeqID_2131; Location=949..1474; Strand=+
  SCN-specific regions: Sequence locations=1-65,88-375,398-526
atggaaaatgataaagatggacctaatgactatgttcttttggaggaagttggagcagcaaacaaaaaacttgacctctgtgaaacgccatcttttttacgttattttcaattcaaaagaggtgatgctagtgccagatgccgaatttgcaaagcccaaatagcgcgaaaagatggaaacacgtcagggatggaccgtcacttgaaacggcacattgagttaattttaatttcgtttctttttatatttttttagaatttacaaggaatttgttttggcaaagtacggcaaaatgcgttcaaaagcgcacttctttttttgatgaatcaacatcacaaaagccaacgaaacaattatgtttagagaatttccgtgagaaagaaaaatggacaaatgcgcatcgtaaatctcagaaaattgattcacttaaattacgctttatctgtttgtctgttgaaccaatccaattgacggaaaagaaaggattttttgagactttataagaagcatgtccaaggtaaaaaca

SEQ ID NO: 78014 - DNA, 652 bp, Heterodera glycines
  Genomic contig location: Contig_ID=SeqID_2132; Location=43..694; Strand=-
  SCN-specific regions: Sequence locations=1-372,394-652
atggacaccggagagacgaccccgccaccgctggccattgacgagcgatcagagcgcatcgaacaactggagaagcagttcaaggaccgggacgacaccatcaaatttctccgcgagcaggtgcgcaatcgagaagcgctgatcagtgatctccgtcggcagctggacgagcacatggtaccaccgatggcaccaccaacgaccagcaaaagtgagtgaactttttccttttttaatttcataaaatctgatcattttttcaattttagcaccaccaaacagaggaagaccgaagaaaagactggatcaactgcagcgcagcgccaggcgcgacatcgtcgaccaaattgtgggcgtcatcgatcgtgatcgctcgcgttccgcgagccgcgcatctttggaccgaatctaccgagaaatccgccacaaattctcgcactacacgccaaagggccaaaagctgcaggagggaatggaagcggaggatggacttctgctgcttgcccagctcgggacgcagatggcttacaacggatgaaggcgactctaaggctgatcgacaggcgctttgacacttttccaccactgagaaaggtgcagtttttcattgatttttttgttttaccaactttttttgggtcgtcgaaataaa

SEQ ID NO: 78015 - DNA, 1903 bp, Heterodera glycines
  Genomic contig location: Contig_ID=SeqID_2132; Location=782..2684; Strand=-
  SCN-specific regions: Sequence locations=1-37,70-451,473-704,728 -867,889-921,946-973,996-1031,1054-1196,1220-1541,1583-1903
atgatcttcatggaattccatcaatctctttgtttagatgatgatcatcagataaaaacatttcaaaatttgttgaccgaaatgcaaatcattggcattcgacacgacgaaattaatcagacaatcaaatatctcgaaaaaaagaagaacgagttgggcaaaattaacaatgtgtaaatggttaatcaaatcattttgagcattgaggaaatcttcaaacaggaaaaggagatgattagtggcgcttatcagttcgggaaagcattgatcagcgagaactgttcgggaaattgcaacaattaaagcgaaagggatgcttctcgtcccgaaattgcatcaccgttcggaaccaaattcagcataaacacccttttcattagcattttttggtagcaaaccaaaaaaaaacacagtcgatttattagttagttattgcttgaaaattccttttatctattttggaaaatgtttcttcacatatctccatttattagggatgtgcgagaattgatttttgccgggaaccgagaccgggaaatgaccccgagaaacgatacgagaaccgagaaatgaccccgggaaccgatacgagaaccgagacccaaaaagcccgagaaatttctcgactcgggaaccgagaaatcttaatggaattaattgaaatcagttttttaatcaaaaaaataaccaaatcactcgtcaaaattgaaatgtaaaaagagttgttattttgcatgctcctccgaaaggtttgatctcttaggattatcaatttctgacagcttgctaaatgttctttctgattcgacagtgcccggcggtggtgacaaaaaatttggaacaattaatttaatgttcgggtacgttgtgcattgttgccaaaactttaaaggatcgtcatccgggttcagagttggactcttaaaatattattttataatttttgattcgttaaaaattctaccttaaaatatgaatcaatttcattttttattacaatatcaggtttgtgagtttgccatttgtcctgtttaagttccagaaaaaagaaaatctgataaaagattttcagaaatggtttgaagcgttccttggttcatatcatccaaatcagtttcggaaaaacggcgctgtggattgatgtttaattctatttaggtttccaacaaaactttattttgaattcggtcttcgaagttgaacacatttatatgatttttataccggggattgaccaaagtagcaatgataagaaacctgaaaaaagaattgtgttatacacaccatcccgaaaaacgagaagtgtaccaataaatagagagtgccagagaaaaacaatatctttttttctctaatttttttgtctccttttggcgtactatctaatattttcattattaggaaaaacaacattcacttcgctatgtttagcttcttttctatatgttagatccacaccaaattttgcaaatcgatagagaaaaaaattctgcatcgatttctatgtttattatcatcgcttaaatgttgtcttaaaaagttataagataaaaaagttaaattattattctttttaaagatttaatggctaaaagaactttattacggaagcgacagaccaaaaatgcacgccatacgcgtgagaataagcgggaggagagaaaagcgcagacgcagagggcgagacaaggccgatgggccaagaaaagtgagttttttcatcaattttatctcaaaaaaatcatttttttgtattccagccgctacacaaccaaatcccaatgccgaaatagcactgcaggacgaagcagggccgtcaacatctgctgcatcaacggaagaagcgatggagcctccgccaccaactccaggaccagtgccaacgccggagatggacgagtaa

SEQ ID NO: 78016 - DNA, 218 bp, Heterodera glycines
  Genomic contig location: Contig_ID=SeqID_14039; Location=700..917; Strand=+
  SCN-specific regions: Sequence locations=1-4,28-218
atgtggggagggggaagggtaaaggccatttccggtcccggccttacaacagtatcttccttcagttgagattgatcaaatcgaattcgaatttggtggtcccaaagttcgcctcaatttcgtcaccaacaccccacatcgaaacaaatgggtacaaagaaacgggtgaaggcggaaaagcgcagtccaacacggaatctgtgaaaaatatacaatga

SEQ ID NO: 78017 - DNA, 122 bp, Heterodera glycines
  Genomic contig location: Contig_ID=SeqID_14040; Location=257..378; Strand=-
  SCN-specific regions: Sequence locations=1-122
atggcatcgaatttaatgatcaaaggttttatgtacgatattgtcacctttcccacgtcagcgggttcaattgtccggaagtgcaatggaacacgggaatttctttgcattggctggaaaag

SEQ ID NO: 78018 - DNA, 2392 bp, Heterodera glycines
  Genomic contig location: Contig_ID=SeqID_14040; Location=266..2657; Strand=+
  SCN-specific regions: Sequence locations=1-134,156-590,643-982,1004 -1278,1317-1491,1514-1546,1593-1775,1797-1956,1980-2392
ccaatgcaaagaaattcccgtgttccattgcacttccggacaattgaacccgctgacgtgggaaaggtgacaatatcgtacataaaacctttgatcattaaattcgatgccataaattttaactgaaatttaatcttttaaaaccatgaaagattatttctattggtctactgtttttccatttctgctgttgtcattttcagcttaagcctttcctttttcccggggaaagctttacaacgaataaaaaagagcataagatttaaaaaaattattttctcacgacaatttcggaaattgtaaaatggcggagattcaaaatggaagtggagagggggggggggctaatttatgctgtcctgctctgtcatttagccaattggttttttctcatttcagaattgtcgtttactgtgaacagtttttcattgcttttccgttcgacgagtgctaccgtatcccatccacacaatttcatgccaaccataaccttttcttggccaacttttatgctaagcatttgagcgttgcttatgcattggacggcgcttatcggctgttggggaagaaagcaaagtaagcaaaaagagaataataaaaatgaattattatatttttatttatttaaaaaagtaaattttagatttgtgcgaatttactcaaaaatttggcgaatcatggaagttttgcactatttcacttcacgcggatgggttttcgagtcgcaaaatgcgctcaaaatgtgggaacggttaagcgaagaggacaaaaaggtggtagccaaatgctcacaattaagggatgcgccatttccgatagatttggacgaaattccgttctaaaaccattgggataccggcggaattcaatctggatttccgtctaattacggaattaacggcttcctgatgcttttcccctcactcattaaacacatcacttttagctttattgtttcgatgttcgtaaagtcgactgggacaaatatttgtttgactatttgatgggaattaaggtgcctaattttgttttaaataaatttgattaacttttattaaccaatttgggaaaaatgtaaaaaagacaaatgaaacttcacggggcgtggcacggcgtttcgaaaaataaattttgttactatttgaaatgtttcgacacaagaaaattcgagttgggtcaaccaaggtcctatcaatgggcatcggctgaaagttttatacttttaaactcaacgattaattaaattatgtaattggctccaagtccaaattaaaggagaaaattttaaataatttaaacaatttttagatttatttgctccgggaaagtttggacgacgtgccgagggcacaagcaaatcttttatggtcagaaagaaattaaattttgcaaaaaaacttgggctttacaggcaaaaacaattgaatttgtactcaaatggtctcttttttgctttgctcgtccgtctttttgcgtggtaaaaaataattatttttgcttttcatttacttttaaacgataataatttatcacaaattcctattaattaattttttctgagttgtttcttcatttttcattttccttatttttggtgtcatttaataattttaaaatgcttaacccaaagatggtacatatttctgaggattatccccatttgtgtttttttgaggggctcagagtttttttttttgaaaagaggatttcgttacttttagcgttttgactataaaaccagagcaaatttttcatattttttattggtttttttggcaaaaatccttaaaaattagttgtttttttgtcaaaatttgttaagtaatcgaataattattcaattttttccgatagcgcattttggcactgctccataaaattctaattaaataaaaaaatgctcataatcagaaacagaaatttgttcatttttagacatgtttattgacaagtctcacctgaattaattaaaaattttcccggcggcgctgtcaccacagccggcggaaccacccttaagaaataaactttgatgaggattattttgagatacctcttctgtttaataggctcttggtcctgtctaattttaaaaaactacaatatttgaccaaaaccttggaattgtaataatatttcatcataaatccatccgctttaggaggcgatcaaaaagacaacgctgggcattttggctcagcggctttctgctgagctttgcctaccaaaatgccaaccattggttgcgtcctgctgttcggctgcgcaatttggaggagtacaagcggacggcgctgcgcttcttctcggaggacgacgaacagaaaaatgggaacggcggcgagagagtgcggcagcggcggagagcggcagaaaacggcagaaacagtga

SEQ ID NO: 78019 - DNA, 581 bp, Heterodera glycines
  Genomic contig location: Contig_ID=SeqID_14041; Location=311..891; Strand=-
  SCN-specific regions: Sequence locations=1-14,92-284,307-419,442 -445,468-581
atggaggaagcgccggaagagaaggaagaggagaaagtggtcaatgaagagaaagaggaagaagagagggaggaggaggaagaagaggagggagcagcggaagtgagtcgaaaggggggacaaatggagggggggggggaagtgatgaggagttttattggtcgcgaaatatccaataataaacattttcagaatggcgatgaaaatagaagaagcgaagcgaacgaattggactcggcctttcccgcaatgatttccaatcttttcggcactcatccgttgcgcaccgaaataaaaaagaaaaggccgtcgcagcgtcgggggaatgccgaggaagagacatttcactcgacaaatgactgtcacggcaaattcgacgcgaaagacacgcgaaattttaattcatcgctggtggaggtgggacgagcgggaggggggagaacagaatgggaataatgggcacacattggaggaggtcagcagacacccggcactgttcgacttcacaagggacgagtacaaatcgaccgaggcacgcaatagacattgggcagaagtggcggaagaaatgcagcaaagtg

SEQ ID NO: 78020 - DNA, 383 bp, Heterodera glycines
  misc_feature (363)..(363): n is a, c, g, or t
  Genomic contig location: Contig_ID=SeqID_14042; Location=58..440; Strand=-
  SCN-specific regions: Sequence locations=1-302,325-383
atgctatttctttccatttttgcacttattcgactgaatgaagcggtaattaagcattccaaacaacaaatattttccaaaattccttttagcaatacacagcacccggggcctattatgtatatgcccctggttacaactttaacccaccgcccccgggtccgggaggtcccgggacggtggggaaaagaaacgcggaagcgccggcaaatgaaaccacaaatggcacaacggtgacgaaaagaagcgcattggcaacagaggcacatataaacggaacagagaagacgaagcgaagtgccggaacagttcaaattggaaatggacgcggaaacgcaacggagcaaggagagagagggcggnggatggagaaaaagggttga

SEQ ID NO: 78021 - DNA, 1527 bp, Heterodera glycines
  Genomic contig location: Contig_ID=SeqID_14046; Location=237..1763; Strand=-
  SCN-specific regions: Sequence locations=1-9,33-401,423-492,517 -929,952-1053,1083-1367,1405-1527
atgttcggcattgttgccacctttgccgattatatcagtgtgcgtgaggatgcggtgcgtctcattttgtccgttttggccggctatcccttggccgctgtccaccgcacattccttttcaacaaacccgcggtgatccaacattcctatttcgcttccatcggactgctgctttatctgttcaattgcggttcgttcctttttgtctgtttaatatgctgccccttgggcttcggtatttcaaattttgaaatttgagctcattcaatgagtgttgcctttttgaagggtgcctgttagagctctccctgaacatggatccaggcctgggtttttcctggatccaggtgcaggttaggcagggaaacgctggagttccttgacaatcttttagaatttgttttttcgactgaccatgttttatttcaaattatcaaagtgtataaatgtttattagtcaaagaccctgaaaatgcaatagggatttacatgaaaaataaacttaaaaattttcctttccctctttcagggcttcaaatttaccactgtttgttgagcacttttctcgtctatttgatcgtcaattttttgcccggcacaaaactctctattttacttgggcatttttgtttcttggtaagttttggcaatcgcctagatcattgctcccgaaaattttttcttttaattttttttctaaaaattcttataacgtttctaggggtgttttgaggcgctgagcacgaatccggcctccattttgacctgtttgtaacaccagacccgaattcgaacagagtcgaaaattagaatttttcgatttttagtctaaaatggtttaaacgattttattgtagcactgatgcgtatcggtgatggctttcagttcgtttccgtgtgtgtaaacaacggttgaacaaaaaagtgaaattttaaagaacttgaattttcgaatgtttgttggaatttgagatcggggttcggaattagggggaaatagaagtcgtattcatgatcagcaacccagaaaactcctggaaacatgttttcatgatttttaaagttataaaaaaatttaaaatgttcgaagtcaggtccggtgttacaaataggtcgaaatggaggccggattcatgctcagcgcctcaaaacacccctagaaacgtgttataagaatttttagaaaaaaaatttaaagaaaaaattttcgggaccaatgatctaggcgattgccgtaagttttcaatcagaaatcgcttttttaactaaggaaatcatcaagttttctttcttttattgcagggtcatctgctcatcggctattggttcgcttatcttttatttgccaaatttcatggaaacaaacaaattccctctccccccattttgggcatgctgaatccaccacctatgacatcacttggacaacgcccttttgcattatgacactccgttacatcggcctggtgatggacgtttatgatgggcaacaagctgttgcgcaacaggttgcaaagccaagaaaat

SEQ ID NO: 78022 - DNA, 113 bp, Heterodera glycines
  Genomic contig location: Contig_ID=SeqID_14046; Location=1873..1985; Strand=-
  SCN-specific regions: Sequence locations=1-13,35-113
ctcaggtgggattgaacctgggactccctttttggtggcaaactcacagaccactgagacaacaaatcaattagtttttgaactgggggctcaaaattgactcggtgtgtaaa

SEQ ID NO: 78023 - DNA, 928 bp, Heterodera glycines
  Genomic contig location: Contig_ID=SeqID_14046; Location=2374..3301; Strand=+
  SCN-specific regions: Sequence locations=1-1,23-362,384-928
  Gene Ontology: Mol. function=enoyl-CoA hydratase activity; Cellular component=mitochondrion; Biological process=growth
caaatgttttcttttgtaaaaatcacccatcgtttttattccaccgaaccgttggtaaaaaaactaacggtgattggctcgggtttgatgggcgcgggcattgcccaagtcagtgcccaggcaaacgtaaaagttgtgctggtcgaccaaagtcagtcaatcgttgagaaggccaaaagtggcattgaaaacagcatcaaacgggtggcgaagaaacaattcgaagacccgggggtgagtgacccaccaattccatcgaatttcggataaatgttaaattattgctttttttagaaacagaatgaactcgtcacccgcgctctttccaatatttccctgtcgacgaatatttcgcaggccgtgtcgggcgccgatttggtcattgaggcaatttctgagaatttggacgtaaaacggaaactgttcgcagaagtggagtcggctttgccacagtgacttacaattggataattcaacatttattttcggatggcatttgtccctttagaaatgggaaaatggccacaaacacttcttctctgacattggccgacattgcggccaatttgaagcgcaaagattcctttggggggctgcactttttcaaccccgtcccaattatgaaacttctcgaggcaattaataaagaatagtaacccatgctttttaaaaaacaattaggttgtccgctttgatggcaccggcgaagagacgttcaacgttctgatggactttggcaaaaccgttggcgaaacgaccgtcgtttgcaagttaattgtttcgactccgtttttttctttaattggcggagattttaggacaccccggggttcatagttaaccgtttgctggttccttttatgctggaagcaatgcgaatgttcgacagcggcgatgcgaccaaagaagacattgacgtagctacgaa

SEQ ID NO: 78024 - DNA, 780 bp, Heterodera glycines
  Genomic contig location: Contig_ID=SeqID_14047; Location=211..990; Strand=+
  SCN-specific regions: Sequence locations=1-271,293-324,357-444,466 -576,607-633,655-780
gcgccagatgtctgttggaacgcgcccttcaaagaagcgattcggaagctgtacaacgattggatggcccatggcgaaaaggcgacgacatcaggcggaaatctgaaggccccgccaatggaggtttacctggaatggattgccaatgcatgggactcgcttccaaagcaaatgattgccgactcttttttgacgtgtgggattagtaaggaagaaaaaggccgacacgacgacaaaattcacgtttttaaggtcctcaagaatgttaacattttttgaaattcttatttttaaccggacggagcaattcctaatgggctcgctatgttgaagcaacgccgacaggaagaagaagtactgaaactggtggaagaaatcgatttaagcgaagacgaaagcgacgaagaaattgatgcagaagtttcctaatattttttttgttaatgttttattaaaacaaattgttcaatagtttttgcacgtttctgacttcaaaagttttgaaaaaaaaattttttttgacgggggcttatattcgaaggggggcttctactcgagggggggcttctattgttcaaccccccaccaaagggggcttatattcgagggggggcttccattcgagggggggcgtataatcgaggaaatacggtaattatttttttcaaatgactaatattatagaaatgcgccacagagattgaactgagcaatccgctgactggatcatctacaacggcatgcttgtgctccgaagcgaaatcaaaggaaggaggatga

SEQ ID NO: 78025 - DNA, 1216 bp, Heterodera glycines
  Genomic contig location: Contig_ID=SeqID_14050; Location=117..1332; Strand=-
  SCN-specific regions: Sequence locations=1-166,191-193,215-354,376 -509,533-543,565-1115,1144-1171,1194-1216
atgctcggatggacattcttgaacatcagcaaattcaaaacggtaatggttttgggcattaaggggaatgcaaagtcttgacagattcccatccccccactcaaaaaaaagaccgccagcatgcggtagggatcagttccatctgagacaaatttttctggccaacattttcaaaactaactttcaaagttggtaattaaaaatgaaaattcttggtatcaagcgaaagcttagggtctcaggaatttataaatgcgagaaagggcaaacagttctaatttaatttgtaactttttacagttcctgcactttctgctcgtatggacaacaaggagggggaaatccgaagcggtaagcatagaaaaattccctcttctatattccatttgaggcagattttctggccaaaattttcaaaaaggcctattttttacaattagcataaaaaagaaagttggataatattgtcaatttctatttttggacttattggtcgaaacccgggctctaaaaaagttgaaatgataaaattaacacagcaccaaaaattaattttaaaaaattggttttcactcactgtatttttaacaaccgaaaaccctttaaacagtttatttttaaaacccttaaaaaaagtatttatgtgcattttccatttcagttttttccattggtttagtcgatttgatttttcaatagaattttttgttactatcattttgtaaattagtcgcttttgaaataagttatggccctcaaaagttggctcaaatggaattggtcaaacgacaggacttctccgcaatgggcgggaaacttgattttttgcataattgacttatttaaaaaacttacagttgaacgttcgcttcgcgcgctggacgaacgcattgacagaagtaaacaaatttgatttgattgaatagcaacaaaaacgttaatggtcaaaagattattagcatttattcataattccattttgatttttccaattccctaatttaccgtcttaaatttgttgagaaccggaaatagttctaatgcgttttactggcctgcaccagggacggtcccaggattttggtttgtggggtaggtgatgccaatggacgacgaatttaattttaaattttaatttttaaactaagaatatcattgaatactttttctaattttttgtgtgaatgcactttgttgatttattgctgaaattaaa

SEQ ID NO: 78026 - DNA, 2774 bp, Heterodera glycines
  Genomic contig location: Contig_ID=SeqID_14051; Location=1..2774; Strand=-
  SCN-specific regions: Sequence locations=1-42,64-66,98-110,133 -379,401-423,446-1588,1610-2098,2123-2310,2333-2335,2365-2394,2418 -2573,2595-2719,2743-2774
  Gene Ontology: Mol. function=microtubule binding; Cellular component =microtubule cytoskeleton; Biological process=nuclear organization and biogenesis
tgcttttggagggttcgccaccgatccgaagcatcgaatcgtttgctgtaaaagcagcccaaaatcgaaaagcccaccccttcctttccttccgtccgttccctcccaacaaaaagcccaaggcgaactttgccccttttccttctccgctgactctgaaaagcctatccattttacgtttgccctcctttcttccgcttcgagcccaagtgccgaattcgctcggcacaaccgattgccgcagcggaggacgagcagtgcgtcgtcggatttgcaattctatcgcgggcagaagcgtggggaaaagcggagcagaagtcgtccgctaaggcacggcttttgggtgcccctcggcgacgactcactgatcaaagcgcttagcgcagaagaaactgaagaatatttgaagggggacagatcggaaaggagggaaaaagaagcggaagaggtgcgaaagttgggtaaagcaaaaacagagagaaaaacatggataaattggcaaatgcagcagaagaacggcacaaaatggaagaagaacatcggaaaacgccgtcggaagagaaaccgcacgaatattttatagagtaagcaaagggagagaaagaacagaacgccagggacaaaatcccgaagcaaattcagcgacgagctgatcagcgactttgagtcgagcttggccggacgggcgcgactgggccgaacgcaagaggacttgggcaagtacagacagcgcatcgacacgaacgcggagcaccaaagggaatactcggaaatcattgccacaatgcaaaacaaagtgacggacggtgccactggcattgtacgatgcttttgcctttgacagctgctcgagtaccgacggcacattgccgacttacaacgcggcacgagtgcgacgaccgccgactcgtcgctgttcccgttgggcgactcgctattccccgcgggggctggggacatgacgacgacggattggagcgcacgttacgggcgggatgccaattacaattatgatgccattctgatgcgattggacgaggaacgccaacggtaaaacaacgacgagggcagagagagaaaaagaattgagagagacaggggaaagagtgaaaaataccgtattactcctacaacttaaaaaggagaaaggcgtagtacggtgtgggagagtataactgctgatttggattgctttttgcttttgtcagttatgatgagttacgcgtccaattggaaagcgaacggacgcaaagcgaccgactgaaagcggatttggtgcatttgcagcgacaatttgagcaagaaatgcaagaaaaggacaaccaatttcgaaacagagaaacagttgaggaaaagggaaaagcaaaataaaaaacgaaataattattaagaatttaacgcaatatttgaacgaagaacagaaaaaagtgacggacctttggaacgaattgcaaagggtccgaaggcaattcgccgatttgagagaccaaacggaacgcgaattgagcgaacaaaggcacgaattcagcagaataatgcgaaatgtgagaacaatgggagacggaagcgaaggtaaagcggacaaaagtgatcagaaaaaggaaaagccaaatgacaggaggaggaacaattgttaatacggacaatgtcctaatcgaactcatccgacggatcaaagaaaggggaggcgctgaagccgcggggaaattggggccggatttggaattgctgaacaaactcagaggggagacgacggcaacggttgagccggaattgtaccgggaactgatcaaaaagtgagaaaagagcgatcggtgggaaaatcacaatggtgatcaaaaggtatgaagaagcaaccgaacggaacattcaattggagacggacggagacgaaaacgcgagacgcgtcgccgaagtcgagaaggaactgcgcaaaacgcaggaaaagctagcggaatgccaagtgaaaatgggaaagtgaaacggacggaaaccaattaaaatgcccacagaaagccattcgaaaagtgaacgaaatgagcacccacggcacccacgagggcgagacgcgttcgcgttccctgtcgcccgccggaaatgcgctggtgctgagcccggcggaaacggtgcggaatgtgcgcaacgcgttgcggaaccgcgacaacgaaatccagcagttggaacaacggcttaaaggaaacggacgccaaattgaggaactcggcactaagctaagccaaaatgaggagacacgacgacgcgtggagaaggaattaaacggggcaaggcgagagaacggagaaatgtaagaggaaagcgaggagggaaaagacactaattaattaattagttaataattaattaggctgagacaattggaagaagcggaaagaagcagaaaacggacggaagaaaagctgaaaagcatgcaaaatgaaaaggcaattgcggaaacggcacaaaacaatttggaaaatgaaattcgacgactcaaacagtgcaaaaaagaataattaagcaattaattataatgataacactttagagagttggaaaaagccatttcagaagggaaaagaaaggcgcacgaagaagccgatgattacgcaattagcatggagacggattataaaaataggttttgagagggaagggacaaagcaaaggaaaagcggaaatttacacagaattgacgaattgaacaagcgaattggcacaatacaggaggaaaagcaaggattaaagaacagaattgacaccgttaagagcaaaag

SEQ ID NO: 78027 - DNA, 1317 bp, Heterodera glycines
  Genomic contig location: Contig_ID=SeqID_14053; Location=1..1317; Strand=-
  SCN-specific regions: Sequence locations=78-80,105-179,203-249,293 -298,321-326,456-525,551-658,689-699,761-761,837-1080,1111-1148,1171 -1189,1249-1317
  Gene Ontology: Mol. function=casein kinase I activity; Cellular component=nucleus; Biological process=signal transduction
atggaattgcgggtcggaggtcgttaccgccttgggcgtaaaattggcagcggttccttcggagatatttatttaggtggttaatttttaaattaataataatacccaatgatcaacaggcctgtaaccaagaggttccccgaaataaaaaaccaaaaaattttaaggaaaatggtgtgcttttttgaaaatttttcaaattttcgccgggatttcatttcccacctcagtttttttgttttcggcatgtatttaattatataaatactgattaaaaatctaatataataaacaatgatttggttggttttaattattcatttttaaggcgagaacattatgacacacgaggaagtggcaataaaattggagtgcgtcaaaaccaaacatccacagcttcacattgaggccaaactgtacaaaatgatgtccggcggagtcggcattccacaggttatccaaagaaaataagccaaaacaattagtgatctaactttcacgaagaaaatgatgacaaaaatttttcagaaaaccaaccaaaaaattttttggttatatttattgggtgtaatttaggatgcagacaatattttctattaaaaaatagtcaaacaccaaaaattcagcaaaaataaatgggaataaccggcaaatttgcaatatttattttatttttttttcataatttctaattgttttaggtccggtggtgtggttttgagggtgaatacaatgtgatggtgatggaactgcttggcccttcgctcgaggatctgttcaatttttgctcacggaaattcacactgaaaacagtgctgttgctcgccgaccaaatggtacatatatttttttcaacatttactaaatacgtaaatgaatttcaaaaatgttagacacatgacattttaaaatttctgcgttcagttttttgattttactagcaataaattacgtattttttggaacggaaattgttgaggattattccacataccgtaattataaaatataagccctggtgtttctatttttcaacccacaaaatggggtttatattttaggcaacatagtattaaagaattttaattttaacaaattttttcatgaaaaattgtcacctggccaagcagtagtagtacaatactacaaatgcattttctttcttaatgacaataaaatgttttttttagttggccaggatccaatacattcacagcaaggatttcatccatcgcgacataaagccaggtttttctttttttttcattttacattattcggccttgtaaaaaagcactctttttagacattttctga

SEQ ID NO: 78028 - DNA, 1308 bp, Heterodera glycines
  Genomic contig location: Contig_ID=SeqID_14056; Location=1082..2389; Strand=+
  SCN-specific regions: Sequence locations=1-769,847-984,1015-1308
atggccccgtcctgtcaatgctcctcctgtacaaggccgagttcattttcctcggcccatccatctccgtgccatgggtctgaaattggcttttcaacatgcgattcgtcgtcagcacaattttcaacatttgacaccaattccaataatcactttggggatgggtgttcatcaacggcgagttgttcagaagcgaattccgcttctgcttcttctgtcggtggtgagccgacttcatatcgcgaagaggaagcagttcaaggagttgaacacgaagagaactcagcggggcagcagcagcaagcacaaattgagcagcaacagtacttcccggcatttccaattgggccgcaaggacaattcccggcattgccaattgagccgcaaggacaattcgtgccccaggaaattccttctgcgccacagcagcaatcctttgcggttgaaaatgccaacaatggtcccgcggcgccatcctttgtgtgccaaagcaatgaggacgataaaggtggacgagaaaacaatatgatcaattcaataccacagcatatgctattccaaaaagaagtgttgtttgttcagctccctattgttgcaacggcgagttgaagcgggtgatgagggaagcatacgcaagtgccggggtgaactgtccgaggaaggaccaccccgaggcgagctgcttccactgctgcaacatccaaagattggcgaacatcatccaggtggtgaaggctaatcaattccatgataagcatggaaccgaccgataaatttaatgaaataatataaaaaatgggattaatttttatattttttatttgctaaatttaaatcttaaaatatgtgtatatgtaagcattgttgttaagcatcactgcgagtgtcggtttggcgtcactttcgaagtcgtcgtcggactgcgcgacttttccctgcacagccattactacgagaacttgttgtgcaaaatttctgaaggggaaaggttggtttttggctttaattttaccaatttttatcaatttccattcgcattttctcagccaaatcgccgcttttgccagtgcccagggcgtttgtctgccggacggaaggccggcaaattcaaataacggcacaattccgccaatgtgcggccaaggggcaacgagcaacggcgaaatgtacgaggaaaagcaccagcaactgagagacggggacaaatgcgcgggggcggaggaaaagcggacagtgcccgaggcggaggaggactatcagctgacggaggggacggggagaagcgaaacgaatgccgacgagcaatga

SEQ ID NO: 78029 - DNA, 650 bp, Heterodera glycines
  Genomic contig location: Contig_ID=SeqID_14056; Location=2967..3616; Strand=+
  SCN-specific regions: Sequence locations=1-18,60-157,179-402,425 -472,508-650
atggccattgtaatggtcgatgaacagcagcagcaccaccaccatcaccagcagcagcccgtttcagcggcggcgattggtccaattgaaacgcaacaatccgctgaagtgtccacttcttcctcgacaattcagggtcaattagcgttttcttcccttaattacatgtttaatttgtgaaggcttcgaagtgtccttattttacatgatttccccaaaactttctcaattttcattcgacccattgcatctttttgcttaattacttataataattggcaaatgcctttagccgccccattggaagcgaaggatgagccgcccgcgccttaccaattcgaccccaacgacgagttttatttggcaccgccaacttgtcaatttctgcactatcgcgacgcggctgtggtggtcggaatcgtcgagattctgctgctaattgggacttttttcacagcaatgagtaaaaacaattaaaaaattaccattaaaattttgtagaaatttctgtgacacaaattggccaattaattcattcgattgttgcaatatgcacagattattatgccggaagtcgccttgtgggcgtgtgggcgccgttgctcgtcgcttctgtgctatgtatcgcaattggcacaaccatctccatg

SEQ ID NO: 78030 - DNA, 393 bp, Heterodera glycines
  Genomic contig location: Contig_ID=SeqID_2134; Location=944..1336; Strand=-
  SCN-specific regions: Sequence locations=1-27,49-52,97-393
atgaaaaaatgggacaagaaattcggcattaaacaaaatatttcaaaaggtgaaattttttaaaagaatttttaatttaattatttaaatattaaagggcggaagcattatacaattgtcgaaaaaatggagaagatgaaacaatattttgaattgaaaaatcaaaatccaaagcttaccgatcgcaaaattgcggaaattttaaatattacaaaaagatctttagaaagatataaagcggaattcaagagaaaaagtgaaggcgttctgaatacggaatgattgagaatttatttcaattttcagggtttagtcaatgtgttgttatgtttgataaatttttgtaatttgaaagaagaatcaaaaaaaaggctggaaaaatattttaataaa

SEQ ID NO: 78031 - DNA, 688 bp, Heterodera glycines
  Genomic contig location: Contig_ID=SeqID_2135; Location=124..811; Strand=-
  SCN-specific regions: Sequence locations=1-75,111-516,539-688
atgaaaatcttattaatatttatattcttacgggttttaatattagaaaatgcaattgaccaaattgaggctggcaaaataaatcaagaaaaaagttttgatgaaatatttggccaaaaatgggacgaaagaacagaagaaaacatttgtcaaattgatgaaataatgcaaggacaaaatgttgatcagaatattcaagcagggccaaatgatctacaaattaatcaaaaatttgatgaaagtttggaagtgaaagaagaagagagtgatgaaatgtccacagattgtgatgaattgggcggccaattgccaatgccaacaaataatggacaaatttatgatcaaattcgaattttaaatgacaaacagaagagagaaattgttgaaaaattccataaaataaaagagaaagttaagcaaatgggaaagaaatattcaaagaaagaatggaaaaaaattgaaagaaaaattgcaaaaaaattgggcgtcagtcaagagaaaatttacaaatggaagagagaatttggattaatcaaaaacagacattcggatgaggaaagacgtaaaatgttaaagcaatttgatcaaatatattctaaattaaaaatgaaattaaatggaaaattggaaggaaaaaagaaaaaatgcaaaaaaataatagcaaaacatttgggcataaatatcagca

SEQ ID NO: 78032 - DNA, 572 bp, Heterodera glycines
  Genomic contig location: Contig_ID=SeqID_2136; Location=102..673; Strand=-
  SCN-specific regions: Sequence locations=1-75,111-334,356-572
atgaaaatcttattaatatttatattcttacgggttttaatattagaaaatgcaattgaccaaattgaggctggcaaaataaatcaagaaaaaagttttgatgaaatatttggccaaaaatgggacgaaagaacagaagaaaacatttgtcaaattgatgaaataatgcaaggacaaaatgttgatcagaatattcaagcagggccaaatgatctacaaattaatcaaaattttgatgaaagtttggaagtgaaagaagaagagagtgatgaaatgtccacagattgtgatgaattgggcggccaattgccaatgccaacaaataatggacaaatttatgataatttttcaaaagcaattgataaaaataaaagagaaactgtggaaaaatttcataaaattaaggagaaagttaagcaaatgcgaaagaaattcacaagaaaagaatggacaaaaattgaaataaaaattgcaaaaaaattgggtacaaatagagaaaaaatttacaaatggaagagagaacttggaatgatgacgaaaaaaaatcattcaattgaagaaaaaagaataat

SEQ ID NO: 78033 - DNA, 3497 bp, Heterodera glycines; identical to SEQ ID NO: 2136
  misc_feature (3456)..(3456): n is a, c, g, or t
  Genomic contig location: Contig_ID=SeqID_2136; Location=1..3497; Strand=+
  SCN-specific regions: Sequence locations=1-226,248-318,340-563,599 -647,755-827,858-889,911-1082,1104-1282,1358-1502,1524-1667,1692 -2012,2035-2281,2303-2665,2692-2956,2978-3054,3077-3119,3162 -3305,3330-3497

SEQ ID NO: 78034 - DNA, 1168 bp, Heterodera glycines
  Genomic contig location: Contig_ID=SeqID_2137; Location=1251..2418; Strand=-
  SCN-specific regions: Sequence locations=1-88,111-131,153-220,248 -748,780-887,972-1168
atgaaaatgttactaaaatttttattattatgcgcattaattttcgaaaatgcaattgatcaaattgaagctggcaaaataagtcaagaaaaaagttttgatgaaatatttggccaaagatgggacgacggagcagaagaaaacatctgccaaatttatcaaataatgcatggagaaacagttgatcagaaccaatatgatcaacaatttgatcatttggaagtgaaagaagagcagagtgaagaaatatccagaaattgtgatgaattgggcggccaattgccaatgccaacaaataatggacaaatttatgataatttttcaaaagcaattaataaaaagaaaagagaaattgttgaaaaatttcataaaattaaggagaaagttaagcaaatgggaaagaaatattcaaagaaagaatggcaaaaaattgaaagaaaaattgccacaaaattaggtgcaaatcaaatgaaaatttacaaatggaaaagagaacttggaatgatgacgaaaaaaaattattcagttgaagaaaaaagaataatgttaaagcaatttgatcaaatatatggcaaattaaaaatgaaattaaatggaaaattggaaggaaaaggaagaaaatgccaaaaaataatagcaaaacatttgggcacaaatatcagcagtattcaaagatggaagaaagaaataaaagttggaaaaatggtgaaaaatcaaaaaactgatgatgaaaaaagagaaattgttgaaaaatatttaaaagtaaaaattaaatttatgcaaaatggaaaacattcgcagaaggaatggaaggcatttaatgcaaaaattaaacaaatgtttggtgtgagttattggacgattgaaaaatgggccaagaaattaggaattaaacaaaataatttaaaaggtaaattcaattaaacttttatttttaaatttaaaataaatttttcaatttaaatatattacagagcgaaaaaggttcacaattgtcgaaaaaatggaaataatgaagcaatattatcttatgaaaaaggaaactccaaaattttccgatgtgaaaatcgccgaattgttgaacattgagctaatgtccttaataaaatacaaatccgaatttaaggaaaaagtggaaatgttttgaatacgacagaaggccaataaa

SEQ ID NO: 78035 - DNA, 439 bp, Heterodera glycines
  Genomic contig location: Contig_ID=SeqID_14060; Location=1326..1764; Strand=-
  SCN-specific regions: Sequence locations=1-1,35-439
gttttaaatataaaaaataaaaatatttattattggaagggaactgctgaacttgggttgctgaatttgccctttcacttacattcttcgaacagttcgaccttccgaccttaatgcgcaattggtactgaatgcccgccacgacttgtgacttggcactgagaacctccaaggggaaaagactgaagcgatcgtttgactcggagtttattttggccactgagcgagaagcgagagactgaacaaagcgagagaattgagcagaagcgaacggacatttgaatttgtaattgccatttatgaacagttagccaaatttccttttcattgccttgattttttcgtcgttcacattttgctctgtccatcccccgacaattgaattctgctgatcagtcattgccaatttgataagcaaaagtaaaagaatgaaaatttg

SEQ ID NO: 78036 - DNA, 204 bp, Heterodera glycines
  misc_feature (166)..(166): n is a, c, g, or t
  misc_feature (197)..(197): n is a, c, g, or t
  Genomic contig location: Contig_ID=SeqID_14061; Location=1..204; Strand=-
  SCN-specific regions: Sequence locations=1-33,55-204
gaatttttcatttttatcaagtgtaagtcttgaaattgtaatttttgaacataatgtacccaacggaaagggacatggaaaacagactgatcagcagtggaagacaataaaagtgatcaatgcgggacaagaaaatctttcgtccatcgattgacagatcagctgngaaggaggacattgtgataatttcgccattntttaccg

SEQ ID NO: 78037 - DNA, 248 bp, Heterodera glycines
  Genomic contig location: Contig_ID=SeqID_14062; Location=1017..1264; Strand=+
  SCN-specific regions: Sequence locations=1-117,154-248
atgatcgaaactgttatttatttggcaaaaaccggtcaaccttttcgaggcaataaagattacggtgttttgtcagtgccaaaaacagttggagagattaatgcagaacagggttggaaatataaattaatgtaaaaaaactaaaaaattaaaggcctttttcgtgctagtctgcaataccgatgtttgagtggagatgaaaaattaaaattacatttggagacaggtggtcaaataaaatcttaaaa

SEQ ID NO: 78038 - DNA, 608 bp, Heterodera glycines
  misc_feature (495)..(495): n is a, c, g, or t
  misc_feature (498)..(498): n is a, c, g, or t
  Genomic contig location: Contig_ID=SeqID_14063; Location=49..656; Strand=+
  SCN-specific regions: Sequence locations=1-301,323-608
atggtccttgtcatcgaattttgtgcccaaattctcggctgttccccgaaatcactccgcgacaagctcaatcatcccgaggaccgagtgaaggcactgaaggagctggtcggaaaaaaggttcggacgacatacaaggaccggaatggaatgcagaaaacattttttgtcgacggaatatcggacaaaggagcggctttgaccccggcgtatggcagactcagacaaccgtacaacatcaacattgctgcccatttctacgctctccaccgtatcaagctgcatctcccgtacgtgccgtgtgttgtggagaaatattctggatgtggcgaagacagatactatccaatggaactactcgaaattgtggatgacgactacaaccaacaaaagaggcgaggcttggcaaattgtttaccgaaatcgaggacgacttcatttcctgtcaaacgctttggtcgagttgaggaagtagaagaaattgacgacaacgangantggggtggtcgctacgaatgcagtcaaccgtcttacgtttattggtaaacacatgtatgttatcttaattatgcacttttctacataaaaacgacaagttcgtgcacata

SEQ ID NO: 78039 - DNA, 679 bp, Heterodera glycines
  Genomic contig location: Contig_ID=SeqID_14063; Location=1198..1876; Strand=-
  SCN-specific regions: Sequence locations=1-198,222-560,606-679
atgcagaaggtgataagaacgcttggatgcggcctcctctacacggacaccgactcgctgattttcgtccacccgatcggcatgaaccgtttggagacaggaccacacttgggacaattcaccgatgaataccccaagcatgaaattgtggagtattgtagtggcggagcgaagcaggttttcaccttttaataattcataatttatactttatcatttcagtatggactcaaactccggcgtaatgggcaggacgaatttgtgctgaagcttaggggcatcacactgaactacgacgtgatgcagaaccaatccctatgctacgacacattcaaagaagaagtgttgcggtatgcccaaaccggagagtatgagccaataaatgtgatgtaccccaactttttgagacccgacattagggatggcggacacgtcacttcaggccccctccaaaaatgttatcgcccatatgtaggcaaagggatagtgggtcctaattatgatgttctcaattttggacacactttgtaaatttatcgtttatcattcattgtatctctcacacacacatacacacacacaccccatacacacgtacacacgcatgtaccacctttgttttttatgttttatacctcaaattgtgtaattttgtcattttatttgcgtttttaataaa

SEQ ID NO: 78040 - DNA, 2385 bp, Heterodera glycines
  misc_feature (229)..(229): n is a, c, g, or t
  Genomic contig location: Contig_ID=SeqID_14065; Location=1236..3620; Strand=-
  SCN-specific regions: Sequence locations=1-25,50-276,298-780,803 -906,928-1006,1030-1766,1790-1900,1925-2097,2120-2385
atgagcgatgagcttcagtggatggtggacgatgatgatgaagatgaacaccaacataccaatgggacaataaatcgaacggttacggtagcgaaccgactcaaattaccgtacaccaacgcagtgatttgtgtaagtaatgtgcataaaacagggatgatttgatgtaatagtaatggcaaaccaggacgtttggtttgacataattacgcatttgagtaaatgtttntaaattggaacagtaactaggattcattaaattttgttcatcttttcaaaatttttaatatttataaagtatgggaatacggctttttatcatgccaaaaaaatgcgttacggatttttttaagcttaccgtaattacgaatacagattttccgagaatttattggtcatgaattgcataaatttaaaccttgatcatttagtccaaaaacatagcttatggcaaaaagttgaaatgaattcacaaaaaaaatctactttatttttgattttctttatcttttaaaactattttaaatttgttccttaaatttattccttttactaagccttttttctaacttttgaggcatatgccttttttctgcgcactagtttcgacatattaagcataaataacaccttttccacttggtttgaggcttctacgttgacttttattatgtctttttttgccttttccgggattttcgtgccttaaatgccttttttggcattttgccattttggtgccttttttggcgttttccgaaaaaaaccattaaaaattgaataaaatcgggaaaatacacccctatgaaatgaatcaaaaattttttatgaaaatacaccactatgaattgcaaatttttttttcaaaaatacactcctaagaaatgaaaaatttgtcaaaaattcatctccaaaagaatattttttcttgataaaaattctaggtttaaaattttccttattaaaaaaagctataaaatattttaataatcatttaatgaccaaaaatgaattttttgattaggttttacgtgttttgctccctaaaaatccttaaagaaatcggaattctgagcccaaaacgtcggaaattggtagtcgtatattgtaattccttgccatccctgttaggtgagaaaaataccgtgccacttttgggtatcagaatcgaatctcgggctcaaaccttcggatatgaaacaatgactaatcctaatgcattgctatcttttcatccgcaataggacaatcttgagcagttcaatgagcttaagcagttgctctgcggacatttcgccatcagtgtgcacccgctgaccgcgctcttccgtctgagtccccgcctttttcggcatttgcctttcctccacggcaaattcaaccgaaccaaaacggtgtaccgtaatttggacgcattctttgagcgccaaatcgacgagcacagactgaaaattaatcagctacagcaatgggataatgacaacacagagccaactgattttgttgaggcttttctaaaggaaaagacgaagcgggacggacggaaacgacggcgatccgatgcaccagttcaggtgagcggctgcaaaatctgttcccataaaatgatgcatttgaaacagtcttccaaaatttttgtccatcttttcgcaaatacttttacaatcagttctgcttcatctcatcttccaaattgtttaagcattgagcagctaaagggcatttgcaacgatttatggtcagctggacaagtaaaatggaataattagcaataatttattttttatttcgtattgggtcattcaggacacgattaccaatacgctttcttggggcattgcctatctgaaccatcatgtccaaattcaagccaaaatgagcgatgagcttcagtggatggtggacgatgatgatgaagatgaacaccaacataccaatggggcaacaaatcgaacggttacggtagcgaaccgactcaaattacattacaccaacgcagtgatttgtgtaagtaatgtgtataaaacagggatgatttgatgtaatagtaatggcaaaccaggacgtttggtttgacataattacgcatttgagtaaatgtttttaaattggaacagtaatgcgccggcttgtgaccattgacgggcacctgctcaaggcggggacgatggtgtgccaataaatttctgcggttcaaatggataaaaaagtgccaaataattaaaaatgattctttataatcaattcagatattcgagaacccgacagcaattttgtcgagaacgattcctggacgagaatgtaaagctaaagcgagtgaatgaattgatcccattctcagttggaaaatggtaacttttggtggattgtaatatatttaataaa

SEQ ID NO: 78041 - DNA, 312 bp, Heterodera glycines
  Genomic contig location: Contig_ID=SeqID_14068; Location=816..1127; Strand=+
  SCN-specific regions: Sequence locations=1-312
atgtccgagcaaaatcatgaatcggatgatgttttgcccacttgggccatggtcgattttcatgaaatgagccgtcgagaaagactgcgaattcagcagcaagaagaattgaagcggcaaaaccaaaaaaagcaaacattggagcagtttcggcaacaacgggtggaacaaaaacttcaatgggagaaggaggaaactgaaaaaaagaccccaaaacatggaagaagaggaccgatgagatgaagaaaatctgtgaggagagatggacgaaagcaaaatatgctggcagtagcaacgacaacaagaaccaca

SEQ ID NO: 78042 - DNA, 935 bp, Heterodera glycines
  Genomic contig location: Contig_ID=SeqID_14069; Location=1095..2029; Strand=-
  SCN-specific regions: Sequence locations=1-159,183-850,872-935
atgaatgaaacggaaaaaatattggacgatcctgaacgtttacttgatcaaattgttggaattgttgatgaggaagatacaattcctttgggagcagaagtaagctaaatttggttcttttaattgtgtaagaccacatttgtagtgcagaattgtaagaaaaattttgaaaatcattttttaagcaataggattttttgccttttgcgatatgaggaaaatttttggaaatagtaaaacaaaataaaaatgaacaaaaacgtttaggccggcaccctcaacaaagaaaaaaggttgaaaaagaatagacgtggcgggaaaaaagtgcagaaactacgggcaaaatcgatggagatggacaaaatctctgttacgacttatttctatttttgccaacaaaattttaaccttttatgtgtttctgtttacggctcaaaaactttggaaagtttgaacatcaatatgggcccaaaatttacagtagctgacgttccgctgcctatcattgaaacggccggattctcaattctgaggccagtagtatctaaaaatacaaatcaaacttttacaatgttttgcaagtaaacaaactgattttttggccatttaatgtaaaaatagcctcacgagttgctagattaattccacacccgacaatatcatttggaaaaaaacggtgcgaatgcacaactggtggaccgcctgtagcggaaaatcctagcaattcgcctgacgactcatagccataagatttcgggctccaacacacgaaatcgctacggtcaagggatccatcacacaggccgataccgaaggttcttaatttaaaataattcgttaaaatatttttgaaaatacccagcgtcgccacggaatttcgcctcataatatgccaaaataggataattgttagatggattcaacggtccaataaa

SEQ ID NO: 78043 - DNA, 1947 bp, Heterodera glycines
  Genomic contig location: Contig_ID=SeqID_14070; Location=808..2754; Strand=-
  SCN-specific regions: Sequence locations=1-67,171-322,361-458,480 -634,727-1062,1086-1298,1320-1381,1410-1544,1576-1661,1814-1947
ttttcaagggagcacttatggggcaaaacaaaggcagccttcaaatacgcatacgaacagtatttagtaaattttaattaccaattaacattttattaattaaaaaccattttttatttattttaatttgcaaaaaccatttttattatattttattaaaataataaattggttattatttttagaatgactttgattggtttctcaagactgacgacgacacttttgtgattgttgagaatttgcgcttccttctgatggctcattcgccagaagaacccatttattatgggtgcaaattcaaaccctttgttgaacaggcaattaaatgaaattaataataattaataaatttaaaatcgattagggctatatgagcggcggagctggctacgttttgagccgaatggcattgaaaaaatttgttgaagaaggactccccgacgcaaagaagtgccgggtatttttattccgaaaatctaaaacaccaattactaaattcaaataatttgaatattagaaatttttccttatttcttgaaacattaatatgtaaaaaatcagattatctattttaagcatttaacattttttaaacttgaattatatattttttacttgagttaacttttgctttatatttaaatattcataattaaattacatttaaatatttccatcttttaaaaaaaaaattgatatttggaatgaaaaaattttttatttgattatcgctagggatgatatttttagctttttatctattttttcctgagttaccaataggcttaaaagcatgaaaatatgtttttttcggtcgttgttaagtacttttcgtgtttttagaacctattttctatgttactatttttagaacctaaaaactcaaaactatttggaaaaaatattttaacgtattttggcgttttcccaaacatattaacaaaaatgcaataaaaacgaaaaaatatacccctaaaaccgatcgcttcagaaaaatacatctctaaaaatcgacataatttttttccaaaaatacacccctaagaatggaccaaaaatttctgaaaatacaaatccataatatgaaactttttgttacctattttccattttagcaactattttaggagttttttagaaactaaaaactaatcactcatccctccctaatttttcagtccgatgaatggggtcacgaggacgttgaaatgggcaaatgtttggacaaaattggcgtcaaggctggcgattcgcgtgatgccgaagaccaccatcgctttttcccatttgtgccggaaactcatttgtccccagaccatatggacaaatcattttggttctggaaatacacttactatccgatggaagaagtaggacgaaaaaaattctaatttaatttaatattagattttgggatagctattttaaattagaacaaatcgtttttttattactttataaattgtacatttaggggcccaactgttgcagtgattatgccatttcttttcactatgttaagccgaattcgatgtatagcgatttaaattatttaaataattaattaatttacaggtactcacttgaatatttggtttaccatttacatctattcggcaatgaaattgaattaaaggacaatttcgaaaaaaacaggctaatttattgaaaataaaattatttattatttttttgttgtaaaataaattttcaaaaattagtttaataaatcgaaaatttttattatttgaaacttaatgaaaaagcttaaaatttttaaatgttagaaaattaattaatatttatttatcacaattagacttaactattatttttgtgtataattaatttagtgtcggcataattctacgaaatgcttacaaattggcaatacaaaacattggtgctgatgatgtgttcaagaacaacgaaaaaactatcgat

SEQ ID NO: 78044 - DNA, 1855 bp, Heterodera glycines
  misc_feature (256)..(256): n is a, c, g, or t
  Genomic contig location: Contig_ID=SeqID_14071; Location=734..2588; Strand=+
  SCN-specific regions: Sequence locations=1-218,262-400,488-520,542 -845,874-964,986-1040,1371-1390,1412-1417,1603-1610,1634-1647,1755 -1775,1840-1855
atgcccaatattttagaagcacaactgccaaatgactattttttctacattttacggctttttgccgttaaacttgacgaagaagcgaaagagaggcatggattgaaaaccagaaatttgcttaataatgaaattttagtctcaagactagtcgccctgggtgcagaattatcacagaggcaggaactactttcctgcgtgcctataatgaaagtgggttttttaaataatgaaataataatttaaataattaatntaaaagaactgggattttttgttgcggtttatatttgttcaatcaaattaaacacttaattagatttcaaagccctttatgtaatttgggtgctttggcttttttttttaatcatatatttagacatataaaatccaagttctgattattagataattgtaattaaaaagataaataataatttaataataataattataaaattaagttaaattacaattaaaattaatacacaataaaaccgttgcataaaaaaagttaccccctttaaaacagttttatttttgaaagttgtataaaaaaacatatagataactctctaagctgaacaaaaaaaagtaactattgctaggtcgtttttcatgtatatataagactatccaaattgtctaaccccagaaaatttaagacggggtagggctttgtatgtccaagtatctctgaaaattggtaccatgccatatgtataatattttcaaaaatacaaaaatggcgtaataattttacaccgatcggttcacgggaatggtcaactaagcaaaaccgggatgttgtacttttttaatgcaacgaaattgtaaatgtatacataataacaaaaaaaatttttttattaagctagcggcattttgaaggaatggccaagcggccaggatgtagagtctattatccaattaagatttaatatttagaaacgttggtttgttttaatgttatattttaggaaaatattgttgaacacatttaattactcattataataattggcccctattcctttaaatcatttattcataatttcattttaataattcatttatgcataattacattttaataactcatttattcataatttcattttaataattcatttatgcataattacattttaataactcatttattcataatttcattttaataactcatttattcataatttcattttaataattcatttatgcataattacattttaataactcatttattcataatttcattttaataactcatttattcataatttcattttaataattcatttatgcataattacattttaataactcatttattcataatttcattttaataactcatttattcataatttcattttaataattcatttatgcataattacattttaataactcatttattcataatttcattttaataactcatttattcataatttcattttaataattcatttatgcataattacattttaataactcatttattcataatttcattttaataactcatttattcataatttcattttaataattcatttatgcataattacattttaataactcatttattcataatttcattttaataactcatttataataattggccactattcctttaaatcatttattcataatttcattttaataattcatttatgcataatttcattttaataactcatttataatataaatttttcaggtttattataaatttaattggcccctattcctttaaaatcatttattcataatttcattaaagtcatttaaaaatttccatttaaatatcttttaatgcatttattttgggtttaattga

SEQ ID NO: 78045 - DNA, 501 bp, Heterodera glycines
  Genomic contig location: Contig_ID=SeqID_14073; Location=418..918; Strand=-
  SCN-specific regions: Sequence locations=1-501
atggcgattcttaagggcattacattgcccaactgtccgctgctcaacttcgtcagcaaattttcccccccccttctgaccccttgcgttccgcgtcatgacccaacccaactgaccccatcgccatcatccccccccctcccccatttaaacagttatgctccctacatataaatcctcaaaatattagagtttccaaatttttctcaaatattttcagaccgaaaattcattttttatgggacaaataaaatccttcgccgtcatttcttctgtcgaaattgctgaaagtcagcagcaatcgtcgggttcatttatggcaacatcttttggaaggcgacgacattggtaaagtaatatcacatgttttaatagtatcccgcgggattaattccacacccacatatttcaaaatttccaaaaaatgcaggattgcggacttggctcatccagcaaaatcctgcgcgatatccaagtccctcaccggtgtcatgacaactc

SEQ ID NO: 78046 - DNA, 497 bp, Heterodera glycines
  Genomic contig location: Contig_ID=SeqID_2143; Location=716..1212; Strand=+
  SCN-specific regions: Sequence locations=1-227,259-497
atggctggacgggcgccggacttttcgacagtggacttttcgacagaggacatttcgacagaaggacttttcgacagcaaaggacttttcgacagaaatattttaaatttaaggaggggacttttcgacagtggacttttcgacagtaaaatgtaattaaatttcaaatttaggggtgtaaaatcttaaaattttatccaaaagcaacaaattaagtcaaataattattgagatacataatttttaaattcaaaaattcttttcaagaatgtaaacaaactaccacgtagatgcagttgcttcaatattccatttactgacacgaatacttatgaatctattgatccacgtgtacgggtggggtactccaacaattatggcgagcgataatccaacgcataattaaagtacatgctatagggaagctattcccgaaggattctgtctccccataaatctgggcgcatcggatcggggggactgccccgaaaacaaaa

SEQ ID NO: 78047 - DNA, 413 bp, Heterodera glycines
  Genomic contig location: Contig_ID=SeqID_14074; Location=102..514; Strand=+
  SCN-specific regions: Sequence locations=1-79,139-280,302-338,360 -372,394-413
atgctgcttatccaagcggcacttttctatctgccaaaatggacgctagacaaattgctgagtgattttatgaaagggcaaaaaaaaaataattaattcaatgaatttaaatattttaaaattattgtttataaaattcagcttgtttgttggcaattgccgtggcacaatttgccgtggttaacgcattgaccggccgagggcaccgctggtggggcattgaaatgggaaaatcattgcgcagtggtgatgaaatacaggtggaaaattgaatggaatgactaatttaagaatatttaacctattttttttagacaaaccctgacttacaaatttaaatgtttttgtttagcaattatttcaaatatttcggaaaatttatgtttattttcaaagtgcataattttatctaa

SEQ ID NO: 78048 - DNA, 712 bp, Heterodera glycines
  Genomic contig location: Contig_ID=SeqID_14075; Location=493..1204; Strand=+
  SCN-specific regions: Sequence locations=1-86,108-345,388-479,541 -588,625-712
acaaatttcacatcttccaattcggctgcatccagcgtcgggtcacgctgtgacgattttgtgagaaattccgtcggttcccggtacaaagagttcaacagcgacccgtacacatgcgagtgcttttttgggggaaccggtgccaatctgtccaacaaaaatgtccatcttccggtgactcatcctcggcccgaaactgacgacgccggcacaacagcagcaggtcgaatttagggaaatacaaattgtaaaagttgtcgtttggtctccttaacccccgggtttatctcctctaaactcgaagacgagcaacagcaggccccaaatgccgcagcattcaatcacaaattaattttaataattgctattaattattattatttatttctttccatcttccagtgactcatcctcggcccgaaaccgacattagtgaaatgtaaattgaaaaaagaatcatatgtcggcatttcattatcaatataaaaaatgtaattaatcttttttattattttctttttagattcaattaaaatttttgtcgaattaactggcataaatgcgaaaagtgccgctgttcgtcgacaccattttgatttgaatattctgctgttgttgttgttgatcagctgttgtttttttagaatgattgtgaggaggaaggaataatttttgtgatttaatttcaaaggaattgaaaatatattaatta

SEQ ID NO: 78049 - DNA, 363 bp, Heterodera glycines
  Genomic contig location: Contig_ID=SeqID_14075; Location=1660..2022; Strand=+
  SCN-specific regions: Sequence locations=1-342
atgggcaatgtccgctgcgggaagatgaacgtagtaaagcatcaatccgacgcccaacatggccacagtgtaatcgatgctcaacgggtgggcccatgccgaacagcgaataggacctgagtgatgttacaactgctcgggaatcccggccgaggcaaaagccggaaatttcgggttattaatgcccgtccagattttgtcgtaaattctcgaactatgaacccctaatttttcaggattaagcagatttagagggaatgagtaccataagggaaagtgccggcttatggaagcgtatttcacccatcggatatattatgaaatattaatcattgagatgttaaaaaaccaaattgtttaaca

SEQ ID NO: 78050 - DNA, 646 bp, Heterodera glycines
  Genomic contig location: Contig_ID=SeqID_14076; Location=561..1206; Strand=-
  SCN-specific regions: Sequence locations=1-646
atgttacgtttcatctattcctggtccaagtagttagacgaaccaattgatcgggggtgaaaatcaaattgttcaaattgacgaatcgcttttcagcaagcggaaaaataacaccgggagtgtgttgccgcagtttggatttttggaggaatttgtcgaattccaaacgaatgttccttatacaaataaacgtgtttgggttttttgtcctaatttctaatttctaggttccggaccgcaacgccaaaaccattctcaatgctaatgtacaaaacaccgcaactggaagcatcattttctccgattcctggtctggatacaaaacgcctgaatttgaagatgctggctttattttaaattcaatcatcggtgtgtttttttttgaaattttttgataaacttatatttcagtttcaactttgttaatccaatgaatggtacgcacactcaaacagtggaaagaatgtggggaagtgcaaaatggcgaaataacaagcaaagaggcaccgcgcgtcatcatttggagagctattttgccgaattcatgtagagaaggatgatcggtgacggagatgtattcgaagaattgatatgagcctgttcgaagtattggcctctcgagtgattctttaatgtgtctaataaa

SEQ ID NO: 78051 - DNA, 755 bp, Heterodera glycines
  Genomic contig location: Contig_ID=SeqID_14076; Location=1279..2033; Strand=-
  SCN-specific regions: Sequence locations=1-8,30-123,145-156,178 -431,453-519,578-755
atggtgtttaaaaataatttctaattccttcaaattaatcaatttcgtacaattttaacttttcttcacaatttttggatttaaaataagtatctaaacattataacaaatcctactattcatcaatcaactactattcctattaattgttaaaaaacaatagaattttcaattatgaaaaaattttcatgttcaataatattttctcacttcatgagcatggaactaataaagatttggtactttacggttatctgtgtccagatttcaaaaaaatttttgattaaaacttgggtttaggcattttcagagtcgggaagccgattttggcatctgttttgctccaatccgacttcagttcccgaactcgaacaaaattcgagaaaaaatgtcgaaaattcattttcaccaaaattcacgtttattgcacaaaaatgatttttaggggttttcagggtccggaaaaccaattcggacatatatttggacaaaatccaactccagaacccggattcgaacaaaaattcaaaaatttttcaacaaaattaacattatatttttttatacatataattttcactgatttttagatttttcaacaaaataatgttacaaatttggggcttggccaagcactgaggatagcttcatcaatttttccaggaacgcaggcttcttcacgccaaacgcaagtgtacaaatggacatccaatgaaattatatttgggataaaggcaagaatggaagtgcaataa

SEQ ID NO: 78052 - DNA, 625 bp, Heterodera glycines
  Genomic contig location: Contig_ID=SeqID_14078; Location=281..905; Strand=-
  SCN-specific regions: Sequence locations=1-115,159-161,184-212,283 -284,306-345,369-432,474-504,527-625
atgagcgaactaaactctgaaggaattttttggactgattcaaacggacggcaaatgatgaaaagacggtgagaaaacaattagctcattaattaaatgattttatcgtttcttgaaataatttgaattaattaaataaacaaataaatttattatttgagtatttaatgaagtagagaaattttagttttgacgtgtttcttaaatttgccattataaatttttaaatataaaaaatatttaaagaaatgtattaattaattcgaaaaaatttaattttttcaaagaattttaatggaaaaatttttgacaaaaaagaaatcctaagactttgaatcgaagaactttttttaaattttttaatatttgggaattttgcttgatatatttcttcaaaatctaaatctgagtcttttcgttttaaagtattccattaattaaatattctttatttttttaattttaaaaattttcatgatttttgaaaatttgtggggaatggcacttttatgaaatgtactagtaaaatttgaatttcagccgcaatgattcgtcattctttgagggcaccgaaccggtggcagccaattattacccagtgaacaggcaaaatttaattacctaa

SEQ ID NO: 78053 - DNA, 758 bp, Heterodera glycines
  Genomic contig location: Contig_ID=SeqID_14079; Location=463..1220; Strand=-
  SCN-specific regions: Sequence locations=1-240,264-314,356-378,426 -508,560-560,585-634,656-758
atggatcagtacaccattggactcgacttactcaatgccagctatggtaattgataaaactgctcgagagagattcaattatatgaatatatgccaaaattttgttataaaattggtaatatattgttgcctaattaattattaaggcgattgcggacacgccaaagtggcctggcaaattgatccatttggccacagcagggaacatgccaatttggccgcaatggtcgagaaacatagtttaaatatttaataaaataattgattaacttatatacaataatgcataagagcctcaaattttttcctggttgtaaattttaattgaaaaaaaaatttttttttttaattttttgattctctaaatttttccagtgctaattttgtatttaaaactttttttgttttatttaaaaatttaaaatggactgttcagattggctatgaagcactgttcttttcacgtatgcactacattgaattggtaaaaaaacacataaaaagagcagatgaaatttttcaatttttcttacgtgttttccttccttttgcttcactctctcatttatctctctttctcttccgcttatctccaatatcacattgtactattttttggttgcgctcacctcttttccactctcctccttttacacctgttttttttttctctttttttcaggaaaaacgtgcagaacaaaaagcgctggaaatgatttggaatgtttccgatgacatcagtacaaaaaaaaaataaa

SEQ ID NO: 78054 - DNA, 330 bp, Heterodera glycines
  Genomic contig location: Contig_ID=SeqID_14080; Location=405..734; Strand=+
  SCN-specific regions: Sequence locations=1-234,257-330
atgatccgagaacaatgtcaaaaaagagcgagcattaaatgttatctcatttggtggcttttttggggttatacattttccttaaaattccaatcattttttaatgtaatttagattatcaattcttttttttgaacaatgggattattttcattaaatggcaaagtctcgccacttcttacttgatgaactgcctaatttttgtccttttgtatgtgtttttttaatcattgccttaatttgttcgtctttatattttagggttgtacgagaatcatttttattacataattttaactagaataactttttttgttttaaataatttga

SEQ ID NO: 78055 - DNA, 159 bp, Heterodera glycines
  Genomic contig location: Contig_ID=SeqID_14082; Location=325..483; Strand=-
  SCN-specific regions: Sequence locations=1-133,157-159
atgacttcgggatttatcgtatacaaaagtctgcttaaaggaaacatgaccaacatttcaacaattaaaggattgtgtgctaaaacttttaatgaaggagatagtgattatttcactgtgcatgcaaatatatctgatttaaaaatgcaaacatataag

SEQ ID NO: 78056 - DNA, 1248 bp, Heterodera glycines
  Genomic contig location: Contig_ID=SeqID_14082; Location=835..2082; Strand=-
  SCN-specific regions: Sequence locations=1-924,948-1207
atggaattgggatataaaatcgataaattctataggtaaggaatattaaaaacaaatttaacatttcgatttagggcatatcatttcgaagaatttgattctgatctatttaaaagatatgttcggaaatttcttaagctcaaagtatgaatatggaaaaatttgtctaattttattaatataggttgactcatcgggatggccccctaatcttactaatgatgaagaaaaacaacattttatttccgaatataaacgaatttttaacataaaattagaccagaacaacattaaaccgaacgccggtatgagatacattgcaaaactcttacttaattcactttggggcaaatttgggtttgtttaaatattgagttaaaatcaaaaaagtttttagaatgcgaaataagttgtcgaaaaacaaaataataagccaaccttcagagtattttgaacttttatttgaccataaaattgtcttatctaaaccagtaattcttaataatgacgcaatacgcgttatatacagagaacaaaacgaatttgttaggccgcacagcgtgtcaaatataataatcgcactatggtataacattctttaaaaatttaattatgacgttttcctaggaccacaagtcaggcgagaataattttgtataaatggctccaaactgttaaatcggataaagataatcatttattatactcagatacaggtactattaatgaataggaaaatactatttttttgttttagatagtgtaatatacaaacaccaaaagggtaaaaaccccatcgcttttggagaatacttagggtatacagttttttaaatcattaattgttttaatttaagcgaaatgtctcatgaaaacaatggaaataaaattctcgaattcgtttctggtggtagtaagcaatactcaataaaatttgaaaatgaaattgacggaaaaatttggtataaaactaaaatgagaggtaattatcacaatcaaaaatgtactaattaatgatttagggataacctttaacaaaaaaaataacttcgaccacgaggactttaaaggaatgattttaaattataaagacgaaaagagaaaatatttcaattatgataaatttggaccatcgcgagacagtaaaatattatcccaaaaaatgacgaaagaatacaaacccgttcaaaaaaaaggaataatcgacgaaaattttgatattattccctatggattttggtgaataaa

SEQ ID NO: 78057 - DNA, 1813 bp, Heterodera glycines
  misc_feature (1796)..(1796): n is a, c, g, or t
  Genomic contig location: Contig_ID=SeqID_14083; Location=55..1867; Strand=-
  SCN-specific regions: Sequence locations=1-64,86-146,168-182,217 -999,1024-1079,1102-1227,1265-1333,1356-1734,1756-1813
atgcgaaaaatttttattgaaataacaaaagactcggaaacccctaacggttatgatgtttttaaggtaatttacattttgagttaccatttatgccaaattaaggacagtacgacaatcgcaggagcggcgataaaaatttacagagccaaatttttaaaggaaaaacacctagctatagtccctgaggggggctttgaaaaacaaaataaccaaagcatgatagcaataaaatattttgaatattatatgcataaacattgtgttaaagggagacacgcagctaacgggggcgagattaaaataggaggtcttagtaatgaaaatcattcattaattttaaaattaagacttcaaagttgattttatttgcgggaaattcaaaaccataatcgaatttcaggttataaatatatgttaactaaaaaaatgataattttagggatgtgtttttcacggtttgttatatcaaaatctttgtaaatatgatattaaggatgtaaaaaatgtttcaaaccttttcaaattgggctcaatggtaaaactgcagaagaaaattttgtaaggacaaaaaaccgaatgtttatgcttagaaaattatgtaataattttggaatacgggtggaggaaatatgggtcagtacaagttaatgatttctcgattaatattttttaggaatgtgaggtccgacgaaagctaaatccacgtgataaagaaaattatgacatagaaatgaagaaatatttcgattcaattccagataagggtggggtagtcaaaacaaaaagcaatttaacaaatatttatgaccaatcgacccccgggatgcttttgcgggtgggcgaacgcaagcattttgtttatattcaaagatttctgaaaacagagaaataaatatagccgacatagtctcattatatccatcggtaatatagcttaaactctcttaaaaattttaattctaggttaattatttcacaccgtacccggttaagacaccaaaaataataataccaaaatctcaagacgttctgtggcaatgtcccgaagacatcccttatgatggtaaccgtaaccgtatacaaaaatataaatattttataggactgttaaaagttagggcaattcctccaaaaaaattggcaataccgctattaccgtaccattatgattccattttattcttcaccaattgttccaaatgttgccaacgggcgaaatctaactttgtttttatgaaaaatgttaaaaaatgtaatcattctgattctgaaagagggcttcatggggtttttacaagcattgaattaaaattaggttagtaaatgtatgtaattttaataatttttattttcaagctatggaattaggatataaaattgataaattctataggtaaggaatattaaaaacaaatttaacagttctatttagggcatatcatttcgaagaatttgattctgatctatttaaaggatatgttcggaaatttcttaagctaaaagtatgaatacggaaaaatttggctaattttattaatataggtagaatcatcgggatggccccctaatcttactaatgatgaagagaaacaacattttatttccgaatataaacgaatttttaacataaaattagaccagaacaacattaaaccgaacgccggtatgagatacattgcaaaactcttacttaattcactttggggcaaatttgggtttgtttaaatttagagttaaaattaaaaaatttttagaatgcgaaataagttgtcgaaaacaaaataataagccanccttcagagtattttga

SEQ ID NO: 78058 - DNA, 553 bp, Heterodera glycines
  Genomic contig location: Contig_ID=SeqID_14084; Location=534..1086; Strand=-
  SCN-specific regions: Sequence locations=1-504,539-553
atgcttttcgtccttcttttcctctctctgttggcttttatccgtgcccaatttgctgccactaatccccccgcccccgaaccggcatatgtgcccccctcaaactaccaatggggtcttaacccgtggcgacgtgagaattgggcggatgcgtcgccgcacaaccaaatgtacgtggactcaagcggccgccaggggatgcgcaacgtgccgatgcaggtgataagtggtgcaatgagtgatcaggcggatcaatggactactaagggatcaaccaaccatgtagtggcaaataatgggataagctaataaattaggaccaatgcagtgatcagtcagtaagcaccttgatcgaatgataacaaaatagcgatcgctgcttctccctaagctgatcaatgcttttaattcccttcccaactgaagacacaacacggatggttcttttggtgcacgacgaaaaattgtgcgggacggagaaggagaaaatgaaagagagaagacatttttttgtttattttataaataatataaaaaaggaaagaaaaataaa

SEQ ID NO: 78059 - DNA, 279 bp, Heterodera glycines
  Genomic contig location: Contig_ID=SeqID_14085; Location=1079..1357; Strand=-
  SCN-specific regions: Sequence locations=1-25,129-279
atgcgccaagagttggtggatgtgtggaagaaaatgagaaaaaagacgacggaaattgaaaatggaagagaaagaaacattgaagagaaagtcaatgggaagaaaaaaggaagagaagggaaagggaattgttgcaagtgtaaaagttggaagggaaaacaaacggaggagaaaggcacacagacggagaaggaaatgccaaaagtggcaaaaggtgccataaaaggggacaagaaaagattgaagagtggggacgaccaaaacggccaaattgcctaa

SEQ ID NO: 78060 - DNA, 183 bp, Heterodera glycines
  Genomic contig location: Contig_ID=SeqID_14085; Location=1559..1741; Strand=+
  SCN-specific regions: Sequence locations=1-183
atggccattaaaagggcattcgagagactgcgaacggacggagcagcggcggaagaacgccttgcacgactcgcagctgagacagccgaagttaacgccacagccggcggaatcaccgcaaatctaagcgaaaggcaatggagaaaaaggaaaagcggacaaatgagaacagccgatcggaaa

SEQ ID NO: 78061 - DNA, 624 bp, Heterodera glycines
  Genomic contig location: Contig_ID=SeqID_14087; Location=292..915; Strand=+
  SCN-specific regions: Sequence locations=1-263,285-344,366-423,445-624
atgtacatcaaattgaacaaattgataagtgaaactaaactaatatatgagcaaattaaatctgacactaatcctgtggataaaaaaaagaagataggggaaatttgtaaaataacacaagcattttgcaccgatgtaaatgacgataattgcttatattcaccaaacattttaaaaaatgtgaaagaaatcgaaacaagcattatcatgctgaaaagcaataacaccaaagtgtttaaagattgtaaggaccttcaaaaacttattgaagtcattgagaaacaaaatgggtctaaagactaaacaaacggttagtcatcaataattttaaaatttattcaattcttaaaaattgatgaatacccgaatttagaaacaacaacaaaaggacttgaagaacagaaaatctgtgatgtgtggacgtacagttttattgtagaagattgtttctttcatttctgtctctttttctttcctcttttattggctttcatatttttaaatgttatttttcgcttattttttgggagtagaaaaacgtaaattttgttgcattcatttatctaattagtatgactctcatttaaaaatactttggtagccaaacgagttagaattattata

SEQ ID NO: 78062 - DNA, 1205 bp, Heterodera glycines
  Genomic contig location: Contig_ID=SeqID_14087; Location=2608..3812; Strand=-
  SCN-specific regions: Sequence locations=1-117,140-898,927-1053,1099 -1166
aaaggaagcaaagaactttttggtgaaattgacgcacaaacaaaccctgaggctaaaaaggctaacttagacgaaatttgccaaaaaactcaagaatattgcacatacgtacaaaacagtataaaagacaacaaaaacatattttctgtttacgaaatttttgatcaactgaaagtgatcgaagaaagcattccaaaactgaaaagcaatgatcccaaattgtttgaagattttgcaaagcttaaagaagtgattggagaaaactctaatcttggcaccaatccaaaattaaccaatgtgttggaaaatcttgaagaattgaaaagcaaaatcaaaaacctaaaagatgttcgaccagcaacaaatgataatccggtggcattaaaaaaacaaattttgcaagaaatttttgcaaaaacaaaaaatttttgcaatatttttcgagaaattttgggagaatttgacatcaaaaccgataacattgagaacggcatcaaacaaattgaacaaaacatcacagagctaaaaatgcacaattaccaagtggttgaggatttggcaaatcttcaacaaatgattgaggacaaaattgaaaatgcttaatttggccaacttttgaaggtgcagcagcagaagaagagttgttgctatgtgatatgctttttagtgtgctattgttggagaacatgggatctgtccaattttttctcttttttttatcatttaaaaatttgtttgacagattgtcaaaaaaccgaaaaaatatggtcggggtctgtctcgttttcgagtgaccattttgcgtggggtacgttttcgcccggggcgacatgaactttgggcaccagaataattgttaaaataggttttataaattagtacctggaagctctaaaccaaataattaatatttattaacttataatgttctgaaaatcataaaaaatgataaaaaaaaatgccgaaataggtacaaaaattgtatcttggtaataggtagaaaacatttaaattgtaaaaattcgtattataaatttcgatgggtctagaagctttaaattaaaaattatttttattattcttttaaattttttaattcaaccaaattctcaaaatgcgtcaaaaaatcacaaaacaggaataatatatatattttaactgttgagaaaatttttctttaattatactaattaaaaaaaaataaa

SEQ ID NO: 78063 - DNA, 1085 bp, Heterodera glycines
  Genomic contig location: Contig_ID=SeqID_14088; Location=55..1139; Strand=+
  SCN-specific regions: Sequence locations=1-70,111-284,306-316,338 -562,606-803,861-1015,1037-1044,1083-1085
atggaagcgactaaagctgtttatcggcatttattcttatggggaaatggaaacagattaaaaacagaggtaaaattattttaaaaatttggtaaaaaaaaatttatttacggttaaatttgataaggacattctcgtgttgcttttgcatttggtcgtcatttttgttgccatttgcagccccaaaataacaatttccttaaaagctatattttatcgcatttttatttgaaattaaaaaaaacccaccataatcatagacaaactcggcatttttagcgcaatgctccagtttacaaaaagcttaaaaacaaaaggattaagaaatattttcacttttttggtttatatggaagaattattcaattaaatatgtttgcctcagatggcaaactaaaagaatcaatgaatttttcattatttttatggggaatcagggctgtatctaaggccgaaaaaagcccatatcccgattacctttgtggcacacaactgaattgacctcctaaatttaaaagtttactaggtaaaattatttatgaaaaatagctataaaaatgccataaaaattattaatttattgtattaatttattttatttttatctttgttttctgctatgacatttggcttaaagatgatatttatctgcttattctgatgacactggtaatcacagaaaaggccattaccacaattattcatttctcatttaacattctctgctgcagtttgggagaaaattcatttacataatttggtgcaaaaatgacataatgcaagagaacattgaaggaattttgaaaaataatattaaaaataaagacaaaaatgtttttaaataataaaaataaggacaattaaaaggtttaaagagtttaagcctcggcagcccatgcgggtgtcaagaatctcggagattgcgaatttcggggatggaatcagattagcggtcgaacccgtcaattttcttagggaaccgaccgagccaaatatgatgtacccacaatttgttagtaaatttattttttaggcagttcatcgaaaattaattttaaaaaattaattcaaattaaatttttcga

SEQ ID NO: 78064 - DNA, 540 bp, Heterodera glycines
  Genomic contig location: Contig_ID=SeqID_14089; Location=137..676; Strand=+
  SCN-specific regions: Sequence locations=1-540
atgtctaccccctattcccttcctaaaatacctaaaaaaagtctacaaatgaacggatgcatgtatcgcctcttgacaaagtgccaaaaccacaaatgccaccaccagcaccaaaaaaatcaatttggagagttgagcaaaatcctcaacgcccgccttcacctcctccgcaaatgactccaagaagtgatgagcgtcagcaatttttgttgaatgaaggcccaaatattacaacgccgccaaatacatattgtaaaacaaaaaatatgtacagatgcttcaactgcttatttttgtatctaaaggtcatgcgtggcgtagtgtgtcttccgcacatatgcagtcgattgaagggaatgagcatttatcatactggatacaaacgaacccgccgcaatcaacatcatatgattatggaacacacgatgatgtttctactgccgaaatagatttggaacagcaacaaccatgtgaaaaaataagcgtactgcgacatttgcggatattcccgacatttgaggacatacacaatttcaaaaa

SEQ ID NO: 78065 - DNA, 739 bp, Heterodera glycines
  Genomic contig location: Contig_ID=SeqID_14090; Location=473..1211; Strand=+
  SCN-specific regions: Sequence locations=1-68,90-99,141-354,377-739
atggaaaacaaagagtctctgttggtccatctctttgaaatgatgccctcttttgtccgcgggaagacgccccatttcccaataaaaaaggtttatctgtttgttttaatttactttttgattgttcagattctgctgctttcatggaaagtgttgcttgcgactctcggcggcaccgattttctccgcaaagaaaaggcgagaaagcgtgccgaggctggcctttcaccagtgacagacaccgttcaagtggccatgaagatgaaacctttgctcagttgcgacggttctgttgggactggcgctttgcttggtctgaactcggcgagtggtggcgatgggaaggccgagacggactcaggaagtaaaatagtaaaaacataaagaagacaatactaaaacaattatattttataactagcaattaccggacaacttgggcgtaaggtccgctccattcaccacccaatccgtccgttcaatcgccaagttgcctgctcctccaattccgaacaaagttcctttcctttaagtcagccttttgatttgttttcaattagctacagcacacgatgaacccaaccgtcgcgaagaaagcaataaaacctttccggttgacaaaaaaggcgaaggaggagaagcattcggaggaatgtcagaagaaaccaaacaaattgcggaggaagtcgacgaggcgatcgttggaggacggaatcaggaaaatgaggtcagaccgtaa

SEQ ID NO: 78066 - DNA, 948 bp, Heterodera glycines
  Genomic contig location: Contig_ID=SeqID_14091; Location=22..969; Strand=+
  SCN-specific regions: Sequence locations=1-49,71-518,540-593,615 -746,770-862,884-948
cccaacggtaaatagacaaattaaaaatatatttgtatgtcttaatttttagcaaaaaacacttccatttccaattgccccccggcgattccaccaccgtttttgctttgcccgagcccattgtcaggggcagtttgcccgcgttgcgtcgcaatctttatgttccgctcaccgagcttcaggttgaattatcgggaattttcttaccctttttgaatgtttcacttccagctcgaatctgaagaccgatataaccgatttccattctcgcaaaaggaattcattgaagattgtccggcagaacgactttacgtccgaatccttcccgaaatgactgaatatgtaattgccctgctcaaagtcattctcgcttcgttgccttcctccaaagttctttttgctaattttttgcattgaattcttagacattctaaaatatactcatttaaggcgaaaatcgatgctgtcacaattctatccgatgtgctgacacccgaaactgacacaaatgagtaaataaagagccatttattcccttttgggacccttactccgattccctaattatttagagtcctttctaattcgatcagtttggaccttgccagtttttcacacacaaatgtattggaagaaactgtccgagtcgcaattgacataaatcgacacaaagaagttgggcttggtttagtaaattttgattattcatgcactctcttcagctgatcatcaaatcggcttcgtcccttctcattcttttgctgaaacacttacgtttgaaccacacactccaatttgaaaacttggcccgttatctcgtcttggccaattgtcttccgctggtgcttaagtttcttgaccagaatatttgtcgatacttccaagcaaagcacgagttggccccgttcaactatcctcagtgtgcactgttttttgtgaggaatggat

SEQ ID NO: 78067 - DNA, 851 bp, Heterodera glycines
  Genomic contig location: Contig_ID=SeqID_14092; Location=507..1357; Strand=+
  SCN-specific regions: Sequence locations=1-851
atgcaagcccgctatttgggtcgacagtggcgcaagacgaacatggatttgatttcgggcatttacttacgcgtccgtcatcggcttaacgacgactgggccttcgccaatgaagtgatgcgaacgaaatctattgactcgcagcaagaagagaacgaattgggcctggccatcagacggtttaacgcacggcgttatccgtacatttacagagacggaggtgggcagacagagacttacagtggtaaaagtgaagcatactgactgacatccacgaattatattcaattgacatttattactctgtaataaatgaatccgaaaaattttttgtggcaatcactctgaaacgagttattagatagaccctttcgaacgttgtttttcattttcccttccggtagagaaattttttagctaacaaataagggaaaatttcacaatacgcaattttcagaatcccatgttggagtggcaagggaaggcgaagaacaacatcagcagcatgagagagtgttttcttcagtgactgacgcggtcaaattgggttttgtggacgaatgggagcctaaggaatgggagccgactgacaatgtgtggttcagtttagctggctaacatttgtggtcactttcattcatttctctttgagtctcttcaatccgcgttggcctgggaaccgcaattcagcgaacggttcacacaaaactacgagcaatggttggaggaagaagtgtacggtcagcagacggattgggactcactgctgcgcaactccaggggactgttggacatttactgctgattcgatagaacagatgatggttgagtctttttaacaattccacaaa

SEQ ID NO: 78068 - DNA, 2061 bp, Heterodera glycines
  misc_feature (685)..(685): n is a, c, g, or t
  Genomic contig location: Contig_ID=SeqID_14093; Location=65..2125; Strand=+
  SCN-specific regions: Sequence locations=1-220,247-994,1016-1227,1249- 1453,1477-1893,1915-2006,2028-2061
  Gene Ontology: Mol. function=chaperone activity; Cellular component =cytoskeleton; Biological process=cell organization and biogenesis
atggaccgtgcgctgaaggaagaacgaaattacattttggagctgtgcaagcaaatcaaaaaggccgggtgcaatgtgttgctcatccaaaagtccattttacggtaagcggtgacgaactgtttgactcgttttccgacatggtttcctttttaacgtgatcctctttagcgatgccatcaacgaaatggcgctgcactttttcgcaaaaatgaaaattatggtgatcaaagacatcgagcgggatgacatcgaattctatgccaaaatcctcgggtgtcgcccggtggcatccgttgaccattttgtgccggaatcgctcggaacggccgatttggtggaggaaattgagacggctgatgggaaagtcctcaaagtcagtggagttttactctctcctttttggctattttgtaaccattttcaggtgaccggccttaaacagagtgggtgcgctgtgtccattttggttcgcggctccagcaaattggtgttggacgaagccgagcgctctctgcacgacgcattgtgcgtcattcgctgtttggtgaagaaacgcgcccttctttccggtaaaaaaaaaactttgttccagtttcgaccatcacttgtgcttctctcccacaggcggcggtgcccccgaaatggaagtgtccgtccgcgtccgcgcagctgctcagacaanacacggagccgaacagtattgctggaaggcatttgcggacgcactcgaagtggtgccatacactttggcagaaaacgctggactgtcgcccattgaaacagtgacggagatgcgcagtcagcacgcaatgggaaacaaagagcacggagtgaatgtgcgaatggtgagcaagcggaatgggagaaggggcggacaccccacaccttttcagtttatttattaatgaactgtctgttgcccaaattatggttttctcattattatgacatgtttgagtcctttcagggtgcaattacggacattcgcgaagaaaatgtggtgcagcctcttttggtcagttcgttcgccgtcaaacaggcagccgaatgtgtgcgcagcattctcaaaatcgacgacattgtgagtcttacccaggccatgtctcccattcattctctttccaattttaggttctgtcagtgcgttaaatgtgacggagaaaggcaataagaaattgttatgcaaccatttaataatgttatgacgttcattgcgtaaatcgctttttacttttaaatatttgtccaacaaaagtttaaacaaaatgatttgttatatttttttctttaatacaaaagtgcattttaaacgatgatacagcagacactgctcaaaatacaatgaaaactgctcttgagttggcaaaaaaaattgtttgtggtgtatttattgcacacgtttttcgccaaaaagttggccgaattcttacgggagtaggtccgccgaatatttaaaaattattttggtttttgaatttaaggtgattccatgctgccgactatccacgatggcgacattctatgggctcgagtttgggatccgaacgatgctttacgaccgggggacgtcgtgtgtttagttgaccctctcgatgcagaagagtaagggaacaattctataatattccgttcgtgcctcgaaatccatcctttccataggtatgtcataaaacgcatttccgctgtccacaaagactgcatagaagttcgcggcgacaatgcgaaaaagtcgttggactcgcgcaaatatggccccgtgccggctggacttgtccgctaccgcgtgtctttgcgactcctccccttaaatcgttgaacattgcgaaaaccaaagtgatcaaaagctaaccaaaaacactaattgactcggtcgctttgcctaattatttgctgtccccaaaaggccttcggttggctccgttcgctgtgtctgccgccgttccgcccgtcgaccctcccccaaattacgagtccgcccttctgctcagttcacctcacccataatgctcaattttcatctgattattgcatttaattttctctttttgcgctggtgaa

SEQ ID NO: 78069 - DNA, 374 bp, Heterodera glycines
  Genomic contig location: Contig_ID=SeqID_14093; Location=2311..2684; Strand=-
  SCN-specific regions: Sequence locations=1-63,85-299,323-374
atggcaatgggagaagcgaaagaatgggacgaagtgagtgttgggacaaacgaagagggcattaattattattattccattttaattgccatttcgaagtttaagcggcgaattccgcgccctcagcgtcgttggctaatgcgcacgacggaacttaaagagggaagcggcggcgacaaatacgtgaaaagggtggtcagcgaaagcgaactgaacgcactgctgaagaacgcgtggctgggcaaaaagcggcgataaaaaagggggagaaatgagaacggagcaaacgtgatttgatcagagagagaaagagaggaaggaacacgaacaaaagcggaataattaagcaacgaattaattaattacacaataaa

SEQ ID NO: 78070 - DNA, 216 bp, Heterodera glycines
  Genomic contig location: Contig_ID=SeqID_14093; Location=949..1164; Strand=-
  SCN-specific regions: Sequence locations=1-85,107-216
cctgggtaagactcacaatgtcgtcgattttgagaatgctgcgcacacattcggctgcctgtttgacggcgaacgaactgaccaaaagaggctgcaccacattttcttcgcgaatgtccgtaattgcaccctgaaaggactcaaacatgtcataataatgagaaaaccataatttgggcaacagacagttcattaataaataaactgaaaaggtgt

SEQ ID NO: 78071 - DNA, 383 bp, Heterodera glycines
  Genomic contig location: Contig_ID=SeqID_2144; Location=213..595; Strand=-
  SCN-specific regions: Sequence locations=1-13,35-53,82-330,352-383
atgaaccgacggtaattaaattaaaagtcacaaattcgtcgtttatttgactaaactgtttttccatttcagttggatttgcaacgacgtttggatggacattttcccatcctttgaccgtcctcaactcggcctcaaattggcacttctttcgccacgtttcaatgcgttggtggacaaacatttcaatggcaaaagcgaattgacaatttggagaccaatcgcaattcgtcgcaaggacaaaggaccagaaccgaaactatctgtgtggatggatgacaaaattgtggaatttccattgcccgattatccgttgaccagcaaaatccgttttaatcaccttcggatttagtaattaaaaatcaaagctttatggcaataaa

SEQ ID NO: 78072 - DNA, 339 bp, Heterodera glycines
  misc_feature (27)..(27): n is a, c, g, or t
  misc_feature (49)..(49): n is a, c, g, or t
  Genomic contig location: Contig_ID=SeqID_2145; Location=1316..1654; Strand=-
  SCN-specific regions: Sequence locations=1-246,268-339
atgcatcgcgttgatcagtgtcgattngacgttgccctttttgcccacnagcaaaaggttcttcactatgtcctttttgctctgccgctccaattctctgttcagcaaatcgagcgtcgtaaaggcgtggaagtgaacgccatggtcagcaaaaaaggcacaacggaaagtcaagcgatcgacgcgagtgccaccgcagtcgcagaacaaatgagtgatcggagcctgggagagggaagcaaatgatcaaatggaattgaatggcattaaagtgatttaaacacgagagaagtggggccatttcaatgggccattgtaacgaggaactgtttaaataaa

SEQ ID NO: 78073 - DNA, 339 bp, Heterodera glycines
  Genomic contig location: Contig_ID=SeqID_2146; Location=686..1024; Strand=-
  SCN-specific regions: Sequence locations=1-144,166-246,268-339
atgcatcgcgttgatcagtgtcgatttgacgttgccctttttgcccaacagcaaaaggttcttcactatgtcctttttgctctgccgctccaattctctgttcagcaaatcgagcgtcgtaaaggcgtggaagtgaacgccatggacagcaaaaaaggcacaacggaaagtcaagtgatcgacgcgagtgccaccgcagtcacagaacaaatgagtgatcggagcctgggagagggaagcaaatgatcaaatggaattgaatggcattaaagtgatttaaacacgagagaagtggggccatttcaatgggccattgtaaccaggaactgtttaaataaa

SEQ ID NO: 78074 - DNA, 996 bp, Heterodera glycines
  Genomic contig location: Contig_ID=SeqID_2146; Location=2975..3970; Strand=+
  SCN-specific regions: Sequence locations=1-556,578-605,677-679,710 -927,968-996
atgaagggtgtcacttctaatgaaaaggaaatgagaaaattctccgaagaatgggccgaatcagtgcagcaattcaaacggttgttgaagcatttggccactgtgaagccccatttgactcgggaaacgttgtcggtgtgtgccgcgcgaagtgccatcgtcaacattataccaatcattgcgtcaaacgggaagcaaattcaagtgaatcacacagacagcctagaattatttaaaatgccgaatttcaaatcattcagaaaagcatcgcaaagttggaaatcgaagaattggaaatcgcagaatggacaaaaaccattggcgaggataagaagaaagccgacattatgtttgacaatttcatgaagaaggaacttggtatactccgcatgcttttgcactccggtgagttttggggtgcaccccaaaatcacgccgccgaaatcacgccgctagaaattttaaaaaaattttcgaacctggaattttttctagaaaaaattcttagaaaattttttacaagaaaatttcaaagaaaaaaaaatttttttggaaaatttcaaaaaacttagtaatttatcataaaatttcaaaataaatcgctgaaaatttttcaaaatttttttttcttttaattttcttaaaaaaatttctaagaattttttttagaaaaattctaggtttgaaaattttttaaaaatttctagcggcgtgaatttgtcccggcgtgatttcggcggcgtgattttgtcctgttcccgagttttgtctaatggaaagagggggggggggatgcgatgaagcagccagcaggggtgaatttctactttttgttcaaattcatgttcgtgagccggaattgatacataggaatgggtgtctttggtgatcaacgataatttttctctcatacaacactaaaaagccaaaatttttaaaaacaaattctatattatataaaaattttggtgtttatgcactttatagaccgtaaaa

SEQ ID NO: 78075 - DNA, 695 bp, Heterodera glycines
  Genomic contig location: Contig_ID=SeqID_2146; Location=4779..5473; Strand=+
  SCN-specific regions: Sequence locations=1-221,243-576,608-695
atgaattgcatgtttaagacagccaaatggatctcctgtttgaagtcaatggcagtgataacggatgatgaccaaatgctgagatacatcgaattgagcatccgagacgccgatggaaagatggccaaattgaagggacagtcgtcccgcgaggagcagcagaagagcatcgatgcactccgagtcagttcaactgcttacaaatagaggaaaaaaacttggaaatacctacgttgttattggatttttaaattcatctatggtcatgcttctccatttttctgtatcggattaactttatccgatggcttccatccacgcttcactttttgtcgattataaaaatcttgaaaattaggggcgtgcgttttcggagttgcagaacacatatgtatgacagggatggcatagaattccggcttcagatgtctggaaaattttttggtgctttggaatgccatccctggtatatgacacgatttcgaccaattcttaagcccaaacacgaattcaaacaaaaaatcgaaaattcaagcccattaaaaaactaatgaaaattcaaatccctttgacgaagtaacaatttatttatttatttacagaaattcaaggaatgttacatcaaagagcgcacactgttcgaaacagcttccggcaatggtggaggagttcaaatttccgaccgaaaatgttga

SEQ ID NO: 78076 - DNA, 347 bp, Heterodera glycines
  Genomic contig location: Contig_ID=SeqID_2147; Location=871..1217; Strand=-
  SCN-specific regions: Sequence locations=1-290,313-347
atggaaatggtgccattcgaattggtgaacgaatggacaaaggaaaagctgacattggccaaagcaaatgaatttgacaaaagttggataatgaaacgatgcaaaattggggagaccacggcggttaagcaacagcagaagaaagatgaaaattgggacaacaattgtaacaatgtgtacttttggctttttagtgccaataattgcatcgggtgagcaattaaaaaagcatttgattttgtttaaataattaaaattgcgcataattaaggccattgtctccgccaccagcagaagaagtggaagaggaagccggacaatgcatcacaaaagggccaaatgagtga

SEQ ID NO: 78077 - DNA, 1012 bp, Heterodera glycines
  Genomic contig location: Contig_ID=SeqID_14094; Location=562..1573; Strand=+
  SCN-specific regions: Sequence locations=1-348,370-390,415-1012
atgcgtcaatgcatgcgaaaagtgctgcctgtggacgccagcgacgagtcacggcggacattggccgaaacggaggaatacaaaggtggacttttaatgaatgagtggtgggtaagttaatttttgcagaacaaaccaaggaaattcctttcctttcccttgcgatggatttaccaccagcgccgctttatttggacgaacggcttcagaatattatcccgcaagtgccgttgtcgacgctgctcatgaaattcaacggacaaacggagaaagtgggcatttgatttataacaaaaccaaatattgcgataattacccaatcggcgagcaactcttttttaattaaacaattaaatagtttaacatttttaactagttaggacaaattcgaagtaatccaaaaatttccattgatttaaggagtacaaaacgtacaaagacaatttcctaaagaagtttgaactgcttcatctccccgaatatctaatcattacttatgatcgtttccacaagaatcagtggttcatcgaaaagaatcccaccatagtaaattttccgatcaggtgaattttgaactgatatttgtacatttcaaaattggtatttttgcatttgggaggcgtaatgaaactgcttttcagtaatgttgatttatacgagtgtttggcaaccgatgtacgggaaaagcaccgatacaccacttacgatttgatctcaaacattgtgcacgacggtaagccaccgactgcggtgagcaaaggcgacatcgcagttgacaccggacgataccgagtgcagctgatccatgaggtggactttcgtcatttttacaatttcacacaaatgcaaactttgttaggggacaggaaaatggttcgaactcgaggatttgcatgtgaaggaaattctgccgcagacaatcactctcacagagtcatacatccaagttaggagcttttcattcattttttgtcagttaatttcatttcgcagatttggcgattgaatagga

SEQ ID NO: 78078 - DNA, 661 bp, Heterodera glycines
  Genomic contig location: Contig_ID=SeqID_14094; Location=563..1223; Strand=-
  SCN-specific regions: Sequence locations=1-248,273-293,315-661
  Gene Ontology: Biological process=cell organization and biogenesis
cactcgtataaatcaacattactgaaaagcagtttcattacgcctcccaaatgcaaaaataccaattttgaaatgtacaaatatcagttcaaaattcacctgatcggaaaatttactatggtgggattcttttcgatgaaccactgattcttgtggaaacgatcataagtaatgattagatattcggggagatgaagcagttcaaacttctttaggaaattgtctttgtacgttttgtactccttaaatcaatggaaatttttggattacttcgaatttgtcctaactagttaaaaatgttaaactatttaattgtttaattaaaaaagagttgctcgccgattgggtaattatcgcaatatttggttttgttataaatcaaatgcccactttctccgtttgtccgttgaatttcatgagcagcgtcgacaacggcacttgcgggataatattctgaagccgttcgtccaaataaagcggcgctggtggtaaatccatcgcaagggaaaggaaaggaatttccttggtttgttctgcaaaaattaacttacccaccactcattcattaaaagtccacctttgtattcctccgtttcggccaatgtccgccgtgactcgtcgctggcgtccacaggcagcacttttcgcatgcattgacgca

SEQ ID NO: 78079 - DNA, 931 bp, Heterodera glycines
  Genomic contig location: Contig_ID=SeqID_14095; Location=8..938; Strand=+
  SCN-specific regions: Sequence locations=1-80,102-179,201-311,333 -674,696-931
  Gene Ontology: Mol. function=structural molecule activity; Cellular component=nuclear pore; Biological process=signal transduction
atgaaaagtgatcgggcaaagtcaaacaatggcatgaaaagtgatcgggcaaagtcaaacaatggcatgaaaagtgatcgggcaaagccaaacaatggcatgaaaagtgatcggacaaagccaaacaatggcatgaaaagtgatcgggcaaagtcaaacaatggcatgaaaagtgatcgggcaaagccaaacaatggcatgaaaagtgatcgggcaaagtcaaacaatggcatgaaaagtgatcgggcaaagtcaaactatggcgtgaaaagtgatcgggcaaagtcaaacaatggcatgaaaagtgatcgggcaaagccaaacaatggcatgaaaagtgatcgggcaaagtcaaacaatggcatgaaaagtgatcggacaaagccaaacaatggcatgaaaagtgatcgggcaaagtcaaacaatggcatgaaaagtgatcgggcaaagtcaaactatggcatgaaaagtgatcggacaaagccaaacaatggcatgaaaagtgatcaggcaaagccaaacaatggcacgaaaagtgatcggacaaagccaaacaatggcatgaaaagtgatcggacaaagccaaacaatggcatgaaaagtgatcggacaaagccaaacaatggcatgaaaagtgatcgggcaaagtcaaacaatggcatgaaaagtgatcgggcaaagccaaacaatggcataaaaagtgatcggacaaagccaaacaatggcatgaaaagtgatcggacaaagccaaacaatggcatgaaaagtgatcgggcaaagtcaaacaatggcatgaaaagtgatcgggcaaagtcaaactatggcgtgaaaagtgatcgggcaaagtcaaacaatggcacgaaaagtgatcggacaaagccaaacaatggcatgaaaagtgatcgggcaaagtcaaacaatggcacgaaaa

SEQ ID NO: 78080 - DNA, 920 bp, Heterodera glycines
  Genomic contig location: Contig_ID=SeqID_14096; Location=252..1171; Strand=+
  SCN-specific regions: Sequence locations=1-267,315-470,493-552,574 -655,677-683,705-820,844-920
atgacgcttggacattatgatgcttggacatttcgacgcttggacattatgacgcttggacattatgatgcttggacatttcgacacttggacattatgacgcttgtacattatgacgcttggacatttaaaaaggcaaatcggtgccgaagtgacaaaaacggttttctattgggcgaagtgacaaaaaggcaaatgtgggcgattagacaaaaaggcaaatgagtggtgatcagaagaggcgggtcatttcagtaccgaataatgattttaattaattaataatataactattttaatctattaattatattgctggccataattataatttcgttattatttaatatttcccaatcaaattacaatattatattctgtctagagagagaaataatatccacatgcatagttgatcaattcgatcaattgcacttttatttattcacaattatatattatattctgtctagagcatttttcatttctttaatattccactattaacttgtctttaataatttattaccgaatttttaattgatttagaatgaaaagtctacttttgaaactttttgttggcctctgcttcattgactttacgtcaaatataaagtcaaaatttgaggactttcttgaaaatcaagaagcaatgaagttgatccaaaattaccaagaaaagcgaatcaaaactattaaagaattacatgctgaactaacaaaaaaagggattaaattggcagaacgtagtttgaggctatatctttgtaaaattaagagtgccaattctgatacatcaaaagaaagtccaaacataccagaaataaaatttgaaaaacaagatagagaggaatatttttggcagacttttactcccaatatggatcattccgtaaaagactaacattaatttttataaa

SEQ ID NO: 78081 - DNA, 583 bp, Heterodera glycines
  Genomic contig location: Contig_ID=SeqID_14096; Location=1717..2299; Strand=+
  SCN-specific regions: Sequence locations=1-79,102-106,130-243,266 -312,334-583
atggcaaaaaatgtactaaaacacacaaatttgagatttgcacaaaataatcgacaaaaattgcgggtaagactatggatggtggtgggcccccttttttcgaatcccgaacccgaattcgaacaaaaagttcaaaattaaattttttgtaagtcatgaaaatacattttcaaaggttttcggggacgctgatcagtgatcacgagtccgtcatccatttcggccaaatccgcggattcaaacaaaaatttaaattttaaaaattcacatttgtaaattgttgagcttttaactatgttttcagcgcttaatatacctaaatggctgtattggaagagtttcaaaattttacattgaaaaaattgcatgaaaaactggctttgaatgacaatgattttgtcgaatggcttgagcatttgggactcgtgcattcgcgtcgctcatgtccttgatgtggtggaaatacttcgattgtagcagttggtggaaattggcgttgcactacaaagaattgtcgggcaaaaacaggttcttggttcgtagtgcgacttttcggaccactattctcgatagaactgtctaa

SEQ ID NO: 78082 - DNA, 590 bp, Heterodera glycines
  Genomic contig location: Contig_ID=SeqID_14097; Location=142..731; Strand=-
  SCN-specific regions: Sequence locations=1-590
atggttgcacagtccgagaaaagatggcatgccgaagcaattgcatttctttttgaaggagccaccaaatatggaatgggccaacactctcaaaaaggtgtggccatattttcgttagccaactgattttgattgcatttaattaatgtccgtccgttttcccattgtttagcattttctccgtgccaatgccatttcttcggtcagctaccaaattcaatttactgtttggcaaccgtcaacgcaaattgtgccatttgaattagcgaacgaacagaccaaggaaaagcggacactgatcaaagcaagcgcaaatgtttgggaagaccgctgggtaatgaaacggtgccaatattgggagacggcggcggttcaatgggcagcccaaaatttggacggatttagcactgtcgagtttcattattacgtcgaagctggcattgggtgagcaacaaaaaagcatttgattttgtttaaaaaattgtgccgaatttttaggcctttgtcgccacgtcgcaaatggtgtccaattatgtgaaggtgatttaatgcatttgagaaatgtcgatcattttgaattatggcgatga

SEQ ID NO: 78083 - DNA, 1440 bp, Heterodera glycines
  Genomic contig location: Contig_ID=SeqID_14101; Location=40..1479; Strand=-
  SCN-specific regions: Sequence locations=1-89,112-1163,1185-1440
atggaaaaagctcgaaaatcaacgccgccgaggtccatgactttggaagcacttctggaagagtgccgttccattcaatcgcttaaaaattcggctgccgctttgtctggtcccggacaagttcattcagtgcaggtccgaccgcaacgagtaagcgatggaagtaagaagtctaaccgaggtaaaatggtcaaccaaaagggcaatgtttcggttccaaattcgaaagagtataattttcctttcaattcgaataggaccgatgaagatcagcagcaaaagtgcaagcgatgtggtcaattccatgtcaacgactgtccttatgcagccgatgtgaattgctaccgctgtggaaaacgtggacacatcagacccgtttgtcctgaacgcacgcagtcaaacgctgtcacagtggcctcaactttttgtgttactcaaaactgccacgattggatttggacgcagccactgatcaatggacatcctgtcaaacttgtggctgactcgtgctcgcatctgacaattattcaggagccactttggataagtttggggagtccaaaattgagaaaacaaggtaaaaaagttggtagtttttccgggcataaattaaatttgttgggcgaattcgattgtttggtgaaatttaaaggtgttgaatttaagctcaaatgttcagtagcaaacaccggagctccaaacatcatgggacttgattggattgtgccgtttgagaaggccacgcaatctcccatcgcgacgacattggatttgtcaaacgccccaacaaaagtcaacacaattgatgaacgtccccgtcatttcaaaacggtgacactgttctcgtgttgaattacggaaggtctggcaagcctaattggtttgaaggcaaaatagtcgatggtaaaggtctaatttggaaggtcaaaattccacttttgaatattactgtcactcgacatgtaaaccaaatacgttcttttgtcccttaccaaacagagacaactttttcggccgatttagttgaccaggttcctcaacagaaaagtccttgccatcacaatgtcgcgaccactccggtgccaaccttgccaattcaaccaacgcctcgtcctcagagacaacgccgccccccaatacgttattcgccgtgaggaaacaaattttaagaagggagatgttggagatggatgttgatgttggattttaattaatttgaattagcgccatacagtaacagtgatgttcctgtttgtttctccgcgccacatttccagtcattattttccctccgttgttcctcctcattcattaattatttcattcttaatttttcggttctaaattaaatctgttttgctccttccattttcgtcattcctctgactccgtcgtcatcttttatttatttattgatttcatttgtctttccacaataaa

SEQ ID NO: 78084 - DNA, 1548 bp, Heterodera glycines
  Genomic contig location: Contig_ID=SeqID_14102; Location=989..2536; Strand=-
  SCN-specific regions: Sequence locations=1-214,237-420,442-500,522 -630,654-740,764-769,808-868,890-1163,1185-1496,1518-1548
  Gene Ontology: Mol. function=alpha1-adrenergic receptor activity; Cellular component=integral to membrane
tgcgcgagaagtcgcgccaaatgattaaacagttgaacgaacagagggcggcacgcacactgtccatcgttgtaggagtgttcatcctttgctggacgcccttttttctgttcacgccgctaatcgctctctgcggcaatgaacaggtgggcaagcctaattgggggggggggggggggaaattaaattcataaattctctgccggtcctaatgataaaattaaacatatttcagagtttcgccgactacgaaacggtcttttccattttcacttgggccggccatttgaattcgatgctcaatccgttgatttattcacgcttttcgcgcgactttcgcaaggcgttcaagcaaattttgacctgtgaaagggaaaggccgaccaaaaaggcgattaagtgagcttatttatatttgtgaaacattttaaaaattaataatggtataaagtcaattaaaaaaccgtacctttcgacaaattctttaatatttggcacatttcagaagccccctgaacattgtccttgcccaactcacttcgatggcacaaattccgccgccgacaaaactgggcgaatcgtcggaaggataaaaaagcgtcaaaaatgaacgacaaaaaaagggctttcaaaatcattcactcataacaaattaatttcttcctcaacattttacttaaaattttcgaatgtttaaaagtgattaataattaattaaattcaacacttgtccaaatgcgtatttttaataaataatttaaatccgactttaaaataggggaaaatttttaaaaataggagcaaaagtgaaaagaaggcgtcccggcaggattgaaatgccgttttgttttgtcgggatgccaatccctacattctgctaatagcacctcttttttaacttatacttacagtgaaaagtatttatggtccagtaatacgtttgttcgtaccttttcagattgtctgcgactattttcgactgaagcaattaatccgcacaaatgttaattagggggcaattaattgctaagaagtcacccgttatccgtcattagcatgtttattcgaaaggtaccttatgagcttatgagtgaatcagctgctcagttgccaatgtgcattttctctcccactgtcagtcgcttaatcgcctaaaaattcacacattttctcaaaataaaaaccaattattttttgtgcctttggggcgcctttcgtttggccattaattggtaaacaaaaaatgcgcaaattggcacaaccaattttccgaatgtgatgtgagttgggtgcctccccctctgtgtgccaatcatttcgcttttggcaccgttacgctttgcttttttgccatttttttaaatttgcccacgcggacatttcgctatttgctggaaattccaataaaaaacagaaagcacgcgaaaaattctcattaggaaccattggcatttacgtaaatggcaccacaaaagcatattgaataaaataattccgttgctttttcatatttaatttctattttagcttaaacaaactgacaaatga

SEQ ID NO: 78085 - DNA, 1981 bp, Heterodera glycines
  Genomic contig location: Contig_ID=SeqID_14103; Location=1..1981; Strand=-
  SCN-specific regions: Sequence locations=1-140,162-190,215-267,312 -376,403-452,486-501,543-856,916-967,989-1050,1072-1155,1177 -1181,1206-1221,1253-1467,1489-1522,1544-1614,1636-1802,1825-1981
  Gene Ontology: Mol. function=dopamine receptor activity; Cellular component=integral to membrane; Biological process=regulation of blood pressure
cgtttcgcttgcggtcgctgatctgatcgtcggtatgccctttggcaatttaacattaattatggcattttgtcattgaaatgtttttcaaatgacatgacttgcttcgccacaatttcattcattcattcgctcgttctttcttgcccaggtttggtggtgatgccgttaaattcgctgtttgagatgagtcgccatgtttggctgcttggtgagccaaacgccaaacatttaaaagaccaaaaaggaaaagccataaaaacaattgggggggggggggggggaaaaaagaaaaaaagggggggggagggaatttgggacaaacaaaaaacgataaaggaactaaggaaggacaacaaaaacaaaacggacggacgggggacaaaggggggaaaacaaaagcaaaaaaaaaaaagccaaactattggtttttgactctccaatttgaaagggcaacaaaagcaaaaaggaaatttaaataaaatttaaagggtaaattaccacaaggaaaatgaaatttaatttttggcaatttaatattaaatggttttctccataaattaaaatggcgttttgcaaattcgttttttctttgtttaaattccatttttggcagtttatccgccctatgccctcccccctttttttgcgtgtcaatccctcccaaaaacatgaatttcaactgcgcttttcatgtgaaagtcatgcaaaaaaagttaaaaataattaaaaatgaatttccgaatttgtcttttgtcaagggttgaccacctgtgacatttggcacgcattggacattttggcgtcgacgtcctcaatttggaatttgtgcgtgatcagtttggtcagtgagccgaaaatttaaaaaaaaaattaaagtttatctttaaaatgattatattttataataattttgtttttgattaggatcggtacatggccggcgtcgacccaattggtacgaaagcaaaataaaaccaaaattaaattattaatgatggcattttgccaaaaaagaggggtcattaaagagatggtccataacagtttttattattattattattattacaaaaaaaaatctgcccaactgtaactgatatctttcataagctcttcccaggtgctattagccagccaaaaaccaaaaagaattatttgctgaaaaatatatttttgggcttttccttttttccatttccattaattgccctgctacccattaactaattatttaattagttaattaattgtccatctccagggtatcgcgaccgcgtgtccaaacgccgcatcatttactgcatttgctgtgtgtggttggtctccgcctgtacgtgcaattattattgccagccaattaaccattaattaatttggaattgccttaggcatttccttcccggcaattttttggtggcgcgcttcttcaccccatttgtacaaggacaaagttggacaatttaattagctaacatcaaaattaaagaaaatttatggaaaattttgttcagaggcgctgtctgttcactgatgatgcgtattacgttgtgttctccgcaatgatttctttttacatccctttggtgctcattctctttgcctacggtaaattttgaaattgcaaaaacaaaatgccaacaaaaatgtcaaaggtcgcgtgtactgtatcgccacaacgcactcgcgatcgatgaagagcggcgagaagcgggtgagtgtttatgctttgagcggaccgactgatcaaatcaaaagcaaaaaaaggggggaaaaagatggaagagagtgatcgttgtgaatttaaatactttttaaaatcattgaattcacctcataatttgcagattttgctgaaacatcgcgaccgaaacagcggaaaatcggccaagtcgggcagtcccgcgcccaatcaatgctcccgaaatcattcggcgggctcggaaacactgcgcattcacttcggacagaaacggacgac

SEQ ID NO: 78086 - DNA, 1239 bp, Heterodera glycines
  misc_feature (638)..(638): n is a, c, g, or t
  misc_feature (739)..(739): n is a, c, g, or t
  misc_feature (759)..(759): n is a, c, g, or t
  Genomic contig location: Contig_ID=SeqID_14104; Location=616..1854; Strand=+
  SCN-specific regions: Sequence locations=1-117,139-287,309-390,430 -599,621-694,718-1147,1178-1183,1205-1239
atggtgttggcaaagacgcgaaaccaacaaagtgcggagccaaataacttgctggaccatttcttggatgaccacaactgtgaacgggacaaagagtgcgattttggacgaaaaaatgtgtgcggacaggtgagtgagagaaacaaaccaattaaatttgctaattagccttaattggctcattaccaaaattttgtatattattctgtttaaatagaaatgtttcaggcaaaattccttgaagagctccgtacagtgctcagtatgatactgctgtttgtgccaatgccattgttttgggcgtaccaatcacatatggtacgttcaaaaaatgttgaggctgatcacagataaacagggagcggcataatgaaaatgcccaaatacctgacaaaaatagtgatgaaataaaaaattttcttttaatgacaaattcgaaaaaaattttaattagcattcactattcgggatttgtactttttcatttagctctcaatttggtccatccaacgggtgaacgtcgacccgaatttgccgatgatcggtgcctttttcagtcgtgatcaaattgggctacatttgaatatttttgtgctcgttctgataccaattttatatgtgagtttgtctgatattgnggataaaaaattgggtttttttgccaaaatcaattttccttttcagtacatcgtttatcatcatcatcatcatcatcattggcacaaattctgcacatgancacgtaagccaattcattantaatggaaaattttcaggatttcaaatgtgatataccgtatacccaaggtatacaaatgttctctcacttgttccaacttctggttttataggtcacacacccactatttgttcgtcaaaagaattttctttttttaattttttgggaaattaagagttttgcctttttttgcagaaagcctatgatgacccaattctgccatcattaaggtatttgaagaggatggcttccggcatatttttgtgcgctttggctagtgccgtttcggcaactgttcagttccggctcaatgttagtgtcaattaaaaaaagactctgctgttcgtctttctattttatttaaagcaaaatccgttagagatttcatgaaaatttcaaaaagtttgtaaaattaccaaataattttcaaaaattattgacgaacccttttaaaatctttttaaatacaaaagtttcacttgtgcctaacggcacaaaaa

SEQ ID NO: 78087 - DNA, 1553 bp, Heterodera glycines
  Genomic contig location: Contig_ID=SeqID_14104; Location=2270..3822; Strand=-
  SCN-specific regions: Sequence locations=1-26,48-403,425-643,665 -795,817-1038,1060-1553
atgtacaaaaagtggtccaaatatgtacaaaaaaccccaaatatgtaaataaaatttttttaatggtatttttgggaaagaaaatccccgtaaagtatgaaatagccacaaaatgacataaaaattactttttttggtatttttaggcaacattttcaaacttattttttctttataaattttcaaaatatgtacaaaaatatttgccgaaattttgaatttttttttgaggatttccaaaaatttccgtaaaaaatactcaaaatatgtaaagaaaatgaaaatatatatgaaaaaaatccaaaatatgtacaaatatgtaagaaaatcccgaaatatgtataaaaaccacgaaatatgtaaaaatatgtaaataaaagtcccgatttttgttcgcaaacacaaaaaagaaagtgtttttcctgctatttagagcaaggagaagctaggaaaaaaatatgtatttacataaaattggcagccctaataccgtatatgctctaattatagcccagtctctattaataccgcagtctccaattatcccccccccctttctgaggagtttaaaaaataatcacccagtctccatttatcccccatgggggataaatagaatttgagaacattgtttgacactaattatttctgaaaaacaaaacaattttccagcaaattggttgataatttgcggcaccgtgttgaccaacacatagggcttgagcttatgaccattgctgcgggcttttgcagtggagaccggacaactggggtcggagggatcccgagtccgggataccgaccgaatcccgatcccgatcaatcccgaacattttggaaaaacgatcgagacggattccgagtcgggatcccgaccgaatcccgatcccgatgaatcccgaagatttttattcgggatcccgcgggattatcgggatttgctaaaacccaattttttattggctttttaatttttagttttgtgctaagttttgttcaagtgcttatctaatatttataattgatcaattcgattgtgaaaaataggaatggtaatttattaggtttttatattttttttccaaaattagaatatctagggtcaaaaattagaacatttaacaacatagctttaaatatttttacaatttaatcaattaatgtcaatttctgtattttcgcctcctattatcattttaaacaattttaaggaaattagaaaatcgtaaactgcatcgggatcaaaaatcaagaatttttttcgcagtgaatttttttcaaaaactttaggggaacaggggggaggccggcggtgccgataggcgccgccgggaaaattttgaatttgaaatgtaatttgttaacagaatttatcctaaaactgtccatattttgtgattttgaactaatttataagaaataatggggttttatgtctggcggtgacggataggcatcgaagaaaaatacgtagacatcaattttattatgattttttggacaaaattcttagaaatcgttgtgccatgaaactacctattataaaaaataaa

SEQ ID NO: 78088 - DNA, 1244 bp, Heterodera glycines
  Genomic contig location: Contig_ID=SeqID_14105; Location=87..1330; Strand=-
  SCN-specific regions: Sequence locations=1-25,78-239,261-264,286 -421,444-495,536-720,743-783,812-943,965-1094,1117-1244
gccacaaaacatcaccaaagtgatcatcgatcatcggtcaatcaatcaatcaatggccaatcaatcaatcaatcaatggtcaatggtccgtcggtcgcccttttccccggccgttaaaatgcgcaccgatttgatcacaaagaagaagagatccgatgagcacactaaagcaaattcacaatcagaaactaaattcagtcgtcagcagagtcattaagctgtttttgttcactccgaaggaaaattaaattttgtgaattaaattatttgtttttaaattccttaaatacaatggcgaaagcaatgatttgcttaacaaagcagtgataacagcagttgtgattgatcaagtcgttagcaatcaattacaccaaattatgcaattaattaattactcatttcgccgtctgtcccccctccttttgctcatccctcgcgccggtctcttcagcaactgcaaattcgcagtttttactgcgtcgaaattttaacaccaattttatattttaatgttattatgtattaattaatattaggtttggttaaagattcccgcttaataatcccccgggttttggccacttctttcatttccttttttgatcaaacccatcgattcccattttcaaatgccatataatttccacctgctgcttctgttgtttttgtgcattgacatcttttgcgcgacaatcgttttgtgttcgccgtccccgcccaaaaagagaacatttccatttggaaaagggtaaattaattgaatttctttgaaaataccaagtcaattttttaattttattattatttttttgtgtttttagtttaggaaattcgctgccaatttcagtgccggtttggccaaattcgttgtcccattattatcaataaccgatcgaacaaaacgcagtcagccggggtaattaagggcattcaattaatccatttaattttaattagtattattaatgaatcacaggtgtatggcgcattaacgtgcaatggaagccccgctggtggggtcagagtgaaattatttgacgtcgaccgctgtaagtgtcagaaattgggagcaaaatgcgattacataaatttaaataaaattgaaattcatagaaaaaattgaaatttcagagattttcctagggttcgaatcggacgatctgttggccgacggatggaccgctcagaacggcactttcgctttgtatgggtccgcaaaagaggcgacaaaaattgtgcccaaa

SEQ ID NO: 78089 - DNA, 135 bp, Heterodera glycines
  Genomic contig location: Contig_ID=SeqID_14107; Location=594..728; Strand=+
  SCN-specific regions: Sequence locations=1-135
aagatgtcaaaaaggggctctgtgaagcatcttgctattacgtcgatgatgtcgaccaggatgattacacaaatagcggctttaaaaacagatcgtcacgtttggctgatggtgccaaatgtgaaaccatggtga

SEQ ID NO: 78090 - DNA, 513 bp, Heterodera glycines
  Genomic contig location: Contig_ID=SeqID_14107; Location=3321..3833; Strand=-
  SCN-specific regions: Sequence locations=1-370,392-513
ggaggctgaaagcaacggaggggaaattttgtatacggacactgacagtatttttgttttgcatgatcgggacgtggagccgatcacaacgggaaaatatttgggagagatgagcgaggaatacggcggctatgagattgaagaatattgctgtggaggggcgaagcagtacgcactgaagatgagaaacaagcagacgggggatattgaatatgttatgaaaattagagggattacgttcgacgtggacaacaggaaaacattgcactacgatacattcagggagatggttttgaattatgggaaaggggaggtggacccggcattcttcgtctataagaatgattttgggtgagttttgtaaaaattatttgcttcattaataaatcaatatttaggccgacaagggattcgaaagtggtgacgagggagaagcataaaatgtacaggccggtctgtcagaagggtatcatcgatgaggagcttaatgtgatgccatttggattttgttaa

SEQ ID NO: 78091 - DNA, 57 bp, Heterodera glycines
  Genomic contig location: Contig_ID=SeqID_14109; Location=244..300; Strand=+
  SCN-specific regions: Sequence locations=36-57
tgccctaccgggaccgggacctgagcttttcaaaatccgggaccgggaaccgggacc

SEQ ID NO: 78092 - DNA, 1071 bp, Heterodera glycines
  misc_feature (778)..(778): n is a, c, g, or t
  Genomic contig location: Contig_ID=SeqID_2149; Location=338..1408; Strand=+
  SCN-specific regions: Sequence locations=1-271,294-580,606-1032,1055 -1071
atgagccacccaatttggcaaattgggctttttaaacgaactacagaagattcggtcgagtgtttggagtgtaaaagtaaaaacgtcagtaattttactcttaaattgtcacagcggagtgtcaaagggctcaagacccatttgtttgccaagcacaaagacacgccatatgcagaaaaatacttaaaactggatgaaggcaagtcaaagaaggatggtccaaaaatcacagattatacaacacggagttcgggtccaagaataaaattgtgatttaaattaattaccattttaggcaaattaagtgtgatggacaaggacattatcaattttattgcttgttgcaatttgccgttccaaataatcaaccacaaaactttcaaaaaattgctccgaaatccttcggaaaatttacgcgacgaaagccattaccgaaaaaatgtcctgcctgaagtttacaaagttgtcaaacaccagatcaagggagaaattgctgagtttgagcaaatttgttgtacctctgacatttggacttcggatacaactaaggatgccttcataaggtttttattcgtttggtacaaatgaaaatattcaaaaatttagcttgactgctgttggtgttagctcaaaattttcgcgcaaaaatttactctagctattcaaaaatttcatggggcccacacttcggaacgcatctctgaaatcctaaaagctcttctcgaaagttggaatgtaaaagaatgccattgttttgtgacgatttcggcagcaaatntagttaaggttagtttattgaacattttatttcaaatacattttttggaggcattggatttaatgcacattgaaagaatcagctgtgccgctcatgacctcaatttatgtgtaaaggattgcttttcaaaagaaaaagacgaaatggctcaaattttcgaaaaatgtcgaaaaattgttggaactttaaaacattcggcaaaattgatggatgatttaaaagatgttcaaggcgaacttggtctaccgaaagctaaattgcttcaagttgctaattatcaaatactcatttaa

SEQ ID NO: 78093 - DNA, 463 bp, Heterodera glycines
  Genomic contig location: Contig_ID=SeqID_2149; Location=2882..3344; Strand=+
  SCN-specific regions: Sequence locations=1-65,87-250,272-463
atgaataaccgacggacaactctgtacaaaagttaaaagtttttttatgagaaatttaaaatagcaagttttgtcctgattttttacatttgtttggcaattttttaaatagggaatgtctgattgaattgaaatattctttacctgagaatttatgcttaaaactaaaatttgatttcgccacgtttcggagtttttcgcaaataatgcgagagggccgaaggagagaagccggaaatttcttccaaaattttctataatatttcaaaaatatcttcatttaaaaaattggaagattttgcactgtttttcactttttttctacaaaggctcagaatctttgtcattctttcttaatttttcagactttttcactgctttgtttttcgtcacttatattggtgcaagtgggtttcttaaaaactgccacccatacgcgattcttaaaactgccaaaatatga

SEQ ID NO: 78094 - DNA, 861 bp, Heterodera glycines
  Genomic contig location: Contig_ID=SeqID_2150; Location=861..1721; Strand=+
  SCN-specific regions: Sequence locations=1-17,39-161,193-495,517 -815,838-861
atgatttattcttctgctatttgttttggaatatttattttcaaccatttttcaattccgttttcaaatgcaattccatttgtgagtcaattaattagggaacttaatttgtttaatcatttttgataggaagacgacaacatgtttaatgcgtttgttcgaaatggtcataaaatgcaaatcaatgaatattcaaagcaaaaatatgagggacattttggcattgtttattttacgagaaagaattggcaatgtgacaaaattgtggatgcatttgaagaatatgaaagggcagaatgccaaaaatatcgaaaatatttggacattttgtacgaatatttatatagagagtacgtcggaattcaaacagtgaagcccaaatttgtgtttaaagaacgaattgaaattgaagggtcaataatttatgcggtgatttgcttggccagaatttcgctattttattttaaattatcttggagtaatgactttaaatataaattaagtgaatttttcatttataattctgaaccaaaattgttgaatgagaagagattaaattttgaagttaaattggttaatgaaaatgaaatgccaattaatgaaatgattttgcaattggcaattgacagagcatatgaatatcaaacaattgaaagtttagacgcaataatccgacaaaaattcaagaaaatgttggaggaaatgttcaaaaaagcggaagaaatggcaaaaaaacataaatggcaaacctttttcgcgattttttatccatattttttaatgccctaatgattagagctcgacaaaacgacttttggggggttttaaatgcatttctttgaaagatttgttcagctttta

SEQ ID NO: 78095 - DNA, 849 bp, Heterodera glycines
  Genomic contig location: Contig_ID=SeqID_2150; Location=2093..2941; Strand=+
  SCN-specific regions: Sequence locations=1-592,614-721,745-849
atggccttattgtctgtcgtaactcgttcctttggtatgtctagcatttgagggtaagcgtatggcttcagtctctctttgcgacagtttaaacacccatattgctttgactgtatcgtgttttgatgaatcttctgccttttggtatccaaaacttctctcttatttgtgccaacagtgtgttatgatttgggtgtctcattaacaaatgtgcctccatgacattgagttttgttgtccatgattccggtggcaaataaattggaaatttcgtttcctcatttattattgcttctccaattcgtcctctgcatctccagagctctttatcgttgaatagacgaaggtctctttgaagtttttccgatggaggaaattgcttttgtgcctcccaaattattaactgttcagatgcacgtaattctgacacagacagtatacagggacaaagaattgataggcttcctgtaccaataataccctcattgacaagatgcccatgagtataccatcaatacaattttcgaattttatgtttcctgtaccaaggttaccctcatgggtaagatgccaatgaggatatcatccatacaaattttttaattttatttttgttcgaattcgggaatgccggattcgtgatcagcgaccccaaaaaccccttaaaacctattttcattatcggttctggtcggttttatgcgcaatttcaaaccaggtacaagcagctgcatcaaaagcgatcagaatgttgcaggggccattcaatgagctaaattaatgatattttaatttttgatttcggcactttgtaaaataattgaaaaatattcggaaattccttaaaaa

SEQ ID NO: 78096 - DNA, 562 bp, Heterodera glycines
  Genomic contig location: Contig_ID=SeqID_2150; Location=3071..3632; Strand=-
  SCN-specific regions: Sequence locations=1-222,244-245,281-361,403-562
atgtgtccatgtcgagcagttttggtggacggcggttgcgattcgaccgtcggacttcgttctgattgtgctcgtccgggaccggctgctcttcaggttgttcgtctgggaagatgcacaaatgcgctgagtgtagcggtcgcaatgacttacactttcacaaatgtgtctttccttaaaattttagaatcttttacttacttactgcataaatatacaatttaaaatggaccaaaataaaacggtatttaaaaaattattatataaataataaattattggtttttagctttttgattaagttttagaatcatttattcattgcttattatatcaattaaaatgaatcaaaacgaaacggtatttaaaataaatatataatataaaaataataaaaattttgtggtttagctttttgagctttatgcggaagacggtttgccatgggcacttatcgctttaacagcggtacgaacatttatctccacaattgggataatatgtaacttagcactagtatacgtcaccatcaaaaccaagtaataaaaaatgataaaataaa

SEQ ID NO: 78097 - DNA, 1480 bp, Heterodera glycines
  Genomic contig location: Contig_ID=SeqID_2150; Location=4386..5865; Strand=-
  SCN-specific regions: Sequence locations=1-143,168-1091,1113 -1154,1176-1480
atgggacgaaagaacataagtgtcgcgaaaggacgagagaaaaaggatgggctttggatggccgggattgttcccggcggactgaaggaagcagggggcccgatgccaaacagtgattaatttatgatcacccccaccatttttgcttccttttcccttcctttcacttcaacaatttgcctcccccccccctctttttccgtcttatccaatttgtttaccatttcccttccttttgcttctcagcatttctcatttgcatttttgtccccccgctcactttcatttcgaaatgttttcctttgttgccccaccgcggggcatctgctctcaaatcgcttcttttgtcccaattttttgcccgtcttttctcaccattcaattcaattcattttgtaccttgggccccaatgtcatcgggcaaatgttcttcccaactttgtccccgtccgaaatgcccattcacgtgatttgcatttcttattgcccggcctatttaacccccgccggtaatctctccggcgttcactcttatttccttcggtcatctttcccttttctttcgtccttcccttcacttcgtctcccccttatcacattttcctccaaatatgtgcccttccctttggcaataaatatttgtgtgtttgtcctttcctttggacagaggaaaattgcccttccctttgggcaatcaccaaattcggtcattcggttggggcattcggcgcccctaatcgcattcggagcgatcagcaattgtcctgcgggattggatcactcctgatccttgcccactccctcccatcgcccttccctcctcagcgatcggagtcggggctcatcccggcaggcaattgggaggttcactcactccttaactgagtggtggtgccgttacatcatccccattttgtcggccctccccattctcctttctcggccccccttgggcattcaattcggaaaggggtcgacaaagccgagaaggagggcaaaggaaaccggcgataacccctccattgatcgccacctttttcgacaataagaaatgcatgcccaattgatcaaataattcatgcagaaatttttgatcagagtgaacaacttggacgaaataaccgacaattttatcaaattgttgttgaaattatggaagtgaaagaagaggagagtgaagaaaagtccagtaattgttatgaattggaacaattagatgaaaataatgaacaaaattatgatcattttccaaataaatttgataaaatgaaaagagaaattatggaaaaatttaataaaattaaagagataattaatcaaatgtcaaataagtattcagataaaagaaaaaggcaaaaaaaaaagttgtgtgcaaatcgactgaaaatttaccctaatggaaaagataatttggaatgaatataaattaatattcggatgaggaaaaacgtgaaatattaaaacaatttgattaaataaa

SEQ ID NO: 78098 - DNA, 742 bp, Heterodera glycines
  Genomic contig location: Contig_ID=SeqID_2150; Location=6364..7105; Strand=-
  SCN-specific regions: Sequence locations=1-19,61-198,357-454,478 -511,533-665,711-742
atgaatcaaaacgaaacggtatttaaaataaatatataatataaaaataataaaaattttggtgtttagctttttgagctttatgcggaagacggtttgccatgggcacttatcgctttaacagcggtacgaacatttatctccacaattgggataatatgtaacttagcactagtatacgtcaccatcaaaaccaagtaataaaaaatgataaaataaattaaatcatttttatttgttagaattaattatttttcatttttcattttttagaattttttttaattcgaaattttttaaaaatccgctattttaattttaattttgtgaaaaaatagaaaaaatttattttttaaggaatttccgaatatttttcaattattttacaaagtgccgaaatcaaaaattaaaatatcattaatttagctcattgaatggcccctgcaacattctgatcgcttttgatgcagctgcttgtgcctggtttgaaattggctcatggattggcatgttccaaattttggtgggccaacaatttgtgccaatacgtctgtgctgtgtttacctgttgctaccattcattactggcatttatgcttcaatgtccgccactttgttgatcgcttttgatcggcttctcagcatttgcttcccaatttggtgtcttatttaatattttaaatgtctaacaaaattatttttttatatttccccaataatttttatattatctccaattaaa

SEQ ID NO: 78099 - DNA, 155 bp, Heterodera glycines
  Genomic contig location: Contig_ID=SeqID_14111; Location=1373..1527; Strand=+
  SCN-specific regions: Sequence locations=1-93,115-117,142-155
  Gene Ontology: Mol. function=translation elongation factor activity; Biological process=protein biosynthesis
atgttggttattgcccacgttgaccatggcaaatcgacacttaccgactcacaggtgtccaaagttggcattatcgctggtgcaaagtctggtgagacgcgcttcactgacacacgcaaggacgagcaggaacgttgcatcgccatcaaatctac

SEQ ID NO: 78100 - DNA, 637 bp, Heterodera glycines
  Genomic contig location: Contig_ID=SeqID_14113; Location=347..983; Strand=-
  SCN-specific regions: Sequence locations=1-259,284-450,473-523,546-637
atgaagcgccttatggtgctggcggtagcggggaaggttgccgaggtgaaggcggtcgggcattcgtccggctgggaagaggacgagaaggattggtgccgcgtcgccagaaaggtaactgaaaaatgaattgaaaatgaccagttcaaattggcaaaaccatgcgtttcggtctaaaaaaaaattttttgttaaatcttctgactcaaaactttgtttaaaaatacatggaaacaaagcgaaagtcatcactgtttcaataaaatataatttcaactatttttggattaaaaatggaaatttgttagagcttttgttcgaattcggattagaattggtcgagagggatgccgaattctcgaaacgtgtttttagaaattacaaaaaaaaaaaaaaaatttctgggaccagtaaaacacattgttgccgtttaattgcagcctcaagacttaaaaaagtgaaacaaaaataaataaacttataatttaagcttgccatgacgtcgacaagatgggcagagattgaaggggaggaggagaagagggcgtttgtcaagcgggaggtccggcggttagagggatgggccatgagaacggcccggaaggagttggtcgccgaatggccggatgttttgcgg

SEQ ID NO: 78101 - DNA, 504 bp, Heterodera glycines
  Genomic contig location: Contig_ID=SeqID_14114; Location=324..827; Strand=+
  SCN-specific regions: Sequence locations=1-82,104-249,278-504
atggttagcaagcacagtttttaacttaagtgattaattttcaactgaaaaaaacaccccctaagaatcgacactaaaattaaaaagagttttttatttgaggtgtgccgggcaagtccctcctggcgccaccttgtaaaaaaaaaacaaaattaatgctttcttatctacatatctattttcggttaagtgctatttggtgatgacgacgcggcggggggcagtgcggaaggggaagcagaagcggcacacgaagaggaggaagaggaagaaaatggtcagcaaattgactttgttttcaaatttaaaacgcgttattttttttttttgcttgaataaattgtagtttttatcactagggttcgaagttgtatgcttttgcatattttttctgcgcatatgctatgaagaaagcggctcaaaaatagcatttctacgttaaaattttttgatttgatgaaggtttttagtgcatataaaagcatattttgggggttttcgaga

SEQ ID NO: 78102 - DNA, 649 bp, Heterodera glycines
  Genomic contig location: Contig_ID=SeqID_14117; Location=84..732; Strand=-
  SCN-specific regions: Sequence locations=1-171,194-649
atgcctcgaaagagaacgttaactggacgacgagagagaatgctccgacgtgaaacatcttcacgtctgggaaaagctgacagtgttgcgggtgcggcttcgattccttcacaggattcattggccagcacagcagccaccagtcctattcaggacctcggcaatggtctccattatttgtttttatttcatgagaatttaatacctatttgtagtgccatcaacctcaaccaatatccgagcacaatgcagtcagccacggggtgctgttgaacctgctgtgggtacgtccccaatggatctgggcacctgtgttgtttcgactccgaccaccactggattacaggccttaagcattattggaggtcttgatttaagcaaaattaaaactaaaacaatatatattaaacaattgccaggctcttcaaataaaagaacccgtcacagttcaaacgtgggtacgcaaaacaatgcaactcagcacacggtacagcaacgagaggatgcaagcgacgttgaaagcgttgcaggtattttgagtcaattttcccataatttttcaacaaaaagtcacagatactcggcgtcggaagtcagcgccgacgctttttgctgcgggtgcgaacactccacgttgtacaagcgttag

SEQ ID NO: 78103 - DNA, 386 bp, Heterodera glycines
  Genomic contig location: Contig_ID=SeqID_14117; Location=1073..1458; Strand=+
  SCN-specific regions: Sequence locations=1-1,23-197,219-237,261 -265,347-386
atgctgggacctgtgtgcaggcacgcagggatattgttcatagtaatttttcaaattataattaggtatgcaattaatgcttaaatattttgtgtccaattcctttaaagaattttattttttcaatatttatcatttaaatgttaagttttttgaggttagaaaataaaataaattttcattgtactaaataaaaaatttgtttttcagaaatggggaattaagcattgagaactcaaaaatcttaaagtaattattttcagtgaaaatattaaagaaatacaaaaatagttaaattacttaaaaaaattaatgaattttacatatgaattttatatataattttcactgttgaatttttgtatatttatgcaaaataattatga

SEQ ID NO: 78104 - DNA, 1736 bp, Heterodera glycines
  Genomic contig location: Contig_ID=SeqID_14118; Location=906..2641; Strand=-
  SCN-specific regions: Sequence locations=1-217,240-612,634-922,953 -1164,1203-1494,1537-1736
atgagcgacagccaaagcagtgatgatgaactgatgtattcggcggatgagaatttcgagatgaaagtctcggttcaaagcagcaaaaataatgacaaaatttcggaagccaaaaaacattcaaattgccaaaaagatccgttggaggatccaccaaatttcgaaaatttattagataacagtccaaattgccaaaaagatccgttggaggatcaacaaaattttggaaaagattcgttggaggatcagcaaaatttgctgaaaaatccgttggaggatgaacaacattttggaaaaaatccgttggaggaaaaaagtaaaaaattcaaaattcctgaggatttgttgggggattctcaaaaaccaaaaactcggaattatgtgccagaaaacattccaaaagtggtggcacggtcaattttggtttttattgtggataatcaagtggaaatcgaactgaggcaaataatgaggaagaaggaaatgaaggcgatggtttttcgaccgagaaagtgggacaaaaatacaattggcacagaaatcgaaattggcacgattacacaatgcatagtgatttggagagaaacgatggacgctgaactgttggcagttctaacaaaagttgaagaaatatgttatgaactgctttgtatttgggttgtccccaaaggagtgccaattcacgttatgaagaaaaggtttccggccattgttcgagtgccagaagaagaaaatattgacaatttattgacaaaattggaacaaattggaatgccaattgagaaaaggggcgaacaaagatggcacgagacagcttcaacaaacgcacctagagtgaattggaaccaattgggagacggtcacagagtgcaggccgcgggaagccattcatacaattcgtttgtggcgccacatttttcatcatatttgccaacaacaacaactaaaatgttcttcccaactccggaaatgccaaaaaaggtgaaaattttggaaaaatccaatcagaaaaatttgatccctttgtggtattgggagtaaaacgaaagtctcaatctccagaatcaaattatgaagaaggagacatttttgaaggccctttgtgcacaaaacgaaccaaattttgggtaaattcgaaatgtgaaactacaaacacggaaccgttgggggtcaaaacatttttcaaaaatgaaaataaggaaatttatcagccacattggaaaccaattgttttaagttcaccttcaggcaaaaaaggagctttctttttcgggaaaaattttgttttttcaaattttcatccgtcttcttttatgatggatggctttaaatgggacaatgtggaacaaaaatactgctttgagaaggcctcgttttttggctattttaatttggcaaaaaaaaattaaattcaaagatggaattactgaaccaagtgaatttaaaaagattactgacaaagagatggaccaatataagtcctttgaagaaaatcccaaaatttttgatcagtatgtatggaatagggttcgagaaaatgtcatacgcccaattttatgggcaaaattcacacaaaatgaaaaatttggtcaaatgttgttggaaactggaaaccttccactgtatgaggcctcagtcaatttttcgtattttttatttgatcatttttatttgtttgtttattttaggctccatataagatcgctaatgcacatgtggcttgctcgataaataaa

SEQ ID NO: 78105 - DNA, 68 bp, Heterodera glycines
  Genomic contig location: Contig_ID=SeqID_14118; Location=322..389; Strand=-
  SCN-specific regions: Sequence locations=1-68
aaaatctttttcaatggtttttgctgatgactctatatttactcctgtttttgtgtatgaatgttcgg

SEQ ID NO: 78106 - DNA, 1218 bp, Heterodera glycines
  Genomic contig location: Contig_ID=SeqID_14118; Location=2808..4025; Strand=-
  SCN-specific regions: Sequence locations=22-187,214-222,244-310,342 -980,1002-1218
attttcattccaaataattcatatattgcgactttattcattagagatgcacatttgaagacaatgcatggcggtcgcgaattggtgaatagcaaattgagagaaaatttttggattcctaaaagcagaaggaaaatttatgaaatattaaaaagaaaaaacaaagaaaaatgcgggatttgtgcaaaatttacaaataataaatatacatatcctaaaaaccctcctctaccagtgtttagagtaaaagggaaaagtgcatttgaacatgttggaattgattattttggacccctctccgtaaaaactttggatggcaataaaaaatgttggggagcaatatttacatgtttaattgtaagagcaattcatttggagttagtttccgatgtaagtgccgaaaaatttcttttagcatttcggcgattcattaaaagaagaagagtgccaaaattaattatttccgataatggtacaaattttgtattagcaagtaaagcattaaaacaaatagcacttgaagaaaataaacaaaatagaatatggtcagaaatttatcgtgatcctacgatacaaaatttttcatcaaatttgggaattgattggcaatttaattcgccatatgcgagttggcgcgggggagcttacgagagaatgataggacttgttaagacacatttaattcggagtttaggaaaacggttattgagttttgaagaattaatgacatatttaatcgaagtcgagaggattgtaaacgaacgccctttaagctatataacccaagatgaagtgattgaaccattaaggccaatcgatatattaaatccgacggatggagaacctttctcattgaaattagatccgacatttgatcgggaagacataaatgaatattttgaaaagaaaactaaaagagaagaattatttgaaatttacaaaaaggcaatttttaaaagtgaaatattttggaaggaatggagtgaaaaatacttattatcgttaagagaaaagcacattaacaaaaataaagatggaaataaatacccaaaaatcggacaagtagtaatcgtgagagaccaggataattatccaagatcaatgtggaaattaggaaaaattttcgaaattctttctgatagaactgttaaattaaaaataggaaaccgaatggcggaaagacccacaaaattattatatcccttagaaatagaggat

SEQ ID NO: 78107 - DNA, 173 bp, Heterodera glycines
  Genomic contig location: Contig_ID=SeqID_14119; Location=27..199; Strand=+
  SCN-specific regions: Sequence locations=1-99,121-134,156-173
agattctccccgatgtgaagaagatgatcagttccgcctgaatgaagggcacacgacacaatgatctttgtttagatttttagacaaatttgcttgttttgaaatatatttttatcacatcttgctggcattttcatttttctgaaataaaaattggacactgaaactgaaaa

SEQ ID NO: 78108 - DNA, 876 bp, Heterodera glycines
  Genomic contig location: Contig_ID=SeqID_14119; Location=510..1385; Strand=+
  SCN-specific regions: Sequence locations=1-24,46-136,158-185,208 -212,236-686,708-714,739-757,779-876
atgcgtgaaatggaagatgtcctcattttgtcttttaaacagcttccgatttggtttctctgggccagcagcagcagtcgtccactgggccttttctgcatccgtgtttccctccagcagctgtgtccgctttacatcagtcaaatccacaacccttcaaagtccaacagtcgccatcgattggccaacagcagcagcaacaactgtactttgttcagcaaagtatcatcaaaaacatgttgtgtgagactaactgactctatgcctttgtttcgcagatgcccaaggcaacttcggtccaatgcattcgtcttcatccacctccccgctgtttggtgtgagacagatgagttactttggccccggtggtgcttccgttcaaccaaactggaaccagcagcgtcaagtgatcataaaaatggctcctaatatgactctggcaaacaaaaaatctttaaggcccaatatattaataaccctcaacttggtcagcaaaacaacataatgtcacctcctaagcaacaacaacaatttgtcgttgcaaattgtaagccttcgcagccgtgccaaatcagctcttttcccgctgacgttgtccaacaacaacaacaaacgatcggttttcctccgccaccttctcaatcgcttcagaactctccccctgttgccactaaacaagaactaaaccaacaccaataccaccagcaaatgcttgttcagcaacaacaacaacaaaggtacgctacttcatatacccaacaacagtttctgtcacaaccgaaccctactgcatttccgatggggtcaaattacggcgttgtggaccatcgacaatttatgagccagccatgttcaattccttcaggtaccagctga

SEQ ID NO: 78109 - DNA, 742 bp, Heterodera glycines
  Genomic contig location: Contig_ID=SeqID_14120; Location=231..972; Strand=+
  SCN-specific regions: Sequence locations=1-742
atgtgttcgattatactttttaccttctgctgctgttcagctgagtatctgcacaaatgttgtgtggatcctgagaaacagtacaaaatggtgaagcggaatacggtaattgtaaaggggcggagtcgttatttaaaaaaccatgattatgaaattcttgtcgaaaaattatttataattttgctccaaagcaatcaaatttttaattcttgatatgattgatagctctaagtgtttctcatgaatgataacaatgattaaaaatttagtgcttttgagcaaattaataagcaaaaaaattcattttgatggtttttaaaataacgcacataatgatggtttttaaatatgacataacaccattgtaaagattcaatctaaatttatttaaatcataatttctaggaagatttggtaaatgaactcaggaagaaggatgagtgtgccggcaaaaacagaaaatgtttttgctgggcacatacgaagatttactcggaatctgctggcggctggtgttaaatttttgtgctgtgacaagtcattatgttcttgttgtgaaacggttggcatggataatggctttaatttgattaattaatgagaatttatttttcatttacttaaattggtcataaatttttctttaaactggaatgaaaaaaatttaaccgaagatttgggacaacattttttaagtaaatgtttagtgtccaccaatgcagaacaacactgataggaaaaa

SEQ ID NO: 78110 - DNA, 615 bp, Heterodera glycines
  Genomic contig location: Contig_ID=SeqID_14120; Location=1353..1967; Strand=+
  SCN-specific regions: Sequence locations=1-170,242-281,312-413,454 -496,518-541,596-615
atgcccacgacattttctatttgtatggatgccgaatcggcggctgttcttcggcccttcctgaacttgaattcgttggccaattgtcaatgcggatgggccaaatgcgtgaatgggtggcgagtggctgctgtccggtcggtacagcttcaacaatgttgtgtcacgggtaaataaaattctattgaataaaagaaatatttaatttttaaaaatttttaaatgcaaaaaattatttaatgtttctttttttgaaaaggctattccaaattcatttatcgttttaatgaaaaaatatataaaaataatttgacgggcaaactgctatagagtgattgattaatttattcagcgaaagccgatttctgttttcaattgaatgccgtcgagccctttaacaaatcggaagtgccaaataaaatatattgattttaattattatttttttaatatccatattgattttaatttctttatcaacattctcacatacaaatgccaaattttcttatttttggatttgctaattaggagtatttaattattgttattcatttatttctcttcatctctacttcatttttatttttattttattgaattaattttagaaga

SEQ ID NO: 78111 - DNA, 992 bp, Heterodera glycines
  Genomic contig location: Contig_ID=SeqID_14121; Location=37..1028; Strand=-
  SCN-specific regions: Sequence locations=1-729,755-992
atggacaaaacgctcgcggaaattttggaaaaattaacgcaagcgatcaaacagcagagcgcgccgacatccaccacaactccaccggcacaaaacatcacattgccggatattcatccgttttcaacagaaaatgtggaggaattcgaggagtggttggagcgattccaattcgcattggattgcgcagcggccaatatggcggatgaagcgaaagtcaaattgttgatgacaaagctcaatccggccgccttcggcgaatacaagcgctactgtctgccggaggaaatcaccaaattcaacttcacggacaccaaatctcgtcttattaaattgttctcacatccgccatctttagcgattaatcgctatgaatgcctgcgagtgtgccgcgagaacggcgaaaaattcgaaatttttgtgaaccgacttaaggcagccctccgcaaattccgtttttcggaattaaacgaagaggaattcaaatgcctggttcttcttacgtcgcttaagtcaccaagcgacgcaaaattacgccaacatatcctcgcgcgtctcacagcagagggcacaaagacgacaaaaacgtccaaattattcgacaaagtcgtcgaggacttaaatacacagctaaaaacggaggcggaagcaaaaattttggagcagccaaagcccaaaataaacgcaattcagcatggcaaatcatcgccaaataagcaccaaaatcgcggaaacggtcgcccaaatcaaaaattcacgggcaaatcaaaggccaaaataccgccgagcaactgctatcgttgcggagaattgcattgggcacaggattgcccaaagaaggaaaatatatgcagcaaatgcaatcgcagaggccacatcgatcggcaatgcgacaaaattcgagcatttcaccaaaataagggcagaaatttcaacacaaatacggtgatgctaagcgcggcttacatcaattccgtccattcatcaaatcg

SEQ ID NO: 78112 - DNA, 1594 bp, Heterodera glycines
  Genomic contig location: Contig_ID=SeqID_14121; Location=1717..3310; Strand=-
  SCN-specific regions: Sequence locations=1-1344,1366-1594
tcatcgtcgcagccgacgcttcacaacatggcatcggcggcgtcatatcacacaaatttgccaatggctcaataaaagccatgtcgcacttttcgcgttcacttacaccggctgagcaaaattacgggcaaatcgaaaaagaagccctagcactcgtggaagcagtcaaacgcttccataagatgattttcggcagaaaattcacattgctgacggatcaccagccgctgaagaaaattttcggcaataaagacggtgtcccgaagcattcgcacaatcgtctcgtccgctggtcacttattttgacggcctacgatttcgaaattcaatacgtcaaaacggacaagtttggacaggcagatgcattatctcgcctaatttccgtccaaaagtcaaaatccgacgacgacgaagtcattattgcctcattcgaagtggaatcggcattggacagaaatttgatcaacaatgtcaaccaattgccgatcaccttcaaaaatttggcccaagaaacggcaaatgatcaggcacttcaacaaattcgtcaatttgtcaaaaatatttggccagcacctaaaaattttcagccaattgaagggctggacgaagccaaattcattcaattttttcggcgccgcgacgaaatttcaatcgtcaaggactgcctgatgttcggcgaccggacagtcatccccaaatcactgcagaagcaaattctcaagctgctcatcaaggacatccgggagtcaagcgaatgaaatctttggcccgaatgcatgtctactggccaatgatggacgcagaaatcgaaacgttcgtccaaaaatgcacttcatgcgcagcagtcgccaaaaatccaatcaagacgacactgcagtcatggccaaaatctgatggcccatggaaacgcattcacatcgattacgccggaccatttcatggaaaaatgtatttgattgtcgtcgactcattttcaaaatatccggagatatttgaaatgaattctacaaatgcatccaaaatgcgctcattgatcgcgcactacggcatcccggaaacaattgtttccgacaacggcactcaattccaaagtcaccaattcgaaggtttcgtcaaatcgaatggaattgatcacatttttacggtgccgtacatgccacaatcaaacggacaagccgagcggatggtcgacacatttaagagggcatttgcgaaaataaaaggggagggagtcgacggcaatgtgctcgacacttttcttctcacatatcgcacaacgccatcagacacactggatggaaaatgcccggccgaattatttcttggccgaaagcctcgaataggcctcgacctcctccggcctccgctgtcaattccaattgtcaaggacgataaaatggaggaccaattcaatcgcaaacacggcgcaaaattccgatcattttaaatcggacaattggttttcacacgtcggcacaattcagcggaatggcgacacggcaaaatcatcgacaaaaagggtgtaatttacaccgtcgaattgccaaacaattctcgcggccgatttcatgccaaccaaatccgcgcacgtcaa

SEQ ID NO: 78113 - DNA, 3228 bp, Heterodera glycines
  Genomic contig location: Contig_ID=SeqID_14122; Location=388..3615; Strand=-
  SCN-specific regions: Sequence locations=1-113,176-363,385-483,506 -600,657-826,849-1084,1106-1489,1511-1921,1967-2046,2082-2368,2438 -2562,2584-2855,2877-3023,3045-3228
  Gene Ontology: Mol. function=pre-mRNA splicing factor activity; Cellular component=nucleus; Biological process=mRNA splicing
aatggggcgaaccgaatagcgctaacgccttatttatgcgacatttttgaataaaattggaattgcacatccacaacaccggagcagaagtttatagcttatcctcttttacctttaaaaaattattgcaaaaaatactttatttttaattaatttattatttaaaaatattaatgatgtcttcccaaattggcgtggtctgggaaaatatgggcccacatttactctcgtttggttgacatgcgggtttttttttgccactatttttttgaaatgccaaccttttgtgctattttttattttggctctaccatttttccacggacgtcagtcagctgctgatgcaacccccgccaatgaatcaaaaatgcaccattttttccaaactatgaattaaatgaatttcaaatttactgcctattcaatgcgcaattcgcaaatgtgccttttcgcgcgcgcgcgtgccacgcctaatcgaatcgctttatttaatttatttttttttgtaccgcaaatttgtatcattttacaattccattttatttgtatacaaattatgtcgatgaatttaatgagcagcaaaaatggacatttttgagcattaaataatttatacattttttatttaaatgaaatatatataaatttttttatttcccttttccaatctttggaacaattttcctattgttgtttgtcccgacactctcgagcaaccaattacttattgaataatttttcatgggaccaatgtctgtttgttttattaccacctgtaatcatattttgtttttaattttttgctgctctctttttaatttttaatttattattattattattattatattgccaatatcattaattaatttacaccttttggggaaatttcttcctcgtttcaatttgggttaaatgggcatttaaaatgtgcccttttctgcgcaggacacgcgtgcgcatgcggagagtgccaaggaggcgctggacgggaagacaatccatgggcgtcagctgcgtgtccgttactcggtccatggcgcgacaattaaggtgtggaaagggggaatagttttattaaacgtaattttttttaattatttttcaacaaattataacggatggggaaggggaatgagtatacggacatctcaatctgtatcattacgtcctcagaaaatttttttttataagagagtcccaggaatttctttttaatttagagatttttataaaattattggtgaaacagtaattcaaattttaaaaatcctcataaaattttcaaccctttgtttgtttttgtatagaaaagatgcataccatctcgtaaattgcgatttagaattgctttcaaaatcaaaatttttcaaaattcgttgtttttttttgggttgagttcggctgcgtttgggttactcccgatgtacaccttgagaaacgggtcgggccggggtttgttaaaatttaccccccccccccctctctcaaaaaacgcaaaaaaaaatttcttttttttttgcagctcaaggaactgtccccggcagtgtccaacgaaatgcttatgctctccttctccgccttcggcgatgtcgagcgtgccattcacattgtggacgagaaggggcggtccaccggcgaaggcattgtcgagtttgagcgcaaagtgtccgcccaggaggccatcgcgcagatccgcgagcgcgtcttcctcatgacgacgttcgtttttatttacggggggaaaattgtgcattttggatgcattatattcttgtctcctccgaatcttgagtaaaaatatcaacaaaaaaaaatttttcgaaaacgctaaaatttttcattgaaaattatataaaatgatgaaaaacttgaagaacctttacaattcacatattttttttactagaaaaaaactcagaaatttaaatagaaattaaaatattacaacttaaaaaaaaattttggcgggtaaacgggggctgtgttggcgctgtccatgcaattctaccatttatgtaattggaaattatattgacaaagatgaattaaaattttaaaaaaaaaacttttttttttttgcaacaccgtaaatattcttcattaggaaattctctgctttcgcccgatcgacccccccccccccccctccaaaaaaattaatatttttgagaccttaattagaattacatattttgatgtctctgctttgttttgcagtaattcgcgtccattgcaagccgattttttggaccaaaaggacgacgaagatggattatgtgagaagacaattcagcgaacgccatacctgtacaagtgagcaaatttgtggggataaattcgaaaaaaactaaaaaaaaaaaaactaaattttataccaaattctattattttgccccatttaaaatgcccaatttttatatttaaattaaattaagtttttgtcctatcccaatataatttattaattatgtttcacatttgtgtgattaagggaacgtgagttgggcccccgttttgcgcaaatgaacagcttcgagtacatctacgggcgccgatggaaggacttgtacgagtttgagcgcaagcggcgcgcggaagtggaggcggaactgcgcgagcaacgccgccgcttggacgcggacatggaggcggaatacgaggattacaaggcgcaaatgttgcgcgaaggtgaagggggcgggtgggataaaataattcgtgaaaaaactaggggctaatgtgagtttatagggtgggtgggaccaggataaatgtgttatcaatcgaaagctcttgatgagccaaatccacataggggcgaaagaagttggttgatccgaagcgattaaacctgctttaaactcgaaaataaagaaaattggccataaaacggtcaaatctggacaaatttgaatcactcgaatgcacttaatgagttaggttgccgcatgtgtactcactcactcacccatctgacaatgagtaccaaaatgaacaattcataccaaaaaatgatggaggaaaataatgaaaagttttttaaattatttttccatgctcaaaagatttaatttgcccctaaaatttggaaaattgcgagaaaattggaatttaatgcctgctgcaattatttaatggtagtgtcccgtccgatcaatttgtttattgtttttttccagaattgctgcatcgccaggaggagttggaccgtctggaggcccagcg

SEQ ID NO: 78114 - DNA, 2803 bp, Heterodera glycines
  Genomic contig location: Contig_ID=SeqID_2151; Location=74..2876; Strand=+
  SCN-specific regions: Sequence locations=1-232,294-339,361-731,753 -1124,1146-1174,1197-2089,2111-2197,2219-2616,2639-2746,2768-2803
atgtgttcgtacgaaaacggcctggccccagacaaacgtatggacattttccaatttgtagcctcacccaatgccaacccggacaacaacaccagcatcaactccgaagcagcttcagttgaccagaatttgccgcatttgatgcatcgtatggaagaattgcagccgaaattgatgtcattgaacatgaacttggccaatcgcaatcgcgacgaaattgtaaatgatggcaaggaaaaggaggaaccgaagaaaggggacaaggcggaggacgaggccaacaaggaggaggaaattgttgtccttaacccatacctttatctgaccaacgaagcaatggaaaagatggagaaggagcacaaagaaaaggattccgctgaagccaattcggatacggtgaaccatttttgtgattaaattcacggtgttaccatgtctagtaccactaatttgcacttttttaatttaactcatctttatccatataaatgaaaacattttttatgaatttaaatatttttcgattcactttcagaccaatgccaattcgttggacaaagaaaagcagccaacggcacccatccaattgggcaacaagcgcaaattgggagacggagtgaacaaagacaacggcgaagaagaccttatgaagttgagcacgcacaactcggaggaaccagttgacaatggaaatggtataattcacttataaaatcaaaattaaatatatagtaatatcttttgatttttcatgattttggtcgggatacgacggaaaattgtccgctttgccatccatccactcataactcaaaaatctatttatttttagtagcatacgtctcttcgttctcgtcccgctcctccacgactactatgtcttccgttgaggacgaggaggacagtggcaccaacgcgggtgacgacggttggatggtggtgaagaaggagtcgttcaagaagttgtgcgacttctacgagaagcgtcgtcgcgtggagtgcggcggtggcaccgtcgccgctgacccattcgcggaacaattggagcgcgaatttcgcgaggcaacgatggctgacaacaaccgcaccgatgaacgcgtggatgagaaattgacggcggagagtggtgagttgggggagggggataattttcgaagattttttaacttctaagttaggaaattttaaaaaattgcgggattgtgaaaagttcaatttggtctactaaaataactgaatttacggtttataataaatttattagtccaataattgagtctcttgtttaaaatttaaaagatattcacaattttagccgaatatgctcgaactttctacatgacaaagccatttagtgttttatttccctcaaatgcttcattttgattgctgtatttatttgtagaaccgaaaaaggcaggcgaattcgtgaaggaagttggacaagaaccggctgctgcggtttatgtggcacaaattgtggatttgaccaccgaaaaagatggaaagtcagaaaattcggagaaggtggtacataattcttcagtaaaagagggaaaaggaacattttttttagaccattccctgtgtccattcggttgtgatgcgcggcgtatgtgccggatgtggacaggattttcgtcaggtaaatgcaaatacggcaaaccatttattaaaacaattatttgtttttattgttagccaaatgaatttgtcgggaactcggctgccattttcaactttgaacagcaacagcaaaagatgaaccagaccgtgcccatttctggttcctttggtttgccacgatgttttcgcacatttctttttaatcattcatgtaacaggtgttgatgcccaccagaaaactgcaaaaaacatctatccgtctttggaactattggttagtacgatggatttaagggggggggggggtcaaaaagttaaaatcagacacacattttaaaccattctgtgtaaaatacaatcagattttggacgagaaagttttataggttcaaataatggattttttaggaaaaagaaccacgcggagggacactgatgggctgcgtggatggagaggaggtgtgcaccgccggactgccctacccgggctatcagaagccaaagggtcagaagcacagtcgtcactgcgagtggaagcacaaaagtgagcaaacgcaaataataatttttgatataatttttcatattccaattcgtactttgttcattttgccttccgctattccctgataattgccaatataaacagaaaaaaagccctcacgacaatgggttttttctagtaaaaagcgcattttagacttggtcatccagagtttggttgaacagttggtcgggatgggcttcgacaactgcaacggttggctgttccgtgtggcggagaaggaaggcgccgagttggaccgcatttttgtcgcgattgacgaggacaagatgtaccgtgcgcggatcagccttcagtgaagaaagaggcaatggaaaacgaaatgaggaaatttatgatgaggtggataaaagaaaacgatgctttttcggctttggtctttaattttaatgagctaattaattaagcaatgctttggaattaaactataaaatcatctaaatatttgtcccttattccttcgctcctcatttactcattcattttaattagtccatttgtaattgcatacattctgtatgatgggctttttcggcgtctgtatgtgtataatcatttcctttccagctctttgtcgttatttactcttgtcacaatcacatttattatcca

SEQ ID NO: 78115 - DNA, 743 bp, Heterodera glycines
  Genomic contig location: Contig_ID=SeqID_2152; Location=568..1310; Strand=+
  SCN-specific regions: Sequence locations=1-70,92-133,155-743
atgtccaaaatgttggtttcgtcgtttttgttgctgccgctactgttggtgttgttgccaaccatggacaatggtgttgatgatgatgatggcatcatggtcttctgttgccaagtctgaacaccaccagcagtgccattgttgttgccgttttgttgcggcggtgatggcactgccgccgattggcgccgtcgaattttgagcaaatggacaagctgttcacgacgccggtcagaaatggcatcaccgagcacgcccaaaagcctaacaaattccaattattactattgtgttcactgtttgctaaacatttatagtgagtaaaaacgaggaaaaagagaaaattccataaaatctttaaaagtacattcaatctggtaagaacaattttttaaaagacctcaaaaaatggcaaattgccagcaaaaaaatgtgacaaattcgggacgtaccaggccgttttcacgtggcccaagttcgggatgctaaaatttcggacattggatcgatttaattgttttttttatattcctttggcatcatttattttagcggtgttacagttacagtgagtgtacagacagagtgaacccgaagtgtagaaaatgataattttttgtttttgatttgctgttgctgacttgtcaatgagatcatccttgaagaattgaggtgatagaaccgtgtgtttgagaatgagacgccaattctgcgtggacaccgaatcgggggtctgttagtga

SEQ ID NO: 78116 - DNA, 958 bp, Heterodera glycines
  Genomic contig location: Contig_ID=SeqID_2152; Location=2162..3119; Strand=-
  SCN-specific regions: Sequence locations=1-48,72-124,146-257,298 -306,373-373,413-757,780-821,857-958
agaattcctcctgtttttggccaaatcctgtctggccccgtcatctgtcgcctcctcctccaccagcaccggtggttcgtcgtcctcctctcccaaaaagtcaaatgtccaacaacagcaccaaatcccagaggaggaagaagccgatgtggaaaatggttgtggtgataatgccaatgccgttgttgccaatgacttcaacgatgaaatgccgagttcactgttctgcattgacgaggaggacgagacgttggtggcaacaacaacgacagcaacaaccagcggcatcaacaacaatctctcgtcgatgatgagtgatggtgaaattgctgatgatggggatggtgacgataatgatgatgatgataatgaagtggttgttgttgttgttgatgatggaggaggaggagggcttccgttgttcaaatgtgacggtagtacacatttgaaatgtttgtttttgctcattttcttgggtgaagggggtgaggggcggggcgtagtaatttaaaaattactagaaaattttttcataaaagattcgatcgctttttttttagtatttccgcaaggacgagcccaatttttggacaagtgggggcaagaaatagcccgacgattttttcaaaaaaacaattttttttcctgaatttttgagaagtttagcccctcggggcttgacgattcggccaaccaccaatggtacaaacagacgctgttttatccctctccaatagagtaatttaagaaaaaatgcaaatcattttcaaaacaaaaatcaagggacatgacgaatgaaggaaaaataaatactactctacatataaaaaattttcaatacaattttttttttatagttttctcgcgtgaaaagtttattgacgaaatcactgtcatggagcagaattattaccggcccattctcatactgatcaacaacaaaggtgggcatacttaa

SEQ ID NO: 78117 - DNA, 2090 bp, Heterodera glycines; identical to SEQ ID NO: 14124
  Genomic contig location: Contig_ID=SeqID_14124; Location=1..2090; Strand=+
  SCN-specific regions: Sequence locations=1-535,557-583,605-748,786 -870,896-1001,1023-1324,1349-1366,1388-1644,1666-1697,1723-1740,1762 -1894,1917-2090

SEQ ID NO: 78118 - DNA, 255 bp, Heterodera glycines
  Genomic contig location: Contig_ID=SeqID_14125; Location=244..498; Strand=-
  SCN-specific regions: Sequence locations=1-134,163-255
atgcgatctccgttttgctatggcacttctcaaccgtttggcttatatcgttatcctcgtaacattccagctaattccgcatcaaatttccaaccggaagcactcaagtacaaagctactttgaaaccaaaatcatacaatcataaatcaaggaacagtgctttaaagaaatcacaatctgcaatggagtggacgaccaatcgtccggctccctattttccccggaacgattacgcagctttcagtacttcacaa

SEQ ID NO: 78119 - DNA, 1147 bp, Heterodera glycines
  Genomic contig location: Contig_ID=SeqID_14126; Location=385..1531; Strand=-
  SCN-specific regions: Sequence locations=1-465,491-1036,1058-1147
atgcttcgttcacaaagtgcggcgagtgtttctgaaattgatttaacatccaacagtgtctttaatgcttcctctctgggtttaagtttagtgaaaaaggaggattcttccgctcacgatcagtcaaattctttttctgcaccgaaaaatgccgaacagctctctaagtgcttgttggatgttgaaactgcaaaaaggttgctcgcttcaaaattgccattgccggaactaaggccattgatggttggttgctacatgcgttaccatgcaatccgagaaattctgaaggttatccattttttagtaaagaaatttgttggcgttgacttattctgcataatgtagaattagctttgagcttttattaataaatatatggtaaaattcaaaaaacgtttcccttcagaataggtatatgggttttactgctctataatttaaatattaaagctctaaaaaatagtcaaagaaaaatttatttattttccttcgggacacaaatttcaaaggtaactaaagtggtctaataatttgtgttccaggactctgaatgcaatttctttattgacaaaattatccacgtcaatagagatggtattcgcttcaagcattgtcgtgacaacagctacagaagcattcacaaaataaaggaaccagaaaatgcaattgatcagcgtggattcaatctgtggataaatgacatgaaaaaatgggtaaatttttagttatagtgcattttatatgagtccaattaaccttgaatttcttttggctgcaattgcctaaaaatagctctgaaactcagcaataagcacgaaaatactaatctaaacaaaaaatcagcatgaaaaactcgaaaatataagtctcaaacaagttagaattcgtttttcatgtttattaacaaatgctgcaaaatccggtctctgctctaaatgcgctagaaccgaataattaaattttctttgatatcgcattttaagaacgaaccattgccctatatggacctccaattactaatcttgaagtcgatcagaaaagcagtttcttcacttgaggagggggagagtcagtcactcatggactcaacagataaaacgactgtcccggagaagccatgtaatatatcaagagcgagtttgacaaa

SEQ ID NO: 78120 - DNA, 319 bp, Heterodera glycines
  misc_feature (263)..(263): n is a, c, g, or t
  misc_feature (304)..(304): n is a, c, g, or t
  Genomic contig location: Contig_ID=SeqID_14126; Location=1..319; Strand=-
  SCN-specific regions: Sequence locations=1-319
ctgtgactggattttacacacagatacgtgctcctccaaatcccaatgttcagaaggtttaataatcgtattggaatataaatgttaatgatgcttttttttgtctttgggataaaaagggaggtgagtcgttcatcttcatggaccaaataatcggtgtttcttgggcaaccaaaccttacatgttgctccaaaggccgttgacaatcgtcctgaaatttcgtcattttcgtgatgatagaatatgtcaattgccttattgnaagatatccgatggaatttcccaggaaattacaaccattgngtgaatgatatgcga

SEQ ID NO: 78121 - DNA, 1118 bp, Heterodera glycines
  Genomic contig location: Contig_ID=SeqID_14127; Location=175..1292; Strand=-
  SCN-specific regions: Sequence locations=1-13,46-61,84-277,299 -614,661-679,702-719,764-1065,1092-1118
atgcaaatatgtgtattattaattttatttttaatcaatttaattgaccaaaccgaaacagaaaagaaaaagttggaacaaaagtcatgtgatggaatatttggagaaaaatgggaagaaaaagaagaagaaaaacgaaatgaactcaaaaaacgagaaataattgcaaaattttataaaataaaagagaaaatcaagcaaaaaggacgaaaatactcaacaaaagaatggaataaaattaatttgaaaattgcaaaaaaattggggacaaatcgtttatatatttataaatggattaaagaatttggtcttcaaaaacaaatacaaaaaagctataaatcaaaaactgatgaagaaaaattagaatttgtacaaaaattcattgaaatgaaaaaggaatataagcaaaaaagaaaatattcgccaaaagaatggaagaaaaattatgtcgaaatttgtaagaaaattagagttaattatggaatgattaagaaatggaagaaacaatttggcattcgcagtaaaataacggaggaacaaaaaatagaaaaaatgaaaaatttataatattagaagagtaagagttcgaagaaacgcagaagaatagtgatttgtttcatttttaatttttttttattcaaattttaattttttttttataaatgttttattcaattttgcattaatatggacatttgaggctttttaagatttaatgcatattttttattctttcataaaaaaattttaaaaatttaattaaggtttgttgaattaatattctggtggcgagagaatacttatgctattgaataggctatgcaacatttagaacttttctcaatcttgcggaattttaagaaacatcttaactcaagagattatcacaaattttaattttaattctttgattttgtgtcttttttatttcatttttaatgacgattaaattgatcatttaccctgcccctcgggggtcgtcgctgttcgtggcgatgactaatggcgctttgtgcaagaattgattggcacctttgggctgatgggatgccttttgccttattcataacaaaaaataacaaaaaaattccttttttttgccatttagaaaaaataaa

SEQ ID NO: 78122 - DNA, 1095 bp, Heterodera glycines
  Genomic contig location: Contig_ID=SeqID_14127; Location=1385..2479; Strand=-
  SCN-specific regions: Sequence locations=1-441,470-490,519-575,601 -907,930-960,1017-1095
atgttgtgcggcgagttgggcccagtgctggacgcgaaaactgagacgggcaatgtggaaattagcactcctctccaagcccttttgagtctattcatcctttgttcgggtgcaacagtttcatcttcggcggctaaaaatttggtgcaactgattctcggcaccgaacccggaatggaattggtcgtctacgaaggagtccgtaaagacaatgtccgtgccggcatctttccaaaccatgaagacgtggaaagagtctggattttgtggtgcgagaaatgtgccgtggcaaagaaactcctccaatcgtctggattcgaccaatccgagtggaaaaactcgggtcaccacctaacggatgccgaattaacggcagggacgcctttttttaggggttgtgatgtgttaaattgaatattttgacctctctctgcttaatttatttctataaattgtgttatttttctctccgacctctgacctacctataattatgttttcctttctttttgttgttttcgctaattatgttgttattttcaatagatatttcctttgctagatttccccgcatgtctccaggaggatttcttttttcatggtacattttactaaggacactgttctctctaaatattttgtgtgcatttatttattcgtcaattttaattaattggtctacagtccgttcgcttgtcatcttgtcggctttctcaatcgtcgactattccgccccgagtggcaaagcaaaagggagaagaattgaattaaaattggacgatatgatttgaatggataaaaaagcatagtattggacaaaaacccgcgcattttttgtttttacaaaatttatggagtgggaaaaacgtgcaaacctattttggtgtaatgtgcaaacagcaacgatttgaattttttaaatatgtatgtccttatttttccgcttgccctagggatatgaatttaatattattattttttgttattgtaaattatgtaaaatatttctaatttttgatgaaacattcattggataattgtcctgatttttttgtgtttgtactgtttttttataatcgatttaaaagcaataaa

SEQ ID NO: 78123 - DNA, 444 bp, Heterodera glycines
  Genomic contig location: Contig_ID=SeqID_14127; Location=2522..2965; Strand=-
  SCN-specific regions: Sequence locations=1-128,150-210,232-413,436-444
atggtcatttaccctggctctaaatcaaaaacacagcacaaaaaattacattggaatcacttcggaccatacgaaattgtcaaaacactcgattcgtctgctagtgttgtcccggttgataaaaaatcggcagaaccaattactgttccaatagaacgccttgtgcgcgttccaatcggtgtacccgacatttctacccttcctcatggaaaaaacccctaccggaatattttggctacaattctattggccagcttaaaactttcaaaattagacacaaaaggaatttttggacagttcgaaccgctcttacagacgcaatttggggaaaattctttaaagtcatcgaaaaaaatcgtcgttaatcagttagggacaactgacaatttaggagaacggaagatgaagcagcgacagcagaaagaaaacgacggactttcgtag

SEQ ID NO: 78124 - DNA, 559 bp, Heterodera glycines
  Genomic contig location: Contig_ID=SeqID_14128; Location=426..984; Strand=+
  SCN-specific regions: Sequence locations=1-480,502-559
atgtcggacgaaccaaaagaagcggaaaagaaaatggaaaagcaaatgtaattgaaaaaagtcactcaaaatatttgtgccaatctcagttggatgtgcggtgacaattggctcaaagtgttcgaattggtcccaattggccaacttggccttggaattgcattggtcagccgcgcatttgacttttttgtggacgagcacttcaaaacgcgcaaatggacgttggactcaattttgatcagatgcaaatttgcagaagatggccaaaaagaaatgcaaactttcaattcgcgcgatgaattagtgccaattcagaaagtgccgttgccaaacaaagtcgtcggcttcaaatgcattcgttgcaggcaattgaacatggcgcatcatctttcggatgttgatgctactaattactacattcagatacatcgaccaaaatgtcgtggattttctcagccaatttcgccatcttttcgccgcttttggggcaaatttgttaattataaacaccgacgaaccaattttggaatgggttatgcgcatttggcctatgctcagg

SEQ ID NO: 78125 - DNA, 588 bp, Heterodera glycines
  Genomic contig location: Contig_ID=SeqID_14129; Location=96..683; Strand=+
  SCN-specific regions: Sequence locations=1-588
atggcttttttcaccgcgttcggacggtgtgccgaaggagctttggtgttccttaaagcagtttgagagattatcggcgattaatgacttgaaaacggtgattcatattcataattgttcaatttctttgctgattcacccctttcaggcttttctcaatgcttcttcccgtgcctatttcatcattttcattagaaattgtggttattacagtggtggtggtgcccccgttgtgtcgccatttgaattgatcaacaatttgacaggggaacgactgacctttaaaatgttaaacaggaaacatgctatgctgaaacgttatcccattgcgcaagatgagcaaaaatgggcgaattgggaaaatgatatgatggtaatgggagcgaaaaatgtcatttggattgaagacgaattcgacaaaagtcgaaagaaagcgaattgaaaagagataattggatgactaaatcgcattgcttttcgagcttttttatttgttatttgcaatattttgactaaatgttgataattaattttggaaaatgcgccccctttcaaagccctaagggtacattcatataacgactttaa

SEQ ID NO: 78126 - DNA, 1284 bp, Heterodera glycines
  misc_feature (798)..(798): n is a, c, g, or t
  Genomic contig location: Contig_ID=SeqID_14129; Location=812..2095; Strand=-
  SCN-specific regions: Sequence locations=1-464,493-865,887-898,931 -979,1009-1076,1098-1125,1162-1284
atggcggtgaaaagtttgccgatggtgacacggtcggatcgtggtgttaatctggccaatcagaagctgattttcacaaagaatggacatcaattgggttggtaaaacaaaaaattttgttttttttttctccattagtaaaagcattttatgtttttttgcgcattggcatcggcatcacttaaatccttttcagatggcaccaattcactcgctcctttcctcttctgtgcccgccgattctctgtttccattcgtttcgttggcagattatggggacaaaatcagcaccaatttcgggccaaatttcatgttcgatttggccaatctctgaaacaattaattgacattgtctttttttaaattttttgttgaggattttcagtggcaaaaaatgccaaaataattaactaaataatgataaaaaatgccaaaaaagtggcaaaataattacaaaaagtcacatttataaatttaaacaaaatattttttcgtttattttcattcaattttgagtttaaaacgcagtgggacatttgcggacagaatgaaatgttggtctcttatgtgattaaaatggggtacggacaatccgtcagtgtatatccgtcagtggacattcgtcagcaaattttttgagctatatcaaaaatctgcgaaaagattgtaaattagaaatatttttcatagatcttcatatttgtataacatacacaattgataatcagtttttagcgaataaataattttcacatgatttaaataaattatgattaaaggtacgggaaatctgatgcncaaaatatcggaaatcggaatttagtgcagctagtgtccagcatttatataatatccttttaattttgaaattgtaaataaattttgttagcaactaagtatatctcaaaaaatttaaaattgtttcttttaatagaagaaacggactaacggggccaagtctttcattccatgttttcagaaatttttaaagattttttaaatttttttccctaaaattgtccgcaaattccggaaggcgttcaaaaagaaagtaattttgtaattaaacaaattaatatccaaaaatgcattaaaaattctaacaaaagaattcaattattccagaatattattttttatggaatatttttaattaattttgttttacggctgttattttttcttttttcagtcaaaaggtactcagttgtcccattctttcagtaccaggtcacggtcccgctatattctagtaaaaaatcattccctttttttacaaataaa

SEQ ID NO: 78127 - DNA, 307 bp, Heterodera glycines
  Genomic contig location: Contig_ID=SeqID_14132; Location=546..852; Strand=-
  SCN-specific regions: Sequence locations=1-307
atggcgtactctttgacacttctttggacggaggcaaggccattcctgggtcgattgaagcagttaaaaggcatcatacctatacattttgttccaaatgcttcatattttgctcttagactttacgagctaagttgtgttcgttttgtaagcaatgaaagtagtgggacacgaggagcaatttgtcaaaaattacaccgtctcggattcgttgggcctcagcctgagcacattttcacaccggcaccggttgctgtcaaataccttcgacagcatggactacgaccaaaattgatagtgcacaaag

SEQ ID NO: 78128 - DNA, 937 bp, Heterodera glycines
  Genomic contig location: Contig_ID=SeqID_14134; Location=2091..3027; Strand=+
  SCN-specific regions: Sequence locations=1-17,39-112,134-171,194 -204,226-552,574-602,624-707,755-841,865-937
atgagtcggacaaaccgaagagatttctcacacaaaggaaatccgtcccatttgaagacgcaaaatgtaactccaacaaaattggcaaatttaaaataaaggaagaaaggacggaggaggaaaatttggaaaatttatttgagagttaaacacggaatttttttactgtggaaattttaaaaaattaaaaattgttacagctcgacattttgaaaaaagccagggaaccaaggctggaacaggattttttagaaatttgggttgttgaaaatcctgaatcttggatggtttcaatgttggacctggacctgaatttcctggctaaaaatcctggaaaattataggtccaggaaaaatcaaggcttgccatggcctggacccaggcaatgggccaagattttataaaatagagtttctgaaaaaagcgtgggccttgacttgcattccatattggacatgacctgaatttcctggacataaatcaaggtccacagattttttttggaatttaggcctagattcgatgtccaagtcgagctctaaaaattttccattttttaattattaagaaaatttcatgtaaagcaacactaattaaattagtgcacaaatgcatttccgaaatttgctaatcgaattaggcgccgcgaatttttggcgatttaatgggaaagtaaatttttttatgacagaaaaaaatattagagaaaattttcttattttcaaaactaaaataattttagaattaaaaagcctttttaagaaagcctctgatattattaaaatttacacgaaaagcgaaaagttaggtaatactttttaaagaaattatgacaattgcgggccggcaaattagtcatcaattattttaaacttttcgaaatttccaattgagttattaattttcggtaattaaaaatttaatttgttttctcta

SEQ ID NO: 78129 - DNA, 416 bp, Heterodera glycines
  Genomic contig location: Contig_ID=SeqID_14135; Location=402..817; Strand=-
  SCN-specific regions: Sequence locations=1-37,63-128,150-276,301-416
atggatcactctcttcgttccccacaaagtcatcgtacggctttcgtcttctcttcttctttgtcttcgtcggatgcctccgttcatttccaaaacatcaataacactgtggccaatgcaatgtctccaattttggcagggcatccaaattgtgtcgtcatcgctaaaatcgacctgacaatgaacaattcaccggcggtgtgtcgcatttgctacagtggcgaggaatcgggtcccaacgatggcgagccgctgatttcgccatgccattgcaagtgagaaaaagaaagggtggaaaagggacaaaaaaggagttgtattttgcaatttcttatactctatctttgcattttcagggggactatggggctttaccatcggacttgtctgaacaaatggctggttgtctctcagag

SEQ ID NO: 78130 - DNA, 621 bp, Heterodera glycines
  Genomic contig location: Contig_ID=SeqID_14136; Location=497..1117; Strand=-
  SCN-specific regions: Sequence locations=1-72,102-621
  Gene Ontology: Mol. function=RNA helicase activity; Cellular component=bud neck; Biological process=cell growth
atggactttatcaatgaccgtgttacgaacttgcacaactgtacttatcttgttcttgacgaggccgaccgaatgctggacatgggattcgaaccgcagattcgatcaatcgttggacaaatccgggtcattcatttcttttgtcgtctttattatttaccttttttatagccggatcgccagactttgatgttctctgccacttggccagttgaagtgcgttctcttgcagccgatttcctttcttcaccagtcggactgaatgtcggctccctcgatctgtcggctaaccacaacatcaaacaaaatgttgaagtcatcgaagactttgcaaagaaagaccgattatttgttttactcaatgacattttgaaacaggtaaatcaagcaataaaatgggaatcagaatttcaacaaaaaatattcatttagacagaatacaaaacgctgatatttgcggaaactaagcgaaaagtggacgaactcaccagagagatgcgctacaagggaattcccgccctttgcatccacggagacaaaagtcaaaaagaacgcgaatgggtgcttagcggtgaacaaatgaattacggatgcaaaatctcattcaatcataaattttag

SEQ ID NO: 78131 - DNA, 366 bp, Heterodera glycines
  Genomic contig location: Contig_ID=SeqID_14137; Location=456..821; Strand=-
  SCN-specific regions: Sequence locations=1-366
atgatcacttggttgaagcattgtgccggtggcggccaaccacagaatcgagtcgggctcgccccgggccattttccatcggtcggccgtgccgccgacactgtgccaacggcacgggagggaaaagtcgcagtcgaagccgacggcggaattatcggaacggaggtcggaaagttgcggcagttcggaggttgtcacgaacagaccaagtgcaacctaaacaaaagcccaactaaacatgaatggttggaggaaaaggctgatcagaatgatcagaagatcactctgatcagttatgaatttgctgagttgatccagtcttaccggacaataattccaatgaatgtatttaattatgtaaactga

SEQ ID NO: 78132 - DNA, 635 bp, Heterodera glycines
  misc_feature (476)..(476): n is a, c, g, or t
  Genomic contig location: Contig_ID=SeqID_14137; Location=556..1190; Strand=+
  SCN-specific regions: Sequence locations=1-547,569-575,604-635
tgatcagccttttcctccaaccattcatgtttagttgggcttttgtttaggttgcacttggtctgttcgtgacaacctccgaactgccgcaactttccgacctccgttccgataattccgccgtcggcttcgactgcgacttttccctcccgtgccgttggcacagtgtcggcggcacggccgaccgatggaaaatggcccggggcgagcccgactcgattctgtggttggccgccaccggcacaatgcttcaaccaagtgatcatttgtccatcaaatgccaataagcaaatgccattccgtcacagccgaaccgttcgctcttttggaggtgcgcgagggtcggctggcggacattctctgctccgaactaatcggctgtcaggaagttccttcgctgctcagcttcacttattggagtgtcagtgcttccgacttggagatttgtctgctcggctcggactttcggcggctanactgcacgggaatgctccaagcgacggcccaaccgggcaaagtggcactgaaagtgccgccgatcagacggagttttcacgtgagaaaccggggaaatcattaaaattaattttaatttaatttaatggcaaactttcaaaaacagatcgcaatcattc

SEQ ID NO: 78133 - DNA, 153 bp, Heterodera glycines
  Genomic contig location: Contig_ID=SeqID_14138; Location=10..162; Strand=-
  SCN-specific regions: Sequence locations=1-153
atgactgtggaagtgaacagcgatgccaaatccggcggcggagtgacgtgtggcggaggtcgcacagtgcccgtgccaaagtccgttgttggcaccacaaagggcgcaatgcgagtgggcgaagcggtgggaaacgaagtgaacggaggcgga

SEQ ID NO: 78134 - DNA, 2228 bp, Heterodera glycines; identical to SEQ ID NO: 14138
  misc_feature (2185)..(2185): n is a, c, g, or t
  Genomic contig location: Contig_ID=SeqID_14138; Location=1..2228; Strand=+
  SCN-specific regions: Sequence locations=1-309,340-462,486-531,670 -1022,1052-1271,1299-1351,1392-1955,1977-2228

SEQ ID NO: 78135 - DNA, 988 bp, Heterodera glycines
  Genomic contig location: Contig_ID=SeqID_14139; Location=280..1267; Strand=-
  SCN-specific regions: Sequence locations=1-649,671-896,918-988
atggacaaaaagcgtgaggagttgcgccgcatggtcggcagaaggtacagagacgtgttggaggcgtcgaacacagtgaaaagactgtccgaaattgcaaatgaattggcctcgctgctggcgaacattgggcaaaatgttgtgcatggacagcagaaagacaaacccagcgaaacgccctcctttgccggcgaagatggcaccaaattagtggcaccaaagttattacgacccaatgccagtcgttgttttttgctccttcaaaatttgctttccatggttcgttcgggaacaggacgacataatttcgccgccgaaattggaaaaaaaaaaattaaactgaaatttttcaagaaaaaaatcgtagaattttttattagaaaattttatggaaaatccttgcgacatttttggtgcacccgattcgttcttccgcttgaattttccaattaatttgaatttttcactcgcttttagtcttttgtctccgacgaccctttggtccgtgccttttgtctgtgtgtcgccgactttttccatcggacgctttcctcctccgattcctttgcacttcccttctcccatcctccggtggtgccgatgttttccgaccaattcatccattttcgaatggaattgcttgacatttccacctccaaaatgggttctgccggtgcccagtggcatttggctgtcagtgctttggtcgcttaccttttgttgaggccacggaccaccgcggatgaactgttacagcttttcctcaagtcgaggatggtcagtgcgtatttgcaatgcaatgactaaaactgtccaaataattgcatttttaaggattttttgatggaaaatcttcgacaacccgactcaactttgctgggcctgatcaaacagatgaaagacactgtgcaaagtgcggaacaaatttttgcccaaggcgcactgatctccgccattcaatgcgttaccaccaaagggtggagccccg

SEQ ID NO: 78136 - DNA, 112 bp, Heterodera glycines
  Genomic contig location: Contig_ID=SeqID_14139; Location=2174..2285; Strand=-
  SCN-specific regions: Sequence locations=1-112
gaatgtgttcaatctgcagtttttcgtgaaggacaatgttggagggggcgacaaaaccgttgtcgatgagtttcgaatttacggcatgccaattgcgaagactacgaacatg

SEQ ID NO: 78137 - DNA, 2725 bp, Heterodera glycines
  Genomic contig location: Contig_ID=SeqID_2154; Location=238..2962; Strand=+
  SCN-specific regions: Sequence locations=1-145,170-173,195-381,403 -411,432-480,502-658,680-809,835-947,969-1192,1230-1400,1504 -1548,1660-1705,1731-1780,1802-1852,1881-1901,1924-1932,2025 -2152,2198-2248,2281-2431,...
  SCN-specific regions: Sequence locations=...2463-2466,2488-2655,2723 -2725
  Gene Ontology: Mol. function=DNA binding; Cellular component=nucleus; Biological process=sex differentiation
atgcctccgcacaatccaaacgcgtgttatgccatcaacaatccgccaatcccaagagcaacaacttcgctgagtaacagcaccaatccgtcgaacatcaacaaccaaaacaatatcagcaacggaaacggaatggctggaggcgtacaacagcagcaacaacagcaggtaaaaacatcagtttaatgggttggactggtcgagagtcttggtctcaagccgggaaatttctcggatttttggaatattgagaatttgaaattttcgagtgtctctaacagtacaattttctgaaaaaatgatctgtctgtatgtaacccattgattggtgtctgatcagaagacactttggtcatattaatgtaggcttatctgaaatttccagcaaaaattatttaatgagtcacaaacaatttaatttaatttaattttgttttttttaatatttctctctaattgactattgttttttgaaaattttgattgactaaaaatttattttaaattgaggcctatgaaaaaaagctcttgaagggacacctgactgccctcgtaatgtccgtcgtctaatgttatacccatgaccctgaaaatctaatgatcaaaaaatagcacggcttttcaaactttaaaatttgcagcaaaagaatccgaagctgtacaaaacggagctgtgtcggtcatggatggaacacggacggtgcaattacggggaaaggtctgactgaacatgaggccgtgacattttgacaacccgttgaacaggtgccaatatgcgcatggtgagagggaaaagcggccggtgccgcggcacccaaaatacaaaacggaggcatgccaatcctaccacaaaacaggtgatgccggattttggtgtgttggcacaaaatttagtttgtccgttttgtaggttactgtccgtatggaccacgctgccatttcgttcgtttttcaaattgttttttctgcgtttggcattttacccaagtgccaaatttagattcacaacgagaacccgtcgcagctgaaggctctgattgatcagaatgaaaaggcgttgcgactggtgcaggaattggccgtcataccgatcagtgagtcgtttaactgctctgatgagtcactttcggcacttttactctcattaagcgtaattaggacgccctatcaatgagagaagggtttttaaatctcttatctttattttagaaaaataaatcctttatttttgtgctgatatttgcgaatcttcaggtggttccgcttctgaaatcccccgaaaatcgctaatcgtttcttcgtcgagcgcttcgctgggcaattcgccatttggctgcgttttgcagaaaaacaattccgtgcacacttttagcaagtaatttgcatcttttttacaaaaattattttattatatttttattttacttatttattcatttgtaattttttaaattattaattatttttgtttttttaataaaattattttttaaataattattttcttttctttgttataattttggcaaaactttgaatcctgtccccatattttttttacatttaaataatttaaacccattatattcatcatttttatatttagttaaatttatcgttattttaaataatatttctaaaaataaaatgtatttttaagctttcacggtcaatatttggagaagactcagagcaataatgctctacaacaacaacagctgcagcagcaagaaaactgtgcacatttcttccagtttaataacgcatcccaacaaaatcatcagcacaaccaccaacaacaactgccaattggggtgggactgaatttgatggggcacagtaacatcgtacagtaccagcagcagcaacagcaacaggacattacagtactgggaaaagaataaggaattaattgaaattttaatcacttggaaattataaattaaatttaaatgatatttattaattattcattttaaattatttattatttcattatctttttataaattattttaaattttgatctcttaacggtggtgagtcattatttaaaaaacatcataaagggcgttatttaaacaccatcaatttgaaaaaaaagagattcataacttagctccaaagcaacaaattaatcattcgatagccctaataaaattttaaaaaatttcgttaaatttcaaaaaaaaattatgaccaaaatactcagaaaaccttcgcattcgaacatttttggtcataactttcttgaaacaacaaaaattttttgcaatatttcatgctaatagaaaacacttattgttcgggctatcgaatggtatcaaggattaaaatttgggtgctttaaagcaaagttaaaagcaatatttttttattttgatggttttttaaataacgcccattagcagcaccctcttaaagattacacaaatataattttaaattctttattaattattcgaaatttttacatttttctcttctaaatttagttcttcgcctctcctcaacaatgttcgccagagaatcaaaatgcgcagcagtcgccgctttcgtccgcatcttatgaaatgttcggcggcatttcgcccaaaaaccaacaacaaatgacgacggaactgttcgatcacggggaaatgagctcaccacagcccaacaacactcacaatcagctccaccaccaccaccagcagcagcacttcaatcagcaccatcagcagag

SEQ ID NO: 78138 - DNA, 344 bp, Heterodera glycines
  Genomic contig location: Contig_ID=SeqID_2154; Location=2611..2954; Strand=-
  SCN-specific regions: Sequence locations=1-15,46-230,252-255,287-344
atggtgctgattgaagtgctgctgctggtggtggtggtggagctgattgtgagtgttgttgggctgtggtgagctcatttccccgtgatcgaacagttccgtcgtcatttgttgttggtttttgggcgaaatgccgccgaacatttcataagatgcggacgaaagcggcgactgctgcgcattttgattctctggcgaacattgttgaggagaggcgaagaactaaatttagaagagaaaaatgtaaaaatttcgaataattaataaagaatttaaaattatatttgtgtaatctttaagagggtgctgctaatgggcgttatttaaaaaaccatcaaaataaa

SEQ ID NO: 78139 - DNA, 466 bp, Heterodera glycines
  Genomic contig location: Contig_ID=SeqID_2155; Location=160..625; Strand=+
  SCN-specific regions: Sequence locations=1-466
tcgattgggccaccccgcaagtcagccgttgtccccattcggcaaggaacagcatcatcagcaacaacagtttggccacaacgctcaagaatggcatttggccaagcaaatgcaagagatttacagcaacggcaaaaatggcacaaaggccgcgagcggtgccaacaatcgcaacaaaaacggcaacagcgagttggacccgcaaaatatgctcgccaatctgtgctcaagcgatggtaaagaaatcatggaagctcgggatttttggctctcgaattgagcaattctgattggattttggagttaaatttcgactctattgcttcattttcgaaccccgtctcggaaaaatttcgaggaattttttgaatgaaaatgagtccttcatagattttgctccaaggtgttattttataacatttggctttttaaaaaattttacggttttaaaaaatcattttttata

SEQ ID NO: 78140 - DNA, 1025 bp, Heterodera glycines
  Genomic contig location: Contig_ID=SeqID_2155; Location=861..1885; Strand=+
  SCN-specific regions: Sequence locations=1-513,537-883,906-1025
atgactttggcatttgatgacgatgtaaaattgataagtttaagtcattcattttatcaaataattttggccattaaggcattcattcggataattatcaatcaattagcgtttcaattaagaaaaaattactttgccaatcgataggctccgatggggaaaaatttgaaaatttttgttctaaaattattcaaaggcaatgaaaatttttaattttcatttcagacattgaccaaatcaaagggtgaaagcaaaaaattggccagccctcaactgattggacaaatcacgaatttatctgacgccgaaagcgatgcgcaaaatcgacggagcagtgacggagacactgtgaaaggtcagtggtagtttttgacgaacaatggcacaatggcttctcatttgggcatttggccaaagtaaaagatcggaaaatgaaaattgacttttcatagagcataagcatgtgaagtgaattataaaaaggatatcttattgggaaaggatcagctgttctattaattaaaattcatgttataaatccgttgggatttctttcaaattaaatgggataaccaagggctagcgccagacccttggcttcgggggggggggggctcaagtaaaaaattcgatttttaggaggtgtatttttctttttcattcgatttttaggggtgtattttttttttagttttttgaattcccgaattaggggggtgtattttacaaaatttttagtcgttttttcgccaaaaattactattttccattttggtctcaatttttcaaaaacatggcaaaatgggggtccggcggtgttgttaggcgccgccgggaaaattttttttttgaaatttttaatgcaatttgttaagaaattgcttgaaattacaaaaaattagctgaaaatttttacttttttggatttcgggagggctttagccccctcggccccccaggctacgcccttggggataccgtacttcttcgattatatccccccctcgattagaacctcctctcga

SEQ ID NO: 78141 - DNA, 1658 bp, Heterodera glycines
  Genomic contig location: Contig_ID=SeqID_2155; Location=3689..5346; Strand=+
  SCN-specific regions: Sequence locations=1-102,124-319,350-515,557 -604,626-651,673-806,828-921,943-1184,1207-1658
atgccattgaaaaatcaagaaaatgcaatccgtaaaaactcttgtcaatggtacaatcttcataacatgaaaatattcgcgtgtgtcacttcattttttggttgggcctgatcattgaaacactaattaaagtttaattaacttaattaatgcccgattaaataggcattaattagctttaattcatttcccaatctaattaccaccgagcaattgatcagaaggcccaactttgacttttcgattggctatttatagcacctttttattgatgtctctcaaattagattgaacgaaaattttgcgaaaatttatttgcattttttaattattattataattaaattttcgttccttttaaacaaattaactacggtttacattttgctgcgcattatcaccgattatagaacttaaatattgtctagatgttctttgatctgctagaactggtgtccaacaaattaatatattaatattccattagaatatatttgcatcattttttgtatttgtaaattttcatttaattgtaaattatttttaaattatttttgtgttcatcttagataaacgttagactgatgttctttggcatttacacataataataataataaaatttgcgcatttttcttatcatctttcattaaaattttcaaaatttttccgggcagatcctattggtactgccggaccatcattttacctcgtttttgaaaatttgaccccaaaatggcaaaaaatagtttgtttttttttggcgcaaaaacagctgcaaatccatgttttttgctctctggcgctgaaattttaaaaatgactggagaaaaaatttctttggcccaaagagcaaaaaaaaaaggtcttctgattccccccttttctggctacgggcttgatcatttcaaaccattttagacaaatttaatgaaaaattattattaaagctaaattaacaggattttttttcaatttaatggtggagaaaaacattgttatcatgaacattaatgaagtgtttacattaaagcgcgtgaagcgtgtaatgcttattgtagtatcgcgaggcgttggcatggcatggcattggcattggcacactgggtggcgggcgtattggcattggcatgcccaaccccaacagtcattactccattaagtggagcgcaatttgataattattcttgcctttttaatgcattatcacttttatctgagaccgaaacgggttgcacccgtatacgcgttcttcggaccctttggcgctataagccgtatatttttcaactgatatgggttttacgagttattgagcccgtagtccggaccccgtataggtaaccagcgcgtaattaattttataactgttgttattggttcttaatagcgatttttcgacgaaattacggaaacaaattaaattttgaaggggtcccagttcaaatgttttaccgtttgaaggcaaaacaaaaaaaaaggggggggggggaaattttcaaggtttgccaatataaaatgctgtttcgaccggtgtacttaagcatttttgaattcgaaactccctgaaaaagtgacaatggaaaagccaaataccggcggaaaatccgacggcgttgagaacagtttacaaaatgagaaaatgcgacaccgcgaaa

SEQ ID NO: 78142 - DNA, 1679 bp, Heterodera glycines
  Genomic contig location: Contig_ID=SeqID_2157; Location=117..1795; Strand=+
  SCN-specific regions: Sequence locations=1-166,220-318,340-670,764 -767,810-955,977-1027,1049-1113,1135-1181,1203-1299,1321-1679
  Gene Ontology: Mol. function=receptor signaling protein activity; Biological process=axon guidance
atggtgcatagcaattacattgacttcttcagccaaattgccaaaggcattgccaaatttggcattaaagtggcaccgaaagagcgcgaaactgtcgcaacatttgagcaggcatattatggacaatttatgaatttggatcaagcagacgatttgattgcattggtaattaaaatatttaaaaaatatatattttataaaataaattatttttaatttgagatacgcactttcctcgagttcgcttgtgtgaaggaagtgatcaacgaacggctgaacgagcttgatgtgccagacaacacagaatagtgaggggcaaacaaacatttaagaaaatatgggttcaaaagtcatgagtagggaacgaattttgaggcataccgtatatgctcaaattatagcccagtctctattaatcccgcagtctccaattatcccccagtctacgaggtgttttgaaaaataatccctctatcataatcccccagtctctaattatcgccccttttatggggaggttgaaaaataatcccccatgggctataattagagcatatacggtatgccttttttttttgctcattagttacgatacattaagcataaataaaatgcaataaaaaaatatatacccctaagaaatgaaaaattttctcaaaaattggtcgccaaaatttaatttaatttttttgataaaaaattttctgtttaaaaatattccttattcaaaaaaaattataaactatttaataatcatttaaatgagcaaaattaaaattttttgattaagttttacgtgttttgctccataaaaatccttaataaaaatttttaaatgacttttttatgcctatttgaggatttttatgccttttttgcatatttttggtacctattacagtgcctttttcgcgatttttagtgccttttttcgttctctagtcatgagacaaataaaaaattaaaatttggtaattttagggcaatttgggggcaatttattgacaaatttcgccaacaatttcaattcttaattaaaatgcattaagtcttttggaaaatgcgcaaaggattctgacggagcattactcgccaacccatgacgacataatccacgcgagagcagccacaaaaggcatttacgaaatcattttcgcattccgggaattcaaaataaggtaaaggaagaagacaaagcaaagggggttattaaaaagtgcagattttaatttagccactaattattattttcagactaattgatgagggtggacagaaaacggagagacgcaaatggatccattgctttggtaatgaatgaatgaaccgggcaatgtcatccccctgaaatttttttcaaataatttttttaggctgatttaaggtgctgatgtgggacgccgaaattgagggagggcgactacacacaccaataccccagggagaagggaggggcgaacgtgatttccaaataatcgatttcttctagtctaatctagtcaaaccggtgcgagaattcgatagaaataacattcacggtgcgaaaaatggggtttgacaagtctattggggaaaaaagactttactaaataatacccctgggagaagggagtgggaaacatgatttcaaaattttcaattttttatagtctaatctactcaaaacggttcagaattca

SEQ ID NO: 78143 - DNA, 91 bp, Heterodera glycines
  Genomic contig location: Contig_ID=SeqID_2157; Location=495..585; Strand=-
  SCN-specific regions: Sequence locations=1-91
ggattatttttcaaaacacctcgtagactgggggataattggagactgcgggattaatagagactgggctataatttgagcatatacggta

SEQ ID NO: 78144 - DNA, 396 bp, Heterodera glycines
  Genomic contig location: Contig_ID=SeqID_2158; Location=99..494; Strand=+
  SCN-specific regions: Sequence locations=1-37,59-396
atgtgggtggacagaaaacggagagacgcaaatggatccattgctttggtaatgaatgaatgaaccgggcaatgtcatccccctgaaatttttttcaaataatttttttaggctgatttaaggtgctgatcacgaatctgacgttaatttaggcctatcccgaacccccggacccgaactcggacaaaaaggtcgcacaaactcgacataaaatcgatttctaaaaattcgaatttgcgacttgtttgggttcgggtccgggattcgaaataggcaaaaatggatgccatattcgtgatcagcaaccccaaaaaaccattggtatatatattacctgttcgttttcacatcatgtgaattttcacctaactcgctggaaacatgttatagctaaaa

SEQ ID NO: 78145 - DNA, 1206 bp, Heterodera glycines
  Genomic contig location: Contig_ID=SeqID_2158; Location=594..1799; Strand=+
  SCN-specific regions: Sequence locations=1-8,45-122,195-329,351 -500,580-722,748-784,815-871,893-1112,1143-1206
atggatccatttttaatttatttttatttttttattattattatcagaggatgttgctgcaatccttttcattgtgtcattgtcctgctacaaccaagtgatggaggaggacagccaaatcgtaaattaatttttgaaaatattttaattgatttaaactcttaggaaaaaaaaattaaatagttaattaatttcagaatcaaatgtcggactccatcgaaatgttcaagacaatgtaccgcaacagattcctccgttcttcgtccttcatcatgtttctgaacaagaaagacatcttcgccaaaaagattcatcaaattccaatggaacaatttttgcccaatttgggggtaattaaactaattaattggttaattttgttgttcccatctaatcgtcgtcgtttttatagacaaaatgaaagcaaatccaaatctgagcggtgatgagctttactcggcggcacttgagttcgtcaagcaaatgttcagttcggtgagttaattaattgtttaattattaaattactattttaaattttattttatttaaatattttactaaaaaatttaaaaaattctccttttttctaggttagaaggcaagacaaacggcaaatttacacacatgtgaccaatgcgacaggttgaaaaaagcatttaatttttttcctaatatttttaattttattcaatttcagatacaaggaacattggcaagtttaaaaataataataataataataatgtataattattagaataaatagctgataatgagtctgaaatttatataaaaaaaataaataaaatttctaaatggactcgaattccctgtaaatggcattaatcccttgaaatctcgttaaatctctgtccctgacccatttccaattgttcgatttcagctacaaagatttaataaataattgattttgaactttggtcataaacaattaacaagccaaattaacaaattcttgccatttttcagactttgtgttcaatgccacctgcgacattattctcgcaaagaatataaagtcagctggcatgaactaacaacagacagcttaagatgagaatctgccaatatttatttgaacaatttgctaatttatcaaattaaatttaataatatttgaatgtaaattgtgccgttgattgccataataggtatcaaattaaaaatgctttattttacata

SEQ ID NO: 78146 - DNA, 656 bp, Heterodera glycines
  Genomic contig location: Contig_ID=SeqID_14144; Location=668..1323; Strand=+
  SCN-specific regions: Sequence locations=1-168,193-196,245-300,322 -331,354-376,398-398,427-470,499-585,607-607,636-656
atgggtcaaacgagtccgggtctggatattgaaaaagacgggtatctgggttgccgcaaaaaaatttgctttggtaacccggtttttgcccaaatacccggccccgtgcatcctagtctaaagtatatgcttcgcatttctttttctttgaaatccgttctcatccataaatttattattttttgtctttcccatcaaataatttttttaagctataaaataaaatttttttattcaaaataatgtttgacatatgttatggtttttctaatggggtgtgatacaaaagctttataatttgattcttaaaagtcccagcctttcacttaacttttcttcttgtgaaatattttctcttcaagataactattgccgacaaaaaagaagtcagaagtttaattgaaaaaacctttaaaaaggttaagtgcggcctgcgctctgtgtggaataaaacagaaagtgtaagcgacaaaatgattattcttaattaaaatttttagctggtgcgcaaattggtccgagtgggatcaatgaacgcagaacaagtgtatcggtcggtgatttttgttaaaaaactattgccgacaaaaaagaagtcagaagtttaattgaaaaaacctttaaaaaggttaagtgcggcctgcgctctgtgtgga

SEQ ID NO: 78147 - DNA, 182 bp, Heterodera glycines
  Genomic contig location: Contig_ID=SeqID_14147; Location=101..282; Strand=-
  SCN-specific regions: Sequence locations=1-182
atgatggaaaatgctcagtgtcgaatggattttcgccccaagcaatctgctttggagtgccaggtgccgaaccgtcagtcgaagaagacccatcaaaaccgcgagggatggcatcataggcatcgggtggactttgatttggcaagtctggcattgaatgaaacatcaacaactgttccaag

SEQ ID NO: 78148 - DNA, 158 bp, Heterodera glycines
  Genomic contig location: Contig_ID=SeqID_14148; Location=564..721; Strand=+
  SCN-specific regions: Sequence locations=1-158
ccttatcaaagacaaacacggagaagcatctggcagcaataaaagtggcaacaatagacggcacaattatcaccaccataagagcaaaagtagtgaccttcacagaagaagcacggaattacacagcatttcacgacggcatagtgccgactcaataa

SEQ ID NO: 78149 - DNA, 67 bp, Heterodera glycines
  Genomic contig location: Contig_ID=SeqID_14149; Location=27..93; Strand=-
  SCN-specific regions: Sequence locations=1-67
atgtccctcttccgccgtcttgcaattttcatcgtcctcctcgcattcttaggcgttttttgtggag

SEQ ID NO: 78150 - DNA, 597 bp, Heterodera glycines
  Genomic contig location: Contig_ID=SeqID_14149; Location=423..1019; Strand=-
  SCN-specific regions: Sequence locations=1-75,97-344,367-399,444 -549,579-597
atgtcggggtcgagatttgtcgagattgtgaaaagcggggtatggtttgtcggggttgtccaaatcgaccggtgggttttcattttttcattatatgtctgggtcggcaaggtcggtcgggatttcacagccggtaacatttttgggaaattgaatgcaattggttggaaattacacaacattagaaaatctttcatcgtgctatgaaaattctaaatgcttagcttgaaaacagttttaaaattcaaattagaaaaaattttctcttggcaaggaaatttttcatttaaaccaacaatgcctttggaaaagcagaatttctttaagtcgcgaatttctcttaatgtttctttcatctgttttgaatgcccaacttctggacaagtgaattatttcatgaaataattatattaaaatgtttattttaataaaaattaattaaagtttgtatttatcgcttagatttatttatttttgaattataattttcaagctttttagctttttaattttcttcaacttttcactttattaattcactttttcaggtttttttaaattttctataattatttattccaataataactaaataaa

SEQ ID NO: 78151 - DNA, 601 bp, Heterodera glycines
  Genomic contig location: Contig_ID=SeqID_14150; Location=1173..1773; Strand=+
  SCN-specific regions: Sequence locations=1-32,54-58,83-84,137-555,598- 601
atgccaaagatgatcttcttggccgctccagaagctgcagcagaatggaggaggtccgtttttgaattcttaaaatttggaacgatttatattaattattaattaaaatcactaatatattaaaatattaatttttcactaaattttactgttaatatgtacaggaggacaaccaccagcagcaaacgaacaaatccaacaaggtcttcgagaaacgagtgtttgaatcatttccgaaaaatgctgctgacaatgatgagaagagcagtgatagtgaaagtgaaaagggtaaaaattgggaacaattacatattaagcaaatctaattaaaaaaaaacattgcttaatattggatttattaattcagcaccaattttaaaatactatgctccagggttaattgatatcctaattttggtcggtaagcacataaattcaatgttatttagaataagcaaaaaattaaaaaatttgatttggtatgagcattatgtgttttcgaacctaaaaagacatgaaaacactaaaacctagtcctattattaatgcgaaccgtaattttatcaattaattatttttatttaatattttatttttgaaa

SEQ ID NO: 78152 - DNA, 3588 bp, Heterodera glycines
  Genomic contig location: Contig_ID=SeqID_14151; Location=803..4390; Strand=-
  SCN-specific regions: Sequence locations=1-985,1009-1044,1067 -1231,1253-1489,1511-1552,1574-1645,1667-1730,1754-1820,1842 -2100,2153-2236,2258-2312,2334-3004,3026-3302,3324-3324,3346-3588
  Gene Ontology: Cellular component=nucleus; Biological process=cell proliferation
gatgtccacgagtatcagcgactgttggaggagcacgacaaattgggcgcggaagtgcggcgagtaggcgaacggaacgaacggtggaagcgcgaaatggacgacagactcagcgagtggttggacccgctgggcgagttggtggccaacatcagcaacaacttcaccaactttttcgcccaactcggctgtgccggcgaagtccggctcgacacgccgccggagaacaaagtgagccaaccccacctggttttggccaaaataaccatggccatgcccttgttttggaaggggcgatggaattttgggaaaatgttcggcgacaatttcccctaggattttatgcctgccagggacggaggatttcggcttgggtggtcccccaaacgacctttttttgcttttcaaaccgtatttttgtggcgcgttttcgaaaaaaatcattcatctaaaattagtaattttgtggattttctgaaaaattcgagttatttttccgtacttgatgccgaatttttaaaaattcactcggcggtgctattgttgatttcgacatttctattcttaaaatttaatgttccatttatttacagtgtgttatttcttttgttacagtacaatgtcgcggagtacggtctgtccatcctcgtcaaattccgcaacggcgttggcctccgcgtgttggacccgcacacgcagtcgggcggcgagcgcagtgtggccacaatgctttatctgttggcactacaaaatctctgtccggtgccgttccgttgcatggacgaaatcaaccagggcatggacccggacaacgagcgggccgtcttcaacatgatggtccgtctgctgggcaacagcggcacggcgaggggaggcggcgaaaacattgccaaaacgcaatactttttgttcgttttcgatgccttattttgtgttaaatttggattataagttgaaatttacacaatcgtaaaaatttaggttgccaaattttcaaaaaacaaattgtttgaattttaggcgctaattaaaattaggttggttttgaattttattaaaaacaaaagggagggatagccttttgggttgcaaaattttttataaataatgcccagtcatgaaaatttgttcacgcgttttgagtccctgcttacgaatctcacacctattttgaccatttctaaaccccgaaatcgagtaagagtcaaaaattaaaatttttcgataatgatcttttttgttcaatttagcaaacttgattttcatgtaaaaattctttcccttagactgactcccaaattgctgaacggactcgagttcaacgagcgcgtcactgtccacattgtgcacaacggacccgaaattgaacacggcgatgtgagtttttgagatggtagggaggaaaaaaattctaaaaaacatcaagttcgggaattccctttcaaaaccgaacgctctcataaaattggttaaaattccattactttgcccttttgttcccatttttctccgtcattttttctcacgggacaattgggcggtcttttttgtcaattaattaattactaattagtttttacattactttccccccttacaattagcattgggatccggagaattttctggctggggccaccaatgggcaccaccagcagcggcagcccgagcacggacaacagcggctgccgggcggccgtccccggcaattcgtccgagcgacggcggaagacggggagggggaggatgaggacgaagggaccgatcactgatcagcggagaggcgccagaggcactgtgatcggcagcggatgagtgaggaaaagggaagggatgaaagagcgatggatgttgggatggctctgatcatcaatcactcactcactctttccccggggggccaatgtttcgccgtctttccgtttggcatttgtttctgtgtgttccctttccccattctctgccactttctctctgcctctgctctctttctttgccttctcccatctcacaatggtttctcgatgtcacttattataattctctcccattgattgatctctcctttttttggcttttccaatcattttttcggatgactaaatttatttattaaattaaatattttcattactttatgtttatataaatacatttgattacacaaaccgtctaattttggtaacgctttcgacgtgggtgtgatgggttttgctgtccctcccctccgaatttcgctttatttccctgccttttcaaatccatatggcaaacaaaagcaaaattaggcgcgaggggggggggcggcaaaaatttggccaatttttgacctatggcaaattgggtcggaggaggagaacacatttccattatttttatttttttggctgtttttgtttaggagggaaagcacaaaatgttgtttctttcaaatcactcttctgtctgatgaaaagccttcagggaatgttgtcgctttttgttggaaaaaattagttcaaagttcaaaacgattcccttgtgcttttggttcaaagacaaaacgccaaacaggcaaattcaaaaaaaagtctaaaaggatcggaacgggccaactccgtctgagccaactttgagtcaatataactcttgaagttattgaccgaatcaaacaatcttgatatcattcgaaagctctttacaggctctattagcctactaaaaattacagaaaatttcgaactataaaaaaagatagaaataaaaaacttcgaaaattctgccttttttgcggttttcaactgacaacttttttgagagctgattaatcactgagaaatagcttataaatatcttctaaacatctagggctttcgaatgataccatgattgtgaagtttggccaacaaagaaaaaacttatagctttttgaacattgctgagacggagttggccagacggagttgacccctaccgtaaaaggatgccgtatttatgaaagtcccctcgaaattttacgaagttattttttctttgtaaacaatgcttggcatagtgttcagaaacgttttgcgcataccgtagtcctcccatttccaatcctttcgttctgttgcagcaatcgaaaaaggaagggattactgatctgattcgagtggaaaagaaagcgcaaattatgcgaaggatggtgccaaagtatgctgacgaaggggcggcagcggagacggcgacggtgccaatgccatcgccgtccgccgttgtagtcattgaaccgacgctgaaaaaggaaaagcaaagggaaaaggaaaagcgcagtggggagacggacaatggcaaaaagcagcggaaggatgaaaaggaagaagacgagcagcaaaacatgggagaagaggagcatacggcacaacaacggcaccaggaaagtgccaacattggcgaagaagcggaggaggaagcggctaatgtcggcaaacggcaccggcgacgacgcttccgacgctgtctgccgctggacggcgccggaggcttgtgcgccgccgtggcgttggacatttcggcgctacggcaacgggcccactcggagggacacatccaacagcagcagcaaag

SEQ ID NO: 78153 - DNA, 375 bp, Heterodera glycines
  Genomic contig location: Contig_ID=SeqID_14151; Location=1435..1809; Strand=+
  SCN-specific regions: Sequence locations=1-375
acggtaggggtcaactccgtctggccaactccgtctcagcaatgttcaaaaagctataagttttttctttgttggccaaacttcacaatcatggtatcattcgaaagccctagatgtttagaagatatttataagctatttctcagtgattaatcagctctcaaaaaagttgtcagttgaaaaccgcaaaaaaggcagaattttcgaagttttttatttctatctttttttatagttcgaaattttctgtaatttttagtaggctaatagagcctgtaaagagctttcgaatgatatcaagattgtttgattcggtcaataacttcaagagttatattgactcaaagttggctcagacggagttggcccgttccg

SEQ ID NO: 78154 - DNA, 825 bp, Heterodera glycines
  Genomic contig location: Contig_ID=SeqID_14152; Location=11..835; Strand=+
  SCN-specific regions: Sequence locations=1-825
atggcaacgcgaaaatggccacgcgatcttcctcagcgcgaaaatagccacgcgaaaacggccacgcgaaaacggccacgcgaaaatggccacgcgaaaatggcaacgcgaaaatggccacgcgaaaacggccacgcgaaaacggccacgcgaaaatggccacgcgaaaacggccacgcgaaaatggccacgcgaaaacggccacgcgaaaacggccacgcgaaaatggcaacgcgaaaatggccacgcgaaaatggcaacgcgaaaatagccatgcgaaaacggccacgcgaaaacggccacgcgaaaatggccacgcgaaaatggcaacgcgaaaatggccacgcgaaaacggccacgcgaaaacggccacgcgaaaatggccacgcgaaaacggccacgcgaaaacggccacgcgaaaatggcaacgcgaaaatggccacgcgaaaatggcaacgcgaaaatggccacgcgaaaacggccacgcgaaaacggccacgcgaaaacggccacgcgaaaatggcaacgcgaaaatggccacgcgaaaatggccacgcgaaaacgtcctggcccgaaataaaagtaccatttttttttctccttcttttgtggcttatcgtataaatgattaaattcttggcaagtcgctttgcctttgacggttgagtgagattgctgttagtttgttgtccaaaatctgactacgaatttcttgactattcgacatagttatttcgcattttctcactttctatgcgtgatttcgacagcaattgaacccgacaattagagactgggtttttaagaattattgacaaaaatgca

SEQ ID NO: 78155 - DNA, 1558 bp, Heterodera glycines
  Genomic contig location: Contig_ID=SeqID_14154; Location=48..1605; Strand=-
  SCN-specific regions: Sequence locations=1-288,310-381,403-437,474 -553,579-629,651-773,796-835,862-865,893-984,1015-1224,1248-1350,1372- 1531,1557-1558
atgatcccagggcagcaaaatgttggcaccccattccaatacactaatccaaattgtcaaaacggtggtcagcagtttcaggcaatttattttgttttattttacttaagtaaaaccaaaaatttgtgtatttaaatttctttaattttatttagccaatgatcccgaccgcacttgggattcaccccatgtcttcagtgatccatggcactccttcagcgggcacatttcagccaactttttcaacagtgccacaggcaattcaaattcattaattaaaaaaaaattctttaaaaagtcagatttaattattcaaatgggtatttagcattttgtttctcatccttttgggatgggtcaattgaatggcgcctatcaaatgcccgggggttaccaaaactcatcgtctgcttcacaggcaataaattattcaagtctttttttctttaaatacataatttttaaattatttagcaaattgttgtacctccgagtcaaatgcctcccccttatcaaaacgcttctcttgtgcatcaacaacatcaggcatttgaataatttttatttaaatttattatcttttgtttgtgttaatagtttgtgtccccagcaactaaccaaatgccgggaaatttccaaaatgcctctttcgctcaggcaatcaaataatataaatctaaccaatttttattagtctatttagctttttattccgtcagctcaagtctcgaataatttaccacacgctcaacacaataaccaatcatttgcacaggtttaaaaatcagattttaatgatattatcaaatctattataacatggattatttttgagttttaaaattttttaaaaaaaataaagtttttctgcatttaaaaaatgatattgggatgcgaaaaatactttatttggtgctatattaattgagaaatttttaaagaagcgataaaaaaatatcttgctaaagttgttgatctttgaacaaataaaaaaaattgtataattttaaaattctttagaagtttaagtcatttttagtcaaatttacttattaatgtttttatggaattttcgggattttttttgtaattacagaatctacggcaaatcaaaaaaaaattaaagaaattttcagttggcgccggcattgcgtgccaacaacaatcaaatgatcacacatgccatggttggcccacaaaatgccgataattcgcagaatttgcaggcaaataattcaaaaaacaaattgtttttattaaaacatttttttttgtttcttttagcccacgaattggtcaaatcatttgcctggtacccaacaaaatgtcgggccccatctttcaaacaatttccaatcacaacaacaacaaaattgccagaatcttcaggtagtgtattcttttttcaaatttaaattatcaaatacactttgtttttattaaaacattttttttgtttctttcagcccacgaatttgtcaaatcatttgcctggcatccatcaaaatgtcgggactcattttttcaccaatttccaaccacaacaacaacaaaatag

SEQ ID NO: 78156 - DNA, 2739 bp, Heterodera glycines
  Genomic contig location: Contig_ID=SeqID_14155; Location=8..2746; Strand=-
  SCN-specific regions: Sequence locations=1-989,1012-1224,1246 -1440,1462-1583,1607-1844,1866-2156,2179-2739
atgcactggatcagcgactgtccaaaggcaccgatctgctcaaactgcaatcgccgtggccaccatcaatcaaaatgccgcctgccagcgccatcatccaagtccaattcacaccgcaaccatgcaacaatgtccatcttcaacatcggagacgacatttcggattggatcatggtcgattgtcaactcaatggcaacaaagcatcactgatggccgattctggatcacgtttggccgttattcagcaagcattatgggaacagttaggcagccccaaactcaaaaagggcatttcaaaagccaaatcatattcggggcactttttcgaaatctccgggtatttcatttgctcagtcacttatcaaggagtcacacttcaattagaatgtcatgtcgcaccggaaggagcaatgaatttgtttggtcttccatggatcagggcgttcgaagcggcacttcaacgtcccattgtcactactctcaccacagatcaattcaaattcgacaccgattcaaattcaatctcaatctcggaggacccggacaaattggcgacaattttaaagcaaaaatttcccaaagttttctccccaagcttaggcctttgcaacaaaatgtgcgcacatctccacctcaagtccggagtacaacccgtcttctgccgtcctcgaccagtcccacatgcggccaaatcagcagttgacgccgaacttgatcggctcgtcgcttgcggtgccatcaaacaagtcgattacagcaagtgggcagcgccgatcgttgcagttcgaaagaagaacggcgatgtgcgtgtgtgcattgattttgcaacaggcctcaacgattgtttggagttaaatcgccacccacttccgcgcatcgatgacattttcgcagcgttggaaggctcaacagtattcagccaaatcgacttccgagacgcctatttgcaaattgcgttggacgaggaatcgaaagaattagtaggaataaacacacaccggggcttatttcagtaccaacgcctgccatttggtgtcaaaagcgctcccagcatttttcaaaagcttatggatgagctcaccgccggacttaacggagtttttggctacttggacgacttcattgtggccacaccaacactggaggaacaccattcgcttctcaagaaattcttttcccggctccaagactggggcctacgtgttcatttgaacaaatgcaaatttctgtgttcccaaattaagttcctcggccacattgtttcagctgaaggaattcgtccggacccggctcgttcagctgcaattgatttcatgccaccaccacatgaccttcaaacacttcggtcatttttgggcgcgcttaactactacggacgcttcatcaaaccaatgcgtgagctccgcacaccgcttgacgagttgctcaaaaaggatgttccttggcaatggggacacgaacaacaacaagcattcgtcaaagcaaaggagttgatgcagtccgaccttctcctcacccactacgacccatccaagccgatcatcgtcgcagcggatgccagcaaaaacggaatcggagccacaatcagtcattcatttccagatggctccgaaaaagtggttgagcatgcctcacgttccctctcctccgcagagcagaactattcacaaatagaaaaggaggcccttgcacttattttcgccgtccaaaagttccacagaatgatctacggacgccgctttacactgctcaccgaccacaagccgctggttgcgatttttggatcaaagaacggaataccaatttacaccgcttcaagactccaaagatgggctttaattctttcaaattatgatttccaaatcaaatatatttcaacaaattcatttggtcaggtggactttctttcacgtctggtcgctcaacaacgcgaaactgtacaatctgaagaccgagtgatcgccaacattgaggaacttcccttgtcaatttcagatcacgatcacccgacctcacgcgatgagcccgacgagtccgctgtcgaatttgtgttcatggcaacaattgatcaacttccggtcaccaccaaagaagttgccgaacaaacgcaactcgacgaaactctcagggaagtttccgaattttgtcgaaatggctggccaaagaaaacaccccaaaatttggcatcttatttcacacatcggtacaaactctcggaagtcaatggatgtcttctgtttggagagcgcgtcatcatcccggcagaattgcgccaacgcatcctgtccgcgctacatttcactcatcctggcattgtacgaatgaaggcacttgcacagcgacacgtgtactggccacgcatggacctcgacattgacaggtgcgtccaaaactgtgacgaatgtgcacttgcagcaaaagcaccgccaaaagcgccgcttcgttcatggccttctacaaacaaagtgtatgagcgtctacacatggattttgccggaccatgttccgatggacgtctctatctaattgtcgtggatgcttttagcaaatggccagaaatattctcagtccagagcacaaccgccgacaatgtcattgtccaattggaatggctattttcgcgatatggttcgtcaccgataatggcccaccttttcactcaaatgaattttcccatttttgcaggaccaggggaattaagcaaagttaggtccgccttatcacccgcagagcaatga

SEQ ID NO: 78157 - DNA, 1622 bp, Heterodera glycines
  Genomic contig location: Contig_ID=SeqID_14156; Location=4..1625; Strand=-
  SCN-specific regions: Sequence locations=1-1622
atggccgttgactttgctcaaatcctaaagcaattagtcgaccaacagacccaagcatttcaaaatttgcttcaaaatgcccaaccaaatcccaatgtttccaatcattcaacaatttattccaccattaattcccaacttggtgaattttcattcaatccagaaatggattcaacatttcaaaattggctcgaccgttatgggcctttcatccaaattgatgggaaagacctccctgatcagatgcaagttcgacttttgctcggcaagctcggatcggaggagtacaaccgctatgcagaaagtgtgcttccaagcaagcccactgatttcacactggcgcagacgatcgacaagctcaaggctatgtttggtgaaacaaaatccattttcacccgtcgatttgaatgttttcagctcacaaaatcaatttcacaatccccattagatttcgcaagccaggtcaacgcaatgtgcgagcgatcacaaatggatctgaccaaagacgaaatcaaagcactgatcttcctcacgggactttcggacactgatcgagaactccgtgagcgttgtttgcgacttttggaagaagcgaaaaagaagacaccgccggaagcaatctcattcgagaagctcacagaagaatgccgcgcgtttctctctcttcgcaacacttccaacgcattagcccattcaactcatgtggccaattcaatcactctaaaaccccaaaaattaagggatcatcaacaacaaaagcggaggtgtcgcaaagctcgtccaagacgacgaccaccaccagcaacaatcaacgatcatcccaatttcagcgcaaaccgcagcagcctccgtcgccatgccgttactgcaaccaaatgcactggatcagcgactgtccaaaggcaccgatctgctcaaactgcaatcgtcgtggccaccatcaatcaaaatgccgcctgccatcgccatcatccaagtacaagtcacaccgcaaccatgccacaatgtctgtcttcaacattggagacgacatttcggattggatcatggtcgattgtcaactcaatggcaacaaagcatcactgatggccgactctggatcgcgtttggccgtcattcagcaagcattatgggaacagttaggcagccccaaactcaaaaagggcatttcaaaagccaaatcatattcggggcactttttcgaaatctccgggtatttcatttgttcagtcacattccaaggagttacacttcaattagaatgtcatgtcgcaccggaaggagcaatgaatttgtttggtcttccatggatcagggcgttcgaagcggcacttcaacgtcccattgtcactactctcaccacagatcaattcaaattcgacaccgattcaaattcaatctcaatctcggaggacccggacaaattggcgacaattttaaagcaaaaatttcccaaagttttctccccaagcttaggcctttgcaacaaaatgtgtgcacatctccacctcaagtccggagtacaacccgtcttctgccgtcctcgaccagtcccacatgcggccaaatcagcagttgacgccgaacttgatcggctcgtcgcttgcggtgccatcaaacaa

SEQ ID NO: 78158 - DNA, 882 bp, Heterodera glycines
  Genomic contig location: Contig_ID=SeqID_14158; Location=878..1759; Strand=+
  SCN-specific regions: Sequence locations=1-220,243-458,481-498,520 -526,548-610,632-674,696-729,751-882
atggcttcacttcgttctcacttaaaaaatcaccatcaactaaaattgaaagaattggaagaaaaagataaggctgcagaaagcctcaaaaataaggaaacgaacccgagacaaccgacgttaaaacgaatttttgcgacttcaagtccagtcattaaaaaaatagcgagggctgaatctgctaactcgtcgcaattaaccatcgaaaaaaccttttgtaggaatttaattttaaatgaatttacataatattttcagctcaatggacacccgacggagaaatgactaagaaaattgacaaggcaattaacgatttggtatgtactgctggattgccgttctcttttgtggaagaacttgggctaaaaaatttattaagaatattggttcctcactataaaactaggtattaatttgataaataaaactttcgatgatcaacttttttcaggggcagaaaatatttcacaaatgatgttttagagtacagctattccttgatgttgcaaaatgttaaaaggcgaattgaaagcactgattacattacaattgccgttgattcgtggtcctctgacacaacccactcaatttttggtataattggccattttttggatccgaattttgaacctaaattcgttgtgctcgcggcgatcccagtgaaaggtcgtcatataggccaaaatttttccaacatggtttcaaaagttagtttttgggtaaagcttaaaatgtaagtctgtgtttttaagactttgaacgcttatcaaattactgataaaaaattgcacttgattctacgtgatgacgaaagtgcgatgaaattggcgaccaatttgctcggttatgattccatgcaatgtcacaaaattcaattggtaa

SEQ ID NO: 78159 - DNA, 984 bp, Heterodera glycines
  Genomic contig location: Contig_ID=SeqID_2159; Location=197..1180; Strand=-
  SCN-specific regions: Sequence locations=1-167,218-326,348-984
atggcatcgcccagaaaaaagcaaaagcattcctccaccgatgaaacttccaccgaaattggtgaatatgaacaacaaataatgggttcagttgtgacatcatttggaaaacggcgaaaagttcacgtgccaaagaaaatgaataaacgaattttgaggaaaatgtgagaatttattgggttaaaattaaacattttttaaaatcattcaattatttttccccggcattttagctggatttgctttgacgtttggatggacatgttcccattttttgaccgtcctcaactcggcctcaaattggcactaatttcgccacgtttcaatgttttaattgacaaatatttcaatggtaaaagggaattgacaatttggaaatggataggaattgacaaaatgggaacagtgccgaaactatccgtgtttactaagtatcctactaattctgtgccatttccgttgcccgaccgtccgctgcacagcaaaattcgtttccatttcctcctaattgagtaattaaattttctatattgtacatgtctaaaccagggttgctatcgaaatattttcaaaatcagaacagggcttaaaaaatcagatattggggtcgaaaaccaaagcatttgcaaaattgtttcaagtttttttcggtttacctcagttggaccggcacggttgggcccagcatatttttccattataacttttttttgttcttcaaaatccaatattttttatatcattcgaaagcttaacatgtttagaatctttttctaagctattgcatagcgattagattcaattaccgagaaagttaaacatgaaaattgcgaaaaagtcgaaattttttcttaataattttttaagaagccaaaaaatctttttgcttttttaaagctaatagagcatgtgaagagctttcggatgatactcaagaatgttggattttcaaaaacttaccaaatattgaatttggggaataaa

SEQ ID NO: 78160 - DNA, 1970 bp, Heterodera glycines
  Genomic contig location: Contig_ID=SeqID_2159; Location=1273..3242; Strand=+
  SCN-specific regions: Sequence locations=1-84,152-308,332-531,554 -606,629-700,723-845,867-1012,1035-1050,1072-1100,1164-1970
atgttcatggaatgggagatccgacgtttaataatgccgacaacattaatgagcaaaaatggacccacggacaaaggatcagtcaaataataatttaattaagaatatatttaaaatgggaaaataaaaaaatatactaaatttaaaatttgtactttcgttcagcttttatagcacttatttcaggcatcggcgaaatctaatcctaatttgttcagattagagattttttggtcaattaagtcatatacatagcatttttctcacagtccaaattgagtaaattagtcacaggaattctctcagcttatttttaatcttttttaaaattcaaactattattttatggattctttgtctgtgggtcctttgtctctgtgggtcctttgtctagatattttgaatgggggtgctgataggcgccgctgggaaaattcttgaaaatttgagtccaatttgttactaaaattacccataaaatccaaaatttttcgtttgcggaggattaaaaatttttttccattattcgcttgaaaatttttaaagttttcatttcggggagggggggggggggaattcttcccctagctacgcccttggctacgataaaagaaaagttttgggttattatgaaaaagcgccggggaacgacctactttgagaggaaggggaggagcagtggcgttgccaacttggcgcctcaaagacaatagtgtaataaattgttcaatttccagcttatccggaacttgtggcacttctgggccgaaccgaacacgtgccagccacctccacagttacttgtgagtaaaaataataattgactttgaaaaaagaaaaaaaccaataatttttcttatctttttcgaataaactggtcaaaataatttatctttagtcacattaaatgattaaatagaaaattgtttttttttcagtgacgtctgccgagttacgcgatttggtgacaagtgcccttgatgccaatatgcgcgcggcggtcaaccaaacgggtaattttatttgaaaaattgaaaaaaaaaattgagtttccgtgtgaaaagggaggggtttgagatttcaacggtcaaaacccctgcatttttacttttaaaatgatatttttataaaaaaaaatttttttgctttttttttatttttatgtaaatgagcatttttcaaaaaataaaaaaggaaaacttgagaaattcttttaaaaaatagtcattaaaattttgggaggaaacgatgcgtggggggtggggcatttcccgccaaaacatatggttggtgctggaacttttactcatcaaaagaaataacaaagtgaaaaaaatttttcaaatttttatgctgactaaattttttcaaaatccaaaaatcgtttggaattttttttgaaaaaactttattttatgtggtattgaaattccctgtttttcagtcagaaacacggtggctgaagaatctcacaatcagcaacaactcattaatcggatcagcgaattggaaaatcaagttcggcagctgcaaattcttggccctcaacctggtgagtagaggaatggtccaacagattctgacattcttcaaattccaaaaacactgttttttaaactttttagagtgccctttcaggggagggggcatcggaagtggggagatcgcagaggagggaaaccgagaaaaatttcttggaaattttggcttattgaaaagaatttggtttttttagtgtatttttgcttcttttgcgtccgattctacccccttttttcatgatcgaaaaaaatcacatcttttttgtttgtttcccgggagtagtgaatgaaacaaaatgcacataaataaagcaataaacattttcagtgacgacttcgaacggaacctccggaattcgcggtaaacatttctttttattttcggtttgtggcattgcaaagccaacaattattttgattatagtataa

SEQ ID NO: 78161 - DNA, 957 bp, Heterodera glycines
  Genomic contig location: Contig_ID=SeqID_2159; Location=3598..4554; Strand=-
  SCN-specific regions: Sequence locations=1-572,595-646,680-802,824-957
atgaaagaaatagagaaagcaatagagcagcggcagtgtaaacagaaaagccggcgaagcgataaaccaacgcgacaaatgacaacaaagcaagagcaaaatagaccggatcagacaactgcacaaggagtgcatcaacaaagacaagtgaatataaaattgtgttataaaatttaagagatctttggatttcctcgcgcaaaaaggatgtaagcaagttcgcattggccggcgtcacattgaacagtctaaccacttcagcattggagagggcattttctgctgcttccaatgacgtaatccgttgctggcaaaaggcagtgaaacgagcttaataacgaatcactgttacatttgaaccgaaaattaatatatgcaaaaaaaagaagaaaattttggaatgtctcaattaaatttggtcagcttattttggaacacggctcgaatgacagacactcagccgaatcaggcccgtatccaggggggaaaaggggggggcacgtgccacatgaaatgaaaaatgcttcaagaaacaattttttgtataaaattgcataatttcttattaaagtacataaaatttcaaaaaattattccctgcagcgccatccggcaccgccggaacccattgaaccatcaattgctgaaaaattttcaataattttttctttaaattttcttataacctatgtattttatattagcatgctaaattttgaaaaatttcgttaagtttcagaaatttatggccaaaaattttcggaaaacaaagtttgctaggttttttggaaatacttttccgaaactcaaacaaatttttcgatttttggcatatagaaaatacctagggctaccgaatgctattaatttaattcaattcgaataacaaaaaagttattctccaaaaaaccgggctggtgcccagttggttggcgccaagtcgaaccccaaattaaa

SEQ ID NO: 78162 - DNA, 287 bp, Heterodera glycines
  Genomic contig location: Contig_ID=SeqID_2159; Location=6194..6480; Strand=+
  SCN-specific regions: Sequence locations=1-287
atggtcaaaggttgggccaaggcccaaaagagttgtgaatggaatcaatcgcaaagtataattattaatagagcccggacgggaccgggatcccgccgggattttgccgggactcccggtccctgcttttttggacaaaccaccgggaccgggagtcccggaaaaacgggagtcccagtcccgggatcccgtcccggtccattttccaagtcccggtcccggccatttcaaaattccgggctctaattattaattaagtcaatcaataattgattgggtgaatcaaa

SEQ ID NO: 78163 - DNA, 332 bp, Heterodera glycines
  Genomic contig location: Contig_ID=SeqID_2159; Location=7263..7594; Strand=-
  SCN-specific regions: Sequence locations=1-332
atgcgctgtccactgggcccggcattttcttctgctgcaattagtgaacatgaacagcaaccgatgggctcatttgtgacagaatttggcaaacggcgaagtctccgcgtggcaatgaaaaagaaccatcgaattttgaagaaaatgtgagaatgtattgggttaacaatttatgaaattcatttttaagaccgctcaacatattttaacaatttcagttggatttgtagcgatgtttggatggacattttgccacattttggtctgccaaaatatccgctgcccaataaaattcgctttaattaccttcggattgagtaattcaaaataaa

SEQ ID NO: 78164 - DNA, 2882 bp, Heterodera glycines
  Genomic contig location: Contig_ID=SeqID_14159; Location=162..3043; Strand=-
  SCN-specific regions: Sequence locations=1-115,137-720,745-847,869 -1227,1249-1258,1280-1518,1540-2378,2418-2499,2521-2882
  Gene Ontology: Mol. function=transporter activity; Cellular component= nucleoplasm; Biological process=protein-nucleus import, docking
atgaagagcggtgcgggatccctattcggacagcaaaacacgttgggacaacaacaaggaagccttttttcgaaaccagctggcggatttttttcaagttcactgggttttcaaaaattaattcattgttgtttttcagccacgacttcgggcgcaacatttccgactgcaacaacgacgtcgtcattgtttggcggacagactcaaacgggtggcctctttggcgcagcaaaaccagcgggaacgtccatgttcggggccacctcccagcctagcggagggcttttcgggcagcaacagacggcgagtgcctttggggcgaccacaacacctggaaccggactgttcggacagaataagccatcggtgtgctgcttttctttcgggaaatgggtttaatttgtctgtttaggcttttggtcaggtgtcacagccgagcatttttgggggacagcagcaaaccactggcagtattttcggtggcactgcgccgtcttccgtcggtggttttggcgctgcgacggtgggaagaatggttaactgttggtttctattacgatagtaatttaagactacgactacgagtcttttcggtggacaacctcaacagagtgccttttcctttggccagcaaccgcagcaaacggccgccaccacgggcctttttggggcgaagccggcgcaacaattcggggcattcggtgccactcaacccacttcaagttttggttgttttttaaatattactttaaagatttgaaattaaattgttttatatgttgttcttggtcgtgaattattttaaagctgggtaattttataggcctataaataccttgcttaccgctataatttatttttaatttttgaaattacctaacattttcagaacttcattgctatgacttgaaaattagttacttttccttgtacaatttcttatctatcaactgatttagcggctaaatttgcgccaccaattggagaggaccaaatgcaactgaaaggaacacctcacaaagtgaacacgaaacaaatgtgcataacatcgatgaaggagtatgagcacaaaagtttggaagtgcgcgggacgaatccttcgcttttatcagtttaatgataattaaggaacttcgggtggaggattatatcgccggcagagcgaaaaacaccggcgccgcttccgccgcgtccacttctttatttggtcatcaaaatgttatgggacaaccgcaacagcagcagcagggcggactttttgggaagccagcgggcggactcttctcacccggtggatatttgttaatttgccaagatccgcgtttgggtcttgtatgtttttgcaaaatccaacaggacacaaagtcgtatcaaaacgtttttagccaggaaccctcagagttcctctcaaaaaacaggccttgggtgaaatggtaatcgaaaatcaattcctgacccagctttttttaccaatagtccaagcctttattgtgaacttcgcggcgagggccggtgtctgcctgccaagaagggaaacataaaaatttataatattcatttttaacctatttcacatatttatcattaaaaaaattttggtttccgtggaggggggctatatccctcctggctacgcccttgaatattatgagataatcgcagaaaggccagtctttgatcatatgcaatcgaacccattctatgaaatcttgagtatcaaaaaatgtcagaaaattttagtgtttctctttcgtaatcggtcaatcgttagccttctctcccaataaattgtaattcccataaaaaaaattccagctacaacttcgggcgcaacatttccgactgcaacaacgacgtcgtcattgtttggcggacagactcaaacgggtggcctctttggcgcagcaaaaccagcgggaacgtccatgttcggggccacctcccagcctagcggagggcttttcgggcagcaacagacggcgagtgcctttggggcgaccacaacacctggaaccggactgttcggacagaataagccatcggtgtgctgcttttctttcgggaaatgggtttaatttgtctgtttaggcttttggtcaggtgtcacagccgagcatttttgggggacagcagcaaaccactggcagtattttcggtggcactgcgccgtcttccgtcggtggttttggcgctgcgacggtgggaagaatggttaactgttggtttctataatgatagtaatttaagactacgactacgagtcttttcggtggacaacctcaacagagtgccttttcctttggccagcaaccgcagcaaacggccgccaccacgggcctttttggggcgaagccggcgcaacaattcggggcattcggtattttattataataaaatacatttaataatttatattaggcactcctgccacccagtcgacttctctgttcggcgcccccttgtccaaaattggcactggtagcatttttggttctccccaacagcaacaacagccccccgttggtggtttattcggacaacagacgggaacaaacttattacaaaagccagcacagccttctctgtttggcacaacatcgcctcagacaggatcaggcatgttcggcacgggtatgtattctttttaaaatttaaatgtgtcccaacctctctcttcattcattttcaggcttttcccaaccttccgcttttggtgcggcttccgccgggtcacctccaattttgcttggctcaaatgtcaacatttctgccatccaacaggccattatcagtgcccaactctcttccctcccctacggggacagtccgttgttgaaaagccccgccatttcgccaagcaaatcggccgatgacattgcgag

SEQ ID NO: 78165 - DNA, 1710 bp, Heterodera glycines
  Genomic contig location: Contig_ID=SeqID_14160; Location=1494..3203; Strand=-
  SCN-specific regions: Sequence locations=1-172,194-877,899-930,954 -1710
  Gene Ontology: Mol. function=hydrogen-transporting ATPase activity, rotational mechanism; Cellular component=hydrogen-transporting ATPase V0 domain; Biological process=negative regulation of locomotion
gtacttgatacgggcgaaatgcatccgacgcacaatcggacgaacaaatttgtacaagtcttccaagacattgtcgactcttacggcattgccagctacagggaaatcaaccccggtaatcaatcccttggcatttctcccccattttcatacttttccttcttcagcaccattcactttggtcaccttcccttttctgtttggcgttatgttcggcgacattggccacggactcgttcttttccttgccggcctttcactcattttgtgggagaggcgaattgagcagtcgcgcatcaaagatgaagtgagtgttgtgatcgttttctgattggcattgccattgataagttagacatttctcgcagattttcctaacattttttggtggtcgtttcattatcgctctgatgggactgttctcaatttacgctggactgatgtacaacgacgccttttccaaatcgttcagtattttcagttcaaaatggacaagtccttacaagtaataacgtgtaatgaatacctttttgaattcgattttgatattttccccctcagtttaactcagttaattgcgttgtcctccgacgccaattcgcctcgtcaaatggttttaggcttggacccggatgttgcttttcttcgtcaggagggctcttattggatggggttggaccccatttggaatttggcggaaaatcggctgaatttcatcaattctttaaaagtgactaatcatttgttgatttgttccgttaacaaattatcttcagatgaaaatgtctgtcatttttggtatttctcaaatgacttttggtgtcgttttgtcacttttcaatgccaggtgaacgcactttctcctctgttttatttgcatttcttttagatttttccattcttccgtcaatttgtggacagtggcaattccgtccttctttttcttgtcttctatttttgtttacctttgcgtgttaattttcgtcaaatggattttcttctcggtaaaaccggatgtgattttcggttattattaccccggtattaatatctttttaattacgatattactttcatattttgctcaattttaggtagtcattgcgcaccttcactgctcatcggactgattaacatgttcatgcaaaaacagcgaccttatggctttgtcgattcaaacaacaattctacggaatacccaaactgtcacttgtccttgtggtacccacagcaggtgaagtgagagtcgttgagggaggggggggggaattgcggaatttatctgatttccttttggttcgattacacatgaattctttaaccgatttttagtaattacttttatttctcaatttcaggctttggtggagtccgtactcgttggcgttgctttgttctgcgtgccgataatgctttgcgggaaaccgttggttcgcaagattcggcatcaccatcgtacgacggatggaatggtggcggccaacagaaaggactcgaccagaaaattgcaaaagtcaaaaaatattgtacgttattattaaaaataattcattatacaatgaattatttcagttggtccgtgttaaaatggactccgaagttgctgaattgatcgccaccacgactagcaacaacgacttggacaaggggacaagaaacggacagccgagcggagagggcggaagggcctaccgagcggaggacgaattg

SEQ ID NO: 78166 - DNA, 471 bp, Heterodera glycines
  Genomic contig location: Contig_ID=SeqID_14161; Location=56..526; Strand=-
  SCN-specific regions: Sequence locations=1-359,381-444,466-471
  Gene Ontology: Mol. function=transporter activity; Cellular component= integral to membrane; Biological process=negative regulation of locomotion
agatgctgcctactcctgtgtggttgagctgggccaatattcgcttgttcagttcaaagatgtgattttcggataattggggttgttattaaaccttttctcttcagctcaaccatcatttgaccaccttccaacggacgtatgtacgcgaagttcgccgttgtgcagaaattgagcggtgccttcgctatttggagactgaagtcgtggaggggggcgtcagcgaccacattccgccattggacaccactcgaacggacatcactctgttgcgtgaaatgtacgatttggaggtaatggacatggaaaattagaaaattaatttactgtttttcaattcagtcacacttatacgacatcgagagggacatccggcagtttcttgccaacgaggcccagctgaagcgcaatttcaacgatttgaagcagttcaaaagtgtctatgaaaaggtggaagctttcttcagagtg

SEQ ID NO: 78167 - DNA, 503 bp, Heterodera glycines
  Genomic contig location: Contig_ID=SeqID_14162; Location=1646..2148; Strand=-
  SCN-specific regions: Sequence locations=1-324,348-443,465-503
atgtccctcttcttcaaaaaggttggcccgcaactcggtgtccctgttcgacaccaccatcatttgtgcctacaacgcgtcgttggcattcccggtcaagcagctgagcagcgcgaacattggcgaccgggtggcccagcggacggtggcacagtgcagcagcggcatcggagaggaggaggagacggcgacgatgacgacggacggggacatttgatgagcgatgactgaccgatcggacaatggaggggtcggggggggggggggggacagagaacggaacgaagccgatccgatcgatcgatgatgtcatttccaccatggtgatgtgccaatgatgtgtgctggtggcggacattttaaaatgccatggattttttttgggggcgagttatttttcgacaccctgccaattcatctaattaatccttacacccgaccaaagtttaataggagcaattaaatgatttctaatacccaaaagtcagggaaaacagaataaa

SEQ ID NO: 78168 - DNA, 800 bp, Heterodera glycines
  misc_feature (662)..(662): n is a, c, g, or t
  Genomic contig location: Contig_ID=SeqID_14162; Location=593..1392; Strand=+
  SCN-specific regions: Sequence locations=1-108,231-324,356-800
atataaaaattattccattacttttttggctgtgaaaaaaatgaattatgccaaaatttgtttcattttcctgcaactttttccaattttattccattcatcggaaggtaaattttttaaataattataaattgcattttaaatccgataaatttagttttaaaagtaaattaataaaaaattgaattacaaattttttttttggaaatttctaaaattttatttattatggaaaaatgattttcttcaatttaatgggagtcactgaaacaatttttcggcaaattcgaacctatcgtgaacaaaaattttaaataaatccgcaattaaaaatttaaataaattttcatataaagaaattctggcccagtattaaaaattatttgatttacaggccgtgtcgaactttggcaagtcagccaagggtatgtttcggtgggcagggtttttttcatttatgaatgactaaattcgaacccgtccgaaaattaatgctccgtttttcgggtaaaaaccccgggggggggggaggcttttcaaacaaatttttgtccaaaatagacaattttatgggggtttttggccgaaaaaatcattgttttttcacccagtaatcccgattactacacacggggcgctattctgaatgaggatgctgtgcncaatgaaaattacaacggcggaggccaacattatgccacattctgagcaaaaattatgattgattgaatgatcgccagtccaattttgcatactgtacaaaaatcattactgttgctttaggttttcacttttgtata

SEQ ID NO: 78169 - DNA, 676 bp, Heterodera glycines
  Genomic contig location: Contig_ID=SeqID_14165; Location=233..908; Strand=-
  SCN-specific regions: Sequence locations=1-70,546-676
  Gene Ontology: Mol. function=DNA binding; Cellular component=nucleus; Biological process=N-linked glycosylation
atggaaaagcactgtctaccgtcggcatcatgctcaaagtttttagtttgtgatttaattggagaaaacggaaaaagaagaggaaaagaggaagaagaacaaaaaaagatgagggaaagagagaagaaagaagagaaagaggaaatggaagacagagaaagggaggagaaaaaagaaaggggagaaaaagaaaagggaggagagaaaggaggaaaggaagagagagaaggagtcgtgaaagaagaggaggaggaaggaggagaaggaaagagaaggaaaaaaacggagagagagcgagaaagaggaggagacgccggagggaagaaaagagaagagaaaattagagagggaaagagaaggaaagaaagtgaaaaaggggaaaatgactgggagaagaaaggagaagaggaagagagagaagaaatggagaaagaagaggacaaagaaaaagaaggaaaggaacggagagaaagagaaacaggggaaaaggacggacagaagaaagtagaagagggagaaggagaaaatgacgggaaggagaaggaaggaaaaactgaagcaaagagagaggccgaaaagcagaaagaagaaaggagccaaagggaatgccgaagaaagcgaacgatgccacaatttgccgatgagagagcagccgaactgctggtcatcgccttcg

SEQ ID NO: 78170 - DNA, 1029 bp, Heterodera glycines
  Genomic contig location: Contig_ID=SeqID_14166; Location=1566..2594; Strand=+
  SCN-specific regions: Sequence locations=1-131,155-161,447-872,894 -1029
atgattataaaaggtacaaaagtgattggaaaagttataagagtaattagaagaggtacaaaagtgattagaaaaagtacaaaaattgtgaaatggtacaaccatggttaacagggtaaaatcatgatttcaaaattaaataaataaggaaatggtttatgaaaaaatataattaaaaaaaatgtattaataatttttaaaaaattattaaaaaatgctttcttttattaattaaaaataaactttgaatttacaatgattgagtattattgtattgaaaataaatttttgacaaattataattaaaaaaacaaataaattctttaatttaaaaataaaaaataattaattttaaatgaatacatttatttaccaaaattatttacttcaaattaaacatttttatttattattaataaaagaaatctattttttattaataaaaacattgaaaataacgtaaaaatgcacagaaaaataatgtacaccgtccggatccgaacctgccccctcccccctcaaaatgatgcctcagaatccccaatcacacagggattctgagggcttaacgatgtaataactgaaatctgatgtcagattagtgatcagcggcctaaattggccctaaagacatatttttggaagatttttgtgaaaaaaattttccactcaaaaatcctggtcacccccctttggtcccgaagccgcccccccccaaaaattgggaatttaaaaaaaatatcagcgatttttaggccgcttccagtgattagaagaggtacaaaagtgattataagaggtacaacagtgattagaagaggtacaatggtgattagaagaggtacaaaagtgattataagaggtacaacagtgattagaagaggtgcaactgtgattagaagtggtacaacagtgattagaagaggtaaacagtgatcagaagaggtagaacagtgatgagaagaggtacaactgtgattagaagtggtacaacattgttaggagaggtacaatattgtttaaaattaa

SEQ ID NO: 78171 - DNA, 92 bp, Heterodera glycines
  Genomic contig location: Contig_ID=SeqID_14166; Location=749..840; Strand=-
  SCN-specific regions: Sequence locations=1-92
acattgacgaaaatgccgacactttgatcaaatcggatggatttttgcaaattgaccaaaaaatgttgtgcgaaattttggaacgcgacgaa

SEQ ID NO: 78172 - DNA, 1099 bp, Heterodera glycines
  Genomic contig location: Contig_ID=SeqID_14167; Location=531..1629; Strand=+
  SCN-specific regions: Sequence locations=1-63,94-342,364-563,585 -695,717-824,846-1099
atggaaaggcaaaaatcggacacggaactttcgggtgtcagggaagatctgaaagtgtgtgagaaattaataaaaatgaaaaaattataaaaacgaaatttcagcagaaacggcacacactcaaagaaattgaagaagcgaaaacgaatttggaggacgcacttgcgaaaatcactcgcgaattgaatttgtcaaatgagcaattggtgaggaaggaaaatttggtggaggaattggagaaccaattggaagagatgcgaattgtagggacgggaaaggtaaaaattggaaaggtattcgggggaggggacaaatggacaaaatgatcacttttattggagcaatttaaacatttaattatttagcaccaatacatcatctctactgaccaaactgtcgttggtggcatcaacggaagtggcgctgtttcttcacacaaaattgacgacgcgacacttcgccaattgttcctttcctattttactgcggaaaagtctaaacaacccgaaattgcaattgtgatgtcaagaatattgggatattctgcagaagtgagtgtcttgttatttctttgggaatgatttcggttggcgcttaccaaaattttttccgaaacagtttttttgagtacgtttgggtcgaatgggcgaacgccccttcaccgattattttttcttttatctccaaaaaattggtaaagaaatgttactttacttaggcattgcatttaaagaagaataaatgaaataaaaattaacaatttacaacgaaaagaaaatgaaaaataatgcttgacaatatgaactgggaattatgatgttcaaatgagctggtgttcatttgacagcctccatttgaaccaatccgttgtgagagaaatttatggatttgccccttggatcagagacccctcccctaatatgtcacttccttttttctaggaactatctcaaatcatatcagatattatatagtacacctcctctgctcctttatatcctacttactttgccacatcttaggcccgatcacatcgcccttctcataaaatatctcttatatgtcttatacgatttgaatgattttctaaaaaatgaga

SEQ ID NO: 78173 - DNA, 505 bp, Heterodera glycines
  Genomic contig location: Contig_ID=SeqID_14169; Location=713..1217; Strand=-
  SCN-specific regions: Sequence locations=1-72,127-264,286-330,356 -397,419-505
atggcttcactgaaaaaggccaacgaacgcccgaaaaagaaattatcggtaattacaataaaatattttgccatttttataaattgattttaaataattatattgtaattttctaattttaatttagtggacaaatgtcaccgtttttctgcgcatttttcgagcaaaaaaagattttctttggaaaggcaacgaaatccaatggacgggcgaaccgttggcagaacgaatgggcattttgcgcacacggaagcaagacaaagtgaagagtttgaagaagaaagcgatcggacagttcgccaaggaatacaaagtgagtgccattttgaatttaaataaatttgaagaaaattgaaataaatgaacaaaaaaagagaaacattttgtaaaactgtcattttgacaaaaaattggcataacatttctcatttgtcagaacaaattgaacatttttgacatcattccatggcactaacaaaaaatgtttcgcttagtcactattaaa

SEQ ID NO: 78174 - DNA, 411 bp, Heterodera glycines
  Genomic contig location: Contig_ID=SeqID_14169; Location=2925..3335; Strand=+
  SCN-specific regions: Sequence locations=1-17,39-71,113-273,295-411
atgcacaaaatcattactttgtttgtcgttttgtttttgtattcttctaaattcaatggacacccaaagggtaaaaattaaattaaataaaaataaaaataattaatttaatcacaaggagaaataactgaagaggaagccgaagtctcggcagaagaaacagaagcagcgccagaagtgaaaaatggccattgcaaatttgaaggaatgcttcttttgggacaaaatgccgacaaaaatgtcgatcttttgtccattttggaaagtgccgaaaacaatgaaaaagccaaagatacggaaaggactgacaaagtgaaaataattaggccaagcgaaatccatcgattcattgaatcgctggaggggcaaacggtggccaaaaatggcatacaattcaacgtaatgtctggg

SEQ ID NO: 78175 - DNA, 2384 bp, Heterodera glycines; identical to SEQ ID NO: 14170
  misc_feature (2279)..(2279): n is a, c, g, or t
  Genomic contig location: Contig_ID=SeqID_14170; Location=1..2384; Strand=+
  SCN-specific regions: Sequence locations=1-295,318-445,467-480,579 -887,916-1305,1329-1384,1407-1417,1439-1841,1881-2126,2148-2319,2345 -2363
  Gene Ontology: Cellular component=plasma membrane; Biological process= hair cell differentiation

SEQ ID NO: 78176 - DNA, 1498 bp, Heterodera glycines
  misc_feature (43)..(43): n is a, c, g, or t
  Genomic contig location: Contig_ID=SeqID_14171; Location=26..1523; Strand=+
  SCN-specific regions: Sequence locations=1-282,318-351,380-590,646 -1150,1172-1498
atgactttgatcagagacaaacacatgccgacgaaggcaaggnggaagcacgcagcggaacagagcataaccaaaccaacgaagaagtgagtactgaaatggaaaggaatcaaaagggaggataaaatgggaaaaataaaaaattaaattgaaatggctgaccgaataatggaaagcgtgtcactccaaccgctgatttaaaaagtattggaatgttcttgagcagttagtgattgcttattaccaggcatattccgacagtccaagtgcttggatgaaacaaaaaatggtgtggaggaagaggaccaagaagaagaccaggaaattgaaggacgaatcatcactgacaaagaacagagaatgaaaagaaaagttaaggcattgcccaccgaaatgctttgtaaacggggcgaaaccaaaggagaaaagcgcacggagtgaacagagccaattgaatgacagccaaaaaggggagaccgatgggaccaccggcgaacagaacgaacagcaaagaggcgaccaagttgaaggccaaggccaacacgtacagcagatagacatggtaagcccaacggacggtttcctgaaatgggaaagaaaggggagaaaagataaaaggagacaaaaacacactgaaacaatgacgacacctgaaactgttggggaatctccacatcgatgtcctggtaaaagcacggcttcagcggcacaatgctcggaagcggaggccaattgtggtcccgattctgtgccccaaagccaaggccgtttgcctgcggctgcgtttgctgacgacggttttgctcctaattgaggcaacggatgtattgtagaagaaatcagggtttttggaccaaagggaattcaatttttacccaacaaatgatattaaatattctaattccatttcaattttgagtcaatcgctcgtccgtccccgttcgcaaacgtcgtcggaagactttttgaaccataactttgttcactgtcaatcaaattaagaattgttggtgttgttcgatagctctatgtgtttattattaatttgcaaaatctcaaaaattttcgttaagtttcaaaaaagttatggccagaaggaactcaaaaacccagtaattcgaactttttttgctctgattttttttgtgcataaataaaatttttgaaaatttgcaggctaatagcatttttcgaatgctttcgaataataccaagaatggttaatttggttgagaaagaaaaaagttatggtcgaaaaattcgttcgacgacgtttcggctgacgacgttttgtcctactccgccccgttcgacctgttcccttttgctcaattcctcctgtcgacgaaacaattcatcttgtcccatgctaactgccggtggagtcgagttggtagccttaaatagggaattcaaaacaaacaatctttgcaactggttgtgagttggatggaccattaaattgcgaaaattaattggcgtcttcttgccaaatcta

SEQ ID NO: 78177 - DNA, 1423 bp, Heterodera glycines
  misc_feature (1356)..(1356): n is a, c, g, or t
  Genomic contig location: Contig_ID=SeqID_14171; Location=1..1423; Strand=-
  SCN-specific regions: Sequence locations=1-227,249-753,809-1019,1048 -1081,1117-1423
  Gene Ontology: Cellular component=synaptic vesicle; Biological process=intracellular protein transport
gctaccaactcgactccaccggcagttagcatgggacaagatgaattgtttcgtcgacaggaggaattgagcaaaagggaacaggtcgaacggggcggagtaggacaaaacgtcgtcagccgaaacgtcgtcgaacgaatttttcgaccataacttttttctttctcaaccaaattaaccattcttggtattattcgaaagcattcgaaaaatgctattagcctgcaaattttcaaaaattttatttatgcacaaaaaaaatcagagcaaaaaaagttcgaattactgggtttttgagttccttctggccataacttttttgaaacttaacgaaaatttttgagattttgcaaattaataataaacacatagagctatcgaacaacaccaacaattcttaatttgattgacagtgaacaaagttatggttcaaaaagtcttccgacgacgtttgcgaacggggacggacgagcgattgactcaaaattgaaatggaattagaatatttaatatcatttgttgggtaaaaattgaattccctttggtccaaaaaccctgatttcttctacaatacatccgttgcctcaattaggagcaaaaccgtcgtcagcaaacgcagccgcaggcaaacggccttggctttggggcacagaatcgggaccacaattggcctccgcttccgagcattgtgccgctgaagccgtgcttttaccaggacatcgatgtggagattccccaacagtttcaggtgtcgtcattgtttcagtgtgtttttgtctccttttatcttttctcccctttctttcccatttcaggaaaccgtccgttgggcttaccatgtctatctgctgtacgtgttggccttggccttcaacttggtcgcctctttgctgttcgttctgttcgccggtggtcccatcggtctcccctttttggctgtcattcaattggctctgttcactccgtgcgcttttctcctttggtttcgccccgtttacaaagcatttcggtgggcaatgccttaacttttcttttcattctctgttctttgtcagtgatgattcgtccttcaatttcctggtcttcttcttggtcctcttcctccacaccattttttgtttcatccaagcacttggactgtcggaatatgcctggtaataagcaatcactaactgctcaagaacattccaatactttttaaatcagcggttggagtgacacgctttccattattcggtcagccatttcaatttaattttttatttttcccattttatcctcccttttgattcctttccatttcagtactcacttcttcgttggtttggttatgctctgttccgctgcgtgcttccnccttgccttcgtcggcatgtgtttgtctctgatcaaagtcatttttcgtcagatttgccctccaaat

SEQ ID NO: 78178 - DNA, 103 bp, Heterodera glycines
  Genomic contig location: Contig_ID=SeqID_14172; Location=498..600; Strand=+
  SCN-specific regions: Sequence locations=1-103
aaaagccacatcaaatgtcgaattggatgccatcattaagacaattgggagagggaaaattccaacgaaagtcgaaaattggattttatcaccagaattataa

SEQ ID NO: 78179 - DNA, 440 bp, Heterodera glycines
  Genomic contig location: Contig_ID=SeqID_14173; Location=434..873; Strand=+
  SCN-specific regions: Sequence locations=1-440
atggtcctttgtccgctcagtttaaaccgacaactcgggtgcacttgcaccgtcctttccgaaagtcattcggtccaaattctgtgcaacggtacccaacccgacaaagtatgggcagttttgggcggtttcgcccccaacattgacaaattggcaatccgtcgctgcacaacgaacaaaaagagcagcatattgaagaatatgctcccgttgaaggttaattggtggctggtcacaagaaaccatgacgaacgattgactgagtttaggttcgaagccttgagatttccaactgcgcaattgcacaaatccaaccgaacgcctttgactcgttggccgattcgttggaagagctgtccctcgaaagcaatgcgctcacttcgcttccgaatctccacaaattaaagcgtgtaaaatccctcaacttcaacaacaattcg

SEQ ID NO: 78180 - DNA, 1781 bp, Heterodera glycines
  misc_feature (141)..(141): n is a, c, g, or t
  Genomic contig location: Contig_ID=SeqID_14174; Location=1..1781; Strand=-
  SCN-specific regions: Sequence locations=1-731,770-1021,1083 -1169,1194-1416,1440-1781
taatataagtaaaaaacaacaaatttcgtttaagttttgtcaaatattgctcaattaaaatgagatgatttaggaatgtaattggcactcaacgacttgttgagctgtgccaacaaatgccacagctgaaggtcaataatntatgggaattttcaatcaaagtgaactcctttttttgtgttaggcctttgtccacgcttccagcgcttatgcaaattgcaatttggccaaaacggaagagcgcatttacgagcaaaaagtggaagtgagcaaattggtgggaacgatggaatggatgagcgacgaaatggtggaggcaattgaggacaaattgttggaggcaacggattaataatctatattatttaaatttgatgtttcaagtttaattttcaaaattttcatggaattttgttttatttttgaaggaccgaccgaacacttacacttttgcgaaggcaatggccgagaatcagttgagcaaaagcgcgaaggatctgccagtaatcattgcgcgtccatcaatgtgagaacgattcgcaattttgttttaatagagggctgcgcaaatggcctgagtttgacggaaaggccaggaaaatattttaatgaatttcgtttttctaaaattataattgatcattttattaattacagcgttttcaggacaagctttttttcaataaacttttggggaacaggaggagtccaatggggtcgatggcgccgctgggggaaaattggaaatttttgccatatttttaataattttacacccagattctagggaaatcacacccattttttgcggtgcgctttttacttttcttactcacaatcagctgattgatcttaatacacaattatctttcagcattggtgcaatttggcaagaaccattgccgggatggattgacaatttgaatggggccacgggcatatttgccagtgttgggaagggtcagtcagcatttgtctgttgtttttgcaatcaaaatttgatattgtattaaaaatttacgggggagtaaaagagagaaaaagagagtgagacggtgagagagagtggggaaaatgagagaaccaatacgggaacagacagttaaagactggacgagagatcggttttctccgcgttaatgggaaagtattttaaataattacgtgactatttatttatttatatttttaatcactttaggactgctgacagatatgtgtggtgatatgaaatccgttgcggatattattcccgtcgacatcgttgccaatatgctcatcgtggcagccgcgtgtcgctcacagatggggtcgcacaataataaattcaaaaatacacaaaattacaatgaaataatcaactcgaaaataaaagcagcgcctcgggtattgtgcccccactaaaaatcgaacatttccgccccgacatttgagcccggatattaatgtcccattccttaagggcaattttcggacatttgctccccttaagaatatttgcgcctcaatcattttaaatttatgttttgtgtcctgatcatacctaaatttaattttactattttaatcggcccaaatattttattatttccaatagttcaaattttatagaaattaaaatcattggcttggtcaaggccatacgagctgtacatttatagctaccaatcttttatccaataatcggctattcgaaattgaatggcattgaaatggcgcccgctgttcgtctcatcatttcgtttttattcatctcataaagcgtaatcaattccttcatc

SEQ ID NO: 78181 - DNA, 1563 bp, Heterodera glycines
  Genomic contig location: Contig_ID=SeqID_14175; Location=1..1563; Strand=-
  SCN-specific regions: Sequence locations=1-208,231-387,430-588,610 -1141,1186-1303,1342-1563
atgaatcccctaattactttaattattcatcccttcagtttgctgatcacaggtgccactggctttttgggtaaagtgctgcttgaaaatttgttattcacgcagccaaaaattgataaaatttttctgctcatccgtccgttaaacaatcaaacaattaaagagcggctcgataatttgcttgaggcattttaataatttaaaggtgttttttaaaataaaaaaattaagagcccattattcaaccgaattcggtgtgtcgatgaaacacgcttaaataaattggtcccaatcagtggtgacctgaaaatggaagggattggcattaatgagcaggaccgtactgcgctgatcaaccaagttacggtaatacgctaacccattaagttttttaattatttaatttttataaacttaaaagttaaattagcactaatttttttctcattaatttaagtttgtgttccattgcgccgctaccgtcaaatttgacgaggcccttaaagttgccattcaaatgtaaaagcaaattaagatgggggggggacatgacattgataatataaagtaaaaaacaacaaatttcgtttaagttttgtcaattattgctcaattaaaatgagatgatttaggaatgtaattggcactcaacgacttgttgagctgtgccaacaaatgccacagctgaaggtcaataatttatgggaattttcaatcaaagtgaactcctttttttgtgttaggcctttgtccacgcttccagcgcttatgcaaattgcaatttggccaaaacggaagagcgcatttacgagcaaaaagtggaagtgagcaaattggtgggaacgatggaatggatgagcgacgaaatggtggtggcaattgaggacaaattgttggaggcaacggattaataatctatattatttaaatttgatgtttcaagtttaattttcaaaattttcatggaattttgttttatttttgaaggaccgaccgaacacttacacttttgcgaaggcaatggccgagaatcagttgagcaaaagcgcgaaggatctgccagtaatcattgcgcgtccatcaatgtgagaacgattcgcaattttgttttaatagagggctgcgcaaatggcctgagtttgacagaaaggcccggaaaacaatttccaaaaatattttaatgaatttcgtttttctaaaattataattgatcattttattaattacagcgttttcaagacaagctttttttcaataaacttttggggaacaggaggagtccaatggggtcgatggcgccgctgggggaaaattggaaatttttgccatatttttaataattttacacccagattctagggaaatcacacccattttttgcggtgcgctttttacttttcttactcacaatcagctgattgatcttaatacacaattatttttcagcattggtgcaatttggcaagaaccattgccgggatggattgacaatttgaatgcgggccacgggcatatttgccagggttgggaaggggtcagtcagcatttgtctgttgtttttgc

SEQ ID NO: 78182 - DNA, 497 bp, Heterodera glycines
  Genomic contig location: Contig_ID=SeqID_2160; Location=333..829; Strand=+
  SCN-specific regions: Sequence locations=1-79,103-142,176-293,351-497
atgtcgtcaaaacccgaaactttggtggagcggatgaagcatttgttgagctcgggcgatgacgcggacgttctctttttggtgggggaaggagagggaaaggaggcgagttttaaggggaaattgttacaaatttaaatgcttaattaatttaaattaattttaatttaatattgttttctttaagcatgtgcccgcgcacagagcgattctgaattcggcttcggacgtttttgaagcgatgttccgttttgacaccacaaaaaatgcgactgactatgaatcagcggctggagaaggtgtgaaaaaacaacaaaaaattttgtatttaaaaaaaaaaaatttaatttgaagcgaagggtcccgtagaagtcactgacatcgatgcgcatgtgttcaaagtgatgctcaacttcatttatgcggatgatttaagtgaattgaatggagacaacgcaatggcagtgctttacacgggccagaaaattagtttttaa

SEQ ID NO: 78183 - DNA, 603 bp, Heterodera glycines
  Genomic contig location: Contig_ID=SeqID_2161; Location=7..609; Strand=-
  SCN-specific regions: Sequence locations=1-246,268-603
atggtcagagaaatccgaaagagagatgagcggaaaacgaattttggacagtgccaggccgaggacaacacgacgattctctgccgaacattcggtgccattttgaaggcattgcgcgtcagcccaacggagtgcctgaaaatgaatttcattcaaaaatttgtacattattagtacagcattccaaataatgagttcgccgctgatgattttcaactggtcacgttcgataatttcatacagcaaattttgttccatttccaaaaaggcatccgattggatcagcgattccgcattttggtcaatgtaatccaagcagcgacaagagaaatcctcaaaaaaaagaaaaaaaataagagatcgatttgatctgattttttgtaccaaacttcaaagaaaaaattaaaatttgtatatgacaaaaattattgattgattttaatttaatgataaaatggaaacaaaatttcatgctttttcgctgagaaggcgagattggtcataagcgagaaacacattgccgagctcggaaatgggaacatttcaacacgctttggccaatgcattaggattatactttttggctaaacataaaaaaataaa

SEQ ID NO: 78184 - DNA, 337 bp, Heterodera glycines
  Genomic contig location: Contig_ID=SeqID_2161; Location=277..613; Strand=+
  SCN-specific regions: Sequence locations=1-66,88-337
  Gene Ontology: Mol. function=protein binding
gatttctcttgtcgctgcttggattacattgaccaaaatgcggaatcgctgatccaatcggatgcctttttggaaatggaacaaaatttgctgtatgaaattatcgaacgtgaccagttgaaaatcatcagcggcgaactcattatttggaatgctgtactaataatgtacaaatttttgaatgaaattcattttcaggcactccgttgggctgacgcgcaatgccttcaaaatggcaccgaatgttcggcagagaatcgtcgtgttgtcctcggcctggcactgtccaaaattcgttttccgctcatctctctttcggatttctctgaccatgttg

SEQ ID NO: 78185 - DNA, 48 bp, Heterodera glycines; identical to SEQ ID NO: 62879
  Genomic contig location: Contig_ID=SeqID_2161; Location=1161..1208; Strand=+
  SCN-specific regions: Sequence locations=1-48

SEQ ID NO: 78186 - DNA, 1095 bp, Heterodera glycines
  Genomic contig location: Contig_ID=SeqID_2162; Location=816..1910; Strand=+
  SCN-specific regions: Sequence locations=1-191,222-448,471-567,601 -706,729-833,868-1095
atgtacaaatttttgaatgaaattcattttcaggcactccgttgggctgacgcgcaatgccttcaaaatggcaccgaatgttcggcagagaatcgtcgtgttgtcctcggcctggcactgtccaaaattcgttttccgctcatctctctttcggatttctctgaccatgttggtaggtcgtccgtcaatacaatattttaaataatatttattttaaaattcctatttttgttagtgccttccggcgtgttgaccagtgacgagttggtcggcatttttctgacccatgcccacgcggaccgtcgtgccaactgcgagttgtaccccaaccaatttcccacccaccatcgcactctgatcgggaaccggcttttttttctacgaaaaattgattagtcgataaagctattttgcaaattgttctgatttttaaccaaaaaattcattaaatttatatcttttctttcttttgtcgctttaagttttgacttttgaaattaacaacaatgaaagatcaaacaaactttttttggcattttttgcgatttaaatttttgacaattttattgcacatcaacattatttaatgtgcaagaaaaatttacgcatttttcccctgaacatttcggcgacgggatcgaaagtttaaaattaacttttttttttcagtatatcatacgtatactgtacccaaagcaaagtagtttttgaaaatttttcaggcaaatgaccttatcaaaaaagtttttgccaagaccatacgtttcggcatcggtaagggcaaatctattggatttattggtcataaatctgcggattatttttcttcaacggaaatatgtattgaaaaaatgaaattttatctttctatatttaaaaagcaaaaaaaaaaaaatgttggataatctgttaccttcagaggcagtaagggaacgaacctgagagtaaaaagtgttgaggaattaatttttaaaaatgagagcatacatgtacaaggggtgcgccagtcagacccccataccgtcggacgtttggcgcagggggggtgcgcccgacgcaccccccttgtccatgtatgaatgagagaatgccaaa

SEQ ID NO: 78187 - DNA, 1086 bp, Heterodera glycines
  Genomic contig location: Contig_ID=SeqID_2162; Location=2215..3300; Strand=-
  SCN-specific regions: Sequence locations=1-385,423-629,651-1086
  Gene Ontology: Mol. function=ubiquitin-specific protease activity; Cellular component=nucleus; Biological process=pathogenesis
atgtacaaatataatttttttttcgcagttccttctggcgttttaacatcagaggaatctgtcggcatttgtcagtttcatttgcctgggcttttatctccggtggcatttccaagccatgcacggatttccgcgtggaataatacccccaggggaaatgcgggaacactcgcaatggaaattacgaaattttctcaatttgcgcgaagggacgagggaaagtgccgacttagcaaaggcaaagtgcacataaaggcacttccgtggaaaatatgtgccaaaataaatacgacgaaaaacgaaaatggcaccaccgaaaagtgtttgggctttttccttcagtgcaccgcgccaagagaaggtgggataatgataattaatggtgttttaattctaattaattattttttattttattataagacccgaaatggagttgcaaatgttcagcgacatttcgaatcatttctcaaaagcgcggcacggagcatttaattggaaaacgcaatgatcacatttttaacaacaaaatgaacactttgggtttctcaaatttcatcactttttctgtaagaaacaattaagagatgtctttttttataattgaccataattaaggaattgatggaaaaggacaaaggattttatgacaaagacggggacaaagtgacattggccatcgatgttattgtgaaggaagaaaaagcggataaattggattattcaaatccaaacaaaacaaacgggaaaattgtgatggaaattggcaaattgactgagttttcgcgagagatttgtttgagtgaacggagcagcgaaatcaaacaaataaagggactttcgtggaagatattggcactgataatcaatcagaataataaaagcagcgaaaagtgtttggcattttaccttttgtgtgccggctcaaaaagtgggcacaaaatatggatttatcccattatttaaattggcaattaaggtgaaaattggagttgcaaatgttcggccacaattcaaattgtctcacaaaagggcggggcggtgaatttaattgggcaattcaatggccgaattttcaacaataaa

SEQ ID NO: 78188 - DNA, 719 bp, Heterodera glycines
  Genomic contig location: Contig_ID=SeqID_2162; Location=4172..4890; Strand=+
  SCN-specific regions: Sequence locations=1-338,360-404,426-517,540-719
atggacccgaacagaggattatatgaccaaaatgaggacaaagtgacattggccatcgatgtcattgtggaagaacaaataacggagcgattcatcatttccgaaccaaacaaatccaacgggacaattgaaatggaaattgacaaattgtcggaatttgcgcgagaagtttcacagagtgaacggagcagcgaaaccatacaaataatgggattgtcatggaaaatagtgacagaaattaatacgaaaaatgacagaaatggaaaatgtttgtgctttttcctgtgtggcacttaaatacataattgaggttttttttgctcaaatcgactaaattgattcccccaccgccggcgggactcaacttgagacttgagcatacatttttgcggggggggggtcacaaattttagaaaatttctcaactagcacaaggttgtctatggcgcccagttggcgtaggttcggcagcgcccagtttgccccgatctcgcaattgtctccccctccgtcctaatttttatctcattaagatgaaaattggagccgcaaatgtatggcaacatttcgaattgtttctcaaatgatcgaccttggggacttctcaagaaaatttgatgaaaagagaatttttagtgctgggaataagaaccgaggatttactaatttcatcacttttgcggtgagtgataattaaaatttaaaagttcattttctca

SEQ ID NO: 78189 - DNA, 143 bp, Heterodera glycines
  Genomic contig location: Contig_ID=SeqID_14176; Location=1143..1285; Strand=+
  SCN-specific regions: Sequence locations=1-143
cataatgcactgttgcaactgaagcgtggctatggctcatatgaatacgaccgaatcacggcactccattccaatatcaatatgatgccatccgcgcacagtgggccaacatttccattatggcacagagaatacaataaacg

SEQ ID NO: 78190 - DNA, 72 bp, Heterodera glycines; identical to SEQ ID NO: 59613
  Genomic contig location: Contig_ID=SeqID_14179; Location=634..705; Strand=+
  SCN-specific regions: Sequence locations=1-72

SEQ ID NO: 78191 - DNA, 1427 bp, Heterodera glycines
  Genomic contig location: Contig_ID=SeqID_14180; Location=1817..3243; Strand=+
  SCN-specific regions: Sequence locations=1-189,212-373,410-604,626 -697,719-1378,1410-1427
  Gene Ontology: Biological process=nucleobase, nucleoside, nucleotide and nucleic acid metabolism
atgaaagtggttgcgctggtgtcgggcggcaaggacagctgcttcaacatgatgcgatgtgcggaggaagggcacgaggtggtctgtgtggccaatttgcatccaccgaacgaggtagaaaagcaaaatttcaaaattccatattttacaaaatgcaaaatttccggtaatggtcccgttttgtcgcccattttaaatttaaatttattttcaaaagtcgtgtaaatatttttcaaggcttttcggggccgcttatcacaaatccggcacccgtttgactaactcagaacctcggattttttgtcagattctgaccctgggtttggaactggtcgaaatggatggatgctcttatgcagtttatttagccccacaaaattttttcacttttcaagcaaaaaacacagcaatatataggtttacggggtcacttgccacgaatctggaaccatttcgactaatttcgaaccccgaacccgaattcggataaaaagtcgaaaattcacttaccaaaattcatatttgcccaaaatctatttaaatttacgaaatggatgctggattcggatcatccatcaaccacaaaaatctctaaaaaaatattttcacaaccaaaattagcaaattttcagattgccgagttggacagttacatgtaccaaagtgtgggcagtgagggaatcaaggttagtgagactaaatatgtatgctttaaaataaagaaattgaatgcaatttaaatttttttaatgcatttgcaatccaaaaattaaaaaaaaggtgccataattttttttaattttcggcttcaaatttttaattttccttaaatttcattttttgcatttccgagggctcctttgtttggaaaaaaactcctaggcctgttttcctgcaattttcagttttacgcggatgcccttggcctgccgctgttccaacgcaaaatttcggggcgtccaaaatgtgtagagagcaacacttatgtgcaggacgaggaggacgaagtggaggatttgtaccaccttttgaagacggtcaaagaatgggacccggaaattcggggtgattttttaatttaactgtgcattttttacatcttttggcaaacaaaaaaatttttgctcaattttcttaaataaaatttcagaattaaatttacaaaaaaagaactaaaggaaaatggcattttttgacgaacgatagcaaaatgaaaatttaaaaaaacctacaatttcatcaaatatttattggaaatgaattattttttggattttaaatttaattttttgtttttaggcgtttccgcgggcgcgataaacagcacttatcaaaaattgcgtgttgaacatgtgtgcgaacggcttggactcgtcccgctgtgcttcctgtgggaattggaccaactccaactgttggacgccatg

SEQ ID NO: 78192 - DNA, 225 bp, Heterodera glycines
  Genomic contig location: Contig_ID=SeqID_14180; Location=1405..1629; Strand=+
  SCN-specific regions: Sequence locations=1-101,125-225
ggcacccccacaaagtgtccaagccacgaaatgtccaaaagagtaaaaacccacgaaatgtccaaaatttttcaaaatttataaaaacaaaatgagtctaatttaggatttttagggttttcggggtcgctgaatacgaatataccctttatattacgccttgcctaaccttaggcccatccgaataataaaaaaactcaatttcgagacttggacattttgtgg

SEQ ID NO: 78193 - DNA, 794 bp, Heterodera glycines
  Genomic contig location: Contig_ID=SeqID_14180; Location=3063..3856; Strand=-
  SCN-specific regions: Sequence locations=1-106,143-239,261-564,586 -631,663-794
atggcccaagtgttttggggtcagcccaagtgcggcaactttgatcagcacggccttcacaccagcggaaatctgcgaggacggcacaaaattttttagcaatttgaaatttaagaaaaaaaattttttttttttaatttttgagtaaactattactagtaaaacatgtaagaattcaaatttttcaggtgggagagggcaaactgttccccctcttcaattgccattgaattcttctcaaacaataagaaaaagagaagctacgaagaatggacgaacatttgcggattttggtattcaaacagggaaagtaaaaagggctactaatttttgttttttttttttgaaaacatggattttttcttaatctcacagaaaactgtaagaaaaaacaattagaaaaaggaaaacacgaaaaattttaaactaaaaaattttctgtggcattttttcacatcgcatcaaaaagagcagcatttttcaatgctttttggatcaacattctcgagtttgcaaaatgtttttgtgtaatttttcataaatcccaaagaacagtaaaaccggaaaaactcaaaattttcttttgtcattttgtgcagcaccattcactgaccatggcgtccaacagttggagttggtccaattcccacaggaagcacagcgggacgagtccaagccgttcgcacacatgttcaacacgcaatttttgataagtgctgtttatcgcgcccgcggaaacgcctaaaaacaaaaaattaaatttaaaatccaaaaaataattcatttccaataaa

SEQ ID NO: 78194 - DNA, 327 bp, Heterodera glycines
  Genomic contig location: Contig_ID=SeqID_14181; Location=694..1020; Strand=+
  SCN-specific regions: Sequence locations=1-327
atgcgaaacaccaaaaaatgcgaaaggcaaaatgcgaaacgtcggcccatccctgatccgtactattaccaaattgagcaaaatttttggaaaattggtgagattggtctttgagggggtaccaacaaggaaaatcgaaaattttcagcaaactttttttccttaaaaatttcaggtgtggtgggacctttggaggggaagggagtaaggacctcgcccccttttgggactgtccctgacctgtacatgggtccaggtacaggtcgatctctaaaagaagcaaaaccgaaacacacatatgtgaaccttttattgaatcaaacataa

SEQ ID NO: 78195 - DNA, 104 bp, Heterodera glycines
  Genomic contig location: Contig_ID=SeqID_14181; Location=1026..1129; Strand=-
  SCN-specific regions: Sequence locations=1-104
gtggaaacacttataccaattgtgaataacagctgcacagtgagcatttcaaacggagaagaggcaatgagcaaagattgctattaatatcgttttgcaataaa

SEQ ID NO: 78196 - DNA, 525 bp, Heterodera glycines
  Genomic contig location: Contig_ID=SeqID_14182; Location=769..1293; Strand=-
  SCN-specific regions: Sequence locations=1-525
ttcaattgacccctccgacgatggcttttccttcaaagaccgccatggcttctctctaatgttggctaaattggctgagctgctcgctgaggacactggagaaagttgcaatttgagtcggaaaacaatttttgagttgttgggcagcagttcggaatggaatttgggcttaattggtccattgcttcccaaatattcgtttttttatgacaaagcggtaatgttgcacttcttccttttctggcattttcatttcttcaaaaagggcttctcggagcttctccgttcgctctttccatcgctcattcgacgtgatcatcagccgtgtgccgactcggccatttcctcctttgtcgaagcattgttcggcactgactcattctcggagaccatttcccgggcgtttgaccagttcattccacaccttttggttataaatggtccaatcattgcatctgttaatttactttcccgttaaggattcccgtctttcggcacgaaatttcttctgtaccttctgcaaaa

SEQ ID NO: 78197 - DNA, 699 bp, Heterodera glycines
  Genomic contig location: Contig_ID=SeqID_14183; Location=453..1151; Strand=-
  SCN-specific regions: Sequence locations=1-18,42-127,171-344,369 -506,535-699
atgacaaattctacccattttgtggttaaaatttcaaaaattaaggtaaaatgaaggtccggcggtgccgataatcgccgccggaaaattttttggaaattgtaataaaatatggtaggaaaagttgttaaattttcaaaaaatttactatttatttcaaaaaaataaatcgcaaaaaaggcaaaaaaatgctccaaaaagttcaagataaaagcttcaaaccaagttaaaaaacctggaccgggacttaccgggaccagaaaagtcgggaccgggacctcgattttcgtccgggactgggaccaaccgggaattttcccaagtgaaattttttgaaaaaaaaatttgaaaatttgagtgcactttgttacgaaaaattgcctatattcaaaaatgtacccataaaattttttaattctcgtttgtggggagaaattagaagaatttttccattatgcaattttgagtgtaatatgttaacagaaaataataaactgaagcattcgttttaaaaattaaattttcaaatatattcattcttagggggtggaaatttcgcatttcgcgccaaagagcgaaatgcgaaaagcgaaatgcgaaacgccaaaaaatgcgaaaggcgaaatgcgaaaagtgaaacgtcggcccatccctgatccatatccaactcatctaacaagggaacattccgagctgtga

SEQ ID NO: 78198 - DNA, 269 bp, Heterodera glycines
  Genomic contig location: Contig_ID=SeqID_14184; Location=266..534; Strand=-
  SCN-specific regions: Sequence locations=1-14,36-269
atggcatcggttcaaaaagacagaagagagcatcattcttcagtgggttttattgatatatttatgaggtcaaacgaaaataaatgaacggcaaaaatatgacccaaaaaattaaaatttgaatacatcaatttatttcagctaaattgtaattgtgacctaaaaatagatatacaggaagaagaaagcaaaattcaaaaaatcctaattaagaaatctcgtttttgactcaattctgtgctaaagcattagttaaacggagcaataaa

SEQ ID NO: 78199 - DNA, 1297 bp, Heterodera glycines
  Genomic contig location: Contig_ID=SeqID_14184; Location=590..1886; Strand=+
  SCN-specific regions: Sequence locations=1-110,133-359,381-830,852 -860,923-1176,1215-1251,1288-1297
atgtcaatttctaccagttcaacaaatgctgatttcacaccatcaataggtgaaggagttaatgaaatgggaaaaggttgaaaataaatggatttttttggggaagggagtaaataaatattataattaaatcagggaattaaatttataaattttcagaagttaatgacgattcaattagtttggatgaagattggcaatttgatagaaaaaatgaaactgttgctgatcggcaacaattgctgatggtgggcaatgaaagaagcttcaatgaggcatttacatatatttttcgacaaaattatttatttttaaaggaatttcatgaaagttatgctaagaataagatgaaaatggaattcaaaattaccaaacttgtacttgagaaggtaagttttacaaagaaaagtttaaaaatccccatttaacgagcagaagaaaaaccattgattttaagcgggacaaaatacttcgcaaagtcaaacgcacactgtcgaattcaaatccttctgagttaaggcagtttccaacaatatgcgaaaattcgttccgcagatcaccattgtcttaaaaaaacttttgaggtaagggaagttcggctgtgctgatattgcacaaaaaagtcccagcgcctcgtgctatcgacacccccccccccctccacccccgtgatcggcgacttgaatgatgactctctcctgtatttacggaatttagatccatggcatatggatattttgtcgttgggccgccataacatttgccaaacaattttacaaaaatacaggtggagaaaaacagaagggcgggaaacgaaggcattggttgtgtgaaaatatactaataaattaaagaggctgaaataatttaaaatttaactcaattaaaaaaaaattaaatttaaggaaaaaatttatattttgaaagtacatcaattggggaagtgagaaggaatgtgatgaatcagtggccaaatcagcgagggacacataattatttatttttgtgcgaaatatatttatgttaatgagcttatttgtggtagaagcattttgtaattgaacaaatatttaaataattaggacggattgagtacaaacagttatcagaacagggatttgccggggccagaagcctggggaccgggaactgggaggaccaactgggaaaaacaacttaattaaattaataatttttttaagttaaaaattaaacttttctagccgacatttgcggaccgacatttgtgactaaattatcaaaaaaaagaaaaaaaaaatttaaaatgaattttcaa

SEQ ID NO: 78200 - DNA, 630 bp, Heterodera glycines
  Genomic contig location: Contig_ID=SeqID_14184; Location=3091..3720; Strand=-
  SCN-specific regions: Sequence locations=1-137,160-330,353-385,415 -525,548-630
atgtttaaattgctaattttgtcattttttattctttttgccttctttggcttcgctgatggttagtcaaatttagggtcattactagggatgcgacttttagtgacgaaaaatcccaaaataattaactaaaatagtgagtaaaaatgccaaaatattgaagaaatagtgacgaagtagccaaaatagtgatttctagtgaccgatagtgacatcagaatcgaaaatttttaacgcagaaatgcgttttttgagctcctttcttcaaatcaagtgagaaaaaaatttagttaaaacctaaaaatcgcatccctcctagtcattacatataattaattgggtttttagttgtcggaacaccgatacaagaacaaggtgattaagctaaataaaaaaaatttaaaataataatatctaggtaataattctttttgtaccgacaattttgaatcaaattgtttagaatttgcaaaaatggtggcaaagcgtgccgatgggtttgatgagtgcttgttggcagcagggtaattcaaattataagcattttgatcattttatttcagtgctacaaattgtgctggtcgtttagcttgttgtgaaaagtatggacaacaaagttgcatttgttga

SEQ ID NO: 78201 - DNA, 513 bp, Heterodera glycines
  Genomic contig location: Contig_ID=SeqID_14185; Location=741..1253; Strand=-
  SCN-specific regions: Sequence locations=1-2,27-74,118-178,206 -361,424-468,496-513
atgacattattttttatttattcgttgaaaaaaacgtgaggctcaaaattgacttggtgtgttaagttggtagctaaatatttttacaaaatttataataagttatttaatttatttctgtcgttttgtggactttcttaataatgttgcttcctaaatcttttcattaattaataaacaaatgaaatgatttaacttttttaaacattattttgggttttattatttatttccaaaaaaaaattaatgactgttcattttaaatttatccgtttgtgtgaatggcaagacaaagatgcgggcactggacactgagcattggtacaaagaaatgccatgaaattggtggtataactaattgaaaaaattaaatttgatattattactaaaaaaatttaattaaaaatatgaaaaatttttatagatcaaaagtgtcgattaatagcgtatattaatccaaaaaacttactttaaaaagtaaattaaaattttgaacacaaatttttcaataaa

SEQ ID NO: 78202 - DNA, 162 bp, Heterodera glycines
  Genomic contig location: Contig_ID=SeqID_14188; Location=1915..2076; Strand=-
  SCN-specific regions: Sequence locations=1-162
gtgttgggccaggaggtcagctacggttcggatgagctggcggatgtgctctcccttcagtcctatgacggtcattattcgtattacgatgccaacaatgattgggaaaatgattacgatgaagacattgattatgatttgtacgactccgattattattag

SEQ ID NO: 78203 - DNA, 259 bp, Heterodera glycines
  Genomic contig location: Contig_ID=SeqID_14189; Location=1..259; Strand=-
  SCN-specific regions: Sequence locations=1-259
ccattttagtgcgagcacagccgatcgggtggagaaattcgcaattgggttcagttgtctgttcggtcatttcgactatggccttggcacttccgatgcaaaagcgatgaattggcacaatttgctccattctttgctcatttcgtgcccccaaattaaaaccattgacgtcaaaattttcttcgaatttcgtccgggcgaacacgagggattgtgcaccattttgctgaaatggtcaccccaatttgtggagacctgc

SEQ ID NO: 78204 - DNA, 451 bp, Heterodera glycines
  Genomic contig location: Contig_ID=SeqID_14190; Location=1..451; Strand=-
  SCN-specific regions: Sequence locations=1-72,113-125,153-246,268-451
  Gene Ontology: Mol. function=motor activity; Cellular component=Z disc; Biological process=leading edge cell differentiation
tatttttcgaaaagctcaatcgcttggcaattactattttgagaatatttctacgatttccaaaatgattgtttttccacttcagttacaccaatgagaagctgcaacagttgttcaacaacacaatgtttgtgctggaacaggaggagtaccaaaaggagggcattgagtggcaattcatcgactttggacacgacttgcagccgaccattgaactcattgaaaaggtgtggtgcggatgacggactgaattttcagagtgtattctgtttaatcggatatgcggctgataattagccgaaaccgaaaatcccttttagtcgaaaaatgaagctccccaaaaaaatattaaaatttagcccaccggcattttggcattgctggacgagcagtgcattttcccgaaagaagcggacaaatcgttggtggaaaagctgatcttgcaccatga

SEQ ID NO: 78205 - DNA, 2441 bp, Heterodera glycines
  Genomic contig location: Contig_ID=SeqID_14191; Location=1116..3556; Strand=-
  SCN-specific regions: Sequence locations=1-370,392-434,456-587,611 -688,718-1118,1142-1166,1190-1281,1308-1498,1527-1830,1873-2035,2086 -2441
  Gene Ontology: Mol. function=ATP binding; Cellular component=muscle myosin; Biological process=cytokinesis
atggtcaaacgcacatcaatcaccgaccccgcattacatgttagtcacatttccactcatctgtcattttaatcggaaattgacaccggaaaaacagatctccaaaaaaaatatttgaattttaacataacgctgtttttaggctgaatgggccagcaaacggctgatttgggtgcctcacgaaacagagggcttcgtcaaggtataattattttttatgacaccaaaattaaaatttttttcaccaaaaggccagcattttgcgtgacgacagcgagacgtacacggtggagttgtgtgagaacggccaacagaccaagctgagcaaggacgactgcgagaagatgaatccgccaaaatttgacaaggtactccttttttggacacccatttttagaaaattcatttttgggattaattttaaatgccttttcaggtggaggacatggccgacttgacatggctgaacgagccttccgtgttggacaatttgaagcagcgctattactctgatctcatttatgtgcgttaattagtttcaaatcggtgattgatgccaaagtgcaatttcattgcagaaaaatgccataaaaaatttgtttgttttttagacatattcgggtctgttctgtgtggtggtcaacccgtacaagaaactgcccatttactccgaaacactgatcgaggcgtacaagggcaagaagcggcacgagcgtccgccccacgtgttcgccattgccgactgtgcataccgttcgatgctgcagggtaatcatttttgagacaaattgttgtaatacaaacaatacaatctcaacaatgttagttaccttaaccaatgagaggcgggggaaaggcaacgacggccctaaacttaagaatttcggggtacccaatggaaaaatctaaagccttttcctcatttttttaagaaatttttacttttttttgagtgtttgcgtacttctggggatttggtttatgcgtaaatttcttacattagctaatttattaaaattttcttcctttaacaccgccaattttcaatgtttttgctagtctcaaaattcaaaaacaaatattgcaaatttctcaatgtgttcatgttgttagaccacgaggaccagtccattctgtgcaccggcgagtcgggcgcgggcaaaacggagaacaccaaaaaggtcattcaatacctcgcgcacgtggcgggcgccactcggcacgcaggcaacgccaaaatcaactcgtcctccacacattcggtgtcttcaccggccagggttattcttaattttatttttatttttttattccgctaaagcgaccattaaagtgccatgcctgaatttgtcatacctttttaattcatattttggtcgtaatttaatgggtttaatcattgagctttgatcaatgtcaacggccattaatttatgtcaatttcagagtcattcctcggctgaccacatcaacatggtgggcgagctggagcagcaattgctgcaggccaaccccatcctggaggcatttgggaacagcaaaacagtgaagaatgacaactcgtcacgatttgtacgaattcaccgcattcattttttcattgtctatttattattttaccattcacattttcagggcaaattcattcggatcaatttcgacatgtccggctacatttccggtgcaaacattgaattctatttgctggagaagtcgcgcacttgtcgccaggcgacggatgaacgctcttttcacattttttaccaatttttgcgcggcacatcgcccgaggagaaaagtgtgattttgttgggatttttacaaacatgcaaatttaaacattttagtattaaatttaaaaaattttaatttggctaatttgaaataaaattaaattcagccaattttttgctggaggacgtcagccggtacgcctttttgaacaacaattacatttcgttgccgaatgtggacgattcggccgaatttcacaacactgttcgctcaatgaagattatgggcttccatgacgaggaaattaattgtaaaatttttaattccaaaaaacattaaaaattaaattttcctttttttcagccgttcttcgcatggtcagcgcggtgttgttgttcggcaacattgagttcaagcaggagaagaacacggaccaggccacgcttcctgacgacactggtgagtgccatcattattaccagtgtcctggtccaattttttcaaacccaaattttgcagtctcgcagaagatttgccatttgctcgggctgccggtggccgagttcagcaaggcgttcctgaggcccaagctcaaggtgtgtgaatcggcatgggctgacttggctcacttcatggacatgcgtatgaattgggatgtgggaaacattgtcccgggatttttggaagtttggtgtatggaactttga

SEQ ID NO: 78206 - DNA, 598 bp, Heterodera glycines
  Genomic contig location: Contig_ID=SeqID_14194; Location=89..686; Strand=+
  SCN-specific regions: Sequence locations=1-105,129-147,182-598
atggaagacagcgtaaatccgagtgccaatttgaacagtgtcacttttgatctgtgagtttcgataaatccattgggtgagcagcagcaatagcatttgattttgccgaaaaataaaatatttaattcattttaggccattgtcgccaccagcggaagaagaaaaagaagaagataaagcggatcaaagcaacggaaatgtcgtctgattaagtgtgcggaaatgaataattaattatatttgagaaatgatcgatctcaatttgttgtgcttattttctctcagaaatgcttttgttaattgtttcgttccaattatataaaaatatgcttttttgttgagcaatttattaataattagggtttgtaatagagaccggataagagggtcggtcgaacggtttcggttaaaaaaccgaaaaaaccgaagaaaaattttcggtataccgtttcggtttcggtttttttgaatttttttatcaactaatatatttttctagaatcttgcaggctattagagaacacttagacctattttgcggcgccaaaatgtcccgcgccaaagtgaccccgacccaaaaaattttggtagaaaaaaa

SEQ ID NO: 78207 - DNA, 783 bp, Heterodera glycines
  misc_feature (354)..(354): n is a, c, g, or t
  Genomic contig location: Contig_ID=SeqID_219; Location=318..1100; Strand=-
  SCN-specific regions: Sequence locations=1-232,254-483,505-512,534-783
atgaatggacttgccgatgagtcggttccgtttggtgatcatttgaaaagtggatttggactcgtggagcacaatgccatgcaacccaatctgttttggaattttcattaccttttccccatgttttctccatccacctgcgttttgttcggtgcgtctccgactctcatcagtgctccgtggtaatcaaccctcaacaaccgttcgagcattcgcaggccgatgttattgagcacctttttgaagtaagacaaccacacagttgtagggggaccgacttgcttctacctaaagaaatgaaactgactcattcaaaggccgcccaactcgtacctaagtccgtacattcttcancccgcccgctttcgcagcaattctccggcgcccgacgccgaatccgacgctcacgtcgtttttgtttttcaaaattgaatattttgactcttttttcagcataattgtccatttcagtcgtcaaaataaaataatagtgagttttagagaaaagtttcaaataatttatttgttgtacataactatcaaatgatttcatttatgtcaaaaatacagatcatattacaacaacggaaaagaaaatattcaccatcaatggtgacaaagtgttccttggttttaattcggtgtcactttccatcagtgaggttgaagaattgacttgaacaaattgtctaacaatattagtggaaaaggaaggaaaactaatgggactggcagaggttaaacaacccaaaaacaacataatatatgagttattataataaa

SEQ ID NO: 78208 - DNA, 1144 bp, Heterodera glycines
  Genomic contig location: Contig_ID=SeqID_220; Location=19736..20879; Strand=-
  SCN-specific regions: Sequence locations=1-381,403-495,517-578,601 -949,981-1144
atggggggacaaactgcattaggtattactgtgccaaaaaaatattgtcatttgtactttttctctctcccttctgctatttaaacttaactttttcttcacttacctatcactttttgggactaggtcgttttggcgccagccaagttttcggacgataactttatctttctaacacatttagagcatatattatttacctattctaaattttaatgaccaacgaagcaggaaattggtgtttgattgaaagtgaccctggccttttcacagaattggtatttcaattggcaccataaaattatgacttttttggatttatttggtcaatatgtggggagtatttttgaacacggcgattcaattttgggctccaagtacaaataagtttattatttatttagtaatcagaacgccaaaactttgcaaaactgaacattttttggggattttcccttgtaaaaacggaagagccgatctcgagttaaaaagcattttgataaaaaacaaagcatcatcctataggttgggttaaaatatgtagcctatacaaaattttaagaaaagttacccacaggaaaaaatcttttcccagggcaaagttttttctttttctctcattttgacgcactatttccatgtctctaacatataagataacacatggttcatttttttgccaataaacaatttttttaaacttttgactaattgagaaatattcttcagaattttcccttcaaaatgagcataaaatggttttatttggtctattattgaaaaagttataagctaaaaaaaattcataaaatcaagggtaaaataactagggatggtaattatatgcacataaaatcgcaaaatatgcgcataaaatatgcaccaaaaattgcaaaatatgcacataaaaagtgaaaaatatgcacataaatttttccaaattgagggcaaattttcaaattttaatatttatttattttgaagaaaattgagcaaaaaaaggagaattttctattttctgactatttttggcataaaattccaattttttaaaaaattacttttttaccagaaaatatacccaaaaatgtgatttttttgaaaaattttcggtcattagagcccaaatggccgcttcaataaa

SEQ ID NO: 78209 - DNA, 65 bp, Heterodera glycines
  Genomic contig location: Contig_ID=SeqID_2163; Location=395..459; Strand=-
  SCN-specific regions: Sequence locations=1-38,60-65
aaaaaattcaaattttaatttatatcaagtgaaaataatacaaaattatttggttttttataata

SEQ ID NO: 78210 - DNA, 734 bp, Heterodera glycines
  Genomic contig location: Contig_ID=SeqID_2165; Location=342..1075; Strand=+
  SCN-specific regions: Sequence locations=1-127,210-388,410-548,572-734
gtagtccttacaacctcgtatccgaacgtgccgtggaacgctacgacctcgaaggactagtgaatcgaaacaatatttaccggttaagcggcgtcggggggacgcccgtgactacatgcgggaggtcattttattcttattaattttgtgaaatatatttatagttattttttttatcttaaaaatgccttttaattaatttaaaaaatgaactccgctttaaggtgtttaccctccgcagtcccacccttgaccctatttcctcattaaaatccgactttaatgatgaataaggacaaattagcaagcactaagggttcattaagatattaaatatgaattaagacataatttagtcgtatcgaaatacatcaccactgttgaaaactaacagctttttatttatcattaaaattctaaaccagttgaattattattttttgctcttccacaatttgcagcggtcgcattcatgcgaatttctaagatttttacttattttggcctacaatgctttttcaactttgggtattattatgaaaatgaagtaaaaataatttttaatttttttgttattggagtaatctattcactataaaatttatttcaggccgattccaatgcccaacaacgatttgatgagtggaaagacctttatttatgggaaaataactaataaaattatgttttatcctcagagacaaggtattccaaaagatcatagtctcgcttag

SEQ ID NO: 78211 - DNA, 1062 bp, Heterodera glycines
  Genomic contig location: Contig_ID=SeqID_2165; Location=2426..3487; Strand=+
  SCN-specific regions: Sequence locations=1-41,84-116,170-491,513-1062
atgcgccggtgttcaactcaaaaaacagctcgtcgtctaacatttattttaaaagttattaaataataaaaatattaataataccaaaagatgttcgtcatatgacaaaaattcccatttaaaattatatatgaaaataaaaattattaatacttttatttaaatttttcttttttctgcacatcactgttgtcttaaaacgtaaagttttcaaccaatcaaaaatataaagactgagaagcaacttgtattattaaaaaagagaggattgctaaaatgtcttttttctccatcatttccaatcaaagaacaattcaatttttattgcttatggttttattaaaaatgacttaaatcgctaaatttggtcatttttggacaaatttgtttttattatgttttatgttttttgaaaaatttccgagttccgaattgcgatttccgacttccgaaaaatttttgggcctcggaattctgatttccgatttccgaaaaattttggacccccggaattccgatttccgaaaatttttggggcctcggaatgccatccctgctatgtaccttaaaaagttacaggctatttgtactccctcgtctttgtcctaaaagcctttgcttgggtccatcaattccttaattgcacaaattgattggtcaattaatgcttctggtcaattaattgtcacacgccgtaaaagtggtaaagtgtgggaatcccgagctgttcgacgtgttgttaaaaacttcgccattaaaatctaaaatctctattcaaatccgccacttcgctctttaataaattgccaatgtcactttgtcctctttttaactcagtaaattattgtttgcgttttgcttcagacggtgactggacaatcggacagtggacaatcggacagtggacaatcggacagtggacaatcggacagtggacaatccgacagtgaggacaatcggacagaagtggacaatcggacagtggacaatccgacagtggacaatccgacagtgaggacaatcggacagaagtggacaatcggacagtcaaatataaaatag

SEQ ID NO: 78212 - DNA, 278 bp, Heterodera glycines
  Genomic contig location: Contig_ID=SeqID_2166; Location=729..1006; Strand=-
  SCN-specific regions: Sequence locations=1-234,257-278
atggaccttaacaatggtttttacgacagggaagaagacaaagtgaaattgaccatcgatctcacaactgttgatgaaccaaaagtggacaaattcaatttggatcaaagcaattcgaaaggcacactctttatggaaattgaaaaagtgtcggaatttgcgcgagaaatctttgagagtgaacgtaaaagcgaaactgtgcacatcaaaggaatgccatggaaaatatgggcagaaataaaaaagaaagatgaaagcactgacaaaaatgagaaatg

SEQ ID NO: 78213 - DNA, 456 bp, Heterodera glycines
  Genomic contig location: Contig_ID=SeqID_2166; Location=1496..1951; Strand=-
  SCN-specific regions: Sequence locations=1-59,96-142,175-456
atgcttggcccggcactgttcaaaattcgctttccgcttttgtcaaatgaggaatttacgaggaaaattggtaaaaaataagtcaaaatttcaaactcattctctgatgagatgccgtaaaatattcattgtttttgtggcgattttttaaaatgtttttaaaaatttatttttcaataagttaatacatatttacagttcccttcggtgttttgtcaaaagatgaagtgatcgccgtttatcagttcaaattccttccaaattatcatgggatttccgacggatttttcccaatgcaatttccgactaatggacggatttccgatcggaaaaaggcacacttttaattgacattgaaaaagtgtcagaatttgcacgagaggaggttgagagcagtcggtacagcgaaaaagtgtacataaatggattgccatggaatatatgggcaaaaataaa

SEQ ID NO: 78214 - DNA, 1214 bp, Heterodera glycines
  Genomic contig location: Contig_ID=SeqID_14200; Location=219..1432; Strand=+
  SCN-specific regions: Sequence locations=1-106,128-925,947-1075,1097 -1166,1188-1214
atggcgcttgcggaaactgtggcgaacatggccaccggcgtgcggaatgcccgcaagcagtttgtgagtgctgtggccaggccggccactgggtgcagcagtgcaaaatcgaggctgcagccaaatgttgcgttgcatgttctgtccgccagcacaaggcggcggaatgttgggtattggaatcttggggtaattattaatcccgcttaaacaaagcccattgctataattattttttttagtccgctcgcggatccgagaaccagactgctgtttgttggaaaattttgtggtgcggcgcgctgctgagactgcagacggattttgcgtcctttgtttccaggtttttttcgctttaaaatgttcatttgccaaaagatactttatcttttaatgaatcattaatttaagaacgaacacgtggccgaaaaatgcccgcaaaaagattcgctggggccgctctacgctcaaatttgcgggtcgcacaaaaactcggcggttttgcgagaatggggtgagttggaaattgtttaaaaataccgtaaaacctcaattacaaccccatggggctctattgtttatatttaacccttttgtaattcgtctgtgggcacgagaagaagaactgcagtcagcaccgtctcagactgcagttcgagcagattcgggccctcttcggcaacttgcaacgccggacaaacgccaaaacgacggattcgacggcaagccctttttgggcgtcgtggtcggggcggcgtagtgacgacatccgtcgccaccgctacatgcctatcgggaaggaaaacaggtttttttttttgcataaaagtattagaaaaatccaatggtttacagagggagcaagacgaaggcggaggctgcagcagaaggcgattttggacagaatgctgcgaaaacgcgggggccacaaaagttagtggtttttggtcggttccaacgcgggtgggtggggagcaggaaaaaacgtcgccgccgaggtactaattcggccgatataatgctgagggttcggaaaatcacaatgtctttcatgttcgggtggaggattgatgggtgtgcctccaggcacagattggacaggcacgatggaatgccacactaacttatgcccaactcaacagcaccaccgaagatcagaagaaacgcttcagaatttggcatttttctacaaaatgctgagagaaaaaaagtaa

SEQ ID NO: 78215 - DNA, 1809 bp, Heterodera glycines
  Genomic contig location: Contig_ID=SeqID_14201; Location=1050..2858; Strand=-
  SCN-specific regions: Sequence locations=1-161,207-382,404-956,978 -1270,1292-1339,1378-1623,1654-1771,1794-1809
atgagtcatgcattccgtgtgccgccccgtcgcccacagtgagaatttctccccattcattagggaatcattttgaagattttgtttatctttttcagagcaaaagcgcatatcttctgtactacaaactgaccaactcaactaactcacaggccaagtgatattaatattattaatttattattattattatcattattattatttgtacctgtgttctgttcccgataccatccgattgtttctttaaaattaattacccatagttttttttaacctttttttagtcgccagtaatatttaaagacagcgccccctaatggtattaaaacaaaattttttcaaataaccacttcttaaatgaaatgacaaaaatctcctttaaaaattgatgaatttaattgagtgactcaaaaattgcattatttctttaaaattgcagaaacgaaggccagggcgacaaaaacgacgatgacgacgaagatcaatctgagatggaaatctttaacagacaaatcaccgatatttgccaaatgttgcttgctcatcatcacaatgaagttgagaaagttggccggctttgcgcacaaatgggcgaagcaattctccaagtattggccatccaacaacaaatcccaaatcccgacgaagttgaacaacaacatggggaggacaatggcagggacaacagaaacaattgttctttcgatgaagatgaaagtgatggcgaaagtgacgacccaacggtggagcatccgttgccagccgctcgtcgtgtgcttcgtcgtctcaaattgcccacaattcttgacattagtgccgcaaccgaagcagatgtgcaagaatatggcacaaaattaagtgacaccattaaacaaatcaccaaattacgcgttcaaaacggcggagcactgacaagcgaattggaattgcggagcaaacagaaacaagcacaaaatctgctgcaacaaattggcaatttaatgccacaattggtcgttgaagaagaggaagtggcggaaatactcaatttggccgaacaaagcgccgatcgcttttccattggatttctgaacaaggaacagaaaaagcaattcgaagaagcaattcgacaagcaaaaaaggtgtgcaacacaggggaatcaacgtcgggagggagcagtttgacccccccccccccctcttaaatttccttggctcccggacaatccatcaatggtaaatctctcagcgcaataattattttgtctggtaaatcttaagaaatatttaaataaaaaagtattgagtagctaaaaaagatgaaaaaatccttggaagatttttttaataaagtatttccttataatgtcattctaaaatatttttatcaattgtctgaaaaaaatttttaccgacggattgaccactgagcgattgtccgaatacctttccttcctcaccatcagtcgagtaaagcattttgaaaatgtagaaatccattgatcggctgagtcattaagtttaacaaataataatttgtccaccacccacctgtaggctttcgagatcctgttgaacataaattggacagtttggggaacaattttatgaggatgtacaaaaaactgcttcttgttggaatggaatattaaaacaaacaaaattgccaaaaaatttgagggcaattgctaagtgccggatctttggacaaacttggcggtggagatggggggtgaaaaaaccataaataagtttaaaaacaaaaaaatccaatgaatttttgcccgaaatttttaaatttttccttttttggggggggaaaataaa

SEQ ID NO: 78216 - DNA, 942 bp, Heterodera glycines
  Genomic contig location: Contig_ID=SeqID_14204; Location=1217..2158; Strand=+
  SCN-specific regions: Sequence locations=1-67,89-143,181-294,316 -471,535-643,665-942
atggatgaaattggtggaagaaaaacgaatgaatttcttaggaaaattagccaattccgtgacgtaatgaataaaatgaatggaacaacaaaggatataattcgtgggagtgttgcattatatttacttagtagcttagtacgtttttttatttttattaatttagtaatttaaaattttcgctaaaaattctgcagacaaagaccaaattggctcagcgaatagtggacggaccgacgagttttacgaaaagccaaatggttatgcaaagatacgagagtctcgactcatcggtttaaaaggcccaaatttggcgatgtttcattttcaggctgtacaaatgcgcgtgcaaaatctatcggattgtaagaatgaactcatatttttcatgccaatggatctaattgttgttttggacggagaggaaaaaggtgtaaaaaagaaaagattttggaaaaggaacacaggaccaaatttttgtattaaaaataggaaaaataaaaaataaataaaataaaatttagatatataattgagcattattttcatcataaaataaataccaatttttttaggttttcgcattgttcgaatttgttttgtaattcctccagataatctcggagttacatattttgaagtgaaaattatcaaattacaaagagaaaatgggtgagttaacagttactaagaataatatattattaatagggcgaggatttctagttttttaactatttttttctgcggctttattttgatgagaaatgcacgaaaaacacattctttttcaaaaaattttcgtttttagtgccactattcatcattaaaaaaaattattttggaagttggccactaaaataattatttgtcactattggcgtttcgtcattatttttgccactattttggcattttttggaaaatttcccaaaaaatgca

SEQ ID NO: 78217 - DNA, 75 bp, Heterodera glycines; identical to SEQ ID NO: 54636
  Genomic contig location: Contig_ID=SeqID_14205; Location=403..477; Strand=+
  SCN-specific regions: Sequence locations=1-75

SEQ ID NO: 78218 - DNA, 783 bp, Heterodera glycines
  Genomic contig location: Contig_ID=SeqID_14205; Location=1014..1796; Strand=+
  SCN-specific regions: Sequence locations=1-140,162-172,194-379,402-783
  Gene Ontology: Mol. function=ATP binding; Cellular component=Golgi apparatus; Biological process=two-component signal transduction system (phosphorelay)
aattcatcagctccctataactattcttacatcttcaagtacattatcatcggtgatatgggcgtaggaaagtgcgtgtgatcttaaacttgttactccaacttcgtcccattttcagatcatgtctcctgcaccaattcactgagaagaaatgtttgttttagtcgttgatatttgtttgtaattttttataaaatgcaatgagtccctttgtttcatcgcttctccgcccattttccctctaagtcatggccgattgccctcacacaattggcgtcgagttcggaacgcgcattattgaagtaaacggccagaaagtcaaactgcaaatttggtgcgagtaaaccccagcgtacaatgaatgcgaaattgcatttcagggacacagccggacaggaaagatttcgcgcggtcacacgttcgtactaccgcggcgctgctggggctctgatggttgactaaatacaaatgaatgcgttttgtaatcattcaacaacaaataggtctacgacataacgagacggtccacctacatccatttgagcagttggctaagcgacgccaaaactctgaccaacccaaatacggtaagagaatgagcagtgacacaatgggccaataaaatagccgaaactctcacaaattaccatccgtttctgtttaggttatttttctgattggaaataagtccgacatggacgcgcagagagacgtcacttacgaagaggcgaaagcatttgcagaagagaacggactcactttcttagaatgttccgcgaaaac

SEQ ID NO: 78219 - DNA, 75 bp, Heterodera glycines
  Genomic contig location: Contig_ID=SeqID_14206; Location=1437..1511; Strand=+
  SCN-specific regions: Sequence locations=43-75
atgggggaggggagggcgaggcctttgttgttttgtttgctcagtcaagccgtgctcgcccataacacattgtat

SEQ ID NO: 78220 - DNA, 1155 bp, Heterodera glycines
  Genomic contig location: Contig_ID=SeqID_14207; Location=1351..2505; Strand=-
  SCN-specific regions: Sequence locations=1-585,607-826,848-963,1000 -1155
gcaaaggcgttggaatgcggttatactgtggacagattttatagagcgtggcactacgaagaggaggcgaatgatttattcaagggatacgtgcgattatttttgaagttgaaggaggaggcgagcggtttcccgaagggggttgagacgggggagcagaaggatatgtggagagaagaatataaggaaaaatatggaattgaaattgaattggctaaagtgaagaagaatccggggttgcggtacataagcaagttgatgctaaatagtttatgggtaagaaaattgaaaataaatttacgataggtaattttcactttcagggaaagttttcgatgagaaattgtttgaacaagaatgcggtaattgatagggcgtcggagttttataaaattgcgtgtgatcataaaattgaattatgtgatattgttgagtattcggatgaggcgattagattgatatacagggacaaggaggactttgtgatggagcacaagtcgagcaacatagtcattagcttatggtgagttcaaaaaattataaatttgtatataacctaatttttaggacgacgagtatggcgaggttaaaattattggaatttatgagggaggctgaaagcaacggaggggaaattttgtatacggacactgacagtatttttgttttgcacgatcgggatgtggagccgatcacgacggggaaatatttgggagagatgagcgaggaatacggcggctatgagattgaagaatattgctgtggaggggcgaagcagtacgcactgaagatgagaagcaagcagacgggggagactgaatacgttatgaaaattagaggaattacgttcgatgtggacaacaggaaaacattgcactacgatacattcagggagatggttttgaattatgggaaaggggaggtggacccggcattcttcgtctataagaatgattttgggtgagtttttaaaaattatttgcttcattaataaatcaatatttaggccgacaagggattcgaaagtggtgacgagggagaagcataaaatgtacaggccggtctgtcagaagggtatcatcgatgaggagcttaatgtgatgccatttggattttgttaattttgtattttatttttgttttttgttaaataaa

SEQ ID NO: 78221 - DNA, 1574 bp, Heterodera glycines
  Genomic contig location: Contig_ID=SeqID_14209; Location=279..1852; Strand=-
  SCN-specific regions: Sequence locations=1-111,183-271,329-376,398 -955,977-985,1008-1106,1141-1149,1214-1245,1328-1339,1396-1418,1440 -1574
cttctcaacggactctctgaacgttacaacaattttcattggttcatctaccaatttttgtgcatcatcggtgtcatcgctaacatttgttttgttgtcgtacttttaaggtaaaaattaataaaaattaattattttaaattaaatttaaaagcattttaaataaatatttaattttatttgatttgatttcaaggccaacaatgcgcaaaaatccgttcaatttgtttttgattgtcatcgcaatctgtgacatgagcctaatggcctcatattttatttataaacaagtaaaaattagtttaaatatgaaaattattgttttattgtggtcatcatccgttttttgaatggcttcccgtggataatccgtcagtaaaatttaaataaaatttggcatttatcccaaacacgtaattaatggattaattaatgtacctttaatatgtaatctgacgtattatccggatagcattgaactgtatattcgacttactgccttctgttcagtggggacataatctgatcgaaattacaaaacaagaaattttaaaaagaattacgaaactgttggattttgttttgtttttttgtctcatttggcatttatcccaaacgcataattaatggattaattaacgtaatttaaattgtaattattactgacggactgtccggacagcttgaactgattaattcaatttaatgccttctatcagtgatgaaataatctgatcgaaattataagccaagaaatatttaaaaatcgtttaatttaatttttgttgccacattttttttggcatttttcacttttcatttattttaattcattcaggtggagatgtgccatccctggtatttcacatttttctggattgtgtacacctacgggtacgccgtgctgtccgtgttcgtccattccgcctcattgtggctgaccgtcaacatggccgtgctgaggtagaaaaattggaaaaaaaaacaaatttaatttgctaaggcttgcatttttatttaaacccttttttagggattggatttttgtaaaatttttaaatttcgcatttaaattattagttgaatttttcaattatggcaatgtaaaattttcctaaaattttgaaaagttattttcttcatggattctttaaaattataaatttttgaaaatttctaattaaaatacatttaattattttttgtattttttcgagggtactgtcaaattttagtaactttatgaatttttaaattttagtattttttactctttgaaaatctaatttaaaattaaatgcattaaattattttttgtattttttttcgagggcatttcaaaatttatttaaaattttcttagattttcttaaattttaaaattatttttttaatggctaatttataattggcataaattttttgaaaatttgcaggtatttggtgctcaagtcgggttcctcctcctcccggcggtgcctcgctagggctcgtacaaagccgcttgcggcgctgtggcggccgccgtcctgctcgccgcggtcggttcagcgccgagcatgctcagatacgag

SEQ ID NO: 78222 - DNA, 440 bp, Heterodera glycines
  Genomic contig location: Contig_ID=SeqID_14210; Location=1157..1596; Strand=+
  SCN-specific regions: Sequence locations=1-30,120-335,374-440
atgtccaagccgaacaagtgttgttttacggtagttgtcggagtcgtcgtggtactgggagttgtcgtcgtggttgtactggtcgaagttgtcgtggttgtggttgtcggagtcgtcgtgctagtgggagttgtcgtagtttcctccgaactgtccgtcatttcgtctgtcgccgaaatgtcagtagtttcgtttgtcgccaaaatgtccgtagtttcgtttgtcgccaaaatgtccgtagtttcgtttatagccgaaatgtccgtattttcgtctgtcgccgaaatgtccgtattttcgtctgtcggagtcggagcctccggagttggaataggtgttgttgtagtcgttgttgttgtggtggtggtggttgacttaaaagaatcgaggcttaagaaaaattgacaccgaaattaaaaaacaaattctttataaaaata

SEQ ID NO: 78223 - DNA, 1438 bp, Heterodera glycines
  Genomic contig location: Contig_ID=SeqID_14210; Location=1186..2623; Strand=-
  SCN-specific regions: Sequence locations=1-212,259-371,602-677,950 -1016,1058-1094,1133-1348
  Gene Ontology: Cellular component=secretory vesicle
ttacgggactgagctggccggggactgagttgactcactctctcattcccatcgcagagattcgttgcaaacattttgcgcggcccttcaaaagaatgctttcccggcaaaggactatgttgtgcaatgtgaaatgtgcggacaagacaattgcaatgccgaattgctttatacaaaagcggtaaatcgaaattttttaaatttggtccctcattaaaaagataataattaattaaattgaattttaataataaaattgctattactagggttggaagttgaatgtattaaagaatgccaaatatgcactgaaatatgcctgaaaaatgcttcaccaaatcaaaaaattttaaccctagaaattcgaaccctaattattactttaaaataattaaaatttttattgtcaatgatcatataaacagtaatattttatcattcattcatattaattattataattaaatattttttctaaattttataccaaaatatgtatacaaaaaaatgtctgaatataataattattttataaaagaattatttagcgaataattaaaaaaatacacattgttattataatcaattaaataattattttgcttttaatttggcccctcgcatctttcaacaatgggctttccattcagtttgcacataatttttgccaggatttataataattttataaatataattagttaattacaataattttttaaatataaatttaataaatgattatttaaattaaatgtaataataatattattaaaatttaataataatatttattacttaaatataattagttaattataataattttttaaatttagatttaataaataactatttaaatttaaatttaataataattttatttattacataaaatataatcagcataatattaattattacaattaaatattttctaaattttataccagaatatacaaaaaaatgtctcaataaaataattgttttttttaatttggccccacttttcttacaaaatttttattatttttataaagaatttgttttttaatttcggtgtcaatttttcttaagcctcgattcttttaagtcaaccaccaccaccacaacaacaacgactacaacaacacctattccaactccggaggctccgactccgacagacgaaaatacggacatttcggcgacagacgaaaatacggacatttcggctataaacgaaactacggacattttggcgacaaacgaaactacggacattttggcgacaaacgaaactactgacatttcggcgacagacgaaatgacggacagttcggaggaaactacgacaactcccactagcacgacgactccgacaaccacaaccacgacaacttcgaccagtacaaccacgacgacaactcccagtaccacgacgactccgacaactacc

SEQ ID NO: 78224 - DNA, 175 bp, Heterodera glycines
  Genomic contig location: Contig_ID=SeqID_14211; Location=61..235; Strand=+
  SCN-specific regions: Sequence locations=1-175
atgtgcccagcgatcacattccgatcatgtcgcaatatgccgtcattccaccaaacttccagagatctttgccgcccattcaccattacggaggctccgcacattccggttccttctatgatttattggcagaataaaacattacattttcaggtggttttggtgcgatcggacg

SEQ ID NO: 78225 - DNA, 924 bp, Heterodera glycines
  Genomic contig location: Contig_ID=SeqID_14212; Location=106..1029; Strand=+
  SCN-specific regions: Sequence locations=1-207,230-269,291-542,575 -779,809-924
  Gene Ontology: Cellular component=intracellular
atggaagaagcatttgcgaaggcgcggtcagaggagaaacagtgcggcatttgtatggagcaaattgtggagaagggactgcgctttggcattctgcagaactgcacgcactgcttctgcttggattgcatccgaaagtggcgccgtcaaacggatgaggaaatcaaaacgaaaacagtgcggttagttggcaaattgggaatatttaacaaatgaatgaataaagaaactttaagtgggtatatatgaaatttactgaccatgagtaattttttgtgaaaattaggctattcccaaaatctctccaggtcgtgtcccgaatgtcgtgtccattccgattacgtcatcccgtccaaagtttggattgacctcaagtcagacaaggacaaattggtttcagtcttcaagggtaacacgaaaaaggtggttgtggtaaaacgattctgttttcctttaccatttttttaagattgcttgcaaatacgtcgtcaatggcgacgtggacaaatgcccattcggtccgttcattcgtgaagcatttcattaaaattttgtttttttttaattttaaattgatccttttcaggtaacaaatgcttctacaaacaccaattgcccgacggttccatcgtcgaaggcaaatcgccgacgcaattgcgcaagaaccgtcgcaacgatgccatcatgttcagtctgtacgactttttgccctccgattcggattgggaggacgactttttcaacgataacagcgatttgtacgattgattcgcctgctttttgtgttatttaaataatttgattgtgtaatgtaagcagagtttcgacataacaattaatacatcagtctttccggacataaaactttgtacgagtaaatggtccagattttcatgttatttgacaaagcatattttagcatta

SEQ ID NO: 78226 - DNA, 1489 bp, Heterodera glycines
  Genomic contig location: Contig_ID=SeqID_2167; Location=770..2258; Strand=+
  SCN-specific regions: Sequence locations=1-322,344-571,601-636,658 -726,803-1114,1186-1282,1318-1489
attttttgtgggattggaactcaaaatttttggggatccctcgagattaatcccgcggatccagcaaaactcaactctgaaattcatggtcacgatcacgaaaaccgtgaatttcacggtttttggatcatggttacggttacgattcacgatgcacaggtttttttcaatcacggcacacctctactcatgctggagcgcggacagaaaaatcccgcggtcgcggatggcgcatcgcggattcaatttgccgcggtcgtggatcgcggtcgcgctccactcctgacctctactaaccacctctaggccattataacaacaatagaaatgctttttcctaaatttaagctcattgtcagaccaagtcttagaaatgtgtgttattttcaatctatagttcccattcggatttaaaagtcaagatcgagattggagttttgaaaaccggtgtcgaaatcgagatctgcttccgaaaaagtcgggattccgaccaaaaatcagtcgggatctcaatgccgtgcaactccactaaaaatcaaccgtaaaaaataacagcataactgtttgagtgaaaaaaattattttaaaaaataaaataatgttcccgggttattttaatttttttttccaatttgctattaaaaaaataattattttgctgctcgtggctgtgcaaagaaagaactgggaaaactctaataagcccaactttatcaccagacaatgaaaataagaaataatttaattcacattttaatttaaattgtattttataatataattttaattttataatattattcgcttatttccttcataaccattctacgattaacaatttaaaaatctttgttaattaattgcattcccttttaattttcgtttgttttttagcttccttactaaataatttttcttaaaaacatggcaattaattgtgctcctctcacccgttttccctatgacataatgatgtttttcataagacatttaataaatcataattaattggactaaagaacaagtttaatttgtgtcaaatcattccatataaatgcattatttgtcgtcattattttattttactttacatttttattcttttaaatgtcgctatttaaataatcatttcaatttaatgtcttttttaatataactttaattgctaattaatttatttttaatgtttcagttaaaatgaacaagatcccttttttatttattgctctttttgttgtgcaaattattgccgcttatgagccaagttgcaaagtttgtgatcaaaaaaataataaattcaataaataacaaattttagtgccccgaaaatgaggagccgggccaaaagagttgcaacggatgtgagccaagttgtgacaatccgaagccggagatttgcactgcgcgcttttgtgactgttcatgcgactgtgtgaagggattgttccgcgacaaaacgaaaaaatgtgtgcccaaatgcccgtattga

SEQ ID NO: 78227 - DNA, 737 bp, Heterodera glycines
  Genomic contig location: Contig_ID=SeqID_2167; Location=3390..4126; Strand=-
  SCN-specific regions: Sequence locations=1-12,34-83,113-368,408-737
atgtcttcttccccgtccgtctctgtgctcgccatcgtcgcaattgtctgtttgatgtgccaatgttgcttttcggcaccgcgtattatttttaatttattattttaatttactaatttgttgttttccgacagatccgtgctgtcccggcagccaaaaagtggtttcacttatgtccaattacgttggcacttttgccaattccatttccaagtcatcgctttgttcggatgcccaaaatgttgcggacgcgttgaaaggccaactgatcggctgctcgaatggcggtgatcgaactcttttggccgaaatcgaagcatcccttgccactcattctgctggtaataaccaattaatgggcaattgcctaataattatttatttatttttaaatcatttttaaatatctctttccccttttagatgagtgtgccctcagcctcggcttcgtccgtgccatgttcgccattgccgcctccgcttcttcccatgccagcaacaacagcgaatggcaggcattgagtacacagtttggtcagaaagtcactgaaattgactcgaaatgtgcagagtttggtattagcattggcaaagtgcccatcaacggtcccaagggtaaagtcaattaagaaaggaataatcaaatccatttaatctcttaaggtgtccatgttcaaaatgtgcccaactcggaaagtgtgatttctatgcctggattggccggctcacacacccaa

SEQ ID NO: 78228 - DNA, 1438 bp, Heterodera glycines
  Genomic contig location: Contig_ID=SeqID_2168; Location=59..1496; Strand=+
  SCN-specific regions: Sequence locations=1-188,210-316,338-422,445 -611,645-903,927-932,955-1036,1058-1438
atgactcgaaatgtgcagagtttggtattagcattggcaaagtgcccatcaacggtcgcaagggtaaagtcaattaagaaaggaataatcaaatccatttaatctcttaaggtgtccatgttcaaaatgtgcccaactcggaaagtgtgatttctattcctggattggccgcgctcacacacccccaagataaaaaatgcatcactgaaaagatttggtaccttatgattattgtgcattaattagctgtggattttgtaaatttaggtaattatatgtaaataaatattaattcgttggagaaacaagattatttttcagaaatattttcttaaagaataatgtggaaattttgagaattataaaaaaatataattgtaaaatgacgataataaatgagaaaaccaactcggatcttactgctgtaaaattagtttttactctttttaactcaattttccaatgttttttttttaaaaaatgttggccaaaaaccggaagattaaaaatggcatcttttgtgttttgtcggcattatttgaaaacccaaagggaaattgagtgggcattaaaattgttggcacaaaatcaattacaaaaatgcgataaacttttattggaattttccaaattatttttatgtaaaacattaagtttaataaatttttcttctctttgatcaaatatttttacataaacaatagaatttttcatctgttgacaaatccgaatatgaattttaaaactaattaaattttttgagtttttctcaaaattggtgacacataataatataagcaatttattttttattgtgcatcttttttgagttaaacattaaaaaaagctgaaaaaaatcatttccgaagtaaccttatgttgctgatattcaatgttgttagcaaattaaatttttaataatttttcaagcaaatatatttgagaaaaatttaagtttgccaaaaatggacaaaatttatgttaccgtttattcttatttcattgaaatatgtattatgatgtttattcatttgattttttattgtttagctaattgatcatattttatcgtttatttcgatattttgttttttttcttcaaccccagcatttgtaatcgcaatcggcggagcattcgtcgaatgccgaaaggcatttcatgtggcattcggtggcaacaccgtggcacttggacaagcatttcacattttgcgcgttgcatccggtgcagcaactgaaaagcaatttgaataaacaattatatccacttccattagattagcataaatattttcataagatgtaatatatgaaaaaaaaatactctttttcttcagcaaatgatgaaaatgggaccaaaagcagtgccaaaagtgaaagccaacgcagaaacattggccaatatcaattctttgagaaagtctttataaacaaatta

SEQ ID NO: 78229 - DNA, 1221 bp, Heterodera glycines
  Genomic contig location: Contig_ID=SeqID_2169; Location=10..1230; Strand=-
  SCN-specific regions: Sequence locations=1-135,177-200,265-318,340 -563,588-701,726-900,924-1221
atgcctatgtacgttttcctttgtatgtttcaccatgacacaatttaacatcatggtaaattgtattttttttattggtcttcgtcaaagtgtttcaatatttttacaactaaaaatcgggaaaattgaaaaaagtaattttttatttaattgaattattattaataagtttttttcttttgcttcgtttgcaaaatagcaaaaattaattttactttatatataagataacttttaattttgaatgaaattatcaaataattagatgaaaaatcatgtgcttatcaggtgtttgatttttgcacttttcgcggtcgaccaaccacgagaaaaaataacttgaatccgattcccgaaatgtcggcccgcaacgccccgaataacttgaaatcgggaagaaaattagctgtcttaacaaaatgttggcctttttatttcgttactctctgttatttcgtatgtataataattttaatcggtttatttctgtattttaaattgtttttaatttgtttaattcaatattttagtgatatcatttttctccataagaatttgtaggcaaaatataattatattaataaattcttcgcaaactcctttttttccttttcacattccataaaaagcattttattttcgctcgccacacagagagaatttttaaaaccacacagcttaaagaaaattataaattcccgatcaaaaattgtgaaaaattaatatggcttcacttttggattttttttatataattacgatttaattggacggactaaaaaaattaataagcaatcaaaaaagattaaagacaaatttttattaatttgtttataaagactttctcaaagaattgatattggccaatgtttctgctttggctttcccttttggcactgcttttgttcccattttcatcatttgctgaagaaaaagagttttttttttcatatattacatcttatgaaaatatttatgctaatctaatggaagtggatataattgtttattcaaattgcttttcagttgctgcaccggatgcaacgcgcaaaatgtgaaatgcttgtccaagtgccacggtgttgccaccgaatgccacatgaaatgcctttcggcattcgacgaatgctccgccgattgcgattacaaatggtggggttgaagaaaaaaaacaaaatatcgaaattataaggaaatatgatcaattagctaaacaataaa

SEQ ID NO: 78230 - DNA, 1853 bp, Heterodera glycines
  Genomic contig location: Contig_ID=SeqID_2169; Location=2432..4284; Strand=+
  SCN-specific regions: Sequence locations=1-38,60-255,292-435,457 -828,852-872,914-1048,1070-1124,1146-1148,1170-1253,1277-1418,1440 -1853
atgtacaccatccttcgctttccattttggccttacgatggggcacaacacattttgttggacaacagctatttgcactatttcaaaacaacgtccgaagaatatacagaagggttggctctgaaaattgcaatttacacccatttttacatgctcaagtggaaaacggaacagaacaaagaaatattggagcagaggagaatatccggctcggaaaactcattatacacggaaatcaacaaccatttgaaaacgtaaataatttataattaattacatttttaataattagatgaaaatttttaggtattaaagtgcaaaatatgcttcgaaatgccaaacaaattttaaaaaaattaggaaaaaaatagtaaacaaatgttccatttgtaaatgaaaaagattaaataaagtgaaaaaaaatattagaaacacaaaatttttaattggaattttcaaaaatcccaaaaataggtaccaaaaatcctgaaatagatacgatttttgcaacccaattttttaaacggtaagattagaaatccgagcatttggtattttgtcgactcattaaaacattgctcataatttttttttttagaatttccataggtagtgcgcttaaaagtctcaatattgcgacagtttgtttactgttaagagaaaaatatactcttttgagtacattaaatggtgccgaattcaaacggcaaaatccgccgtgcccatcgtgtgaaacccaagagaaagcgcaacagacagtgaaagatcattttgaggaaatggcagaatggatgctcagcgatctgctcaaatcatttcactcgagaaaaagattaataaaatatttgaaatggtcattaaaattgtgaaacaataaaattattttttaaaaattcaaaaaacaattatttttcagcgaaattgcagcaaaaaataaccaatacgaaattgaaaaggcgtggaaaaagctggtcaatctgttcggatttgcacgtgctctacttctttgtagaacatttcggcaggaatttggcattttgtgtaagcgaaattagtggttcatttaaaattattcgtcaattatttactagggatgtcaattttatgtaaatacatatttttcctggcttctccatgctttgaatagtaggaaaaacactttcttttttgtgtcttcgaacaaaaaccgggacttttatttacatatttcggggttttattcatattttacttacattaaagacttattgttagaaaaattaattgctatatttttgagagattcgtgcgttttaagccattgaacggttagtagttaaccgccccggtgcgtagtttgggcgggaaaatttcccgcacaaacgccagcctattgggcggttttaggctttgaagttgccgccacctgtcaatcaaaaggtggcgggggaggggaggggtcgagagtgagtgatcggtggagagggtgcgcgggagggggtgttgggtttaagcctaaacctattgcgtagtttggggaggagtcccgtaggtgttgatgggtgggtcgggattttttttgaaactgagggggtcaagaggtcaatgaccaggtgtgaaattcacacctggttttggatgaagtggtgatgaatcggtgagggaggagggggacggatgagttaaggtgtgaaattcacaccttttttttgaacggtgacaaaagttggttggggggggcgttcggacagtttaaggtgtgaagttcacaccttgttctgagaaaggagggaaggggcgatgaaatatgttaaaattctcactaatctgacatttgagatcgcgtaattgatgctttatctgttgaaattaaa

SEQ ID NO: 78231 - DNA, 1310 bp, Heterodera glycines
  Genomic contig location: Contig_ID=SeqID_14213; Location=195..1504; Strand=-
  SCN-specific regions: Sequence locations=1-147,169-433,484-753,776 -778,807-942,978-1068,1116-1165,1194-1310
atgaagggcggcagcagacgggtcccattcccgacccccggcacctatgtaaggacagacgagagtcccctccattcccggcgcatgatgagcgcaacaactcccccctcttcccccgcccctccctccccccacaagcgcgtcctctttaatcaacattatattttctcgccatttacacgtacatgtcgagagtcgagagtgcgggagcagccgaccaccaccaccacaaatacacatcccatttacgggggctgtggctgttccgcggctgctgctaccgctgcacaaataaatgcatgcgcttacattatgtatttgatgggtttgttttatttagaggttttcaaaaaaaaattctgaaatatctgcactatgtaaaaatggataagatgggatggacagcagcagcgccccattggattttaagctgatatttttaaaaaataatataatttattattaattattattattaattatggtgatcaaacggactggtggcagtttgtcgagatttttaagtgattaactagttcggtaccgaaagtcccgagaactcacaaaattgttgtcccaacgatcccttttcaatcaatggtcccgttttttaaacatttagattactctgtccgattttcaaattatcattcattggtctaaaatttgtatgactagtaggccatgaaacaagtttttatatacaataacaactatgtacagtaattgtgatgggtgcagtatcttgaatataaaatttcaaataaaaaaccattccaatttttaaattaattttttatttaaaagcaaatttccagcatcgaatgatttctttttaattgaggcttccataaaggccttagctttttttcaatcattttattagcaacacgtctccaataacgagcagcacggccacttttaacccgggtaaaatttgcgtaataaaatatattttaaataaaaattataaatttgaattcaaacttacaaaacttattttaaggtcaaaaacgtcctcctcctccacctaacgcgggtagtcaatcaaattcagtggttggttactaaaaatattaattaattaattagtttaattgtttttttaaattttacagcaccatcttcaacagcaaattttaagtgccagcagctgctacacagttcaacatcagcagcagcagcagtcatcatccgcttcactgttcacactggcggacgccactttgttgcaaaattcggcaattgtcaatgaagcattgaaaacgcttggcacatttcaacagcaggaaattgccgcaaagcggtga

SEQ ID NO: 78232 - DNA, 310 bp, Heterodera glycines
  Genomic contig location: Contig_ID=SeqID_14215; Location=118..427; Strand=+
  SCN-specific regions: Sequence locations=1-73,135-191,223-310
cactgaatatcgccaagtgttcaaaaaagaattccgttcattgtttggtcgtctcagaaaaaataatggtaacatttttaaaaattaaaaattaatcttttttcattttatttttaatttaattaaattttttaccgtaatcttttttagttgttcaaacaattggtatggcacaaatgtgcaatgtcaacccaagcaacatcaacaacaacaaagttaaccgttcaagtcaaatgacaattataagaaatgtgaataccatcatccaaatccgtcattaattttattaattcatttttagtgaaaaata

SEQ ID NO: 78233 - DNA, 946 bp, Heterodera glycines
  Genomic contig location: Contig_ID=SeqID_14215; Location=789..1734; Strand=-
  SCN-specific regions: Sequence locations=1-322,347-793,815-815,837-946
atgcctaatgtatcgcgacagaatcgtgattccaaaaatcagtcagcagaagttggcccgacaacatgtatattcaccaaaattgtactcagaaatggaataatttaccaaaactgacaatcaatgattttgccaaatttacaacggcaaacggaattacacaattattttcagcatcatacatacaatgtctaatggacaagtggagcattaagaaggcttttcgaaagctaaaaggggagggcttcacaggatattgaaacgttcctggtcacttttctgaccacacccagtgatttgctcccaaacctaaactccccggttgaaatgctcttggttgcaaaacgcgaaccactctaaatttgctgaaactgccgccttcgcaaccctcgaaatgagacgagaaaatggtacaaaacttcaatcgacaatttggcacgaggcaacgacgttatacgcacgccatcgcctctcggagctagtgatcgcatttagatggcttgaaaccgggtcttgaaaatttatgaaaattctattttgcttatggcaattagcaatgaggcccacagtcttgaaatttgtggaaatagtatcgcctagttacctgattaattgccacgtttattttgtcaaaaatgcaatttaagataatcttttaaaagagtgcgggaacttttgtcgcaccagttttccattacttttatttattgcgtgaccggaaatttcaaatttcttgaatccttagaaaacttaattgaaaaaacgcagaacgagtttttaagcaattttggccgtttgtaatacaatacttaatgatatagtactttatttcagaaatataatattactgacgcattttccattgacacattttccgaaagccattcatcctttgtttttccacttttagcatacaatttaagttttaaattaaatatgaaataaa

SEQ ID NO: 78234 - DNA, 1980 bp, Heterodera glycines
  Genomic contig location: Contig_ID=SeqID_14215; Location=2134..4113; Strand=+
  SCN-specific regions: Sequence locations=1-288,343-500,542-617,639 -650,740-756,778-1287,1320-1406,1486-1554,1611-1785,1847-1929,1951 -1980
atgtcctcaattaacaccagctcagacaatgcggtaaaacaacaaaaaataataatgaaaatattaaccaaatatttaagtgaataaaaaaatcccataaatttattataattaggtatttgaaaataaaaatttactttttcagctttatttggcctaccgttctgtgggtccatccgtcgatttgattgtgccggccgttgcgctgtatttggttgcgttaattggcattgtgatgaacggcacagctttggtggtcactgccaaatcgaggcaaatgccattggcattttttattttaattatcataattgaatttaatttcaatttcaatttaaatttcccatttttcagttccctccgcggctccgccaattttctgatggctctgatttgtctttgtgaattggtccaccaaattgggcacacttttttactggttgttgtcatttcgggcacaaattttgtcagtttgcacactgctgacttaattatagcggtaaattttaaatataaatttaaaattttcaaatttaattttgaaacttcaaaatttaagccttctgtttttgcgttaaattgcggcttaatggcaatgttttgtgctgcggttgaccgtctctttgctgtattaatgccttttaagtgagaaaatttaaatctaatttaatatttcttacgaaaatttattaattactttttttcatttttttaaaattttatataattatttttaaatgatggcttttataatttagacatttctccatttgtgcaaagtataaattaccatatttgtttggccatctgctcatttgcataatttatggtacttttatacagtatcatgtgctcgcatcggcattcgaaaatgcgggaatgtaattaaaatgcattaattaacattttaaatttaattagtcaatttcattatcttttttaggccgaccaatggtttattagccgatgcttttcaggatgatatttatcaatttttcatcggtggagtttacagcatttcatttggttgcatttgctgttatgtgaccatttttttgattgtcaggcttaaaaaaagtggtaaattcattggcatttgtcttaaagtgcctaatttaaatacactatacatttgttacagtaacccagcaaacaaatacccgactgttacgttctttggtcatcattttgtccataaacattggcggctatttgggcactttgatcatgagtcagcttattggaaccattggccaagtgtatttgtgagtttttttttctttttttccaaaatttaaacccccaaaggtccccaatccaagcttggcaatttactttttgtgcttacattcttttaaatgttgttgccggatcaaatgctattgttctttttttaaacaggtccaaatttaatttattaaaatatttaatttgctgatttaatttaatttaaaaaatttattttttcattttaaatttttttaagcactgaataccgtcattgtttaaaaaagaattacgtgcaattaaagatcgtttctttaaaaagaatggtaaaaatatagttaaatttctttaatttttaaaataatatttaatactttttaattgaattgcttttttagctgttcaacctatttgtacaatcaaagtcaaaccgaaaacataattcgattacatcacatcaaataattgtttttctcatgaaaattcattttgaactctttttcattatagaattcattggtttattctatgtattgtttttaatttatgtaaaatggcttaataataataataatagttaaatacatttttattattaattcctttaaaaaaaatttttcaatctctatgtatattaaagaatttggtttataatttcttttttcatttatagcctttttctattaatgtgctcatatttactttccaaaaaatgggggaaagaatggcgcgcaatttaattaattgatgaaa

SEQ ID NO: 78235 - DNA, 162 bp, Heterodera glycines
  Genomic contig location: Contig_ID=SeqID_14216; Location=1044..1205; Strand=-
  SCN-specific regions: Sequence locations=1-105
ttgttcttgactacgatgctgaggccagctccaaaaaggccaaaaaccgattggatttgaccaaaaaatatggaaaagcagcactgaggcagagctctcgctaagaaaaaattgatttaaaaattataattcaaaaatttttgaatttaaaaaaataataaa

SEQ ID NO: 78236 - DNA, 1635 bp, Heterodera glycines
  Genomic contig location: Contig_ID=SeqID_14217; Location=206..1840; Strand=-
  SCN-specific regions: Sequence locations=1-5,27-68,90-269,291-325,348- 637,663-798,820-1068,1122-1219,1300-1426,1467-1612,1634-1635
atgagttttgtatgttttaataaattcactgaatgtatttgtcagtgtcgcgtcggagtgccagtaaatgttgtgccaattcttgcacactgcaaaagtcgtcggctgcaatgtaagcgtcgtccggcacgcccaccccacggagcacagtgcggtgcagcaccaccggcactgtcagtgcgcgaagcgcgttccaaaacttttccgtcacatattcggagcacaccgaattttcaaatgccaaataaaagaaatgggactctgaaggaaattcaaataggaatttttaactcatcattttgcttgatcatccaattaaatggtggaattaattaattaattggtttggttagcactcatttgttgcccatagcattgttcgtcacattcgttcccactgcatgccccaaacacatcgacagggaccagttggcccaattgcgcagtgagaatatcccttgcggaggatgcgccacatttggacacaatttgcagcgcaaatttgctcttctggccaacaagcgctttgatcttcaatttgacgcaattaggcactattcgcttctacgccgctgcccgcccattctgtctccgccagcaatccccgcgggacgagaaaaaattggatggaattcgggccgaatggcgaaaatttttgggttgggattcgggatgagaaaaaggcctggattcgggactcggttggcaccactgtccccagccaatcgctcggtaatttttgcgctgaatcggccactcgtccgttggcactttatgtttgtcatttgagtcccctgcaccctctcactttttgctcgttccaaaattggtcatcctcaatttgcgtgatttcgccacttcgatgctcatgtagttcatcatatttggtgcatatggtgctgttgccgtgataagtcatggacaaattgaaccaatcattgggcaaattatcgaaaactcttcccgcataatacggcgactcttgagtgaagaaggtgtaactaaaagagttaaaccgttttaattcccagatttgagcgtttgctttttttgttttgttgaatgtgctaaattttaatattacttttagaattgattttttataattttctaaaaaaaaagttttggttcaaatttttgccgactgagcaaactgtaaatattaaaaaagggctttttgggtcccaaatgaagataaaaatttttcatctgggttctgattttaaattaattttttaggcttatataataattattattttaaaaaaatttaaaataaaaatatataacaaaaatttacagttgctcttgactacgatgttgaggccagctccaaaaaggccaaaaaccgatcggatttgaccaaaaaatatggaaaagcagcactgaggcagaactctcgctaaaaaaaaatcgatttatcaagttttaattctaaaatttttaaattaaaaaaaaataatttacgcctttcgttccgttgtgtaaatgcattggaaaggacaattggaatttgggtcctcgccatatgacaaagatgatggccaaaaatcccattggtgagggtagaaaaactgcttgttccatgctaagattatgggcaatccacggtattgcttaaatatatttaataaa

SEQ ID NO: 78237 - DNA, 1368 bp, Heterodera glycines
  Genomic contig location: Contig_ID=SeqID_14221; Location=124..1491; Strand=-
  SCN-specific regions: Sequence locations=1-122,146-429,451-1031,1061 -1196,1229-1253,1275-1368
atgggcgcggttgcggtcgtttactcgcgcagtggacctttgccggagtggacggaggaggagtgggaggcacggaagagaattgaacggtcgacggcgattgtaaggaaaaagaacaaagcatttttaaattatatatatttttggaaaccttcttcccagtctctgttaaggctcaggacggacctcgaggtagggatcccgtaatttaatcccgcgagatcccacgcacgtccggtctctagttcaaattggtgcaaagccttataagttttagtttgggtcttctttttttgttatttctttttgagtcaaaaatagccaaaaattcactagttttgagaaaatgaagaatttgcaagtccgacaatgaagaaaggcgcagctgattaaattgtagaagaatctggatcggtttatgaagaaaacatttgaaattttgattttcacatttctacggggagggcgtgacgagcaggggttgagctcagtttttatatccctgctcgaaaatatgtaacacccattagtaatatacccaatttgacaaaaaaaaagtgattggaaattcaagttaattagcaatattattttaatagatttttttctttttagaaaacttcgacaatgtttagcgctttgagcagttctaaacgggtgcaacaggtggttgttcaatctgttttccaatttgctttttgcatccttataaatgtccaacattttgtttgaagttgttggccctgcctgggataatcgaacggtatatgcccgaaccgaaagaccgggaaatggtggaggcaattcggcaaacattcgttggcctttgggggttggaaaatgacgacgaacagacgcaccaattgatcagggtaaataatgcacaaattaaaaactcactttaaattatttagcaaaggcgctaagaaaaaaagcgattatttaaagtgtaaaaacaattagaaacccatggtctttaactgttcattaatgtgttcgacaattacatgaacagatcagtataacaaattctaaactaaattatgtataaaatcaggtaacggttaacttttgttattaagccaatcagcagtttcattaagacacttgaagaaccatttatcaaaaaatagtgtttttgccatttattgaattttttcaaaaataacttatttgatttgctaccgaatctaaagaaaatatttttatttttttaaatgaaaaattacaaattctttcgtgaaatattcatttagtttttgaaaaatattaattcaggacccggttggacccgataccgggactttgcaaaacctggacaacctggacccggacccggcttttgtagacccggcaataccggaccca

SEQ ID NO: 78238 - DNA, 2635 bp, Heterodera glycines
  Genomic contig location: Contig_ID=SeqID_14223; Location=437..3071; Strand=-
  SCN-specific regions: Sequence locations=1-128,163-440,462-544,567 -645,667-709,732-883,1080-1682,1717-1815,1847-2131,2153-2243,2265 -2538,2560-2635
atggcattatgcaataaaaaatgccaaatccaatgccatttgccgtcattttgtttaattgttgtccttctcgtcgtcctaatcgacgaaaaactgttgattttggcacaaattttgggcggacaacagccaccgcctccgccaccaccgccgccacaacaaccggctcctcaaggacaagcggtgggaccgggcgggcccggaatgctattcaccggcacagggaccaacatgtattatggaggtaattggacaatttttaacagaagtatacgatattactgtcagtgttttttgccaaatgattggactatggtaattatcattttattttcaataataattgaaaattgactgtgaaaaaaatattcaggaaatatctaaaataaaagtaaaaaatttactgtaattaatcatattcaaatttttcttagttaattttgtgaattttattctgaaaatggctgattattggtgcctagtcgttactgaaaaaacaccaaaaggaaatttttgacgaaaaattattctatttttcttaagaataaccaaatttttaatacttgatatctttcgtagctctaagtattttctattagatagaaatattattgacataagttttctgaaaatttttttttaattttgtagacaaatagaaaatattaggcttttgaatgataccaaaaattaaaatataatggtttcattgacaataattaatttgaaaaatacattttgtagtaaatttggtgccttttggacccgaaaatggcgaccttgaagtgtcaccagggttcctgacgtccggtcagaccattgaccttcatctgttcttcccattttacgggggcctttacaactacacaacagtaagaataagattattattatataatttatttttgtaattacctaatttcatatttatttttaagcaaatattaattttattttttgcatttttttatattaatgctctaaacatttaattttgaaatttatttttcaaaaattcaaatatgtttatttttagtgtaaaatatattttttaattttttaaaattattaaaatataacgatataaataatgctcagatttctgtgaatggatatttgggctttgccactgtgttggaccagggcccaaccatcaatgttggcccggacagcacggattggccacgggtacaagacccagcaatgattgctccatatttatgcaaacagcaggtcacaaattagggtaataattaattaagtatcgaacctaatgctttaaattagagccattatcagggtaattaggcaccaatcaagaggcttcccttaatgatgagtcaagcaacattaaaacactattgaattttttagaaagcaaaaagtggttcggttgacaaaataaatcaaaaaaccgaaaaactttaattttctaaatcgttttttgtcgattaaaatttgaataaaaaccaaaaaaaatcgagttctggtatctaaattgtatccttttttggcccccgttcagatcactcaggacgcaattcctggccttcgtgccggcgttttctttcgtctgatgatgcgccaaagtttgtttggccgtggtgttggcacaaatttgaacgcggatggcacaattatgcaatccgctttctttggacaaccggcaaatcagcaaaaccatttaatttttgttatttttaaaaaaaaattttacaggcttgtccaagcacagcaggctcttatgtacgatgtgatgcgaacagtgactattttttggacgaaatgatgcgatggcttcagggtaatcaaatgttttttttatttttgaaatttttttattttagagggtgtcgctggtgcttcggcatttcgtgcagatgccgctctggtatttattttttttattgttttcattgaaaaatttttagaattacttattcaaattatttagtggaattaaatgatcgactaagtattacattattaaaattaagcaaaaatgaaaaaatatttactaagtaacataacttttcgataatgaagtgtaaaaatctcaaaaagtttaattgcagaaaaatctttttgtgttattttaaaaccctcatatgtcctcactgacactaaaattttttgaatggtttttcaaactgacgagaaaaaaaatgctttaatcggttttggcaatgcaagagttcgcatcttaatctgtcaactctgcgattattttttttgaaatttggcttgaaaaaagcttaaaaaagttttttttcactctataaccaaactttttgagtttttccatttttattcaaaatatcgattttttgtgttactgcctagtaaattattgattttattatgatgcctataggtggtcacatggtacaacacgggctcagccgtgtcgggtcgatcggatttggacggaggacaattagccacttaccaggccatttggttgactgatcagccgggaaggttgagctacgtgatcatcaactatgataagctgggctttgatgctgctgattttcgtgccaactcgcgcagcggacgatgccgagtaagaaatgtcagagagtgaccattaggacacataaaatcgaaaaattttagcagcaaatgcaataaa

SEQ ID NO: 78239 - DNA, 497 bp, Heterodera glycines
  Genomic contig location: Contig_ID=SeqID_14224; Location=537..1033; Strand=+
  SCN-specific regions: Sequence locations=1-88,118-262,285-497
atgggcattgtggcgcggcgtctgctaaaaaaccgggccattcaaaagcagttggaccgtcgacaaaaaagtcggttgaattatgtggaaaaattttaaaagaaattttttttttttcaagatatgaaaacacttcgccgtcagcaggcggcagctggtcggtcgcccattgttgtgcattcggcgggcattggtttgccaaggaccgagccggttcatcaagtaaaaagttttcacatttttttttgtttactgaaaacacttttttttttttttttttttttagcgccaggaaatctgcacagtgcccgcccatgaagtcatctacgacgtgccttttgatggaaaaagagaggaagacgaggactcattctgatggacgattaaatttaactcgataatcatttaactcattttttcatttcctttttaaatttaactccataatcatttaactcatttttcatttgccttttaattacatacttatatggaaa

SEQ ID NO: 78240 - DNA, 348 bp, Heterodera glycines
  Genomic contig location: Contig_ID=SeqID_14224; Location=1887..2234; Strand=+
  SCN-specific regions: Sequence locations=1-348
atgcccgatgaacgtgttctacacctcgagtgctttgagagcggtgattatgatgtaaataattgttgaaaattccatttttttccctcaattttaatccatttcagatgatggaattgtacgggccggaccgtgctaaagagatgctgatcgaattgcgcgactatgctgaggcgcacggaatgccatgtcagtatgtgaagatgctgctgtacaaactggacaaaggactgatcaaatggaagggaaccaagccatgaaatggatgatgagtgatcagatattttggtgacaggacgaaggggggatgattgaactcattggtgatgaatgtgattttaaaaaaaa

SEQ ID NO: 78241 - DNA, 1409 bp, Heterodera glycines
  Genomic contig location: Contig_ID=SeqID_14224; Location=2452..3860; Strand=+
  SCN-specific regions: Sequence locations=1-126,148-1409
atggcgatcaatatctccgacaaaaaatcgttgttcaaccaaatcctcggccaaacggacctcaccgtgacctcgagtggtataaccatcagcggtccccgcctctcgacacctcgcttcatcccatttgatgaagccggtcgttgtagatgctgtaagggaactgagtccgaaattgacactgtgattacgaaagaaggcatcacgctttggtgcacgcgcatagagaaggcccaattcattccgttcgatgtggtgtacgatttgccgggtcattgctttttccgtttgaaaaataagtctcgagtgttcaacataccctacggcgacataccctcttctgacacgcacaccactaaacggccccgcaccaatgactatcatcaacatgagctgaagcgcaaagcaaaggtagctcttgacttagtggaggccggactaatggccgatgccatgcaggacggcgcacgctggaagaaggcgaaaacagcaatcaatgtgctcggcaacctccttttggcggaatcgctggacaccacctccgctactccgctgaaaaatgatgtcgcggacatcaaaaaagaagaagaagcaactgtggcggaagaacacaaagaagatgatgatgaccaacaaaaagaggacctcggagacattgacaaaacgcttgacgatttcttcaacagtattaaagcatccacagcaaacatgtagaccctcattttgtgtaaaaaatgttaaacagccaagcattcagcgataaagacatttgctttaaattaccatttggtctaatcatttcggggccttcgtcgtcgggaaaaactcaatttctgctaaaattcattgccgaatcggaccaattaatcacaccaaagcctgtgtccatgctctattgttttggtgaaatgaatgcggcggtgcctgtgcttcaaaaggcaggagttgatgtgtacgcgggagtcccatccgaggaattgattaagcgcctccctaagcctcttttgctcgtccttgacgacttgatgctgtccgttgatgagcgatacttgtccgatttgttcactaaaaaggctcaccaccatcagtttgcagtggtgtttgtcactcaaaatttgtttgagcgaaagataaaagtggcccgcctgtccgctcagtacttggtactgatgcgggccccaaattcactgctgtccatccgcaacattggcgtgcagctctttccgcgtcagcttgacttttttcttgacgcctaccgtaaggcgaccgcccggccctatggttatctgttgatcgacatgcatgcagcatcggacccatcgctgcggcttcgcacaaatatatttaaggatgagcaggaggaagatgaagggacagttgtgttcattcctaaaaatggagcggcataa

SEQ ID NO: 78242 - DNA, 561 bp, Heterodera glycines
  Genomic contig location: Contig_ID=SeqID_14224; Location=4456..5016; Strand=+
  SCN-specific regions: Sequence locations=1-116,149-561
atgcggcgagagctagcagacagaccggccaaagttgagctcaccaaagggataagcgtgctgttgaggagaggtgctgaagatgaagagggtgaagttgtggacactccatcccgtcctcccccaccaccaccacctccacctggaggacgccctcggctcccaccaagtcctccgggtcgcgctccgtccccaccagggagtcctccgcctcgcccacaacgtcctcccagaccgactagggcttctcggagagacgatcgcctggagcagtgggagaaaaggcgacacgatatacaaagacggcgaccggttgtgcgggaccttcttgcggaagcagctgctgcccccttaccggaaagttatacagatgatgagtacatgttggagagtgggttagcgctgccaacaccatcccaatactatggggacttgcctgtggtgccataccaacatcaaattgagcagatggacactgctgctgctcagcacaggattgccatcagaagaaaattaaaaaaggacgaagcatatgatgattcggaccgcaaaaaatacagg

SEQ ID NO: 78243 - DNA, 2298 bp, Heterodera glycines
  Genomic contig location: Contig_ID=SeqID_14227; Location=679..2976; Strand=+
  SCN-specific regions: Sequence locations=1-154,176-366,388-836,858 -1146,1168-1973,1995-2201,2223-2298
atgattacgagatcacccccattaacacgacagcgagctctaaaccttggaattgaactagacaatggcggaaagcaaattttggaaagagtgaatccgaattcgaaccagaatccctctctaagtctagaattggggaatggtcacagagaaatggttgatgatggtggtggtttaggacaaagccgacttttgaacgaacaacaactgcgaaatcgtttgctgacagtgaccatgctcgacaacaacaatccagtcgtacatgtaccaaatgaaaatgtgcagaaccaacgcattgcaatgaatgctccgcttgtcaattcgggtatttttggctcaaataacgggaatgtgggtgactattctgaagagttaggaggtacacgaattttgcaaaatcgaccaaacagtaattcgggtgcaatcaatttgaataatgcggaaatgatcccaacatatccaccagcactcgcatcaacccctgttgaaaattttggcaatttggcacgaaattcggaaaatgaaaattttgcgttcatcgagcataacgaagtgcgcgcacaatacacgcagcctcggagtactgaaaacattaggcctatttttgtgcgccaaacagctattcattcgcatctaagtgctatgcgtttaccacccatccaacagccggttgtggcaatagatttccctgagcagtttgtccagagaaatacccaaactaacatgccgcaaccacctttctatggcaatcaacgccaaaatgaaaatttgcaccaaaatttacaacgagttgctggcaacgaagtacaacaaagaggagtgcatataaacccaggaaattttccggaaagggttaatgctccaaatgccgatgcttttcatatgcgacgggaaatgcatgatttagttctgacacaagcaattaaaagcttggataatttctcttattcaatgacgttgaattcactcccagagctgaaagggaatacaggctcagatgcggttcgagcatttttccgtcattttgatgttgcaactgaagaatggccagaggctaagcgccttagcgcacttaggtcaaagtgttcaggccgtgctgaacgcgctttcaatgtcgccgtctcgaacaatccatttcggtacgagaatgttaaaaggtctatggtgcaacaactggaagagacggatgcgagacaaatgtccgcatttgacgagcttatgtcagggatttctcgccgaaataatgaaaggattgacgatttggcagatcgggtctcttccctagtcagaaaggcttaccctggcttgttggagcatctttatgatgattactcaatccgtcattttatcagagcacttcagaaccccgaacttgcactcactcttaaattagcccgtagaccatcaatgatttttgatgagtttgtagcattagctgctcgggccgaagcaactcaaaaggcgtcaaagatttcattgcaaaaacaacgaaatataccaaatttccaagaccataatcagtctgttcactacaatccccggccaatgcaacagactttccgcaatgaaaattttccgcggatcagtcagagtcaaaaccgacaaaattgttacaattgtggtcgtttcgggcattttgcccgacaatgcaattacccgcggcaagttagaactgaaaatgctaacattggtactccagcgactggtgccaacaaaacatcagtcgaagtgcctaaagacacgtcacagccacaatacaacaaaccgctaccgttttcaagaaattatctccgtcaaaattttcttgttgaacaacaagaaaatcctccaccgacgtcacaaaattttttgattggaggaatttcaatgagtaatgatgaattggagaaactttttgaaagagacaaaagcgttgaagccggaaatagtcgagcaaagttgttgaatgtctctgttggtaaaatcatggtcattaaagtttttgtttgtgatttatcagccacggccatgttggacggaggagcacaagtttcacttgtgtcctttgcttttttctcgaaaattatgactgagaaaaacatcgataaaattctactttgtccgacccgcgaaagcactcaagttgttgacataaacgggaaaacagtagagtatgttggagttgtgtcattaccaattgtcagaaaaaatactaaagtttggatcagatttcatgtgacaaatgcgtcatttggttatgagtttctttttggcaccaatgcattggcgcgtctggttttaagctttatgacggcctga

SEQ ID NO: 78244 - DNA, 1438 bp, Heterodera glycines
  Genomic contig location: Contig_ID=SeqID_14228; Location=258..1695; Strand=-
  SCN-specific regions: Sequence locations=1-288,310-700,722-850,872 -1177,1199-1438
atggaattgtcaaaatatttgcgacaagaatttgaatttgctcaaattttcggaatttcattgcatttgcaggagataaaaaagcattttgttggacaaaatggacaattaatggccaatgatatcgaagcctcggtaaatcggaagctgaaaaagcattaaaaagccaaaataatttaaaatattaacgtttagttggattcattcatttcaaaaaatggctttgggctcatagaaaacgaacagaaactcaaaattgaagaggcaattagcgaacttgaacaaattataaggaaatgggtaaggtaattaagaagaaaagaaaacgcttctcaaatttaagaattccatgtcgaaacttatcgtcacgggcgcctaccaattgggcgcactcaccaaaaagtcggacatcgatgccatttgtgttgtgccagaattgccctcatgggaagcggcacagttttttgggagtgcaaaatgtgaaattcagtcgaacggcgacagaaaatgcgccgacaattcactcttctgccatctctgtttggtgagtgtcaaaaaattggggtttaaacttaaaaaatacttctgctgagatcagtgacgggcgaaactttgggcttcgtactttaaagcccaatcgattttttgggcatcgaacttcgagcttcgttaaaatattcgaagttcaaattatgggctcaagaaagaagaatgacacttttttctatttttcaaaattgcagaaaatttgtaacaaattagaacaaaatttcgaaaactttccccggtggcgcctatcggcaccccaaaattgatttttaattttttaaattgattcaaaaaccgcgaagcattaagaattgcaacaaactttttcgagtttcagaaaatacatattgatcaaattcaatgtgaaattacggttattacaaaagtgctagtgcttgggcaaaattaaaattccgcgcccatcgtttaggtggcaaaagtggcgaagctcaatcggacgccggacgcgtggatgccgctaattgagttcaaattcgaaatcagtccgaacactttcgttgcttttgacattggactcaccaccttcgcaccccaagaagaaatttttaaaaccgaagaacgaataaattacgaacaaagtgacgcattgtcagcgaaaatggccaacgaaattggccaattggccaatcggaggagagaatttattacgaagggtggaggatatgaggaactgaaggaaatgaacaacgaggaggagaagctgagggtaaagctcagatcattggcaggtgattggcggtgcttaattaagtctgatagcgacgctaaactttttgattacggaaagaaccccccagggggaattgcctggggctatcttttagttgggtttctatattcactaagccttaaaaaataattaaataaa

SEQ ID NO: 78245 - DNA, 655 bp, Heterodera glycines
  Genomic contig location: Contig_ID=SeqID_14229; Location=98..752; Strand=-
  SCN-specific regions: Sequence locations=1-598
  Gene Ontology: Mol. function=structural molecule activity; Cellular component=cytoskeleton; Biological process=spermatogenesis
atgcgaattgatacatttgtgggcgaagtagaaaatgtcagcgaaattttcgacctggccgaaaaatgcaaagaaaaatttgcaaatttcgaagaaaatgtcaaaaatcaaaatgaaaatttcaatgaaaaaaatgaagaaaattactcggatgaaaaagaaagaaaaaatggaaataaattgggaaaagatgaagaagaagccgacaaaacaaaagtttttgatgtggacgaagcactgaaatatgtgaattcggaggagaataatgagggaaaagataaaaagaaaaaaaagggaaagaaaaagccaaagccaaacaaaatgccatcagaaattggcacaaaatcggaggaagaaaatcaaaacgaagacaaaatgccaatgaatggaatggaagaaaaaaagttgaaaaaagtcaaagtgtcagctgacagaattccatcagaaagtaatttaagcgaaaaggatggacaatttgttgagaaagaatcttatgcaaaattaatgccaaaaacacataaaaatgatggcacaaactttgaaataacacaaaaagaaaacgaaaaagacaatggaagcgaaggagaaacaatgagagaaaaagaaaaagagaaaaaggaaaaaataacacaaaagaaaaaagaaacaaaaaaaa

SEQ ID NO: 78246 - DNA, 1204 bp, Heterodera glycines
  Genomic contig location: Contig_ID=SeqID_14229; Location=1569..2772; Strand=-
  SCN-specific regions: Sequence locations=1-110,134-225,247-499,521 -1051,1074-1093,1123-1140,1162-1204
atgccagaggaagcacggattataggagaaagtgggataaagaaggacatgggtcaaaagggagcggcctccatagctcagtcggttcgagcattccacggtatgtaaaagccgtgtgttcgaatcccaccggacgagttaccttttatgttctataaataaaccaaattttaataaacaattttggaaagggcttaatctacatatgccgatgaaaaaaaggctgattgtacaatttttatgtgtgtatttagacggaatccgtgcgcggaaagcgcgaagcattcagggcctggataacgctcacaaatttcttggtaagaaaatttggcccattttttttttgctcaaccaatggcatttgcacatttttcacacattctcgcgcaggtggaatcaatgcgggttgcctacacgcagcagttcaagcgccgatcattgcatcgtcactcgagcagttcacaggtggggggaagtgccgaaattcatggcatttttagtggaaattccacactattttaaatcggaaaatctcgtcaggattttcatggaatttttttatggttttttttaaattttttgaaattggcattgtgttaattttttcgcattttctttgcaggtggttgtccagttggccacgctggaggagctgtcaccgtccgcgcagtcgatgatgtcggcacggcatcgagcgcacacgcccacagtgccattgacgaccctttgatcgactcacgaatggattgatcactctgatcacactgatcactcacatattaatgtaaaatctgatcacacactctcatcttgttaactgaacaaatgagtgatgaaaggcgcggttgtaggtggtataatcactactgtaatttgtatgtaattcgattgacttgcagcagaacagacatttgcagcacaagttacacaaaaattctaattctttttttacaaattaatatctctccccaccagggctgggcgaagctcggcttagcactcgaagccgaaggcgaagcccaatttttattcgaagccgaagccgaagctcgaagcccaaaaaacccgaagttttcgaagccgaagttttttcaaaattttttttaattctaaaatttttttcatcacataatttcggttaaatatcaaatttaatcaattgacgcagtttctagagcccaaccaacccttttcgataaataaa

SEQ ID NO: 78247 - DNA, 6710 bp, Heterodera glycines
  misc_feature (2724)..(2724): n is a, c, g, or t
  Genomic contig location: Contig_ID=SeqID_2170; Location=1114..7823; Strand=+
  SCN-specific regions: Sequence locations=1-47,69-545,567-590,612 -635,717-910,934-1108,1204-1227,1281-1285,1317-1408,1498-1610,1640 -1856,1916-1924,1954-2074,2121-2179,2204-2702,2769-2942,2964 -3064,3086-3214,3239-3352,...
  SCN-specific regions: Sequence locations=...3374-3388,3410-3869,3934 -4240,4262-4328,4392-4444,4478-4545,4582-4584,4606-4643,4665 -4767,4831-4840,4862-5355,5389-5407,5502-5528,5574-5618,5642 -5761,5789-6040,6066-6198,6243-6426,6498-6710
  Gene Ontology: Mol. function=protein serine/threonine kinase activity; Cellular component=nucleus; Biological process=signal transduction
atgccaccggaaattgtacgtcggcaacccgaagtaaaaaactaatttcaagaaaatctcaaaatttcaaaaaaatttccagggctacggccaatgcgcggattggtggagcttcggtgtcattgcgtttgaactgctcaccggctgttccccgtttacggttgacggcaaccagaactcaacggaggacattgcacgacgcattttgaccaaaaaagtgccatacccaaaatggatggaccgaacggcgcgcgacttcatcggccaactgttgaacagggacccgaagttgaggtgtgatcaccgattaagtctgatctgtcattgatcaagaatgatcaaccactgatcaacaaatgattactcattgatcaaagcatgatcagtcactgataaataaggatcagccacagaccaataatgatcagccattgataaataatgaacactcactgttcaagtataatcagtcactgattactgaagtttgagacatttatggttcggatatttgtcccggtcaatttcctcaaaatttaaaacataattaaatgcaaatggggctcaaatgccaagggctggtttgatctgaaagaatattgaaaaaatgatcagaaatgttttttacaaccttagttatacattgaattgaagagtattaatgttttttttaaattcatttatttatcctaaatttcattataattttttatatacttccatattttaatcaaatgtaaaaaattcatattccccacagacttggcgcccggggcgctgccgaagtgaagaagcatcacttttttgacggcaccgattgggaggcggtggaacggcgtcagacaaccgggcccatcaagccgagcatggccggctgtgttgcggacgtggaaaactttgccacaggcaataaaaattattttttgaaattttcaaagaaaattttacagaatttactgcccaagcaccgctgttctcgcctgcggataaaccaccaccggaatgccacacattcttcagcggctactcctttgtgtcgccgtcagtgatttttgccagcgacaatgtgatcgggcaggagtgcctggagtcaaggtggcctccggggaattttttttaaatttttgatttgatttacatttcaaaaaattttcttaaaaattaatttcattttttaaattcaaaaattttaacttttaaattcttacatatcggcccgattaggagaattaaatttttgaattgattgtttaaaatttaaaaaaaaatttaaaaattttcttgtcagggattattccatttttatagtaaaattaattctttttttcaatacattataagccctaaatgtttgggaaatttttttaaatgaaaattggaaatagaaggaatttttcgacaggctttgaaaattaaaaaatgatttttttttttttttacaaaaaaattcacccattaaaaatttattcaattttttaaattcaaaaattaaaaattctaacatctcggcggaacaattcatgttattttaagaaataccgtaaccgaatgagttttataaccgtcactaccgggtgctttttttaccataataaatttcttaccgtaccattaaaatactaaaaatatttaaaattttgtcacagtgttcgcctcctgtccgcccagtcgtccccattttttgccaattatcggctggacatcacggcacagggactgctcggcaaaggctcattttcaatttgtcgcaaatgcgaacgcatcgcggacggacgacaatttgctgtcaaaattgtgtcgcaacgtttcgcgcaccaagcacgacgagaggtgattaaataaaaaagcaaaaggagataaaatttgaatttattattattattttttaaatagcaaattttaattaattttttaaccctcttgtaaaagaaggttttaaaaatttttgttccactttttattgattattcatttttttaacttaatttattgatcactcatatcacttttaaaagtgatcagtagtccgcaaaattttgcatgtgtacgaaaaaaagtgataattgtttatcccaaattaatttaaaaaatcataaaaaaaaaaaaattaaaaaaaaaatgcaatatgcaaaaaggaaaagctacatttagcgatttttgaattatccgattcgttaaaatttttattttttgtgtattttagaaaaaaaaaatgtttaatggataaaaacccaataatttaagcgcataaatccaacgggcaaatacaagattatgtatgtaaaatccattctcaaaggatatctccaatacaaatttggtgtgatgggagccaaaatttataggaattacattggcaaatactcttgcccattttgtgccaggtccgcgtgctggaggcgttgcaaccgcactcgcacattgtgccgttggtagacgccatgtcggacgcctttcaccattacattgtgcttgaactgcttgacggcggtgaactgttgcaacggttgcgacgcatggaaaagttcacggaattgcaagcggccgaaatcatggcacaacttgttgctgctgtcaagcacatgcacgaccgagacattgtgcacaggtagaaggaagaagcattgaaaatttaatcaatcagaactggtcaatttttttaaatcttttttttgatgggattaggaaaccccgtcaaaaagtataatttaaaaaatatataanatatttactattcattattgtcctaatataataattaaatataagtctgattagagtaaaatcacatcagcattttgatcattttccgatcatggtcaatagtttggaatctttcttttatatagattttagcggaattggaaatcggagttccaatgccttaaaaaaaatatcgggaatttttttgaaattttaatcaattttcttaacaaattgcattaaaattctcaaaaattttcccggcggcgcctaccggcaccgccggaccaccattttaccatatttttgaaaaatggagaccaaaatggcaaaaaatagtaattttttggcaaaaaaaaacggctaaaaattttgtaaaatacacccccccccctaatttgggatttcaaaaaacgaaaaatacacccctaaaaatcgactgaaaaaagaaaaatacacccctaaaaaaccaaatttttgactttagccccccccccccctctgaagccaagggtctggctacgccttttggttggataagactgatcagggagctctatcatttcagcagctcaaattttgctgtgttaatttctaaaagttagaatttataattaaacattaagctcatcagcattaagctatcctgttttaaataataaatatatttgataacattttcagggacctgaaaccggaaaacattctgtttgaacgtgatgggcccgacgacgcaaagccaagacttcgccttgtggacttcggttttgctcgcattttgccacggcctgccgccatcggctcaacaatgggctcccaatcgctgatcaccccgttgtgcggcacgcttcactacgcggcacccgaagtgttggacattgaagacgaattaccccaatacaacgaggtgggcgggtgcgaaaagtgatttgatcaaatgaaaagataaactttgaacaacaacttgatcaaaatgagtgaaaaattaatcaagggtttgatcaaaatgagcgaaaatagattagcgacttgatcaaattaagcgacaaaatcgatcaatggcttgatcaaaacaaacgctaaattggttaatgatttgatcaaaatgagcgtcaaattgaacagaacttggccatcattaaatcttttttactcgtaaatggatgatttttaaaaaatttaggtatttatttttcatttttaaatattataaaataaattaaatttttactcaaagccaaactatggcgattaaattttatttgtatgttgggattttttggatttttgtcagaaaatttttttataattttcttcattaccaaatgtttagcaatgcgacctgtggagccttggcgttgttttgttcacaatgctttctggcaaagtgccgttccatgcgaaaagccaagccgagtcagcggcggaaattattgcgcgcatccgtgccgcggatttctcattttcggaccccgtctggtcaatggtttcacaatcggccaaggatttgagtgagatttttggccaattatttaagtgttttattttggttggaatataaacaacattttgttggaaaagaaaagttacttagagaaataaaaatcacacccacacaacggtctcgtggtgtagttggttatcacgtcagtctaacacactgaaggtcgccggttcgaacccggccgagatcatttcttttttcaatttttttgttttttgtttggaaaagcggaaatgcaatttataattatttttttaaaaaacttattttgttatttgagcttaataaaaaaaagaataggtattagcatatgatatttttttctcctaacgaaatacaaaatttattaaataaaaaattttttaatattttttgttatttcttacaaaagaaattttaagtttttgagtcgtaaactatttttttaaaattacagtttgaaccaacaaaagctttaagcctaatgggaagaataggtggtggtacctcgttctcaaaataaaatacacaatattttttccggcgataaggaaaaaattagagtcgagcaataccggtctcgtggtgtagttggttatcacgtcagtctaacacactgaaggtcgccggttcgaacccggccgagatcatttcttttttaattttattttaatacgctaatttttatttcctaataaaaaaagccaatttaaatttgccactttttttacagtcaccggactgctaacagtggaccccacgcggcgcttgtcgttggcccaactcggtgcccatccctggctacaatcggtctcaacaaccaccgatgacggcactgtgccggacggcggtgccggtggtggcggtggcaccgaattgccaacaccgaccattttgccgtccagcgctgacgccacatttaatgccactctgtccgcctttttgcatgccaatcgggacggctttcaactaatggatgtgcagaccgcaccgctgctggtcaaacggcgtggcatgaagcggcaacgcggtccggacacaacagcaacaacagcatcgggaagcggaggaaccgcggcaggtggcgtggcattaataaggaaaaaaagctgcgggtgggaagacggaattttctcgaaaaatttcttttttaggcgtatttagaaaagttaattttttaaaaattatatagaaaaataattctctgctcggggtaacctgaaatttttaaaaaaattacataattctttttcaaaaaaaaaattttttttttgttctcaagaaaattcaaaaaaaaatttattaaattttttatcaattacaaggtttttcctgaattctcttattttttaaaaaatcattaatttttttctttttttgattttttcttttacttttcctaagaaaaaatgtattgtattgttaaagaatcaaaaaataaatttaaaaaatttacaaatttggcaaaaattgactcaaaaaaagaggaaaacagttcatctcatcaatgcatataatgtttaggtgccaacgacggcggtggcattggtgccgagagaatggagcagtgcgcggcgaacaacaccaacaacaacagcatgacaacggcgacgacactttgcactgtgtcagaatgtccagaactgacaatgaatatgaacagcagcggcggtgatcagcaccaccagcaacaaaaatttaaacgacgtccaacaacgctgaatttgttcggcaccatcggggaggtggagcagcaacagcaacaacatgaacaccaacaaccgcagggcacgccaaactcggcggcatttaccgagtatcgggtaaataattaatgggcgggcgaataatcagatttttatttaaatttatatttaatcgcattaaaattagttttttttggagggctaggttgtttcgtgaaaagtgccaattttacagattttagcgagaaaacttgtcaaattattcgtataataaatacgataccttttggatgctttcttagcatgaaaaatttaaaaaaacaaattaattacattttcaaaaaaattatgactaaaaatgctcaaaaaatgacatattatttcctcgattttttaaccagattttcagcaaaaaaaaaactagttttggtgaattttcggaaaaatttcgtgaatttctgaatttttttggggaattttagtggtagaccttggaggagatagtaccaagaagaaaaccgaaaaatttttagcaaaaaaattttttcctttaaaatattattttttttttaatttataattgtttaatcgtatttaaatattaactttttgtataggacaccaagccgccctatttgaagtacagtcgtgacgattttacgcgtgccgaatgtggcggaagtggcgccactgttgaacagcagcagcacattggcggcggcacacccggcatggccaatgatcagtcaagcgggtgctcatcactgtctggtgcatcgacaatccgactgtccaacgattcgaatgagtcccaatga

SEQ ID NO: 78248 - DNA, 1221 bp, Heterodera glycines
  Genomic contig location: Contig_ID=SeqID_14230; Location=69..1289; Strand=+
  SCN-specific regions: Sequence locations=1-14,39-155,177-204,246 -252,275-446,468-913,936-952,988-1102,1125-1221
atgattaaagtaagtcatttaaatttttgaaaattaatcacttataaatacttttgatctaatgtaaggcaaaaatctttttcattttgcaattaggataagccaaacgaatatttagatttgctgcaaaaaataggcagcgattatttcttattttccaaaaattccaatttttgtcactgatgaattgagttatcccatttctaattatttaatttacaaaaaatttatttctaattatatatggttcaataaattatagtttaaaaacaacggcgaactcaaagtggcacagatttacccactttcaatcaatcaactcattgatcaggagataacagtggaacaaattgccacaaaaatccgaggaaaaagcaacgatttgtgggaggggcaagtggccaaatgggcaaaaaaatgggtgggaacgaaggacaaaatcagcgagaagaaaaaggcaaagggcaataatgggaaaagcgcgtacttctccaaattctatgacagtctgagaatggaccgtctcgtgctgttggccaacaacattcgtgaagcatcgataaataaggtgggggccgggtcactttggcgcgggatattttggcgccgcaaagtttaaagtgttcattctcttttctatgaaacgaagaaatggcattcggcgccaaaacggccagaaaatttgaattttttgaggtttttggccataactttttttgtgtctaactaaattttttgaaattttgcaggtggttaggggacctggatacccggtttttcaatatccggaccatgttttttgaaaatccaatatctggtacccgacccggtaggtccgggtctaaaagtacactgataagaatgggggtctggtcaaattgttaagcaaagttggaggagaaacatacaactgtatttaaattataattttatttgacctcgcaataacatgaatataaaaataaactttatttgtagaaatttactgatagtactgatgtgatcgaaatccttgtcacgacaaccaatcaggaaaaggacaagacggggattagtgagacattttgtcacaaattagcccaagaaaacgaagtgtccggcaattataaacacattttgataccgttatgcatgaacaggcgcaacgaagtgttcagagaagatgaagaagtgatcaaccaaacagacgaaaaggcaattttactgagaaattatgattag

SEQ ID NO: 78249 - DNA, 938 bp, Heterodera glycines
  Genomic contig location: Contig_ID=SeqID_14231; Location=299..1236; Strand=+
  SCN-specific regions: Sequence locations=1-178,200-262,286-300,323 -339,372-902,925-938
gttattgaacgattaaacgaaatcgtcaaagatcctcataacttcgcagaattgaccgaaaatgaccttttggtgaatgcgctagtcacttttagttttcccaaattgcgtcacattttcaaaaaatacgaagaaaaatatggggaaaaaattgaagagcaggtggacaacgcttacatcaaagaattcaaacatttatcaaaaaaccgaataatgaatctacttaaactggaccttcatgtcgagcaacatttttgggtaattattttttgtgttaaattttttgatagatgcattatgtatttgtttagcaaagttaattaattaaaagagattttagaaggaaagaatttttaaaaaatgtgaaattgctcacaattttttgaaagattcatcatgcatttgtttagcaatttttcaaaattttattcctttcgctttttagctttttctcaaaaacttttttctgaattcggaaaaattttcacattgcaaaaaatccttgagtctgacccggacgaaataattaaatttagcaaacattgaacgcaatcttaacggacattcaaggtcgcccatatttttttgcacaattattgaaagaaaagcttgacaaattgcgaggaaacgaaaagtgggcctcagcggacgcgctgaaagacgtgacgcgaattttgctcactcgcgcacccatcgatttggccgacattgaccaggaatttcagggattgagtggcagcttgaccataagaatttcgatttcggcttacatcgagcaaattatcggattcgaaaaagagaaaaagcaaaaaaagggaaatgtttttcgaagcttttccatacgttcaaaatcgcacgaagacattggcaccgccgttagtagcgaatccaatacggcagcagcagaaggaaagccatcgcagaaaattgaactttga

SEQ ID NO: 78250 - DNA, 1330 bp, Heterodera glycines
  Genomic contig location: Contig_ID=SeqID_14232; Location=676..2005; Strand=-
  SCN-specific regions: Sequence locations=1-127,163-363,385-506,541 -847,869-969,994-1330
atgccagtgttcttcctttacttctctcgaacatacatcggcttgacacagcgccagttgttggatggtgttaacgcatttggagataatccactcaatttttcacccattggcaatcattgtttgtttaaatttatgcattttatttccaaaaatttaatttttagctgcactcgggacaacaatttcgaccatcaattcggaacacagctatgcggctaccccaatacagttcggcatcggcaccatcaactcttacgtggccaaccactgtgagtccacgggagcagcttgttcaatattcgttgagcccgctaccgactttgacagctccttcaggcaaaatctttaatcaatcatccgtttaaatttaataaaaaaattcagttccagcgtgggaggacgaaatcgttcgtgcgccacattttccaattccgctttggaacatgcactcacaggcaacatctgccctcgctcgtacaaacaacggactggaggcaactcatcttcattttatggtctttaatttattaaaaacaaattgaaaagaaacatttagaaaggcctctgtcaccaccccgccctctcggacttcatttgtggggttaataaaagcatcgacagacaggtggacgctgcccgatctgctcgccatttcattcacaagcgacacaaacgatacatcctccaggatgctgtcattatgcgaattttggcggacgcgtcgtacaacagcaatggtgaaattagtgatctgatgtcggcgcttggtctccaagttgaaggatatgcgggaaaattgagagattttaaaaattacgatgattcaattgtccatgttccgtgatgattttattgaatgtttaataaaattatttttttcaatatgtgaagctgagggtgtgtctatagagagaattcggatcacaataggagcattaaaaatttgttcgaattttggtcgcttagaaattaaaattttttcctatttcatggttatatttgtgtttagggttaggcaaggggctatataaatgtcgtattcgtattcagcgaccccgaaaagcctaaaacagacccgttttccggctttttatgagctttttagacttttggacaattcgtgggtttttactcttttggacaattcgtggcttggacaaaacgtggcttggacaattcgtggcttggacaattcgtggcttggacaattcgtggcttggacaattcgtggcttggacaattcgtggcttggacaattcgtggcttggacaattcgtggcttggacaattcgtggcttggacaattcgtggcttggacaatttgtgg

SEQ ID NO: 78251 - DNA, 396 bp, Heterodera glycines
  Genomic contig location: Contig_ID=SeqID_14234; Location=1361..1756; Strand=+
  SCN-specific regions: Sequence locations=1-9,52-53,75-315,387-396
  Gene Ontology: Biological process=coenzymes and prosthetic group metabolism
atgattcaaaataacattactaatgacaacaacaataacaataataataatgccccgaataatggcaataatggcattttcaaccacattcatcaccagcagcccacaactgatgaagcaaaacaactccgtgccaccaatattgggctagccgagtgcttgaagggtggtgtgattatggatgtgatgaatgcggaacaggcaaagattgcgcaggaagcgggtgccgttgcggtgatggcattggaacgcattccggcactgatccgacaggtggtgtagataaaaactgagaaaaaaaagaaaattttgtgctaaatttttataaatcattttttttattataggaatattaaattatttaaaattaagatatttatatttttctcgttcgaa

SEQ ID NO: 78252 - DNA, 1061 bp, Heterodera glycines
  Genomic contig location: Contig_ID=SeqID_14235; Location=1..1061; Strand=+
  SCN-specific regions: Sequence locations=1-50,135-276,336-358,389 -566,588-595,618-625,654-722,754-865,887-1061
  Gene Ontology: Mol. function=protein binding; Biological process =coenzymes and prosthetic group metabolism
cggtcccggtttgcccaagattccgggtcccgctcaactctagttaattcattttgtgagcaatatgaaagttaataattaataaaattaaaaagtatatattaatttaaaatcgattttttaaaataaataatgaacattccaaaattaaaaataaaaatgtttaggcagaaattcggaatctcacaaagatgaatgaagaggaactgatgagctgggctcgtttgaacagtgcaccaattgaattggtttttcaaactgcacgcgaaggtgggcaattaaagataaattaattatttaatttttaattcatttttattatattttctttaattggccattttttgtggctttttgcaaaaattataattatttttcaattttttaagggagtttgccggtgccaaactttgctgcaggcggtgttgccacgccagcagatgcggcattgctgatgcagttgggtgccgaagcggtgttcgtcggttccggcatttttgtatgttggcataaaatgtcatcatcgaaatttttgttcaaaaactttatgataatgtactaacaaataagaaaaattcttaattttttcagtaacttaaaaattaataaaaaaaaatcccaacagaattttaaataattattactataaaaaaccgaaaatttccttttattttttacgtaattttcgtttgtttaaggattttctatgaattgaagttttgttttttttaaatttattctaaaatttttattggctttctgatttttgttgcattttgctgccaaagacaaaaaaatgccagaaaaaatatcaaaattttttttaaacatctcggaggggtgagtaataaataaaaaaacgataaattttaaaaaccatttaaattcctaatagatgagcgacaatccggcaaaacgtgccgccgccattgtgcaagcggtcacccattttgacaagcccaatgtgttggcaaaagtgtcacgcggcttaggcattgcgatgaagggtatggaccgtgttggtgccggaaaaacggtcacattggaacaataaaaaagaa

SEQ ID NO: 78253 - DNA, 2257 bp, Heterodera glycines
  Genomic contig location: Contig_ID=SeqID_14236; Location=338..2594; Strand=+
  SCN-specific regions: Sequence locations=1-462,499-581,604-751,798 -921,983-1019,1041-1140,1163-1595,1617-2193,2227-2235
gctttccacgtgtacccaatatcacatcagtcggggtaagtattaattacaattaccgtatacttcgcatatttactattcattttctgatcattttttctttgtcaatttgccaaaattcgtaaacaaactttttggaccaacattcttgaacaaaaagagaaatgttcaaaagatcataaatagggcttccttttttaggcaaatgcctaaaattttgcgcacttgatacgcaaagataagcacgaaaaacgcgttttccgcttggtttggggtgtctacgatgacttttataatgcctatttcgtggtttttgtgcctaaagtgcctattttaggctttttgaaaaaatccataagaaaaatgcaataaaaacgaaaaaaccacccctaagaaatgaccctaaaaaatttcagaaaatacacccttaagaattgagaaaattttcaaaaaaatgatcccaaaaatttaatatattttttcttaataaaaatttttggtttaaaattttgtccttatttaataatttcatttacaattgaaatatttaagtttttacttgttttaataccaaaaaagcgttaataaaaaaaaattttttttgcctattttagggtttttgtgcctatttaatgcctattttgcgatttttttatgcctaaaaaaggaagccctaatcataaaatatgacaaatgaaaaaatgatttcactcaaaaatattgtaaatttcagtaaaatatgctaaaagggattattatatacattaatttttaaaattctttttgaatattttttaggaaaaggcgtttctattccaagatgcgaattgtggtgacaatcccgaatacaaagatggtaattaattctcgatattggttgaaaatagcttagccttcttcccagcgttttattcttaaccgaattaaaatatcataaaaattaaatttttattcgaaattaaaaactaatttaagatttattcatcaatcatttatccttttttattttactattattctctgcttttgttattttaaagatagttttgtcaccccggtgtccagctgtcccggcggaagttgcatcgaaatgttggtcgtggcaggtgggaaaaagctgtggtgctattagccacacagaaaaaattatatattatatttagcacttaatttttgcgtaggggatgccattttgcctggaaagaaatcggcatttgccaggatttggaggtcatagttcttacgttcgatggcacccataaaagcttgaaaagccgccccccccccccctctaatatatcctccccgctcctaagaggaggtcgaacggtgccaggtctttactcaaaaaccatcaaaatgaaaattttgacaaaaaattatataatcttgatattattcgaattagccctaaatgttctattatcttgcaaaattaaaaaaaaaattcattaacattcaaaaatgttatgacctgagaaactcaaaaaagcaagtttttttgaacagttttggtcatgacataacttactttaaacttaactaaactttttgaaattttgcaggataatagaaaacacatagggctatcgaatgatattaagaattaaaaatttgattgcctttgagtaaagttatatcaaatattttttgattttggtggttttttgagtagcgcccattttgatggttttttgagtaatgtcatagcaccggtcgaacaacaggagcccctggggctttataaaagaaacaccggtttaaaaaaaaaaggattaccaattttcgtacatttaagacggcatttactcggtgctgcgcggctgtctcagcgactttttcgacttcccaccctccaacggagaggagggctgcacctgggggctgtcctcggagaatgcgctgatcgccaccagcgaaaagggcgaattggtgcaaaatgtgcgagtgggcgtcaatctgtgcccggcaaaagtgagacggacaaattgccaaaaattaatccgctcacatcaaatagtgtgaactggaattcaattaatggagttaattaattagatagctgatctgattgattatgctgctaattccagactttcttatcgcgtcagtcatttttctgctctattgcagttttatgcgactataaaataacatgactagggctgccaaaaatatgtacaaaaagtggtccaaatatgtacataaatatgtaagaaaaatcccaaaatatgtacaaaaaaccccaaatatgtaa

SEQ ID NO: 78254 - DNA, 989 bp, Heterodera glycines
  Genomic contig location: Contig_ID=SeqID_14237; Location=267..1255; Strand=+
  SCN-specific regions: Sequence locations=1-227,249-463,567-961
atgcaattcgttgttgagaccctccgtggaatatgcccagggcaaacagcaaacggacgcttcgacgagcgccgccggcaacgcttggccgtacagctgccgaaaatcgacatcaagtgaagcatttaatatctaaatgagaccagcagaaagtaataacgcccaattgtcagattatatcatgaaagcccttttagagggaggaaattgccaaaaaaggataaaaatttgattaaattaattgcaaaattatgaaaaaatattaaagtggttcaatgcttacaatgctcgcgctatgattgggacggcgactgtcactggaactaccgggagtactgtaccggggcatggtaattatgcacagaaaatttcaacatactatctgaatatgtattttcagaagataaattaaaaatatttaggtgcacaaaaacaattggatatgttaacggtgtgtttttgcattaaatatatttttgataatttataaaataattatttatataaatgtttcattaatctgtttaaatttacattttaaatcgttaattattcatattttaattgtctttttaggtcgttggcttgagcagcgcggctgtgccccattcaatccgttgaacagccaaatttgcacaaaagtcgagacgaatgccgcgttatcagagcttagcggacaaaatattgacattgtgcgttatgcactaaaaacggcaattagtcaactaattaacattaattggctctcgattttatctttctttttttgccaatattttttttttcattttttagcatgtgagctccgaacaatgcttttgcaatcagaaccgatgcaacggcacttttacaccaaaaacgctgactgcgctttctgtgctgtggccgcttatgttggcatttttccttgtgaagaattattgaagtcgcatttcaaatcgatgacaaaatggcattttggattatttttaaatttttgttttataaaa

SEQ ID NO: 78255 - DNA, 724 bp, Heterodera glycines
  Genomic contig location: Contig_ID=SeqID_14238; Location=42..765; Strand=-
  SCN-specific regions: Sequence locations=1-724
atgagcagtggagaagatcgacaaatggaacaggaggacctgcaacagtcgacggtaattaatgaataattagcgggacaatggtgaagggaatgaaacattgcaaaatgctgtgccaatggcactagaatacggagacgcttttgtttattgttttagcgaattgtctttgctctataaaaaaaacttggggaaatattgatattttgaattgtactgcaattctatgttttcgtccattcgcaggttggaacgggcacaaaacggaagttggcagctcaggccagcttcgacgacgatttggacctggatggattcagtgagttggacaagttggagccggcggtcgctgccgcagcagggtctggcgcgaatgcagagcaaacgaacaacggaggcacaatgttgcagaatggcacggtttgtttttcaaaacgccaaaattttcattttttgtttacggatgtaatgtttattcgttagtttgttttaaaatgtttatttctgtcactgtttcacctccactttggcagatgatgctcaacggtggcatggccccccaacaacagccgccccctccgccgcattcgtcgagcagttcaaccgccggagggacaccgcaacagcagcaaagtgtgttgcaggagttgctgctcacccaatcgaccacgtcggcgacgatgcataacaacagcccgaggccgggcggctcttttgcaacaaa

SEQ ID NO: 78256 - DNA, 3490 bp, Heterodera glycines
  misc_feature (3362)..(3362): n is a, c, g, or t
  misc_feature (3432)..(3432): n is a, c, g, or t
  Genomic contig location: Contig_ID=SeqID_14240; Location=947..4436; Strand=+
  SCN-specific regions: Sequence locations=1-289,311-767,799-909,931 -1056,1078-1090,1114-1350,1374-1619,1641-1652,1675-1820,1842 -2036,2060-2140,2162-2199,2237-2538,2560-2747,2769-2913,2935 -3132,3154-3253,3276-3305,3327-3490
aaaaaaaataaacaaagtgctttatatcaagcggccaatgattcaagaaatgcaattttttattcactaagtgcttttgaaataatatgtaagaaatgtggtgctttgcattttaaagaagaaagtgcgacaaaaaacgccaacggagaagcattctatagctgctgtaaagatggaaagatttctttactttcagatcatttagaagaatatccaatggaattaaaacaattatattttatagaccatccctaccacaaaaattttattacaaatatacgtcgaatcaatagtgcattttcttttgcttctttaagttgtttgcgtttttcgttcaaaacacctgggcccccatgtttcaaaatacaggggcaggtttatcataaattcaatgaaagtgcaatgccaaacaataacgaattgccaacaaatggacaactttattttattgacacaaatgatgcggctgagttgcgttgtaaaatcaatataagttgtgaccaaaatttaatggaatacatcgaaaattttatgagagaacaaaataagtttgctaagtcttttttgttaatgaaagaagtttatgaggaacaaaatgaaatttctaaaaaagaaggaaaggaaataccggaacttagattgctttttagtctcaaacaaaattttgataaaaggcgttataatttaccacaaaccaatgaagtttgtgcaattatgttttgcgattctaatgatgaaattccaccggctagaattgttgtatacccaaaaataaataaaaaattaaaaaatttatatcctcttgataagtgtgtggaaccaatgacttacccgttactgtatccactcgataaagaagggtaccatattggcctaaaggataaaaacggcaaaaaataacactttgtgattattttaaatattttctatatttccgtgaaaaatttttccctcatttttatgcaaaaaagctctttcaacaatggttagtggattctgctgcaaaaatcgaatgggacagacttgaatacattaagactcatcaaacggaattatgtagtagcaattattcaaatgttgaggattttttaaaattgaaagcagaaaaaagtggtgccgaaatccaaaggaaaataattttgccttcgactttttccggtggccctcgcaatatgcatgagcattttatggatgctatggcaatagtcaacgaaacaggaaaaccagacctttttgtaacttttacatgtacccaaaacgaccctgacattttaaaatgtttaaaacctggtcaaacaccgtctgacagacctgatataatagcaagagtttttcaattaaaaaaagattatttattgcatttaattttgtctgaacaaatatttggaaatgttgtcgggtattgttgggttatagaataccaaaaaagaggtttaccacacctccatttattggtaacattagaccgtaattctaaatggcggacaaccactgaaatcgataaatttattgctgcctctattcctaataaaagtgaagacgctgatttatatgaaattgtttcgagttgcatgatgcatggaccatgctcagaaaaaacactttgttgggatcacgcaaaaaacaaatgtatgaaaaaattccctaaaccatttttagaagaaacaaaaataaatgaggatggttatccttattataaaagatcaaacgatagtagatttgtatttaaaaagggagttaaattatcaaatcaatttgttgtgccgtacaactatggtaaaagttttgctgatctaaaaactgttaatggtaaaaaatatgattcttttgcaaaagcatgtttagctcgagggctttgtcgagatgacgacgaatggtttaaatgtatggaagaagcaagtattttttctagaaaatatccgagaggacttagagttctgtttgcaaacattttgattcattgtggaccaaaatacccggaaaaattatgggatttttttaaggattatatggttgccgacataaaattaaaaaatccaaatttgacgacagatttccattatcaaattggcttacagctaataaatcaaatcctaataagccaagaacgttccttatcagattttaaaacaatgccacaaacaaaaatgctaaaacaaacttatcaagaaactgataattttaatcccatcgaagaaacaaaaattgcagataaattaaaaatgatgttaaatgaggaacaaatgaacataattaaggaactgactgatgtttttgaaagtaataaacaaaaatgcatttttattgatggaccgggaggaacgggaaaatcgatttactttaaaaacaatttatcattatgcgagagggaaaaacaaaaatgtttgtaatatggctttttcaggaatcgcagcaacaatccttaaaaaaggaagaacgctgcgataatcgttttaaattgccacttaatattaataaaaattcaacttcgggtattgaaattaatagtgaagaagcgaaatgaaattaaagaaacggatatttttatttgggatgaagctccgatggatcgcgttttattttggatataattgaccggaaactaaaagaaataatgcagaataatttgtcgtttggtgggaaaacgtttatattaagtggtgattttagacaatgccttcctattaaagaatttgcgataaggtctgaaataattgatttgttgattaaaaattcgccattgtggaaagaatttacaactttaaaattaacacaaaatatgcgagcaaatacgaatgaaaaacagtttgcaaaagatttaattgaaattggtaatggcacaatgggtaaaaatggttatttcaatgtaccggaacactgcatttgccaagaaaatttagtttgtgaaatatatggagaaaatttaaaaaaccataattatgatgaattaagcaagtgcgcaattttgtcaccgtataataccgtagtggataaatataatgtagagattttggatttattacctggtgaacaacattcatatttaagtattgatgaaacagatttaagtaaaaataacccagtaactccagaaattcttaattcattgaaatgttccagtataccagatcatgaaattaagcttaaaaaaggggcgatgataatgttattacgcaatttaaatgtaaaggagggattgtgtaatggaacaaggttgcaagtgattgatttgggcaaacatgtaataaactgtatcattaaaagtggagatcgaattggagaacaaacttttattccaagaattactttaattgaagagaaaaaatttccttttctactgcgtagacatcaatttccaatanagcttgcttttgcatttactatagacaaaagtcagtctccaacatttttcgaaaattgggtcttgatttncaatgatgatccctttttcacatggccaaacatacgttgctttatcaagagcgaaatc

SEQ ID NO: 78257 - DNA, 2314 bp, Heterodera glycines
  Genomic contig location: Contig_ID=SeqID_14241; Location=268..2581; Strand=+
  SCN-specific regions: Sequence locations=1-53,75-491,513-535,559 -641,663-806,907-1017,1061-1330,1359-1378,1406-1430,1458-1510,1549 -1587,1627-1660,1709-1736,1765-1944,2016-2100,2193-2314
  Gene Ontology: Mol. function=acetylcholinesterase activity; Cellular component=cell; Biological process=synaptic transmission, cholinergic
atgcagctggtgcggcttgtcggctgcaaccgcactttgctcgcggatgccatccgctgtctgcgccgcattccacccgccgacttcacggaacagttgtggaacatgcagttgaacttcctggagtttccgctcgtcattgtgtcgcgggatgccaactttttcagcgccgaggacgcgtttgaggcgctgcgcaagcgccactacgcacaggacgtgaacctaatgatcggtaattagtttatggacgaagtcggcacagattaattaacatatttaaagcgtatgcctttctacaaattagattttaaaattttcattccggatctgtaaacggaataaattcggaaccgtattttctgggttgaattctagattttttcgggttttagcggcttacattaactgggttgagactgtatttcaacgcactcaatccgttttttaaatcaaaatacgatagttttccacaattttaggcattctctgcatttgggcaaaattcagtgttgcctatgggtggttcttatattagaaaatttagaaaattagatataaaataattgatttcttttaatttaggcatcaatcatgacgagggcactttttggtaattcacgataattaacatccaaattaaaaattatgcattttttgtatctaatttccaggaacatttacaacatcccaaaattctttgatgtgccacatcagccaatgcttagcctggataatttcaatgaatgcgtgaagacggcattttcgcgcttgccagacattgtccgagacgcagcatcggttaaaacaaaaaataattttttatattaattagaattaatgatttttattttatttaaaatttaatagaattttcaatttattaacattattaatatttctttaaaagcatgtttatttgggcgcacggcgttgtgagtacgagacgggaatgcacaaaaatttggccgatcaagtcaatcagatggttcgttcgaaatttttacataaatacataggatttaaattatttttttaaatactattaatttcttaatttaatcattctttaggtcggcgattattttttcacttgtgacagcatttggctggctgatcaggcaagaacatttaggaaaaatttattgtttattgaacataaataattatacactgatcaaaattgaaattttatgcttcaatacatcaataaatatcataaaattatcactatttttctgcgatttataaaaagaagaaaccatttttagcttgacaactcgccagcccgtgtttacgtttattactttgaccaagcgtcgagcgctgtaagtaaaaaaattaattattttaaaaataatcaaatctaattgggtaatttgttttatcaattaaaaaatttaaatttcagaatccgtggccaaaatggactggtgtaatgcatggctatgaaattgaatacgtttttggcgtcccaatttataatgagagtgccggatatacaaaaagtaacaaaaaatgaataaataaaaaaatatattttcaattttaggagagcaaattcttagccaaaaaatggtgaacattttcaaaaataattgaaatttaattaaaatttaattaattttagattaagctgtggacatcatttgcttccaccgggtattaatattttcaaatataattgttatttttaaaatgaaaataaattggtcaacttaattgcattagtttaatccatataaaaattacataattaattaattagtgcttaattgataagtttctcgggatttcttgttttcggatttctctgattattttcctattattttaggattccaagcttggaccatcgtgaaggcttctcggatcggcttcattggccccaataccattcgcagaacaaccctcgttggcttgagctccgagcatcgcacatcaggctaataaaattttacaaaaattttatttcgttttatctattttgaattttaataatttaatttatattttttgtaggccaatgcgcgcaacaaaaaagcaggaatgccgtatatggcgagcatcgcgagacatggaatacaacgaatacagtaaaacattattaaaatattatgcaatattaaaaattaaaaataaataataattttgaataaatttaaatgatttataatattttatttaaaaattttcagtgatggaaaaattgacatccgctttatctgcatcatttgcaaaaacgcgactatttccacagtcaattgtagctatttttttcacactgatctctgtgcaaaaaattctcatttactag

SEQ ID NO: 78258 - DNA, 147 bp, Heterodera glycines
  Genomic contig location: Contig_ID=SeqID_14242; Location=807..953; Strand=-
  SCN-specific regions: Sequence locations=1-147
cgccaaaaattgagtgaagtatataaaaagatatttgagaaagagatgattgctatgctgcatagagagttcactggcgacttttgggaactgatgtaatttttttaaacataattttctcattaaatcatgcatattttaaataaa

SEQ ID NO: 78259 - DNA, 1575 bp, Heterodera glycines
  Genomic contig location: Contig_ID=SeqID_14243; Location=900..2474; Strand=+
  SCN-specific regions: Sequence locations=1-82,104-325,347-379,526 -559,581-629,653-661,688-884,922-1046,1070-1175,1198-1312,1334 -1357,1379-1382,1404-1575
  Gene Ontology: Mol. function=glucosidase activity; Cellular component= extracellular space; Biological process=cell wall organization and biogenesis
gttcagcccgctgctgaaagcagcagcggtagctcaagcagtggtagctacgacacacaggaggttggacattttgataatttaataaattcttttcaattaattacttcgctaattaagactcaaccgagcggcagcgatagcagcagcggtgcgtgcagtggagcttcttgcggagaagcggtaaaaaaacaaattctaaatttatttattacttttttggtaaaatgatttttgaaattattgttttttttttgcttttaagaatttagtaagtaatttttataaaaaagtttttttctaattctcaggctcagcctggcgccagcagcagctcctcatgcagtggtgcatcatgcggacaagcggtaacaatttgtataattttttgaaatatattttaaatatttatttttattatttgaaatttgtaaatttctttttttatatattatattagaaaatttaaaatatataattttcacttaaaattttataattttgtgttttttaattaaaaattaagaaagttgtttattttttaggctcagcctgccgccagcagcagctcctcatgcagcggcggcgcatgtggacagcaagtgagaaatttggaattttcaattttcatttttaaatttaaattttttttctatactagacttcttcatcttcctcctccacatcgtcatgttccacttgcggtctgaccagctacaacaacaattggtccagcaaaagcagttacaccacaagcaggtgggtgtttgatttagtggtgtttcgggaatacaaaatatacgggtcgaaaatttggtaaaaaattggcgaattttgtctaacccgaaccccctcgtgggatgaataaatgtatgacaagaatctaaaaaaaaaataatttgttagaatattaaattaattgcacttttttatattgtgtttttctctcaattagtcttcgagaacgagcgatgcttcttcaatcatatacgaagctgccgccaatttcccgactctagaaaggagtcctaagagatttttcacaaaatattcttaaaaaatatatataccgtttaccgtatttttttaaaatatgccctcgggggctctgggttcaaccccactcaaaagagggctctaatttagggggagggctgtattttagagaaaacgttattttatttagtaaaaatgaatttttctaggctaattattgtgaaaatgtcaatccgtgttttttttctgggttcagcgccgattcaaaaaatggtatccccgcgcgttcgggacaggaacaaataatgacattaaagcagagagatccgtaaccaaaatgttttccccatttaaagctccagcggcagtgccgcggcacccgcccccgtccccgcagccgcgccagccgcgggtggctacagtggcggtagctcagccggtggacactcctcctcctcttcctgctacgtgtgcggacgacacggcctcacctcctacccgcaaacgtcgtacacaacgcggacctacggtggcggaagcggatgcggaagcggcggctgtcgcagtctcggctgtccg

SEQ ID NO: 78260 - DNA, 1215 bp, Heterodera glycines
  Genomic contig location: Contig_ID=SeqID_14244; Location=58..1272; Strand=+
  SCN-specific regions: Sequence locations=1-46,68-639,661-672,697-1215
atgctggcaggaggcctgtccctaagcctcttgtgcttcatcttcaccatgtgttccatggtgggatacgccatggcaggactgagaatccttttttggattttctcagtcttgttcgcgcgcttattcaagccgcgaaaagagacatgggtattgagtgaggaggaggaaaacctcctctatcctcaccgacgaatacgccggcccaggccagcaacaagaaactgggccagtggccgagttagccaaatgacaatacttgtcatggcatctcttccgtttgtacacgggggaattgagacagtggccataatggccaaatcagagagctgtctcaacaacggcacaacgaaaatgtgccaagtcaagggaagcgtaacccttgcgcttctcccggcaggacaaccgaatgtcctgtcaatgaagaccgatgatggtctcattttgggaacccttcaagtgatcttgaaggggctctctctcgaatgccaagtatacaccaaggcttggaaacgatcatacgagatcgcttccgtggccagcaaacgatgtccgtcggctggctcatgtgtcggtgacttttgcacaaaagtccgaccctccacagccatccgagagctgagggagaccgaaacgttccccgggaacagtttctgcatcgacagcacggctttttggggaaaccaatgtctcctagcagccagttcatgtctcttctacaagtggtttgccaaaccacgctcatcagccatttacgaagtcatcggatgcaactcttgggagtttggcatccatattcaatttcgcctcgattctacaactggaagaagtaccacagtcgaaactgtgcttcttccaggccgtgtgctcaaatggcacaacatcagcatttcaacaataggggtgagccaagcaccgactcccctattgaacgctgacttcctgattgaaggacgaaatgtcgcccttgtccgtgaaagaatcacggactctctccattgtacagatttgaaagccgcccaagcttttaactgtactctgggaatcgacgcatgcacgggctgtcttcccgatcacacagacgggacagtctcgtgccattgtcgcgtcgccaatctcgagggactaatggaagaccttcagcggagacttccgctctcattccgccattacgagttgcggaatatcggaaggcggatattcgccataacctga

SEQ ID NO: 78261 - DNA, 1208 bp, Heterodera glycines
  Genomic contig location: Contig_ID=SeqID_14245; Location=1344..2551; Strand=+
  SCN-specific regions: Sequence locations=1-214,372-392,414-588,913 -924,1201-1208
  Gene Ontology: Biological process=protein biosynthesis
atggccaacggttggccaatgaaggaaaagccgatcagcggaaaaaggacagagcgattggagagcaaatcggtgcagcggagagagtggagacattccttaaacggaaggggaaggggagtggatttgatgatgataagcatgagggaagggggacaaaacgaacagtgccgaaaggctggtggacaaattgccaaagttgacggccgttgtcggaaaggacggagagggggagagagggaggggagaaacacatggaacagagaaaaagggggggagagaatggaagggagggatgaaaaggaagagggagaattggccaaaagaaacaaaaagagaagaaaaggaagtggataatgaaatgagaggaatttgctggagagagagagatgaggaaaaggaaaatgaaaaggggggaggcaatcgatgggggcgggggaagcgaagtctgttttaagttaaagtgcaatggcccagacagaccaatgagtcacgtgacagactggtgggacaaaaaaaggcggaaaggggaaaaaggaaacttttaaaaaaggaaaaaggaaagagaagagaagaaggaaaaggaaggagaagagaagaggaaaaaggaaagagaagagaagaaggaaaaggaaagagaagagaagaaggaaaaggaaagagaagagaagaaggaaaaggaaagagaagagaagaaggaaaaggaaagagaagagaagaaggaaaaggaaagagaagagaagaaggaaaaggaaagagaagagaagaaggaaaaggaaagagaagagaagaaggaaaaggaaagagaagagaagaaggaaaaggaaggagaagagaagaaggaaaaggaaagagaagagaagaaggaaaaggaaagagaagagaagaaggaaaaggaaagagaagagaagaaggaaaaggaaggagaagagaagaaggaaaaggaaagagaagagaagaaggaaaaggaaagagaagagaagaaggaaaaggaaagagaagagaagaaggaaaaggaaagagaagagaagaaggaaaaggaaagagaagagaagaaggaaaaggaaagagaagagaagaaggaaaaggaaagagaagagaagaaggaaaaggaaagagaagagaagaaggaaaaggaaagagaagagaagaaggaaaaggaaagagaagagaagaaggaaaaggaaagagaagagaagaaggaaaag

SEQ ID NO: 78262 - DNA, 1222 bp, Heterodera glycines
  Genomic contig location: Contig_ID=SeqID_2171; Location=1307..2528; Strand=-
  SCN-specific regions: Sequence locations=1-621,643-884,906-1222
  Gene Ontology: Mol. function=helicase activity; Cellular component =cytoplasm; Biological process=mitosis
atgatcagaaacgcacagtgctccgctacatcaaggcctgtgagacgtcgccaagacagcgaacgagggaaaagctgcacaaatccttttgagcaaggaaaagcgacggatcatcttctgcactctttacttgctgaacagattggcacactctttgacgacaccgacatgatcattgtggacgagagtgggcaagcctcttatgtccaactgttatccatgctcaccaattttcccaatttgaacaaattgttggtagcaggtgaccgttggcagctgagtgtgaatttgaaagatgtgccggaagctgtacaaaatggctatggattggacaccgccattttaaatcttgacgcagcggcgggcgttgatcggacgactttgactgtcaactttcgatcacacccattcatcacggaatgcatttctgccggagtatatgccgcgcacaacgaaattctgaccactggacgaaccatcaaacagatggaccaattaacatcaaaaactcccatttcacttccagtgccgcagtgtcccatcatttttgtccatcaaattgatcgaatgcaagaggacccgacctcattttcggcaacgaatccaatgcaaacccggactgtcatgaagtgcttgactttcctacggccatgtttcaacggattgattcgcgttgtctgcttttacgctggccaagcgaaggaaattggaaccgaagtgtctgcgctcaacatgccgaacgtaatggtaacaacagttgatggttgccaggggcacgaggccgaattcgtcttcgttgtcacaacaaaaagcggcctgagctcgaatgacaacagcggcgccttttggaacgatgaacggcgtgttaacgtggccctcagccgcagcaagttcggcatgatggttgtcggcgatttgaagctgttgtggtcagctggcggcatttggcggcgattcctgcgcagagctctggacaaggccattgctgtgactccggagtacatccatgcgatgatggatccgcatccacaatttgtggatggcgtaattgccacccccaacggatcagtgaaagcattcgacttttacgatgattggcaaggctctgatggtccctttctgcctaggtcaattagacctccgcgcatgttattcgctggcacttcgaggcagcagcagtcagcacgtcaacctggttcagctcatccgaacatgcccgctg

SEQ ID NO: 78263 - DNA, 1515 bp, Heterodera glycines
  Genomic contig location: Contig_ID=SeqID_2172; Location=642..2156; Strand=-
  SCN-specific regions: Sequence locations=1-143,165-902,925-1515
atgattttggagacaagcgtggacccaatggccacgctgggggccaaaatgcttgaattggaaggagcgtcattcgtgacgaataatcctgagaaaagtggtgaaggaagtgaaaaaagtgccgggacaaatgatctcatggagacagaagaaggagagaaaaatgagggaatgccattcgtggcagaaatcctgaatgtggttaatgaaatgagtggcacggaaatgccagagaaagctcaaaaggcgggttttgggtttattttagatgatgaaatgcatcaggcattggacaacatcgacgaaagcaacgacaccgccggatttgggacttctcatcttcgatgtgccattgtccaagtgcaatcatccatggctgtcgcaatgctgaagcgattcaccaagaattgcccttggtttttcggcatttccaacggaactccgacagggagtgatcgccgtctccgattgggcgacgaagtcgacattgtcaacttcgcctggaaaagtggctacgaagtcctgcggcatttcgaccaggacggcacttctcctccatggctcaatgccggaaacatcaacatccaagcaacggcaatcaaagccaacatcgccaatccgacgaacatcgttcccaaaatcgggattgtgcttaatgtcaaacgccgtggaatgcgcaaaacgaacgtcatccaaagcctaacggttgtggcacccggcatgaaagttgcacaaagcttaccaggctgggctcttggtgagaaggattggtttagaaccgggcaagctgtgcttgtcgaaacggttgaattaatgagacctaatttgtggaaagtcaatcaaatttatgcactgccgctcaattgcccgtttggccaagtgaatgatcggaaagcctaccatccttttgtggctgttggcattgatcaatccccaattttgcacaaatttccattcagaagaggggatttggatgccaccattgcgcaaggcgaacaagcaattgccgcggcagtcacagcatgtttggacaagctggaggaggacatcctgcggtttaccatcactgccgaacctcaagtggaatatggagcggaagccgacactgccataatcaccattcgacatcgcttagacaacaagcaggaaatggtcgacatgtcgaaaatgtggactgaagaccagccaatccatgtgcgtgtggcagccaaaggggccaaaccatgtgccaccggcttcatcatgaatgttgaacgacaggaatcggaaacgggactcagcattgtcgccaaactcttcctagcgtaccaagaagccaagaactacgattgtgaggaggcatgggaccgaataatggacggggaattgaccgaaattgagcctttgcattctaggaaaatcctaatgcaaagggccgaaaaattttcagttaatttattcactgaaatggcgaaaaacacaacgacgggactcggcacaattatgtccattctaatggcacgccaaggggaatga

SEQ ID NO: 78264 - DNA, 2225 bp, Heterodera glycines
  Genomic contig location: Contig_ID=SeqID_14246; Location=1..2225; Strand=+
  SCN-specific regions: Sequence locations=1-460,498-708,739-810,832 -1382,1405-1680,1708-1769,1791-1963,1988-2186,2223-2225
  Gene Ontology: Mol. function=UDP-glycosyltransferase activity; Cellular component=membrane fraction; Biological process=lipid metabolism
caaaacaatcattaatttttactaaatttaacctagaaatagacaattttcaatgaaagtctgtttaaaatggtcaaaagttctaatttttctcccggcagcgccaatcgcaccgcccaaccccaaaaaataacgcacaatttttcttaacaaattgacccaaaatcgcaaaaattttgtctttttttggtgaaaatctgttaacaaatcacaatcaaattttcaaaattttccggcggcgcctatcggcaccgccggcccccgccccccttgtaccccaaaaagtttttttttgaaaaaccgccgcaaaaaaatggttttgaaaaacaaaaaactctattcttttgatttgcaagttgacaacctgttgttgaggatgtttttgaaaaaatgcataaattgcttaactgaaataataaatatttggataaaatcattccggggaaaaatagaattgtggaaaattttctttttattttttttgtttaaatttttatgtgtacttggatttcacaaatttcccccgttatgcacttggaaattggcatgcctgtacttggaaagtgacttggtacgatccgagccctgccataaatcattaattaattttggcatttattaaaaaaacaattaaagccaaaaattgtattaaaaattaattcacaaaaaaaaggtttattcaccccaatgaatggaggacacaaaatgaattttaaatttaaaaattaaattaaatttgtcttttaggagcctgttattgctgaagcatttggccgccaaaatttccccccgctgaaacaaattatgcgcaatgtttccctgctgtttacaaattcaaatcaagtcggacaaaaacataatgccaaaaattgtcggaaaattaattttttagttctttgaaatgccgagaccaatttcgaacaaaattataaacattggaggaatcgtggaaatgaaagtgaaagaattggaaccggtaaaaattatgggataaaataatttttaaaacatggaaatcaattctttagggaattaaagcgatcgtggataattccagggatggcacagtgatcgtttccttcggcacttttgccgatattaactcaatgaaaagggaaatgacaatggcatttttggaagcatttgcccattttccgaactatgaatttatatggaaagttgaattgtccgataaagatgccaaagtgtttgccaagtacaaaaatgtacaccccgtgaaatggatggaccaaaaatcgttgctcagtgagttaaaatggaaaaagattaaattaggctctgttccaattggcgcgtctaattagtgaccgtttttagtttattgggctacaacttttttttactttgcctaaattctcggctaaatgcaacagacaaaaaattattcttgaatttactataaaattctgaattccgcatttctcattgctattttctatgtcaagattttgatgttttcttgagtttctaaattccagagactgagaaatcgtttgataccaagaatcaacaatataggcattgaaaatattgtggcccaagaaactaaaacgatagttactgattggacgaataaactgaatagagccgaaaattctgttaacatttgatcaattaatacatatcaaatgcactacagttaattacccttaattgcctaataaatttccttttctaatttgaaatttcatttcaaagtgcatcccaaaatgcgggcctttgtctcccactgcggtttgaacagtgtcagtgaggcagtccaatttggagtgccaattttggccattccgttgcttggagaccaactgtacaatgccattatggcacgtgtgaaaggcattgctgtccaattggacgttggccaactcaacggggacggggccgaacagctgctggtcgatggacttgacaaggctaattagcaccagctaattatgtctttaataagttaattgcttttgcaggtgctaaatgacccctcttatagccaaaatgtcaaattgttgaaacaaaagtttgcttcaaccccttttggggccaaggaaaagctgatcagatgggtggaatttgctgccgaatttcccgacctaaacgagttgaatttgccgtgggaagaagagctcggcacattggcctattattctgtggacatcatttttttgattgttgcaatgttggcaatatttgcatggattcttttcaaa

SEQ ID NO: 78265 - DNA, 911 bp, Heterodera glycines
  Genomic contig location: Contig_ID=SeqID_14247; Location=68..978; Strand=+
  SCN-specific regions: Sequence locations=1-411,458-595,617-758,783-911
aatatcacagatccgttggatgccatcgagagattttactttggtattacggatccatccggcaatcgttctgaatataaacaagaattcatttctcgctgtaaaggatattcatctcataggtctccgcatggtgttctgattgtgagtaatcggggttaattcggagtttgttgcggttgggaatgtgggatcggggatatccccaaaaaatgaccaaattgtcgggggccgggtgtgaaatatttgttacggcacaaaacaatgttttacagaaaatgaaacgtaacctattgctcaattgccgtttgccattaggcaacgagacggaaagttatgctgatgttcttgggctttttcacaagattgaaaagcaccttcataacatgtccatttcctcggaagaatacgaatttttaaaaaactgtaaatatttaaaattttatgatttaaaatagaaggcaaggatcgggatcgcgaccggcatttgttccagtttccttttttgggtctcggtccctttctcgtttttaaaacgcaaatcccgatcccggtaggcacggacttacgacaattaaaattcaatgttttgaatgtaaattttgggtcacttgtaagcccgattaatcttaatcacgatcccgacttatcaaaaaagcaaagcgcgttccagattcacaatgtcaatcccaaacccgctcccagctttcaaggcttttaaggtcctggttaaaattaataccgatcccgtacaaatctaattaaaaattaaaattttatttcatgtatattttcagcacttttggctaaatcaacgtgggtgcaagataaattaaaatcaagtagttcaaataatctaatgtttaagacgctactattctttattgaataaatactgctaaatatattta

SEQ ID NO: 78266 - DNA, 1239 bp, Heterodera glycines
  Genomic contig location: Contig_ID=SeqID_14248; Location=894..2132; Strand=-
  SCN-specific regions: Sequence locations=1-189,211-817,853-1117,1145 -1239
  Gene Ontology: Mol. function=structural constituent of bone; Cellular component=basement membrane; Biological process=positive regulation of body size
agtggacatttcaacgcgctccaaccagccgaagtgatcgccaaaattggcattggtgccagctgtttggcgttgtgtgccctcctttggtcgacgcatagcattttgtgggaaattgagcagatccaagcggaaattgaacagaacgcggcagcttttagggcaagcacattcctttaaaatgactttaaaattcaataaataatgaaatgccattaagacaaattcggaaagaatttggccgaaaattctttttttggcatttccaaaagtcacaaaaagtggtgacccatcttcggcactccgtcatttggtcagcagaaggaacacagaagcgaaagaaacaatgaaagcatttggaaaaggcgccgaatttcaagcactgaaaggatgccaaagtaaaaagtgactaaaatagtcaattgaagaaaaaaacaaaggaatgccaaccgaaagtcgagagtcattctcgagacggagagactgaaacatcgcttaatgccccattcacagagtgcgcacgtatgaattgcccagttggtccaactggtctgcccggccagccgggcgatgatggcatccccggcacagtgggacggctcggagtgcccggcgtggatggcactgacattcaggaaaatccgttgccagacatgccgtgtattgtgtgccccgctggtctggtggttccattcgaattttcgatatttgttctaattaaggttaccccggactgcgaggaacgcaaggcgagcgcggattgcccggggcggcagggccccgaggcaaaggcggaccgcccggcaaatcgggcaaagacggaggctttggaaaaagaggcccactgggcaaaaggggtcaattgggcgtgccgggcaaagcgggggcagcgggagagaatgtcgtcggtctgttcttgatcagtgttttctttttgaactgatcacattttgattggaaccattttcaggtggcattggcgtgaaaggggcgcccggtcagccgggcgccaaaggccctccgggctttgccggcctcgcaggtcgtccatcaaagatggccggtcagcccggaaggcaggggctacgtggtccgacgggaatgccgggagaggttgtcaaaattattaattaaatcatttgaactttggaatttaagccgggtccgtacggtgtgccggggccgcaagcgccgcccggtgaaattggacaggcggcgaatttctgtccgatgcgttgc

SEQ ID NO: 78267 - DNA, 433 bp, Heterodera glycines
  Genomic contig location: Contig_ID=SeqID_14251; Location=496..928; Strand=-
  SCN-specific regions: Sequence locations=1-170,238-286,310-359,381-433
atgagcatctacttttctctatctcacgtaattggtgtatcagttcccaatttaaataaattttatacagtagtacattcaattatttaatttcctttaattcaataaatcaaatgaaaatgcacattaataatttggtccgataataaaatttttaaatgacaggctactttaaattaactttttttaattttactttgaaaaaaattttttttttataagatttttaattaatttgaattaggtccatgttatggcaatttaaaaaataatactaaaatatactttttagaaaacaaattttgctattattattcaaaggttatattacaacaatgtttaaaaatgaaaagtagatatttataaaagtttttcatttatttttttaacaattttcaagaaaaaaattaggtgagcaaaaaaatttaataaa

SEQ ID NO: 78268 - DNA, 192 bp, Heterodera glycines
  misc_feature (36)..(36): n is a, c, g, or t
  misc_feature (64)..(64): n is a, c, g, or t
  Genomic contig location: Contig_ID=SeqID_14251; Location=1359..1550; Strand=-
  SCN-specific regions: Sequence locations=1-192
atgccgaaaaagcaacttgttttggtaatttctttncattcttattcaaattcggccaattttntagcctgagtggagaaatgacacaaaaattttacttatcaaggcgaatatggatcagttgtttttggcaccatctactgagcccgatgcagaagaaaaagaattataaattgattatttggaaataaa

SEQ ID NO: 78269 - DNA, 1150 bp, Heterodera glycines
  misc_feature (1056)..(1056): n is a, c, g, or t
  misc_feature (1108)..(1108): n is a, c, g, or t
  Genomic contig location: Contig_ID=SeqID_14252; Location=5..1154; Strand=-
  SCN-specific regions: Sequence locations=1-38,60-170,193-264,286 -351,373-971,993-1150
atgtctgacatttggaaatatttcgacaaatcatcgaatgataaagcattatgtaatgtatgcgggaaaaaaattgtcagaaatgatggatcaacaatgggcatgtggaaacacttggaggcaagacacaaacaacaatttactgagttgaaatcctggaatttgcttgaaaagcaagaacaaaaggttaaccaataagctttttaaattttttgatttactattttagaaacagcgccgaattgacaattatgtggttccaaagaaaaatgaactggaagaagcggaagagagtattgtgcgaattatgattcgccaaaacaactcgtttttatttgttgaggacccggatttgaggaatttgacaaagaaggcatttcctaatttggtatttttttgtcatttttggttttcagttttcattattttaggaatttggaggccgcgatcactttcgacgtaaagtgatccctcgaatggctgatcaaattcgccatgcaattagaacgggaattggtgatggacattttgcaattacgagcgacggctggtctaaacccacgcattcacctcaattacaaaggtgaatcttcataatttttcctttagccagaaaaatttttccgttttagcctgaccattcactggattgatgataatttctgcagaaatgatgccgttctcggtgcctttcctatggacgaatttttccattctggagaagtgattgctgaaggaatagcaaattgtctgacagaaaatggatttcattggataaaattgcgtgatgtgtgcatgatgacgctcgtaatatgcagtcggccacacgccaattggataaggacaggcaatttttatcatttatttttgaatggttccgtgttcccttttaagtttccagtgttgttgccattttttaaatttggttattcaagatgcgatcaaaaatcaatgcctttctgaaattatctggaaggcaaaagagccaattttaagtcagttccgacgagatggaattcgacctaccgaatgttggcatctttcaaagagcagaanaaagttttgctggcaatgcaattttgaagagaccaagaaatgcccggaattntgtctgcacccaaaaaacctcgatgggccgagatggaaataa

SEQ ID NO: 78270 - DNA, 1383 bp, Heterodera glycines
  Genomic contig location: Contig_ID=SeqID_14254; Location=19..1401; Strand=-
  SCN-specific regions: Sequence locations=1-70,103-133,208-219,336 -342,364-507,878-891,1061-1071,1323-1383
  Gene Ontology: Biological process=protein biosynthesis
atgccaaaaaagaaggaaagtgaaaaggaaattaaaaggaggcaagcgatccggtggtcaagtagttagtgtgccttcctttggtgctggcttgccatgggttagagtcccatttcttctgatattttaaagcaaatattatattgaaattatgtttttttaaatttatttttttaattaattaactttatggtattttaaattaatgataatgttttttgaattaataaaataataaatatttataattaatagaataataaagtctaaattaaatattaaaattaatcgaataaaaattaaaaataaacaaatattaataaatatttaaataatttataaatctcaaaatgagttaattttagggttagacgaatccgggtatttgggcaaaaccgggtccggatatttccgggtccagaaaagccgggtccgggtccaagtttttaaaccgggtacgggaggaagagaaagtggaagaggaacagaaagtggaagaggaacagtaagtggaagaggaacaaaaagtggaagaaaaagtggaagaggaccagaaagtggaagaggaaggaaagaggaagagaacgagaaataggaagagaacgagaaagaggaagaaaaagaagaggaaggaaagtggaagaggaacagaaagaggaagaggaacagaaagaggaagaggaacagaaagtggaagagaaagtggaagaggaacagaaattgtaagaggaagagaaagtggaagaggaacagaaagtggaagaggaacagaaagtggaagaggaagagaaagaggaagaggaacagaaagtggaagtcgaacagaaagtggaagaggaacagaaagtggaagaggaacagaaagcggaagagaaagtggaagataaagtggaagaggaacagaaagtggaagataaagtggaagaggaacagaaagtggaagagaaagtggaagaggaacagaaagaggaaggaaagaggaagaggaagagaacgagaaataggaagagaacgagaaagaggaagaaaaagaagaagaggaaggaaagaggaagaggaacagaacgtggaagagagacagaaagtggaagaggaacataaagtggaagacaaagtggaagaggaacagaaagtggaagaggaacagaaagtggaagagaaagtggaagaggaacagaaagtggaagagaaagtggaagaggaacagaaagtgaagagaaagtggaagaggaagtggaagacgaacagaaagtggaagagaaagtggaagaggaacagaaagttgaagagaaactggaagaggaacagaaagtggaagagaaagtggaagaggaacagaaagttgaagagaaactggaagaggaacagaaagtggaagagaaa

SEQ ID NO: 78271 - DNA, 921 bp, Heterodera glycines
  Genomic contig location: Contig_ID=SeqID_14255; Location=749..1669; Strand=+
  SCN-specific regions: Sequence locations=1-61,83-83,116-194,217 -218,248-588,610-755,787-887,914-921
cattcgctgaatttgttgtgcacttttgggtcaaaatgcattttgcagaataagtgagccctttatttatttaataaatttagccaaatctttaaaaaataaacattttttcaaaggtttgaaacggcgcgcaattttctcgaacttggcgtcaaaagggtgacgctgctgcccgaaaccgagtgagtaaaaagtttttagaaattttatcattttctaaatttttcccctcccccaaaaaaggccgaccattttgctgtccttttactgctgctacgctgaggcgctgttccacaccggcgacatcgaacgtgcgcttgactacgccaagcgggcgcaaaaactgtcgcaagggagtgacattgatgcggctgtgcgggcgtacgtgcgcgacttctcacggcaaatcgaacgcgacacactgcggtgagcagagagagtggcagagaaatggagaaaaagtcaaggggcgaaaagacaatgggcaacagttaggggaggaatcagagaaatagagaaaaacgaaagagtggattaggctaggtctaaactttcggctaggcataaggtttaggattaggcctaacaaaagcttatttaaaatttcatcggcaagattttggggtgctcccgcgaggcgcagggaaaattagcgggaattcctttttaatttttcaatttgtttctgtttttccctttatggcttttgccctttctgttcagggcatctgttcggtcaaacaacgaaaggacggcttcttcttcttcttcttcttcttcttcttcaacttcactttctgcagagggcgcagaaggcacagaaaagggaatttcgaattggctgtggcccttcaaataatttaaaaaattgttttgcctaattttgcatcgttttttataaacaaatttgttttggcaaaa

SEQ ID NO: 78272 - DNA, 924 bp, Heterodera glycines
  Genomic contig location: Contig_ID=SeqID_14256; Location=1317..2240; Strand=-
  SCN-specific regions: Sequence locations=1-88,111-177,208-339,368 -446,478-710,733-795,852-924
atgtctttgatcacgagcatatcgctggctgtgcttgtctttgtggttgcaactgtgcgcgaaagtgaagccggctgttggtaagtttgcaaaaaaggcacttaattacagtttaattatcccgataaaaaaaactatattagggagtcttgagtttcggtcatgaccttgaaaatgaaaaaatattataaaaaattaaaattaaaaggcccccagcccttaatggtttttcatcggggtatttaaaccttaaaagttccgaaaaaattcaattaaaaaaatctgtatattttttagctgttgccactgctgcaagtgttgctcgtgctggttagaaacatttttaaaaaattaattttttttttttgtaaaaccgggaccgggatatcgtcagtaaaaaattgaattatttaaataatatgtataacacaaattattaaaccggacccccctgttcccccaaaaaattggaaaaagcgccgcaaaaatcaacttcgatttttcatgctcataatttcacaaaatgcttagttctaagaaaaaattgcaattgatcatggacaatagaaaatataacatttgaacattttaaacgtgttttgaataatttgtgaaaatgaggcttttgacccaaaatgaggcttttttgcctgccaaatgaggcttttgataatttcatctgcgaaccctgaacatagcctatcaattctcaaggaaaaatattattacaaactacgagaagacaaatcaatggcaatttacaaagtacgaaaaatcactcaacagttcgtggacaaatttttttttttgatattttcttctaatttataatttttttagaaatattttttctttttctgactattgaatatgatttaaaaattgactaaaatattcaaatagagtaattcaattggaaataaa

SEQ ID NO: 78273 - DNA, 651 bp, Heterodera glycines
  misc_feature (626)..(626): n is a, c, g, or t
  misc_feature (635)..(635): n is a, c, g, or t
  Genomic contig location: Contig_ID=SeqID_14257; Location=48..698; Strand=-
  SCN-specific regions: Sequence locations=1-108,257-316,338-362,385 -403,425-541,628-651
atgaaattattaccactattctttttaattgtaattttaattatcaaaattgaccaatttggagcagagaagaaaaaattgaaacaaaagtcatttgacgaaatttttggagaaaaatgggaagaaaaggaagaagaaaggcgaaatgaactcaaaaaaagagaaataattgcaaaattttataaaataaaagagaaaataaagcaaaaaggaagaaaatacccaagaaaagaatggaataaaattgaaagaaaaattgcgaaaaaaatggggacatatcgcaaaaatatttatgaatggattaaagaattggggcttcaaaaacaaataaagaaaagctataaatcaaaaacggatgaagaaaagttagaaattgtacaaaaattcattgaaatggcaaatgagcttaaagagaaaagaaaatattcgaccaaagaatggaaacaaaattatgccgaaatttgtaagaaaattggagttagtcaaagaataattgagaaatggaagaaacaatttgctatacgcagtataaaattattcgttattttttcttcaattttattccattcttttcttgagtattttcttcctttttacttatttttttcttttattttataatattntttcatggnggaccattttaataaa

SEQ ID NO: 78274 - DNA, 1172 bp, Heterodera glycines
  Genomic contig location: Contig_ID=SeqID_14257; Location=875..2046; Strand=-
  SCN-specific regions: Sequence locations=1-323,345-418,485-558,580 -956,978-1172
atggttcccattttgagaaacgacccatcattgacgacgaagctgagaattgggtaagccggcagaagtttgtgggagatctgcctggcctgagggctagaaacaaagacgtgtacacgcaagtaaagaagtctgagatttaaagttgtccgggctagtcgaagactaaagggacttttaaagaaaagaattgagaaaatctgtccgggctagttgaaaactaaagggacactgaaaaacgaagagaaagaggtacacaaaaatgtgcccagtctttctaaacgctaaaggggcgtatttgtaaggatgagagaaaagagaggaattaaagaagccaaaaataaccaaaaaaaggcctagtagcagccgaataactgaccaatttaaaaactttttgaacgaatgagaggccagaaacaagagagaaagaggccaaaaacaaaaaaagagagagaaaaagtgagacaaaaaaaggagaaataaattgcggtaaagcaaaaaggcccgggctgataaccaatcaaaggggtgcgattttaactggctgaaaatagagaaccaattgaaaaatgaaaattatgccctattattttgtttaccgtatgagttacaattttcagagttccaaagttcacttcattcatttttctttcgtttctcacgccataagaatattcacgtgatcacgtgccgccgcactttcgtcagcgagattatttcatttttgcggcgcctgagaagtttaattgctctcgttaggcggagtttaagcggagatggagcagataaaagccattcctggaaggcgttctcatccattcgattatccgcaaagaaattacaaaaatttttcaggcggcgcctatcggcaccgccggacccactcccatcccccgttctccaaaattccttggaaaaatgcgccgcaaaaaatttgtttttttagattaaaaatgcactgaatttgctaatttacttcccaaaatcgttaaaaatgataattggaggcgaaaaatacaaaagttgataatatattaattgtataaagtgttatacaagcgatttaagtattttttgttaaatgttcttatttttgaccctaaaatcttattttatggcctgtatgttcttattttgaaattttttcgatggaagccctgcattagaataaa

SEQ ID NO: 78275 - DNA, 1690 bp, Heterodera glycines
  Genomic contig location: Contig_ID=SeqID_14258; Location=2880..4569; Strand=-
  SCN-specific regions: Sequence locations=1-228,251-498,539-649,671 -693,715-761,784-818,841-910,939-995,1017-1690
atgtttggcgccggcgagctcagtacccacaagctggtcggcctgccgttgacgtggatcagcaacatgttcttccagcaggagttcaaggagtggctgcgcattcggagcggactacgctcaaagggtgggtgggccgactaatgaatgatgatggtgcccccccccccccccccctctggctacgcccttgcctattttcgggttttaaagcctaaagcctacctattttggcttttttgaaaatttataaatcgatacaataaccctcaaaaacatgttaattttttgtgcgaaacattgccgcaaaatgttcccccgatcattttctgccaaattttcagcactgatcagctgcttcatcactttctccgtgtccgctggccaggccttccgcatttgtcgctttggtcgaaacagcataatgccatacaacggctcgcacaattcgttgtttgtgtacgcactgttgccgacgcccgaggtgaagaggagtcgaaaatttcaattttttatttatttatttttaattttttttgctctttaggcacataaaaattttttgatgttccttgattttttgagccattggaaaaagggaaattttagccatgttttaatgaagttttgtttaaaaaaatttgttcgagttttaaaaattttcctccactcaccttgaaggggggtctcccattttttggggccctttatgataacaatgccggcaggcctgaaaattctatgactggaaattgagaaacttttttaaataaattttttaaagacttttgtccaaaatggaaaatgtatttcaaacaaaatcaaacggaattttatttattccctgcggtgtcgaggaaatttttttttttgaaattgttaagagatttacgccgaaatgaagaatttgttttttttttttttttgttttaattatagaggaaataaaaccatcttcgtggccttattattttttcgttaaaatgaaaaagtttccaaggacaaggccccttcttacatacaaaaaaaaatgctaagagttttcaggtggcatggcacgtgtgctgggcctgcaaccaaattgacgaaaatttgggcaactattggccctccaagtatggccagatgaaattcaagcccaccgtgcaaatgtcggctcgtcaaacctttctggacgagacaaactcataaaaagtgagtggaaatgagtgaatttggcattctgtctgtcgccaaaaaaaattttgtttttttttgttggttttgtgaacctttgggcttttttcagtggataaatataccagggattgtacggaattatgctttccgaaattttttgagtcgaaattccgatttatgagatttttttgggttccatctcggcttcctactaaaggcttgttctatttcactttccaattttattggcatttttagatgcgccttatatggagcagaatttgccttcgacggattttttttagcatttgcattgacttgggctttttgacttcgtggtgaccttccgtaatccttcaatttttatatccgttttttgcgcaatctgatcgtaatttttgatcaaattttgtgagtcacaaaatgctttctaatttggcaacaaaagcactgcttccagctgcctatatttatttactaagtatttgagaatttttatttgagaaataaa

SEQ ID NO: 78276 - DNA, 535 bp, Heterodera glycines
  Genomic contig location: Contig_ID=SeqID_14259; Location=373..907; Strand=+
  SCN-specific regions: Sequence locations=1-244,266-504,532-535
atggccaaccgctggcaccgccaacaacggcaccgtacagacgaacggggccaatacggtaagcaatgacgaatggcattaggtggcataattaatccccaaaattgacccaaactgttgcagattcccgccactttgatggagttcggccaacaaaatgcgctctccgacaccgccgtccgaatggtccaacagcagcaacagcaaatggccgttctgtccgcgttggctgtccatcagcagttgcagcaccaacaccaaatgctccgttttggcgggtggggcaacgaatgaacggagaaaagacgaacaaattggagcaataaatatctacgagaaattgttttaattgaatcttatacaaaaatcgaattgacaaatttggaatatgccaaaggcgaagaaattggggggtgggagggtaacacaacaggccaaggtggagaactccgttttccccttttttaatgttcgacaaaagtcacacataaatcgttttccaataattgtttcccaaattaattggattttaaaa

SEQ ID NO: 78277 - DNA, 1266 bp, Heterodera glycines
  Genomic contig location: Contig_ID=SeqID_14259; Location=1499..2764; Strand=-
  SCN-specific regions: Sequence locations=1-187,209-230,253-288,310 -418,599-908,930-947,1009-1266
  Gene Ontology: Mol. function=transmembrane receptor activity; Cellular component=cell wall (sensu Fungi); Biological process=Rho protein signal transduction
atgatgctgttcacttgcaaaatcaaactttgcatgttgaaagaagacgaatgcaacactttgacggtgaccgaccaaagaatgcctttggcagtggcactttgcttattaaccaatcactcgcaaattaagccaccaagttgcaacgggaagcgagcaaagagtgccgcgaatggcaatttcaatgtggacaacgcgggggcggaggtgggcacggggacagcggccattgggggcagaaacggtggagggacaacgggaaaagaggaggaacagcagacgatgagaggaaagggcaaaaagcaaaacggcggcagagggagcagaacggaagtgagtggagaggtggcggagggaacggcacagacggacgactcgggaccaacgacggaacgaccgaccgaacgaacgacaggggcaacgacagcaagcagtacagcaccaacagcaacgacaacctcaaccgagagaacgacagcaacagcacaaacaaccgaaacaacaacagaaccgacacaaagcacgaacacgacaacgggaacaacctcatcaacaacagcaacgagtacgacagcaagcagtacaacgatgacgacgaagacggttacggaggaacaactgctgagcagcgtggaaagggcggcaagtggggagagcagcgaaggcattcaaccgaaagcatcatcgctatcatccgcagcagaagctgctgcacaaccatcgtcctcgtcagcgtcatcgccgatcacggcacaaacaacagaaacttcgccaattactgacggcacaacaattcactacaaaaagagcagagaagaaatgacggaggatttccctcggccccaattgttgcttcaaaatgatcatgccaaaacggcggaaggggacaaaaagcgcatggagagaatggaaagggcggaggagggaagttggacaatttcggcatcggaggagggcgaggagaagggcaaagggaagaagaaagtgccgggaggggaggaggaggagttcggtggggtgacgaagccagtgcaagtcttcaagaagggcaaattggagggaacggcgccgacggaagagggaaaagcgaagccacaaatggcggcggcgggacgcactcagcgggacacgcccgcggcgggcggaagggcgggcggaagccgacgcaggatggctgaggtggacttcgacatccaatcgccagaactgatgatcttggacgattacggtctcgaaatcgcgagcatttcgcctagtggggtgtga

SEQ ID NO: 78278 - DNA, 2337 bp, Heterodera glycines
  Genomic contig location: Contig_ID=SeqID_2173; Location=335..2671; Strand=-
  SCN-specific regions: Sequence locations=1-462,485-651,673-1865,1888 -1970,1992-2118,2165-2191,2225-2231,2253-2314,2336-2337
atgttcattccacgctcacctccattgactcgccaacgtgcacgaaatatccagcagcagcaacaaaacgaacaccaaaacacacaaagaccgcataacaccgctaacaccgaaaatgttcttgaaaattctgttgttgatggagaaattttaaggacgaacggaaatatggactcggcacaaattcgaaatgctcttcttgagttggctcaaccgaacagacaaaatgaaggacaagagaacggagcggaaaacaatggaaacgaagaacaacgcggaggtttgcgaatgagattccgaaatgtgggaacaaacgacggaagagaaaattggttggttggagacgaaaatagaaatgatggtcatcgcaatctcaaccaaaacttgttgcctcgaacatccacgcctataagtggcccaatatttccggaattactcattcaaaacgtgcatcagtctgtacaccaaaatttgccaaacagacaaaatatgggtgacaaaaaccaacagcatggtattcctaaaaccgcaatgccgcaaccacaagtcgttcagcaaccaatagcatttttcccgccggttcagcaagcagttccagggccctttttgaattacccggcaataaatccattttaccagctagcaccattacccatgcagcttccaaaccaacaaatgattggttttatgagcacaaatgcgcaaaatccaccacaaatgcaaaatgcttataacccgcaattccaacagccgtatttgccccaagggaaccaccaatttggcatgataaaccaagcacacattccgcaagttgttcagccaatttcgcaaccacaacagcaacaaattaatgccgctcaaaatttggctcgccaaaatttcgaaaatcgtccaattgagaatgtcattgaacggggaagagaaccgggaatggaccaagtagcatacgcactcataatgagtcaaatccccgctctaaaaggcaatgaaggtgcggaaaagttccgtgaatttttcaagcgttttgattcgaatactggcgaatggacaaatgcgaaaaggataagttcgctcgagtccaaagtttttggacgagccgagagggcctttaggtcggcatgttcgacagtacctttccgctatgagttaatcaaacgtgaaatgttgcggcaattagaggagaccgatgcacgcgaatggaatgcatttgatcagttgatgtcaggcattcggcgaaaaaatggagaagatttggatgatttggctgatcgcgtaattactttagtcagacgtgcctaccccggattaactgaccatctcgttgatgactatgcaataaagcatttgatcaggacctttgaaagctctgagttagctttaagtttggaaatgggcagaaggccgggaatgacattcgatcaatttgtggggatggctgcgcgcgccgaggcaacgcagaaagcaacgcgtcgcattgcatcaaataatgcttatggaaaaacgaactttggagcaactctaacacggcaaggtcctgaaccgaaaaccaattttcaacattccactggaaaccgtccaaaatgtttttactgtgaaaaagagggtcatattgcgcgaaattgtttccggcgtcaggcggaagaaggcaatcagaatcataattcgcaacaaaatcataatgtgacgggttcaaataaaaccccgttgtccttgtacccaagccaaagtcccgcttataaacccgaaccgaacaatgcaaatccgcaacgcccacaaaatacgcaatcgcgaaattttctcaggcaaaattacttacaaaggaaggtccccaggtgtccgtgggatttccgaatgaaatttggtgggtggatagagcacccacaggttcttaagaaaagtgattttattttttgcggaatgaactcgagtgccgagttatgacgtgccaaagtttttggtgttttctaattaaagaaaagaaataattacttcgctacgcaacaagcatctattggtgtagaggtagtgcgttagtcaaatttattttgtgtctcagattcgaatcctctgcatgctaatacattttacaatttttatttttgcttttctggtgcagtctattattaaaaatattttttatgaaatagttattttaattttatttcattaacacccaaaaaaatcattaaagataaagacgtaataatttaatttaaaagatacacacctttctgttaaatttttattgaatatcttatatgttaaaatggtaaaaaaatttagttcataaaaaaacatatttgattatttacttttgcataaaaaggcaaaaataaa

SEQ ID NO: 78279 - DNA, 2357 bp, Heterodera glycines
  misc_feature (158)..(158): n is a, c, g, or t
  misc_feature (249)..(249): n is a, c, g, or t
  Genomic contig location: Contig_ID=SeqID_2174; Location=820..3176; Strand=-
  SCN-specific regions: Sequence locations=1-400,425-675,698-901,924 -2357
aagcagagacataaagcgaaatgggcagcagcagaaccgcggtcactgatgaccgggagaagcggacgaaagagacgaattgcgatcatttcccactttggtcgaggcattacaacgagtggatgaacacgcgggattcaatgtggagatcaaatacncaatgagaatgaaggtaattgggcaccggggggggggggagtcgagaatagcattttcttaacgttttcgaattgaatgccctcccccctntcaattgaaggatgggtcgcacgaatgtgagaattacttcgagcgcaaccagtacatggaccaactgctggtggacgtgttcagacacgccggcaaaagacgcattgttttttcgtcatttgacccggacatttgcacgctgtacgcatataaaaaatgtcaaaatgaatttgctcagttcctttttagactgtccgtcaaacagaataagtacccggtgctgttcctttgtgtgggccaaaccgacaggcaattaacgattaattgactgacatattttaaatgtcctatttcaattgaactctgttttaattgttacatagatatgtgccatttctggatgaacggagcaaagtgacgagagtgggcaccaactttgccgcctgctccaaccttttggcaaggctaaaatgccattctttgaaattgctccgcctcccaccgccccttagggcatcaatttgcacagcgaagaattgctctccgacccgtcatccctgaaaagggccgttgcaatgaaactgatcacttttgtctggggagaggacttggacaaattggaacacgtcgcatatttcagacggcaaaatgtggacgcaattatttacgacaggtgaaatgcgcaaattcatttttgaattgtcagcccaatattttatttcttgcatttgaaaatcaattaaccccaaggcgacattttcagaatcggcgaattggaaacacggcaaaatgtgttcgtcgtggaaagggaagtgaagagcgccctgttcaagtcgccccgcacttcaccttctctgtcgcgagcaaattcactgtttcgcaacagtcaaagcccgactatgccggtggaagagccaaggcggtcaccgtccaacagaagaatgttggccaacggatttgcccggcaaatgacaattgccaacactgactttttcccaaccaaatgagtgaagaaatcttatgtttactcttccgaagaatatcgaactgaattgagcatcagaattgaacaaatgatttcatttcattgcgatttgtccgtccttttccttttcgcgcgtttctccgtctctgtccctcggctcgtctttctctttctttgcgttttcacacttcctggtttattttttgtcctaaacgggaaaaggggtagaacgacaagatgaagcagcagaggatgaagcagagattgaatcagttaatggattcctttttagagactcaattgtttttttcttaaaccatccccgccctttgttcgacgaactgtcctcggcgtttgccaggcgtcgtgctgagtccattctgcggctttttgtgccgaattttcgtccctaattttttcggcagccatttcttcccgccggccatcatttcgcgcttcgttttctccaatgcctcggcatttccgactctattctttgtttgttgtttttcctcctcattttcttcgcttttcgtttctttttgctgccgtctttccttcactctcaacgcattcaaattttcaattgaaaattcgacgattggcctctttaattaaaaatgttttctccaagttggcattccaatcgttcaccaaccctttcgtcagagaatgtcgtcggattgttgttcaacttcctcaggcagttcagcgccaaagtgtgttcggtgaaggtgacaaagccgaatccgctggattttcccaaaatggcgcgtcccttttcgttttggcccttcagttgccgcattatccggcactctgagatggccgtcgcgggacaatcgccggccgcttccgaacaaacgcttttcagttggtcgtccttccacgagaagggaatgttgtgtatctgagaaagcagtaaaaactttaaacgtttctccgctgatttgccccttttggctgaccacaagtcgatttggtgagacgaacatcgtcaagtttttgagtttggtcttggccacttccagcatccgttgtctcaatttcgcgtcctcttccgacattcccttcgccagcgctgtgccgggccgtaacaacgacgccctcattaggtacaaattgcgtttgtccttcaccggctttttgtctgtcacattgaacttttttgcctcatttcgtt

SEQ ID NO: 78280 - DNA, 416 bp, Heterodera glycines
  Genomic contig location: Contig_ID=SeqID_2175; Location=352..767; Strand=-
  SCN-specific regions: Sequence locations=1-105,127-416
aatttgctgtccgatgccgacccattctttagagaacagtccgaaaatggcgaacccttccgaaacgacggcgaagattactttgtgttccgcacaacttcagtggccattgagtttttggtgattttgcacaaataaactgtttttatctacatttttctttttcgttttaggcatttcgaattgaattatttatgctccagcaacggaattgggcttcgacagaatcaaagattggcctaactccgtcccgatttgcgcttgcttattgtccgtctgctgctatcgggtcgggtgccatcattgtctgctgtcccttaaggcatgccctcctcaatgccggacacaattggctccctttccctgccattggtcgctgtgaaaacgcagaagccgatgggccaaataaaagttga

SEQ ID NO: 78281 - DNA, 668 bp, Heterodera glycines
  Genomic contig location: Contig_ID=SeqID_14262; Location=712..1379; Strand=-
  SCN-specific regions: Sequence locations=1-344,366-568,590-668
atgaatccaatttctgaattgtttcgcattgcaaatggacagggaaatgatggaaatgattttaaaaaattacaagcggaacatgcgatcgaccaactcaatgatcgtttacataacatcaccgaaaaattaaaaagtttgctgcccgagatgcaatttgatcaaattattccattttcggatgcaaaattttttgaaatttgctcagaaggcattgtcgagaatggcatcattaagcacattcgagaaagtctcgaagagattgtcagaaatcaagaaaattcacaacagagcaaaaacaaggcactgaatgccataataattattcaagcaataaaaagtgatttggacatttttgcaaatttggcaattgaaaatttaaacattctgagagaggaggaacaaagcgatgacaaaattaaaatgaatttatctaattagtgatctttagttacttaataatatatttcatgtagaaatgcttcgattgtatttttcaagaaaatatggaataatcaaaccgaaaaaaatcaaaaaaaaaacgaaatttttccatcgatttttttcgagaaaatatttttaaaaaatatcaagaatttagatattcaaccgataaattaatcagcgaaaggatgtgaaaaattgatgatcatttttgcgttaataaa

SEQ ID NO: 78282 - DNA, 813 bp, Heterodera glycines
  Genomic contig location: Contig_ID=SeqID_14263; Location=91..903; Strand=-
  SCN-specific regions: Sequence locations=1-4,30-210,232-652,685 -727,749-813
atggaaataataaattattttttatttttcacaatttttctcttttatccttcacaaagctccgcgtcaaaaaagctccgtttgtgcgttatctgtgaacattcacgagaagttaaaattgtgttggaactgttttatgaattaaatggtggaatatttaaaatatattcggatgtccaaattggagaaaatttcgaaatcaaaattaatgaaaaagatgaaagagaaattgacaattatattttgcaatttcatgtgtcggtaaatcccataaataatgaatttttgccggatgaaaatgacgaaaacccggcggatgatcagccatacgaagatcaatttgtgcaaatggacgacatccggtccctgcaccggaccgtcaaagtcgagctgttcaggccgaacttctcgcggctgtacgtggtcaatttgggcagtgccgaccccccgggacggctcaattggaaccgaagagtttttgtggaagcggaaaacgacgcgggcaattaccacgcatttgtgtacgcttttgtacagaaaaaccgacgcggatttgagttagaggacgagagaatacttttgggatttgccccactcgaaaaattggaaaatgcaaatggacagcaaatgccaaaggcaaaaaataaatgccaaataaataatattaataatttgatattttaagttcacagaatacaaactatcaatcccggtcaatttgaatcgctttttcaaacacaaaatttggtttctcgacattgacatttatcagtatgaagaggttgattaactttgattattattgtaaataaa

SEQ ID NO: 78283 - DNA, 343 bp, Heterodera glycines
  Genomic contig location: Contig_ID=SeqID_14263; Location=989..1331; Strand=+
  SCN-specific regions: Sequence locations=1-8,31-76,118-125,151 -234,256-343
atgttttattatgcatatttaataaataacggatgccgaaaaaaaatcgatgctcattgtaagttaaaggcaaacctataaaatatttttattttataatttaaatttacataaattgagaatttggaaaggaaatttaaaaattaattagaaacattcctaaaaaagcaccattaaatttttcttttccctttatttttttgcctaaaatatttcgctgtcattcactgcgctcaattaaccattttcagtcaaataaattcgattagttgctgctaattgtcaattaaaagaattttttttgtttttttaactttttattttcttcattttcaatttaaaa

SEQ ID NO: 78284 - DNA, 177 bp, Heterodera glycines
  Genomic contig location: Contig_ID=SeqID_14267; Location=4371..4547; Strand=+
  SCN-specific regions: Sequence locations=1-177
atggaggtggacaaacatgaaaaatctgaagcggtgccaaccgaagcaaaaaatgagtcagaactgatcaaatcaactaaattggaggacgaagaggaattcgaggagtttcctgtttacaacaaaggcgaaggaatcgacacggtcgaagcacaggcggcgattaatgtttgggag

SEQ ID NO: 78285 - DNA, 3154 bp, Heterodera glycines
  Genomic contig location: Contig_ID=SeqID_14267; Location=196..3349; Strand=-
  SCN-specific regions: Sequence locations=1-725,748-1434,1494 -1753,1798-2572,2615-2624,2646-2778,2817-3027,3050-3154
  Gene Ontology: Mol. function=sodium-dependent phosphate transporter activity; Cellular component=integral to membrane; Biological process=anion transport
cagagggccaagtctcgggaatttctcacgctgagcattccttaatttttcaggtcagaatcaaaactttggacggccaactttttcctcggcacgtgtgtgttgtacgcttcacgtgttgcgctgccaatctgtgcggtggcgatggcccaggagtacgggtggaacaaaacggactcggcaagtccaattcggaattctttcgcaaaattaaatcccgagtctaatccccttttaagggtactatgctgtcctgctttttttggggttacgccttcactcaactcatcgccggaagttgcgccggtctgtctacttttttgggaccgtaaaatcgttaaatattcatccactctcatggggtacctaaccgctggttccattttcgacccacacacattccatttaattttgagaaactcgaataccaacctgaattccaacaaaaagcctagtcgcgattttattttttgttaaaattgtgcaaagtcgctcaatttatccctaatttgtccgttagatttgctgggcggtgagcgtatccttcccgtctccaccctcgtctggtcattactcactctgtgcacgccacaactgtttgacattgcctattggacaaactctccgctgctcgtcctcctctttgtacgcgtgtccaccggcgttggccaaggtgggcaacagttttagcagtttttttgtgggaatagttgcagggaatttacatttttttaaattttttaaaatgcaaaatcaaacaaaaatcgacagtgtatcgggtaaaatgtgggtttgtcaggttcacaaccagtataaatactgaaattctggaattttacacttcgtttcctcatttttagggggtcatttgttagcaaaaggtgccatcatttctcctttctctcttttgccaggctttcatctgccatccatggccagcatgatcagtcggcatttgaccgcctcggagaagggccgcgtgttcggcattttgcttggccggctccactttgggctcggtggtcgccggcggggtcggctccgtgatgctcgaatggttcggctggcggagtttgttccattttgttggtaataattccatgtttcttttgttggggtttcggataattttagttttggcttttttcactccgtttgttgtggttgtgtttaattgtatttaggcattttgagcatcctgtggtgtttgatgttcaattttttgagcaaagacgcactgtccgtgcggcagcgccggcgcattttcgactcatccgccaaagtcagaggaaaggcgccgcgggggcgggggttgttatgataatcgaccctccaaaatcgaggatttttcgtttttttaaatcttaactctcgggatttcccactccgaaaaacaaaaaatatccaaattagcaatttgtcaaaaaacctgggaataaaaagaatttgatttaattttattaaaaaaaatttatttggaattttaaaaaattccatttttattttgtacacttttcaggttgccaatccgaatagtgaggcgaagaaaacggacagtccgccgatgactccatcgccggcgaccaccgcgacaaatggcggcactgtgtcagcggcgggaaacgaaagcgctgccgtgccatggggcaaactgttcaggcacccctcattttggcaagtcttacagtgaaaaaatgggcataaaatcagaatgccaaattcaaagaaaactaaatcactgtagtctgcactcaatttaaatttttttgatttaaattaataattttattaaaaattctcgagggtacttaaaaggaaaaaaattataaaaatccattctgaattgtaacaatagcattgatttttttcctcttaaatttttgccctaatattgttctctcgtctccccagggccgcctcgagtgcgcagtattgcggtgccaatgcctacttcaccatgttcagctggttgccctcctatttctcggacaacttcccacacgccaagccgtacatttacaacgtggtgccgagcatggccattgtggtcacttcgctgctgtcgccgctggtcgccagccgaatgatggccaaggggcggtcggtgacttttgcacgccgctgcatggaggtacggtgtttattgttttgtatttgtggtggatatcaagggcgtagccaaacccttggtttcggaggtgggctgaattcaaaaattcgattttaggggtattttttcagtttttgagggtgtgtcccctgactacagacctgaatttctaaaaacgctaaaaagccatggtttccctccccccccctctccgcccagtgctgctcccttctcggcatggctttgtgctttctgtccgtctcccttttgcccgactctttctccgcttcgcttgcccttttcactttggcaatggccgtccggggctttcaccatggtcagtttttgatttgaatgcattaaaaataaaaaatttctttgaaaaaattctcaatctttgcagaaaaaactcatgaaaactaacttttttgtgagaattactttctttttatgaaaatttcgttaaattttttaaaaattttcaccaaatattttatttttattgtcaaagacttttcaattctttcatctttaaggcggtgtcgcagtcaatccgactgatttcgcgccaaatcacacagggtcggtgttcggtgtgttcaacgctttcgccgccatcaccggctttatcggcgtttatgttgcgggttggattttgcaggtgtggcaaaataattgttatgtaaaataatattttaaaataattcccccaccgaaattgaaaatatttttttgacagagaattcggcaacttttaaaaatgtttttgctgttatcaataatattataaaaacgtggcaactaaatttcaaaaacaatggcccatttcctcgcatcttttcggaaaatttcaaaaaaatttttgaattactaaattttcattttcaaattttgtttttatttttgactcttatgcattttcccctcttcccgggttcgcagatgaccaacaatcactggggcgttgtgttcatttgcaccgctgtccaatgcgttgtcggcgcggtcgcttacggctttaagggcaccggaaaaaggataatt

SEQ ID NO: 78286 - DNA, 229 bp, Heterodera glycines
  Genomic contig location: Contig_ID=SeqID_14268; Location=6..234; Strand=+
  SCN-specific regions: Sequence locations=1-229
gcgattttttgctgctttccgttgaagaattttccccaaaattaggagtgcatataagaacaagcagaaatgcaattttcaagggaaacattttggtggtttttgaatttggtggggaattgcaagcttttctcgggtatttaaacgaaattttttcatcaatttttcattaaattcttgaatttcatccatttctggctttttgtgttcccaggccgttcctctgcgg

SEQ ID NO: 78287 - DNA, 918 bp, Heterodera glycines
  Genomic contig location: Contig_ID=SeqID_14269; Location=1054..1971; Strand=+
  SCN-specific regions: Sequence locations=1-918
atggaggaaattttgagcgaatgggactgcaccgaaatgcaggccttcaatgaattgtgggctggcgtgaagcgacaaccggacgaatctttggaccaattcgccgaacgacttcatggagttgttgaatgtgcttatccaggtttgcccccaaatttcgtcgatgaatttgcagtaaagcacctaattcgtgctatggaaaatccggaaatttcggtgggattggaaatagctcgccgtccaggcatgagcttctacagtttcgtcgctctcgcagtacgcgcagaggcagtgcaaaaagccactaaatcggctggatttggaaaagagcaccggccaaattttcagcaaaaatcgacagttccgccacaaaaaattttcccgccaaagacaaaccgaattgtgtgctacaactgcaacaaaacgggacacatttctcgccattgtaggttgcccttcgcgcggaagcaatccaactgtgcacgaaaaccgccacaacaaaattttgcgacgaaaagtgccgattttcgaaaaaattcagaagctgagaagaaattgattgatttgcagttgtcgaaccaaccaccggcacaaccaacgaacgtggaagctggaccaaaacggaaagcgtccaaccgacagcgcaattcgtcgtcaagttgcagcgtaaaagcaacaaaaatggaggaaaaatcggcggaaattccaaaatggtttttgaatgctattttcgctgcgttggttgtgttcgccggcgtattttcgaaggaaaagtcaaagtgtggacaaatttggaaaagtaaaggctcaatgagtcgcaccgacgaagtgaaaggcggaaagcattcggaaaattggggacaattttttcgccgaaggccggggaggaattggcggatgtcgcagccgccaatctga

SEQ ID NO: 78288 - DNA, 981 bp, Heterodera glycines
  Genomic contig location: Contig_ID=SeqID_14270; Location=595..1575; Strand=-
  SCN-specific regions: Sequence locations=1-68,91-351,374-458,483 -638,677-877,961-981
atgtgctacgaaaaagtgttccattcaaagaaaggagtgccaaaagttagcagtttccaacaatcaatgcttcttccttcgccctccgtcttccatgcttcttctcggccactttcgtcccgttggtccgcacttttgccaacgattggacaccgttcaatcaaaaattggtcgtccttcccaattcttcggcctgtcaaccgttcacgagtgcacgaattcaccagctcaaattggcccccattcgcagcatcatgttcaaaggaatgcaaccaaatgatgaagctgacggcaatggtggcactcatcagaaacagctaaaagaaaggcggcgcacgattttgcggaattttgagaaaaatcacagaaatttggtcggctgtggcaccattcttcggttcttttgggacaacgtcaaaaaacgacgacgccccaacaaaaaagaaatgtaaaaaacgaaaaaaatatataaaatttaaattcctttttttcagcttcatctccgccgattgttggctcgaagtgttcgcttttcttgcgccttctcagcttggcctcggaagccgcggtcgagaatcgcggatcgcacaaaaaaatttgctgggaatcgcgcatttaaaaccccaaaaatttccaagtttttaaacataaatttttttaaactttttaaaattttcctgattagaaaaaataattaatcaagtgccggtcacgggcgaaaagaaaaaaaggtcgtcgctagcgcggcacaaaatgggaatatttctaacagagttgagcgggaccgggaattttgggcaaaaccgggaccgggacctgagaagccgggaccgggacctcgattttttttcgggaccgggaaccggaaccaaccgggaatttttaaaaattcaaaaaatttttaaaaaattcaaattttaattttttttcaactgaaaataatacaaaattaaatttttactttgttttttattgaataaa

SEQ ID NO: 78289 - DNA, 648 bp, Heterodera glycines
  Genomic contig location: Contig_ID=SeqID_14272; Location=672..1319; Strand=+
  SCN-specific regions: Sequence locations=23-87,109-212,236-648
ctctttggcatttggctttcactacactctccgacacaatttttttttctatcatgagactttttgcttaggtgtgcccttctcggacccgtcgtctccgtctgtgtcctccttcacctcaaatgttgctgctaatgacggttcatcatcatcatcgaataacaacaaccacctgctacaccatcatcaacagcagcttaatcaccatggttctgctgctgctgctgctactgctcacacaacaagtctcaacaatgacgcggacacaagcaaatgggtgatcaacgggtacacaacggtgtacggcacttacattggcccaatgcgatcgtcaatggtcggcacgacgacaatggcacaatcagcagcgaacaataacattggccacttttttgcggtcaatgaaagtgttgtgcaatgtgtgaactgcacctttgctggtgatattgcaggtgcagtttttgactttttttttggtcatattggtttaaactggatacaacaataaaattggccatatttcatcaatcaggcccgagaatattgagccttactttcatagtggtacggaccaaaacaattttatgcttaaagagtttctctataattaaggaaaatttgaaaaaatttcgtttatttttttaaaaa

SEQ ID NO: 78290 - DNA, 1188 bp, Heterodera glycines
  Genomic contig location: Contig_ID=SeqID_14273; Location=138..1325; Strand=-
  SCN-specific regions: Sequence locations=1-9,38-112,135-257,280 -740,762-827,852-1029,1059-1188
atggcaaatgaatttaaacaaaaaggaaaatattcaagcaaagaatggcaacaaaattatgccgaaattggtaagaaaattggagttaattatagagcaattacaacatggaaaaaacagtttggcattagtcttaagagaataacggaaaaagaaaaaatggcaaaaatgaaaatttttggcaaataaaaagagaaactccaaaaataagtgaacagaaattgccaaaatgaccaacacttcggcgaagaacttttggaaatggaaagccaaaaaagaggacaaagaaattgttgaaattctcgaaaattcggaaaattatattttatgtgacttttgtttttggtcattaacagggctgcaaaaaatatgcaaatgcataaaaaacactttttttttgtgtttgcgtataaaagtcgggacttttatttgcatatttaggctttttctgcatatttcatgcatattttgccatttttcgtcaaatattttccgattttttgcatattttgccatttttcgtcaaatattttccgattttttgcatattttgccatttttcgtcaaatattttccgattttttgcatattttgccatttttcgtcaaatattttccgattcgaatatctcttaggaaaaaaatttgattatgcctaaaattaatccaaatttgaatgggtgcgcgagtgggtcaacagtgagcttctctgccgaaaatcttgagaagattttctacttgatttattgtacatatgaattactattaatatacaatttgcatatacaaaatttagaattgagtaagtggtaataataaagatgcgtatgattatttttattaaaaaatcttatatacgattctcgaatcgtgtgggaaaatatgctaacaaatgctggcgttgagtgccaagatgcaaatatctacaagctctttcttatagcagaattcgaaaatcgcaaaccccgctgcaatgtaaagagcctgtcctaatcattttaatttttcaaaatttatcgaaactttaccatatagaacaagtttttaaaaacaaactttactgtcgagatcaccactgtcgaaaactaacagcaccgatggaacgacgagttgtcgaccctacactggacaacactgaactggccgctctcaacagctaaaattgctcaatttccagaaaataattaaa

SEQ ID NO: 78291 - DNA, 249 bp, Heterodera glycines
  Genomic contig location: Contig_ID=SeqID_14275; Location=558..806; Strand=+
  SCN-specific regions: Sequence locations=1-5,222-249
  Gene Ontology: Biological process=N-linked glycosylation
atgagcagggaaatgaaatggaaatggaaaagggaaaagaaaagtaaaaagaaaatggaatggaaaagtaaaagaaaaaggaaacgaagaaaaagaaaggaaaaggaaaaaggaaagggaaaggaaaaggaaaagggaaaaggaaaagggaaaagggaaaaggaaaaaggaaaggaaacaggaaaggaaaagggaaaacgaaaagggaaaagggaagagaaaagggaaaacgaaaagggaaaagggaag

SEQ ID NO: 78292 - DNA, 700 bp, Heterodera glycines
  Genomic contig location: Contig_ID=SeqID_14277; Location=318..1017; Strand=+
  SCN-specific regions: Sequence locations=1-114,136-351,377-700
atgcacccggtataatggggagcaatcagttcgtccccctcccccccggatctgtccccccccgcattgtaactccctcgagaatttttttttaaattttactgatctagaaatttttgcaagaaaaatttaaaaataagttttaaggggttttagggtcgttgatcacgaatccgggctcagatcagcgctaccgttcactacatgagctgtacagggacaaagaattgataggtttcctgtaccaataataccctcattggcaaggtgcccatgaggatttcgaattttattcttcctgtaccaaggttaccctcatgggcaagatgccaatgaggatatcatccatacaaattttctatttttatttttgttcgagtccgggtcagaggttcgaaattggcaaaaatgggtgctgtattcgtgatcagcgacctcaaaacccccataaaactaggcatctgaaaatgtatgtgaaatctgccccttaaactagataagtaccgggtataccaacacgaaaaacccataaattttcaacaaaaaaattattgttttcaaattattaatttccagttggaagactgcgaagatttggacaacgaaattgacgaggcgctgtccgagttcgaggcgaataatccggagcgcaatttgctgcacacaatttgcttctattgaccccccaccccccaaaaaa

SEQ ID NO: 78293 - DNA, 1612 bp, Heterodera glycines
  Genomic contig location: Contig_ID=SeqID_14278; Location=166..1777; Strand=-
  SCN-specific regions: Sequence locations=1-181,216-530,567-694,717 -859,881-1376,1402-1612
atgaaacaaacggcgccgatcacaaagacgggcctggcaaaacgcagtctccgctcgggctacgccttctcccactgcagtggctttggagaactgatcgccaagggcacgatgttcaagaacatcgaacacttgcgcatcccatcattgtcagtcagttcaatgatccatcgattgggtggattgattgattgattaaataattgattggttgaccaatcattggttggtcagattgaatcccttggttaatggtttctgccctttaagtcagtttgcccttcatcatgattcccactccatccatcgctctcgtcgccactctctttcccgggtccatcctgcactttcctcggcaaattcttcaacgggtcacagttccgatcagcaaattcttaacccgatcgtcctcaactctgataacgacgatggcgaaggtgccgcagtttcttcaatgactcatttttcgccgacttcgtccaatatgaccaccaccacgacattgggaggtggcaacgccaaaagccaacaaaaggtcatccaaactcacacaaatgacgggcggaacttcggattgggatttgtcaaaaatgaattccaatgctttaccacggaatataattgagagctttgaatttcagattcggccaattttgccccctcctccggcggtgccaaactcttctcgactccatcagtcccaacaccattctcatcaatatcggcaccataagcatcatcaaccgacttcaactcggcggagtaccattgaatcattagtcattgagcaaccgccgtcagcggacgatgagaaggacgacggaatgacaccaatgatcacacaaatcgtagtagtcaaagaagaggatgaggagggagacgaagtgatcagagcaacagaacagcagcagcgagttggaagcagcaattatcagcaagggacaacaccaacagaattgatcagaggaagcgatcaatatgggaaacaaacggaactggtcgattcgactgatcagcattggtcgtcagaacgggttcaggcttctgatcactatggcaaatcaacagcagatgatcgcccattgtctgagcgtgacaacgaaagtcggcggatggtgacggcttattccgctcgtcctattgacatggcacggccgaattctgagctgaaacacaatttggtagtaaatgccgaattggaggacgaagaagaccaaaggtcggaaatgccaacgccgaatacctcccacagttttgtggtcaatgctgaattggacgatgatgtgccttctttgcccagcaattggtaaatttattcggcactttttctttcaaaatttgtgaatttgccaagaaacgttctttttgctcgaatgaattttaattttaaatgttttaaggcttcgaaaagccgacacaatgccaaaattattcgatgctaatgaattagcgatgacgagcgttgaacagacagcagcagctgaacatggcaaaacattcgtcagcaaaacgagacgaaagagttcgagcagttcggcaacgagtcgaaactcgcaagagatgggaacggtgaagatggacagccagagaaacagacagacggttttcacgg

SEQ ID NO: 78294 - DNA, 748 bp, Heterodera glycines
  Genomic contig location: Contig_ID=SeqID_2177; Location=1440..2187; Strand=-
  SCN-specific regions: Sequence locations=1-173,202-688,710-748
atgcgctcattggtgcaaattcaaacggacgaatggtcacagctgttgaggcgacttgagcaggaggaatttgagcagcacaaagaacaaattcaagaggaaaatgcactgctaaaacgactgttggccgagtaaaaatgaattgtttttgatttaataaaaatttacgggaaactccactcccctcacccctaatcttgtggatatatacaatccaatttcgggggttttaagatttcggggattagattttggagaggattttataaaattccagagtttccgccccaaaaattagggtaaacattgtgaaataattcattatcaaaaattaatgttacaaaaattgtaaactttttaatagaattacaaaaatacaaaattaaacaaaaaaaatgataaatgcaattaaaatggccaattgtgtgatcagaaatgataataatatgaaatgatcaatcaaatgtcagatgtggcagacacgaggaacagctgagcaaacggcacagtgagcagagtcatcagctggaaatggaggcggccaaagtccgattttggcacaaatttcttttcttggcaacacatgtccaagcagggggaaatgtgaatcatgggatcatgggccctgtactgtatgatcagctcaaggatggaaaagaaattttagattttccatcaaaaagaactaagaaaattaaaaattttccgttacataaataatttgaaaatcccgaaatctaacaataaa

SEQ ID NO: 78295 - DNA, 63 bp, Heterodera glycines
  Genomic contig location: Contig_ID=SeqID_2177; Location=428..490; Strand=-
  SCN-specific regions: Sequence locations=1-63
tcccgattggtcccgggttttttcgcggtcccggtcgaaaaacttggtcccggtcccgacttt

SEQ ID NO: 78296 - DNA, 1253 bp, Heterodera glycines
  Genomic contig location: Contig_ID=SeqID_2178; Location=781..2033; Strand=-
  SCN-specific regions: Sequence locations=1-525,549-713,736-816,838 -852,875-904,992-1253
atgggaagagataaagcgcaggcatcagaaaatgcgcgaatcagtgcaaaaacaacaggtgggcgagcaagaaaaactcgtttttcgattagttgagctcggagagaatcgagattttcccaggatcctgcttttgaatttttttgaaaacatgtcggggccaggatcccgaataatcgagctttgaattccgataatcctatcctagtcagaaccggtcctgatcacaattcggaaacgtcaggattccaatcccagcatgacatgtaatctcccgatcctgttcccgactttttcgaaattctcggctctatattatgcggctgttttattatatcctattcttgactcccaccctgactcaattctcgaaactctcggaaaattctatgcacgcatttccaccctaaattttatgttattttcctcaccccgccttcagcaatgcgttgtggaacgactcgttgaccaaagtcacaaaatgtcgctgaaaaagcgtaaccatttgaacagcaccagtctgggggagaagcaggccagcaatgacggggacaacaaggacaacaattgccaacaaaaccaacaacaacacaattcattggcactacgaatttcggatccggcacataccgtaacaacggtggaattgaccggggaccagaaacgggtcggtcggttaccgggattttgcaaaaaaaaaaaaatgaacaaataaatttttaaagacttttcccatttttaggggagtttttttttaattgacctttaggggatgtatttttcgctttttataatatttttgcaatcagttcttcgaaaatatgaaaattgtttaattaatgaatgcaagtgaatatatattttttatataaatcagtatttgtgatcaacactatagcctgtatgactaattagctaattagcacctaatgagctgattgactaattagctattatcatttaataagctgagtgactaattagctaattagcatctaatgagttgaatgactaattagctaattagcacctaatgagctgattgactaattagctaattagaacccataactgtttgcttgtttgtttcagatgcgttcattggtgcaaattcaaacggacgaatggtcacagctgttgaggcgacttgagcaggaggaatttgagcagcacaaagaacaaattcaagaggaaaatgcactgctaaaacgactgttggccgagtaaaaatgaattgtttttgatttaataaa

SEQ ID NO: 78297 - DNA, 143 bp, Heterodera glycines
  Genomic contig location: Contig_ID=SeqID_2179; Location=1561..1703; Strand=-
  SCN-specific regions: Sequence locations=1-114,136-143
cggtgcaaattaataaggcaaaggaattcaggggtttgctaaaagcaatgagttctgagtaggagattttctgttctgtgccacatttacactatattttaatcgcctgtgaatttttaacctttgatttatttttattcatt

SEQ ID NO: 78298 - DNA, 151 bp, Heterodera glycines
  Genomic contig location: Contig_ID=SeqID_14279; Location=344..494; Strand=-
  SCN-specific regions: Sequence locations=23-151
atggaagaaaaagatgaagaaatgtcgcaaaaatttggtcagccacaaataaaatgggcccattcaacgagggaatggatgaaaattgccgaaaagattggcacttcccttacatcaatttacagatggaaagcccaattgggcttgacca

SEQ ID NO: 78299 - DNA, 433 bp, Heterodera glycines
  Genomic contig location: Contig_ID=SeqID_14280; Location=538..970; Strand=-
  SCN-specific regions: Sequence locations=1-157,180-204,241-353,375-433
atgcgaaaagatgtaagaccaattaattaaacgattaattagtggtagcaaaaataatcaaaaaatcacgaaaatttgttttttgatgcatattcgaattatacacataaaacataatattaattttttccataacatttaattctcttttcaatacaatttttaattaattttaattagcatttttaattatgggtatgtttctttatatttttttaatattttgatcataatattttagtcacttgctgatcataaatttgttcgtgggtatcttttttttggggcaataagtcaagcagcaaaactaaaaataacattcaccaatcaccggaaacttttggtatccaaaaacataaaaattttcaatttaaatccttattaataaatctataaagtaattgttgatctcttgtgaaatcatataaataaa

SEQ ID NO: 78300 - DNA, 1323 bp, Heterodera glycines
  Genomic contig location: Contig_ID=SeqID_14281; Location=264..1586; Strand=-
  SCN-specific regions: Sequence locations=1-22,44-226,261-468,490 -539,563-777,800-818,840-1140,1162-1278,1310-1323
atgattttacaattggcaattgacacagccaaagaaagcccaaatgaaagtgttgatgaaataataaaacaaaattttgatcgaaatttatacgaaatgtttaaaaaagcggcaaaaatgacacaagaaaaaaatggcagttcatcatcattggatgcttttgatgataagcatttgataattatcgggtcaaaatttgatgattcaaacatatgggtgagcattcaattaaatttaacttaaatattatttttaattatgccaaattaagtgtgatgatgctttattcactgaatttttgaaaaaagggcagtgaattttgggaaaatgcgagtgcaaggagagtgtgctcgaatagtatggcttcattcaaataatagttttcaaatgagttgaaaagtttgcacgacaatacgttaacagaaagtctaaaacaacctgcaaaattcatgatttttaatcgctcaaaaattttgaagttttctaaaagtaaaaaaatttcaagtccaagtttttcaaaaatggcgaattttttttattatatgaaacaaattgaaattttgcatgaagtcgcgcttatgccaacgtatttgaaaattcgtgtaataaggcatacaaattaaatccgattacaactgaaaaaaataattagaattcccaaaattttgaaattttccaacttgctgcttcatatggaaatccaggccccggcttttctaggcccggcatgtgtcggttttacccaaaaaattccggtctcagcaaatctaatgtgttcaaaaatttagaacaaataaagaaattagcgaaagtgttggagaaaatttagtttatttcatcgtaatgacagaattaaaattaaaccttcacaatggtatgaaattataaaattcactaattaattaaatttgttcgaaattaattaatgtattttctcacagatatacaaaaaaaattgtcccaaatttggtcagggaattggaagaaatccttcggactgagaattggcatcccattataaaacatgaaaaaataatttgaaatttgggctttcattttcatttccaaatgttttgctaaataacatttcgtataaatttcgatcaaaattttgttttattatttcatcaacactttcatttgggctttctttggctgtgtcaattgccaattgtaaaatcatttcattaatttacttttttggtccgttttccgatttaatttcatttctcaatttattctcattcaataattttggttcaacattatgatggtaccattttttaaattgatatttataatatttaatcggattaaaataaa

SEQ ID NO: 78301 - DNA, 405 bp, Heterodera glycines
  Genomic contig location: Contig_ID=SeqID_14281; Location=1638..2042; Strand=-
  SCN-specific regions: Sequence locations=1-222,244-298,321-330,362-405
atgctaattgcttttatgaaaggccaacaaaaaaatcttcaaatcagtaaatatgcaatccaaaaatatgaggcataccttggcattttgtattttttgaaaaagaattggcaatgcaaaaatatccttgaaaattttgatgaatttgaatggaaaaaatgccaaaaatatcgcaaatatttggtcattttgtacgaatatttgctcagagagtacgccggaattccagcagtgaaggcaaaatacgtgaataaaatgtggtcaattgaaattgaaggtttttatgttctttattcccttaccaaaatttcgtagttttattttaatccgattaaatattataaatatcaatttaaaaaatggtaccatcataatgttgaaccaaaattattgaatgagaataaa

SEQ ID NO: 78302 - DNA, 364 bp, Heterodera glycines
  Genomic contig location: Contig_ID=SeqID_14282; Location=526..889; Strand=+
  SCN-specific regions: Sequence locations=1-18,40-49,71-186,208 -308,330-364
attacatttttattcataaattttgagcaaaacacaaaaggtcaaaataggttttgttaaacttcttagggttcaaagaaaataaaaacgataaaataagtgctaataactcgaagagttgcttaacaatcaccaaaaaacatattttccatgctttagggccactgcaagttcaggaaaaataagtaaaatctaaaaaacttatttctatgtagtaatattatttagcaatacacattaatatgttaattaaaaagaaatttagtaaaactgacaaacaataacttgtttttatgattactgtcgaaaagtccattttatttttctgtcgaaaaatccttcactgtcgaaatgtcctttgctg

SEQ ID NO: 78303 - DNA, 1751 bp, Heterodera glycines
  Genomic contig location: Contig_ID=SeqID_14284; Location=270..2020; Strand=+
  SCN-specific regions: Sequence locations=1-124,146-386,438-593,616 -811,833-1005,1067-1246,1272-1293,1315-1637,1659-1706,1728-1751
atgttttattccgtttcaaccattctcctttttattactgctattatacatctttatttaattcatatttcatgtgcaattccatcggtgagttaattaatccgagtaattaattttacgggtctattttaattagtttgatgacaatattctaattgcatttatgaaaggccatcattggaaatgtgacaaaatagcagagaaatttgaagaatatgaacgcaccgaatgccaaaaatatcgcaaatttttggacattttgtacgaatatttgttcagagaatacatcggtattcacacagtgaagccaaaatttgtgtttaaagaccaaattgaaattaatgggccaataatttatgtggtgcattgtctagcgaaaatttcgcaattttattttaaattatcttggaataaaaattatgaatataaattaaaatctctgttcaaatggcttgacaatatttttgaaccaaagttgttgaatgagcacagattgaattatgacgaaacaaaattgccaattaatgaaattattttacaattggcaattgaaaaagcgaatgaatggcaaataaataaaagcttagacggaataattgtacaaaaatttagcaataaatttgaagaaaatttggaggaaatgtttaaaaaagcggaagaaagggcaaaaaacaataaatggaaagcaaatctaataaatgatgacaagcatttaatacttgtggacccgaagtacgaagataaatggacatgggtgagacttaaaattcaatgaaattatataaattcaaaacttagactgatgatgcgctattttctgaatttgtcaaaggattagcgacaaattttgagaaattttttaaaatggctaaagaatattcaaattatttaaatcgaatgaaagagaaaggagggaggaatttaaagaaaaatgccaaaaacatcgaaaacatttgcatattttatatgaatatttattccgattatatgctgaaggtttgttggaattttagtttattttgatttttacatttattaaagtaatataataataataatttaataagctaataagctaaaagtccgaaattgtcgaaacaattgcccccattggtgaagccaatttttattgttggagggaatcttcctgacagtttaattggtcttgtcgaaaaaatgaatgaaatttcgaaatgtttttggggaaaaaaggaaaaaactcttgatgaaataaaattagtaaatgagtaggaattaaattttgaaattaaagagcagaaaaattagtcccataaaattaaacaaaagagaaaacaaattttaaaaggacaaacggacactgaatgaattcggcaagaatttgaacaaaaaatggaaaaaatatatgaaaatacgaaagaaaatgccaaagaagaaaaggcaaaattggaaaaagcaattgaaaatgcgacaaatagtgaagaaaaggaagttctgggagaagaatacaatgacaaatttggcactttcaattcatcgccatttattgacgaaatttgacaaatttggcactttcatttcgtcgctctttcataaatcgttccttctttcccatcagatccatggcatttctgatgatgggtactattttttcttggaactttcattcaaatattatttttaggggttgattactggtttatttctctaaacttttggcttaaaacggggaaatttactatttccccgggaggggaaaaaaaaaagggtca

SEQ ID NO: 78304 - DNA, 431 bp, Heterodera glycines
  Genomic contig location: Contig_ID=SeqID_14285; Location=86..516; Strand=+
  SCN-specific regions: Sequence locations=1-431
cgacagatggctttgatccgcttgtccgattctgcgtttaaacaccgctatgtgccggctgagcgccaaacttattcagagcaacaaccgtatgaacgcacgagtgccaatggggacgaaacgatttcaaccgagaaaaaatgggacacaaaagcgatgaattggccgaaaatgttgcttgatgaagaagggaagagatgaatgaatgaatattgggaaaatcaaacaatttcatgatgaatttatgcacttatgatggatgcccttgattatgccatttaaaaaagaattttacatttttcgctttaaaattcaaaatcttttttttgtgagatggaatcccgagggataatcctgctaaaaccccagttaaattttatgggatcacgggtgattgcggaatttttgcatgttcgaaaattctaacttta

SEQ ID NO: 78305 - DNA, 509 bp, Heterodera glycines
  Genomic contig location: Contig_ID=SeqID_14285; Location=3697..4205; Strand=+
  SCN-specific regions: Sequence locations=1-424,446-509
ctagacccaaatataaagattaaatagcaaaaaaatattcaaagctcttacaaagagtgctgatcaaaattcgaacaagtttagggctcctatgtgatccgaattccctctatagacccaccctcagcttcacacattgaaaaaaataattttattaaacattcaataaaattcattacgggacatggacaattgaatcatcaaaattttcaaatccttcaattttcctgcatatccctcaatttgagagtgccggcggaattggaaaatgtggtgcccgaacgatttcgtcctcccatgctgtaaatgaatctttttattgagtttaaaacggtttaattgattaaaagaattctgcctgaaggcgctatcgaagtcgatagcggactcaacaaatattgaacaagctgctcacgtggactcacagtggttggccatgtaagagttgatggtgccggtgagccggtgccgaactctaggggtagccgcatggcttgttccgagttgat

SEQ ID NO: 78306 - DNA, 625 bp, Heterodera glycines
  Genomic contig location: Contig_ID=SeqID_14285; Location=1481..2105; Strand=-
  SCN-specific regions: Sequence locations=1-192,215-248,273-322,344 -351,379-516,568-625
atggacataccaacatacactctaaacaaatattcgtacaaaatgtccaaatattttcgatatttttggcattctatccgtcatattctgcaaatttctccccaattttgtcacattgccaattctttctcattaaatgcacaattccaaggtaagcctcatattcttgcgttgaatattgacaaatagtggtttttatgctctttaataaatgcaattagccaattgtctgtcacctaattaatggattaaaatagaattttccaaaatttaacccatcaatggatttgcatttgaaattggaaatgagaaatggaaagcaaaaataacaaaagaaattaatggagcagaaaaaatcattttgttttctttgtctaaatatttaattaagtggaataatcagattgaattaaagtccaactaaacgatttaataatatttcaaagttaaataaatgttttcgaaagtttgaataaaaattaataatgtcaggttttgtaaggatttttccaattgaatttatgatatttattttttaaattaattaaacttcaaaattaattttttgacaactatttttcatgagtaaattaagacttttgcttcaggtgggggtcttaataaa

SEQ ID NO: 78307 - DNA, 517 bp, Heterodera glycines
  Genomic contig location: Contig_ID=SeqID_14285; Location=2107..2623; Strand=+
  SCN-specific regions: Sequence locations=1-128,164-452,496-517
atggacccaaaaactttgcaattggcaattgacacagcgaagaaggttcagcatggagagccaatgaaatattcgaggaaagcatttgataattttgtatttagaattccaaaattcagacatttgggtaatattttttttgattaaaataaattcaaaattagactgatgatgcgttgttttcagaatttatgaaaggccaagcgacaaattttaagaaattccataagctgtttaatgaaaatgaattaatgatttttgcaaagcaaaagaacatttgaaatatgaagtgcatctcggctttgtatttgatgcgacaaaattggcaagtgccaaaattggagagaaatttaatgaatatgaacgagaaatatgccaaaaatatgacaaatatttgcgtattttgtacgaatatttatttaggctttatgttgaaggtttgctcaatttccattaattcaaaataattttttgattttaaataataattttaaaggaaaaaacgctgaattggcca

SEQ ID NO: 78308 - DNA, 818 bp, Heterodera glycines
  Genomic contig location: Contig_ID=SeqID_14285; Location=3370..4187; Strand=-
  SCN-specific regions: Sequence locations=1-46,68-818
atgcggctacccctagagttcggcaccggctcaccggcaccatcaactcttacatggccaaccactgtgagtccacgtgagcagcttgttcaatatttgttgagtccgctatcgacttcgatagcgccttcaggcagaattcttttaatcaattaaaccgttttaaactcaataaaaagattcatttacagcatgggaggacgaaatcgttcgggcaccacattttccaattccgccggcactctcaaattgagggatatgcaggaaaattgaaggatttgaaaattttgatgattcaattgtccatgtcccgtaatgaattttattgaatgtttaataaaattatttttttcaatgtgtgaagctgagggtgggtctatagagggaattcggatcacataggagccctaaacttgttcgaattttgatcagcactctttgtaagagctttgaatatttttttgctatttaatctttatatttgggtctagggttaggcaaggggctatataaatgtcgtattggtattcagcgaccccgaaaaccctaaaatagacccattttccggctttttatgagctttttagactttggacaattcgtgggtttttactcttttggacaattcgtggcttggacaattcgtggcttggacaaaacgtggcttggacaattcgtggcttggacaattcgtggcttggacaattcgtggcttggacaatttgtgggtcagcggaaaagataaagctaaattgaatatcaaaattgggcaatcattgggaggaaagccgctaaataatttacaaatgaaaaagtga

SEQ ID NO: 78309 - DNA, 1326 bp, Heterodera glycines
  Genomic contig location: Contig_ID=SeqID_14286; Location=399..1724; Strand=-
  SCN-specific regions: Sequence locations=1-229,297-313,337-478,505 -721,753-807,829-1326
atgtcgacgacactcaaaccgtcggactacaaaatattcccaaaaagtcagaaatgcgtcccctccaatggcacggaatcaaccgccagcggcgcaaccgaagattcattctcagcagaggatcgaaaaacggactggcgctcaatttatttggccgctttggtgtgcttttttggccaagttcagttcagcattttcctcaactcgcaattcgcctttatgaaaacggtaaaattaaaaaaataaataaatatttatttttgaatattatgaaaatactcatttaaaattattatcattttagcagaatatgtattcattttctgtaaaatttgaccatcatttccccccttttctgttctctcttttcttatcatttttctgctgaattttcaattttcagtgctctttatgtttatgctttctatttttgactacagaatataaaaaataaggcgattaaaccaaaaaaaatgcgacaaataattaaaaaatgttaaattcgttcaatgccttccgttcagcttgaccccaccgtttctgagggcttcttcggcatcatcgtcggctgtttctcgctgatgcaaatgattttctcacctttgatgggcatttgggccgaccgcattggtcagctgcgtgtgccgttgttggtgtgcaacgccatgatgttgatcggcaatatgttgtacttcgtcatcgagtggttccctgtcgaatggatgaagcatgtgatgttgctgtccaggctcgtggccggaattgggcccggtaatttctcattcgaatttggtttttgagcaaaccaattcaacagcccaaatcagtctgctggttgctttttcgaccattgccagtgtggacaaagatcgctaccgcgcaacggcgtggacgacctttggcacagcgattggcattactcttggcccgagtgaggagaaaactcatgcaagcaaatccaatttaattttagccttccaatggtttttcacttacattggttaccccgggtggcggctcaaccgatggatttcgataaatatgttcactgccacggcactttttgcgatttgcaccaatgtgttgattcattttttgctccaatttttctttcgcgaaagttccgtcggcattttagacagtccaaaaagcaaggtgaaaattggaagagcaaataaaatttttcaaaaattgtttgcttaggcaaattcgtccgaagtcgagtcggccattcaaaaattgccgccctacgaccgctgggcattggccatttgctgtgcgatgcgattcacgcagtatttgatcttcacgaatttggagacgtaa

SEQ ID NO: 78310 - DNA, 917 bp, Heterodera glycines
  Genomic contig location: Contig_ID=SeqID_14286; Location=1840..2756; Strand=+
  SCN-specific regions: Sequence locations=1-91,130-257,281-303,351 -433,455-726,749-917
atgggtcatgggattggttggttgtggtcattgcaatgattaatgttaatgagtgtgtgcacacacaaaaaccaaatttatttgaaatgacaaataaaatatgaaaataaaagaaaaataattaaaatactaaaaactctaaaattccaattttttatgttattggaactttcgacaacagaataatgcaactttattgcagcaatggccttctccatttggtgctctgcttcaaacaaaatgttaaaaatagcggcgtttgtgtgtaataatatggtaataattgtggattaatcattatgcaaaatattttttcatttttatattaaagaaaatataaaaaaataaatcaattagggaaaagaagagaatttttatgttaaagtgcctatgaaaaaaagttttaatttaaatgcaaatattgtgtttcccgttgaattgatggatgaattaaagacaattatgaaataagaaacaatgttttttttcattaaatgatagtgaaatgaagagactcccaaattttatagcctcagatgtaattgatgcaatttggccggttgatccacctacacttcgaatggctttatcacgggatgaaactgacaaatgaacacattggggagaagaaacattgacgaactgataaaagacaaacgaatggaagagataagagataagcagcaaagctaaaacagaaatttgatcaaattaacaaatgttttgaaatatcaacaaaatgaaatgagtacatttgtacgcagcgattgggggaaacatagggacaaatgataggagaaagggcgaaaagaaagaagcacgaacagaaacatctgaccacaacttacgggaaggcctgtgctaattgaacgttacaaaaaaatgttgaaaggattaattacactatttggagtgga

SEQ ID NO: 78311 - DNA, 445 bp, Heterodera glycines
  Genomic contig location: Contig_ID=SeqID_14288; Location=443..887; Strand=+
  SCN-specific regions: Sequence locations=1-94,180-331,357-384,406-445
atggcaatacgtcaaatatttcagtttgggcatcaactttgtatgaatgtgacggcattcaaaaatgaattctttgggtaagtatttgaaaaagtaaataatattattattaatatacaatatatatacaaataaataattaaatttttttattaaaattaatatataataattttaatcttttcagaaatgatcagtcacacaaattttgtgtgcacacccgcaggggagattttgttaaaagaggttgggactcgaagaaggaacctacggagaaaggaattgatttgggatttgaatatttaaaggtgattcaaatgatgaattatcctttttaatttttaattaaaaatttaggaaaaatatgacaacatttccatttctgttgttttgcttggagaagacaaacaatttttggcgaatttatcattcaatcagcaggcaa

SEQ ID NO: 78312 - DNA, 273 bp, Heterodera glycines
  Genomic contig location: Contig_ID=SeqID_14289; Location=223..495; Strand=-
  SCN-specific regions: Sequence locations=1-183,209-273
atgtataaaaaattatttactggtgcagcaagtattcagtattctgtccttagatgacaaaataaacaattctgaatttttaggtgagtttttaggatcaatttgtgtaatcttattggaattttaaaaaaaaaaaatcctctttctaattttttataaaatggacatttgcgtcgctgagtcaaaaatatattttaaaaatattattgcaattttcagaaaattttctcaaacgactgtgaaatgatttttttaatttatttttagaataaa

SEQ ID NO: 78313 - DNA, 103 bp, Heterodera glycines
  Genomic contig location: Contig_ID=SeqID_14289; Location=1631..1733; Strand=+
  SCN-specific regions: Sequence locations=1-103
atgccaccattatttcgtcgacatccacgacgaagcggatggtgcgctttcaccgataagaattcggaaggcattccgaattctcttggaatgtcagggaaaa

SEQ ID NO: 78314 - DNA, 229 bp, Heterodera glycines
  Genomic contig location: Contig_ID=SeqID_14290; Location=1610..1838; Strand=-
  SCN-specific regions: Sequence locations=1-229
ggccgatccatcattatactgggaagttaattcacaaaaatggccaatgattggtgccgttgtacggaaatttctttctccgcctgcaacaagttcagaaagtgagaggcttttctcaacggccggcctgatttcagatgacttgagaaagagtttacaggcggagaatctggcaaagcttttgtttcttcatcacaatttgcttttaaccggtttctcaattgaatga

SEQ ID NO: 78315 - DNA, 1003 bp, Heterodera glycines
  Genomic contig location: Contig_ID=SeqID_14292; Location=1519..2521; Strand=-
  SCN-specific regions: Sequence locations=1-344,367-438,460-725,748 -1003
atgggttttaccagttttgtacgggctacttactacaaaaacaaaggagacctatgcccgcttttttcggatggttgtgtctttctggcctaattttcgtcctgactcaatttcggttgactttgaagcaggaatcatcggtgctgtaaaagaagtgttttaggattgtgaactgtcaggatgcttttttcatcttgtccgtaatttcaaaaagcgtcttgctactgaacaccttgttgaggtttttccttcaacgctgtgtcacttttaatttccattccaattttagcgctacaattctgacccggtctttcaaatgaatgccaaaatgattacatcattggcttttttaccaattgaacatttgacgcttggaatcatggcacttgaaagagaacttcctctcgaacttcagccagtttttgactggtaaaaattcaattttgaaagttgcttaaatgttaaatacaggttcatcaacaattacactggccgaccgcgttttgacggaactcgaaaccctgcactgtttgatccggtgatctggagtgttcatctgcgaaccatccaaaaacgagacaggacgaataattacgcagaagccgcacaccgatcacttcaacgcgcatttggctgtgaccatccgtcaatttggttatcgacagactccgaaagtgtcagaaaattatcgacgccgattttgcaaaattttcgatgggtaattcaaaaataaatcaaaaatttttaaagctgactttataggcgaacaaccttcaaagaagcggaagcagtacagagacgccgatcgccgaattcttactcttgttgaacgatacgcccaagaaatgggagtccaaaatccgttagtgcccattcattacgatcaccaatactttgcaaatcccggcccaaattttaactatgtgattgaatttcttcagggaatatcccacaattatgagatgaacccatgatttgttatttatgttttccaattaataaa

SEQ ID NO: 78316 - DNA, 1831 bp, Heterodera glycines
  Genomic contig location: Contig_ID=SeqID_14293; Location=804..2634; Strand=-
  SCN-specific regions: Sequence locations=1-357,380-396,418-587,609 -868,890-973,1019-1570,1592-1831
atgccgactgcgacgacgaaaacaacagtggtgccaagagcaatgttggtggacgacatgccgacagtggccgtggcattctcgagactttggctgatcagctcgctgaacgaattgaacggtttactgatctgcacagtgaggtgtgtttgtggtccggtccattacccgattcttttttggctctttccatactcccgacaattttaatctcgatgggttcggggtcgtttgaacgttttcccgttccggtaccgcgtatatttactaggcttaacattttttcgtaagtttgagactaatttctggaaacctaagagaaattaccaactttgaaattttaagaaaaaagcttagaaagtttttaataagaaaattacaaaaaaaattatagtgaattactaagttttttcaagaaaatcgctaaaaaaaattttcaaaaactttttttcttgcaaaaagtgtctaggtttggaaaaaattgttatataaaattttccgggggggggggggacaagctgctcccgatgaaaagacctgtaaaattcagccaattttaaaaacattttagggataggcatcaataactgatcaatctgatcaagcccattataaaataaatttattcagcgctttgttcaacaatttattttccgtctggccgatctggaggatgtccaaatgcaaccagagcacagacaagcagaaattgaccaacaaaagtgcgagacaaacaaacgattgggcgtcgcactgcgcgacgatttggcggcacttttggacaaatacaaaaagtacggtacaaaatgtgtcatcgcgagtactgtaattggaccattaaataaattgaggtcattgaatatgatggcaaattttttggctaaacaaagctctgcaaatttgtaaccgaggtcttttgaaattaaaacccgacagatcattcgggagtttgatacctaaagtaaatatacagtaaatattatttttttaatttcaaataaaacattttcaaaaaattcagaaaagcaaaaattcttattttttttcttccataaaaaatatctaagatttaaaaatttttaaacggagagtgggatcggcgtgggactgggcgggaaacgagcttctgctctcttttaatgacccgcattttaatccgccgcagggaattcacgtggtcgcaccttttcgccaatgttcaccagtgccttcttgcggaggatgcgcaggaaatgttcatggttcagcagcaggcgaattccgacccgtcttcttcgtcgtcctcgacacgtacacggaaaagggaagtgatcttccggggcaacaaccaatcgcaacagaacgccgccacccaccaaagtcagcaccggcccgagtccgcaattgtgccaaccgaagacggtagggcaaccaatccttttctacggtaaaaacactcttgaagcgtagaatttgtggagtcaatcactatttccttgacatttctcgtttatccggagcacaaaagcccagttatcctgtaaatcctgctttaagaaaagaatacagtattccgtgcatgattaccgtaccatccctccttaatttattcgttctcagttcgtacaaccgcagcggatgcgatggcctcgctgttgctaatgtctcgcagcgtcatcggcgactttacgcatgtgagcgacgccaaccaaccagggcgagagagagacaacggcagcaacaacggcaaactgctgacccatttggccaaacagagaccgaaaccggcacggctcaatcgcagtcgcattcagccgaccatggcaacggtgacaagcccgacggtggatga

SEQ ID NO: 78317 - DNA, 230 bp, Heterodera glycines
  Genomic contig location: Contig_ID=SeqID_2180; Location=234..463; Strand=-
  SCN-specific regions: Sequence locations=1-7,41-230
atggcttcttctgtttcttcttcatcatcactggctcatcaccatcgttctcattttggcattttgccactaattgtttcgccgcttttcctctgcctgtcaattttcggcaccgatgccattcccatcgacggggttgacgatgccgcgtttcagccctttcagcagcgacaaccgttcgcactctttgccgtcgcgcaggaagcggacgaaaatggcggcattggaag

SEQ ID NO: 78318 - DNA, 351 bp, Heterodera glycines
  Genomic contig location: Contig_ID=SeqID_2181; Location=5194..5544; Strand=+
  SCN-specific regions: Sequence locations=1-351
atgtcatttctcctccgctttatccttcagctcggtttggcccttttccatcgttgcacttttggcattggcacttggagtggccctttccttttcgtcgattgcctcaaagtccgttcgatttgtcgccgccgtgggattgttaggcaaatggcgaaggaaatgatcagagtaatttgaaaacgaaaataaatcactgaggggataaatctattaaattttgagttggcatcactctttaatttaattcttttttagatcgccgccaaatcgaatgatccactgatcggatggattgccaaagaggacgcgaccacggatgccttcttccaatccgttttttaatacgaa

SEQ ID NO: 78319 - DNA, 300 bp, Heterodera glycines
  Genomic contig location: Contig_ID=SeqID_2181; Location=7024..7323; Strand=+
  SCN-specific regions: Sequence locations=1-3,25-300
ctttttcacttccctttccaatttatcatcgatggaatgcttctgattgccatccaaaaattgtgatcaatgaaagcacaaatgccattcagcgcaatacgacggggacagaaggtgataaaattatcaatgaaatttcgatattttctcaattttaatttttttttaagaatttcttggtggtgatggccttctaattcctcgttcatgccgagcagggccaattcaaatgtcatatgcttctgctggtcgcattggcattatttatgcggaatatcgaattcttgctggaaatggccc

SEQ ID NO: 78320 - DNA, 1331 bp, Heterodera glycines
  Genomic contig location: Contig_ID=SeqID_2182; Location=266..1596; Strand=+
  SCN-specific regions: Sequence locations=1-160,200-288,311-686,709 -1136,1167-1212,1235-1331
atgcgggattgcgggatttgcgggattaatcccgcgggatcccgtcccgcaaagaattttgagttccaatcccgcagtgggatccgcaaatttgattttttgtgcgggattatgcgggattttattgatttttttgaaaatttttctaagacagaatgccaaatatttttaaataaattaaataataaatttaattaaagttaactcatttttcgtcgcaaatttcattcaaaatttgtgaaattttcccggcggcgcctatcggcaccgccgtaccctcctccaagttcccaaaaagtttttgaaaaaatcgcgctgtaaaaaacatgtaaatagtcactcctttttccaaaaatgttctaaaataatgaaaaatgacaaaaagaaatgattaattttaaaaaacaatattttaagccgaaaaagggggaaaaaaatattaacgaaattttgggacatttttttttgcagaatacagagaacatatagagcaatcgctatctgtgactttgttttaattcgagcaactatacaaacgaattatgcactagaaaaccgtgccatcgaccattatctgccaccggtccgggttatcccccctcccaaaaaaaaaaatcaaaaaattgcttatttgcagagaagcgtgtttactgcgcaagtgttcgaggtgccctgctttgctgtgccaatgacatccttgaggaaaatattgcgcgcaattggattgaggcggaggaaaagaacgtggacataatcatttccgcccgaattgccaccactgttgaaacggaattatttgcactgacctatgagactggtgagtgagtgggggctgccgagaaaaattttggaaaattaggggtatgttatattttcatcaaaaaatgacccaaaaattttgtgatttgagcaataaaccacccccccccccctccccacctaaaaagtgtataaaaatctcgtcccgcaaaaaatgttgtaattttttgaataatttgtggacaccatgtgccataccatatacacttacgcatatttacggacaaaaaatcattgcgtatttaaaacgaaattttaattcatatttgatgcttaatgtaatggtgccaacaatttcaatcgcccaaaaacagcagaaattaatttaattaattatcattttaatagacggcgccaaactgttgccctcttgcgactgtaccgaccctcacttgctttttgatgggaaaagaagtcttagccactattgcaagcttccttgtaaggccgactcgacatgcaaaatattttccctttactaaagtaaatttcgatttgagtcttttgtttca

SEQ ID NO: 78321 - DNA, 1752 bp, Heterodera glycines
  Genomic contig location: Contig_ID=SeqID_14296; Location=516..2267; Strand=-
  SCN-specific regions: Sequence locations=1-160,185-258,281-297,321 -367,402-402,425-496,520-1334,1356-1575,1599-1752
atgccatccgtcagtttgtctatgattgacttttcacatgtatttttcattcaaaagacggagacaaaaatggatgaaaattacatgtttggacttcttcacatcatcaaattggttggtaaatgttatttaatttcaactcatgaccagtttttgcttttcaaatttttaaaaatttagtttcgaaaaattcgaatggatttgttgcttgccatgaaattggaagctcaataaccgtacgaggaatgctacaatcaaatacaaataaaatattgaaaatgataaattcggtgtaccaaaaataatgatgaccaattgaacataatcccagcagatcattccaatgccaaaaacaacataaccaaccatttcatattgatttgtttgttcatttgtgttttatttgatgaattttattggcataaacattttgaactctttaataaactatttaactcccgttccaatcacttttcgacatggtttttgaccattgccttggcatttggccattctatcggtttttccacttcccattcctttctaacaaatttttcagaaaaaaatttttgtgatgcgaaagggctaatgagattctcgcccagaatttttccctcatttttgcagcaattaatcaacagaaattttctagccttgcactgtccccttccggcaacttcggcgggtaaaagaaaatggacaattttaacctaaagaatcatgttttctctgaatcttcgggtgctttatcatttaaacccaatttgtgttagaatttttcatttagcaaattccgtttcctttttttcactttcagccaaattctcaaccgacggaaagtcggacgtattttgcgcttcgcttttgcacaacgaactttgcgaaaagctcgataagcgtaaggaagagtggaggaagcaaaggccgggaacgaaggaatatacggcgaccaaagaacagcttaaccaattgcaggaaggcgagaaattctttttttatttgctaaatattattttcaatcagtccttttttacgtcaaccatttttagaaatcatcaaaatcgaaaactccaaatacgaatttttgcatactgaaagggacaaaatgagcattgctaaccttgttttggcgccaactcaagtcacactggaggcacgtattaaaaaaagggttaaaagtgatgaccagacccgtaacctgggggagggggcaagtgagggcgattcccccctcccaaaaaatgaaaaaaaattttcagaaagagtaattcctacgaatttgacccaaaatttacgcaattttccctagcagtgtctaaaggtatcgccgggtcccaatttcttatattttggccaaaattggtctcaaaatggccaaaattttgcgaaaatgactggctaaaaatttcccattttcccacagcgcaaaaatctagcaaaatctcactgggcaaaaaatgtgggccggaagatcaaaaaaaaattcttgggtgtccctcccgaaattttatctgattatgggcctgatgatgacccattttcctataaaaacacactttttctctacttacataggtgatcagcaacgggaccacccacctgcgcccgtcggtggtgctccgtacgccgttgaatgcctacttgttcaactgccccgagggcatttgccgctttttgcccacctttcggctgaggacaaatgccatcaacgacatgttcttcaccaagggtgctgcttcaatcatcaataaa

SEQ ID NO: 78322 - DNA, 158 bp, Heterodera glycines
  Genomic contig location: Contig_ID=SeqID_14296; Location=2639..2796; Strand=+
  SCN-specific regions: Sequence locations=1-158
tcggagtaggacaaaacgtcgtcggccgaaacgtcgtcgaacgaatttttcgaccgtaacttttttctttctcaaccgaattaaacgattcttggtattattcgaaagcgttcgaaaggatactattagcctgcaaattttcaaaaatttttatttat

SEQ ID NO: 78323 - DNA, 196 bp, Heterodera glycines
  misc_feature (125)..(125): n is a, c, g, or t
  Genomic contig location: Contig_ID=SeqID_14297; Location=1541..1736; Strand=+
  SCN-specific regions: Sequence locations=1-196
atggacaaagacattgtgccaaaagaaggaaatcgctttaaaaagcacttcgacccattgactaccaaagaaggtgggctttgcataaaatgacatcattatttaattttatcctaatttgttanaaatttaagcaaagtcttccgtcacttttcgatccaccgaaattactggtgattattttgttctaccataa

SEQ ID NO: 78324 - DNA, 1887 bp, Heterodera glycines
  Genomic contig location: Contig_ID=SeqID_14298; Location=11..1897; Strand=+
  SCN-specific regions: Sequence locations=1-51,73-523,545-571,593 -723,745-766,788-795,817-967,995-1144,1189-1253,1283-1449,1471 -1480,1502-1758,1800-1887
atgggtttttgggctatgggttcacatcctgttgcctgtaaaaattgtgttttaattattttggggtttttgggccgctgatcacgaatttgatattaatttctccctgtaccgaacccctgacccaaactcgaacattttaagaatttaaatgagaataaaaaaattttttggtaaaaataaatcggagtcttcaatgctattaaaaaaggaagaatcgtaccgaaacaattgtgggaaacaccaaaaaatgcaaattaggtatgcgagtgggatctagaccccgatttaaatgaacattttaattttgttaaactccccgaaaaaaccgcctctcgtattcaacctttagatcgttttttcaacaaacaatttaaataatttattcgcacaattcatgaaaaggtacgccgatcttactcaaactataatttgtctaatcgcaaatttatcggtcgcatattaaatgaaattcatttccaactttctgcgccaatttttgtcaattttattcgttattcatggaaaatttcggggtatttgggcattgtcacaattccaccatttgaaaccccaccccaattttgtttccgaaatttggatgtttatctctcatgccaaaattgtaatgtgcctgaaatctgtccgcaaatttggacactgacctcccctccgcccattatgcacccctaagaaatgaaaatttctcaaaaattcacctccaaaatttatttattttattttcttgacgataatttttgattttgaaaattatttatatccttaatgacttggcaaaatatttttgctttttgatgaaaattttcaattttacacccctaaatttggaactttttggcacctattttccaatttttggcacctattttgggctttttttagggcctaaaacctacctatttcggcattttttagcacctataaatattagccctagtcagtaatgaacaaaatttatttttaatttcaaaatatgtgctaatattgagattttcaaatgtattttggcatttttaagcaaagtcttccgtcacttttcgatccaccgaaattactggtgattattttgttctatcataacgatcaaaatgggctttggataatttttgaaaattttttaccgaaaaaaaattaaattttctattttattttgctttaaaaatatatgtcataatgtgcgaccaaattttaacaatggatttcttacaaattatggtcctaaaagttcagaattttatcattttttcaaaatctttcaaagaattcctaatttttagcccatgaatatttggatttttcattgtttcgtttggtgccaccgcatttggtggaccctggcacaattgtggtgaaaactgtgcgacagccaaatgttcttgaagagcacaattatcacaagcggccaattatgtacattatcaatcaattaattataaaatcaatcaatcatctcacacaagggataaagccaaatgccttatttttgacataaaaaattcaaaataattaaatttgtgtagcgatcgatcgctgccatcggtgccaaatttgcctctctttcagcaaaaccctggtcagaaaacggttgtattggctgcgttctccctccccaacttttgctgattctgatcactcgcaaaacaatgaatcgtcgatagaatcagcggagaatttgcatgagaatacggcgacggaggggagaccgcgcgcagaaagttaggcaaaattttcttttggaaattttcgtgttttcctttaaatttaaaaatttaggggaagaattgatgttttgtaatccattgataactttcaaaatttaaagatttaatatattaatgggcggggaaaacattcaaaaagaagcga

SEQ ID NO: 78325 - DNA, 387 bp, Heterodera glycines
  Genomic contig location: Contig_ID=SeqID_14299; Location=87..473; Strand=+
  SCN-specific regions: Sequence locations=1-15,58-124,298-387
atggcactttcccaactgaaggggaaggagaaaaaactgctggatgagaagacaaaattggaaaaattgtccgaaattgcgcggccgtcccatcgtttgatgccaattttgttgcataggcaaccagagatagatgtaaagaaagaagcggaagagacagtgttggacggaggagagagtgagaaagatgtgaaacgagagactgttgagaatgaagagagcgagaaagaagcggcagagaaacagccaaaggaagagacagaaaagggacgagaaacgcaagcagaagcagaaacatcagcaacacaacacacagtcagggaaaaagaaaatgacgacaaagggaagagagtggacgaaagaaggcaaagcattgaccagaaataa

SEQ ID NO: 78326 - DNA, 612 bp, Heterodera glycines
  Genomic contig location: Contig_ID=SeqID_14299; Location=589..1200; Strand=+
  SCN-specific regions: Sequence locations=1-198,221-576,598-612
atggccgaggcaattgtgccaaagtttggcatgctcaccaaagaggaaatggcacggatgaaaatgctgcaacagcaaatggagcggaaacccgaactcgctgctgctgtgaagagagctcggctcgagcaggaacataaaacattgaagacggacgaggaggtaatcaaccggatgggcgggcggggtaaagttgggttggaatttttcctaataaaattaatcaggaataaaaatatacataaattcgaatggctattgaatgtctgctggagaatcatgttttcatttttaaagattttgaatacagtgttccaaaattaaaggaaaagcaacaagtgcaggacgttcgtgagaaatatacgacatggcttcctcccgaagaccaatcgggcgacggttcgacacgtttaaatcgaaaatttgcaggaaaatattaaagacatatattttcttgttctttcgagtttatgcttttataaagcccagaaattgctttttaaatagaaatctgaaaaaacattcaaaatcattgcttcacagggttcgactacactaaacttaacagtccctggtcaggaaaatacaaagtagcataagaataattctaaa

SEQ ID NO: 78327 - DNA, 828 bp, Heterodera glycines
  Genomic contig location: Contig_ID=SeqID_14299; Location=2091..2918; Strand=-
  SCN-specific regions: Sequence locations=1-71,93-345,367-442,464 -770,792-828
atgtatttgcgatctgcggaagatttgatcatttggatgggcaaactcaatgatggcagcacaaagccgcaattttaccatgcaggaaaggtgaaaatggttattcattaaagagagcacccactcccccagtcggtgcatagtttcggactacaaacctgaattctaacatctttaaagttcggaatttgctgaactcagattcaaaacttgccattgaaataattcctgtatctatattccccaattgacctttatctgttttttcgatctaaaaatagaggaaaaatacaagtgaccaacaagccaatttcattctttagtttcagaataaaaccacaattttttcgctattcaagttttttaaataaaaaaatgtgttctttcggttgtcattgatcttgcatggtttaggaaaaatacaggtctggatccccaggtatatttgtttttcaggttcaaattggcgatgagctgctcgattcatacgtttctcgcatcactcatcagtttgtcgatggtgccgtgaccaaaaatgagagtgccgtcgttgttgtcgaagttcttttggcaaatctaacgattggaaatatgcccagtgatgccattcgatcggtggtccattacactaaaagcggacggacgaatgccgagttcatagtcaatcgggtgcagcagctgaatgcatggcaaacgctggcggggaaactgaggggatgcgtcagaaggacgacggccgactcggcctggggatatttcgtacggatgggaaacggtgagacaaaaaacacggcaaaggcaactgagaattgtccaaattgggtttag

SEQ ID NO: 78328 - DNA, 765 bp, Heterodera glycines
  Genomic contig location: Contig_ID=SeqID_14300; Location=323..1087; Strand=+
  SCN-specific regions: Sequence locations=1-241,280-744
atgaaagaagaagacagacactggaatttgattgtgcaagattacaacaataacccacaaaatggaatgcgtggcaggggaatggcaaggaaaaacatttacgtacagcaggaccaagcaattcgcgccattttcttggatcgtcataacagaccttttttggcctatctacgtgcaatcgcttatcgaatgccggaaccaaattgatttgattgagatatttttaggaaataatccgttctaatgacttgaaaatattttttaaaatagaaatttactgtcggattgtccactgtcggattgtccacttctgtcggattgtcctcactgtcggattgtccaactgtcggattgtccactgtcggattgtccactgtcggattgtccagtcacgtatccaaaagttattaaatttaatgatgagaaataagtaaactaaaaatagttcttcggttagaaatcttggtcaagcagtaaatacagctaatcaaaaagcttaagcaaaacagtgatttatatgattcgaacccggatttatttggcttttcattttttacatgatttttttgatgtttctaaactggttttttctcatttccatatttctgattttgtctatatttccatattgtacattcatattacggcatttttacaaatctcaaagacaccactcaatattttttgtttttgtaaaatacgaccttaaaatagaaaaattttggaaaaccatcataaatgtaggaaacgaaaagaattgcagaa

SEQ ID NO: 78329 - DNA, 296 bp, Heterodera glycines
  Genomic contig location: Contig_ID=SeqID_14302; Location=2159..2454; Strand=+
  SCN-specific regions: Sequence locations=1-49,72-157,206-218,274-296
ctggatttttgtccaggaaatcaaggtccaggtcaaatgtgaaaaaaaatccaggtccaggtccaggcaaaacaggaaaaaacctggattttcctggacaaaattttagaatttattttttcaagtgaccgatgttttttcaagttttcgaaaacagattaaataaatttaaaaacacattattattattaattagatatttttagatgcttctaagcaaataattaattttttcaaacatttttttgatttttaaaataaatttaaaaaaatccagtccaggcctggatccaggt

SEQ ID NO: 78330 - DNA, 75 bp, Heterodera glycines
  Genomic contig location: Contig_ID=SeqID_14303; Location=1269..1343; Strand=+
  SCN-specific regions: Sequence locations=1-75
ttttactaaaactataaattaaacgcaaatgacaactaattaaaaaaacacaacaataaatcactaatcacaaag

SEQ ID NO: 78331 - DNA, 1403 bp, Heterodera glycines
  Genomic contig location: Contig_ID=SeqID_14306; Location=479..1881; Strand=+
  SCN-specific regions: Sequence locations=1-172,195-319,341-369,397 -426,520-952,999-1031,1053-1115,1138-1163,1231-1344,1367-1403
caaacgccaagtgtatgtggtggaggagccccgtgacacatttgttgtgccgttgaactcgcagcatgccaacgaaaaggaaaatgccacttttgaatgcgaagtgaacgacaaggacatcgatgtgaaatggttccatgacggtgccgagatcgggatggacgggcggcactttaaggtgggaaggagggggcaaatctcttgctaatcaaagaatacattcatatttttgtgttatgattaatttcaaaaattgagtaggagtttaaattacctattttgggattcctttaatcccaaaaatccctaagtatggatatttccaaaattcaaaccaaaactagctcaaattcttcaattcaaatgcctatcagaaatttaaaaaatatattagaaaagtcagaaacaaaaccatttttttaacaatattttttttaattttatatttttttacattatctaaaatttatttttatttttttgccaaatttcattttgtttttctattgtgtattttatagatgcttcttgttttacaggaacgggctggatgccgtcgtcgcctgctgatcatcaatgtactcattgaagaccacggggagtacaaatgcacagccaaagacgacgaaacaatggcccaactcattgtgcaccccaaattcgtcaaaaaagcggagcgcaagccggtgacctgctggttggacgatgagttgtattaaaattttttgtttttcactgttcctgttttatttgtgcccatctcttttttaaactctgtgaattgaagataaaattttattttcctttaattgtcctaattttatggtatatcccaaccagggctggccgtgattgaatttccaatcacggaaatccgtgagccgtgatcacggggctttaaaaaaaatccgtgatccgagatcacggcaccccaaaaactccgtgatccttgattaaaaaatttttttctaatgatttttttaatttaaatttatttagaaaaacggaatttaatcgctggaaaaattcctaaaagatattttaaagaaaccaaaacacaatccgctttttttgctgcgtaccttttccaaaaaatgactaagtttaccattttgagcaaattttttgatgaaaattaggcctttttgtagaaatctccaaggaaaaattttattttttaacaaagtttattaagaaaatttttcaaatttttcttaaatttatatttaactgtcccataatgtttctttaaaaattttagacattgcaattttgcgtacttttccaattttttgcaaaattaattcatgaatattttttcagaaagtgctctgaaacgcatctaattttatttacatgttaacaaggtcctcttaggcttatattatgaataaggctaaaga

SEQ ID NO: 78332 - DNA, 216 bp, Heterodera glycines
  Genomic contig location: Contig_ID=SeqID_14308; Location=103..318; Strand=-
  SCN-specific regions: Sequence locations=1-64,94-216
atttgaaagagaatagaaagaaccaggttcgatgaagttttggtaagccaaaaaaaatccaaacatttaaaaatctataaaaaatttaaaaatgagaattcatgcgagattttctggaaataagcttaattgggcctagttaagctgtaaaaaaaaatttggggcgatttgaaagagaatagaaagaaccaggttcgatgaagttttgttaagcca

SEQ ID NO: 78333 - DNA, 364 bp, Heterodera glycines; identical to SEQ ID NO: 62360
  Genomic contig location: Contig_ID=SeqID_14308; Location=472..835; Strand=-
  SCN-specific regions: Sequence locations=1-86,116-247,281-364

SEQ ID NO: 78334 - DNA, 648 bp, Heterodera glycines
  Genomic contig location: Contig_ID=SeqID_14309; Location=999..1646; Strand=+
  SCN-specific regions: Sequence locations=1-53,75-243,272-622,645-648
atgaacatttatttgggaaattccggaacaagtgaggcttattgggcaactcatttccctgtcggtgattttgtggcagaagtaacggagaacgcaattgtgttagaaagcgaacaaagcgtgttttattttgaaaaagaaaagggcgatgaaagagagggtattgttggcgtaccagacgaggcgtataaaatgtcaaatgacgttttcattctgatacacactccgagtccacaaaaagcgagaggaaaaagggaaacaaagcagaaaagtgaacctcagagaaaagagcgaccagcgaaacaggaagtgtttctgaaaatcaggccgggtcaaaattcaaaatttgaaaatttggacccagcgtccagacccaaaagcaattggacagggacaacttgggctccaaaaaggaacacaacggagctaataattttgagtaccccggttccccagtccacaagtacagtggggagtacgataaaagtgaccatgacaatttcgacaaatattacaagcacggttccaacgactataaggcctaagatagaagtcaaaaaaccaattttcaagaaaattcaaataaaaaatgagcaaaaactcagtcagtatacaaggcagttgggaaaaaggtggaaaaattggtag

SEQ ID NO: 78335 - DNA, 462 bp, Heterodera glycines
  Genomic contig location: Contig_ID=SeqID_14310; Location=381..842; Strand=+
  SCN-specific regions: Sequence locations=1-94,117-234,257-462
atgaatgtgactgagattccagcacttatgactccaattcctccaaccactcaaaaaattgtggaaaaggtggaattgccgaaagagaaaggggaaaacaaatcagacagcattaaagctgaaaagaaaaatgaaaagttattaattccatccacggcaattacggttgtgaagaaaattaaggacgaaaaagtaagagacgtgtcggaaaagacagtaaagaataaaaagagtgaggaagaatacagtcaggaagttgaagctgaggtcattgagagcttagctaatgatggcaatgaaatggaagaattcgaaaattcattccaggatgaaagcgatgaggaagttagtgtggaattattcgatgagaatgaaatcttcgacatggatcgaagaaaaagaacgacagttacaacacctgacgcccggtggattaaaaaagtagagaaaagcaaagtgtga

SEQ ID NO: 78336 - DNA, 345 bp, Heterodera glycines
  Genomic contig location: Contig_ID=SeqID_14311; Location=796..1140; Strand=+
  SCN-specific regions: Sequence locations=1-102,126-345
atgatgcttgaccagaatattattcgtgagtcggaatctgagttcgcttctcctattgtgatggtcccgaaagcggacaaaaaatcatggagatttgcggttgattacagggcgttgaataaaatgaccaaaaagagagtttttcatcttccgaatattcaagagcttttggatttaatgggagccaaaaaatattacacttgtatggacatgatgcagggatttatgcaaatcccaatggcaaaggaggacattgaaaagacagcttttatttctcatttgggcatttatgaatttatcacaatgccttttggtttaacagcagcaccggacacatttcagagg

SEQ ID NO: 78337 - DNA, 965 bp, Heterodera glycines
  Genomic contig location: Contig_ID=SeqID_14312; Location=2539..3503; Strand=+
  SCN-specific regions: Sequence locations=1-558,580-783,805-965
atgtttaagcccagccagatagtcggtctggtgtggacgggggcccttcactcgctggccttgagggtgaaggtgtgtctgttcctagcagcgggggtggcggttcctagccctaatgtgccctgcctacgggctgcattggtacagcgagagaataaccgggactggctggcccggaggaccgcgagtcactgagcagtgtcgaatgcgcagctgctcaaactcaacaccccggattaaaatccgcgttgacggaactcatatgtgctgtgggcgttggcgcaagtgccttatggagggagtaattacccaacatagggaggcctagaccaaaccttgcactttgggatggtagtgccacacactttgagttccatgagcggttccataatcgcttgctatgatagtcatagttggtgggcatgccctccattgtgatggcttgggcaggaaggttaaaaacacgtgtagggggtgacctatgcgcgtttttgactctccaaaaatggcccaaatcatcgctcaggagaggggtcatgcccgatttttttttgggtggcccttttctttgtcattttcgatcaaaattgttttactcttttcttaaaattgatcaaaatcaatttcagaaaaaaaaatgagccaataatccgacgattccctcccccctaccctcgatggaccgtattcccctgttggggatgatgatggagccgaattgatcgacgccgccccgccgctggaagaagtcatcatgcacttgccaaattccgtacgttttgcgaaaatgtttttaaattttttcatctaattttgcgaggtcttttcaggttgtgccgtctgaagtgaatgaacgaaaggcccgcaaggaaccatcaataactcgcgaattggacaccaagttgttcaaagtgatggctttatgtgtttgtccgccgcgcaggcggaagcggggcggttcaaag

SEQ ID NO: 78338 - DNA, 331 bp, Heterodera glycines
  Genomic contig location: Contig_ID=SeqID_14312; Location=1..331; Strand=-
  SCN-specific regions: Sequence locations=1-331
gtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaaatcgattttttcaagtgtccgtttggg

SEQ ID NO: 78339 - DNA, 739 bp, Heterodera glycines
  Genomic contig location: Contig_ID=SeqID_14312; Location=1080..1818; Strand=-
  SCN-specific regions: Sequence locations=1-63,85-107,129-136,158 -633,662-739
aataatttttaaatttgaaaaaacagaacgccataatttaattttgaaaaaaaagaatgccaagaatttaaatattttttaaatgagaaaatggggaaaacaaatgcaagaaattggcaagaaataaatagggaaatttggcacaaaaatgtgcaaaaatttggcaagaaataaatagggaaatttggcacaaaaatgtgtaaaaattggcaaaagatagggttaaaaattgtggcaaaataatgccaaaaattggcaagaaataaataaatagggaaatttggcacaaaaatgtgcaaaaatttggcaagaaataaatagggaaatttggcacaaaaatgtgtaaaaattggcaaaagatagggttaaaaattgtggcaaaataatgccaaaaattggcaagaaataaataaatagggaaatttggcacaaaaatgtgcaaaaatttggtaagaaataaatagggaaatttggcacaaaaatgtgtaaaaattggcaaaataaagggttaaaaatttgggcaaaacaatgcaaaaattggcaagaaataaattgggaaataagggggcaaaacaatgccaaaaaattgcggcaaaatggcacaaaaaacggtaccataataatgccaatctggcacataaataataaatggcaaaaagtaatgggtaaatgggtaaacaaatgccaaagaaggaaaaaattaaggcataaataaatgataatggattattgattggct

SEQ ID NO: 78340 - DNA, 3863 bp, Heterodera glycines
  Genomic contig location: Contig_ID=SeqID_2183; Location=716..4578; Strand=-
  SCN-specific regions: Sequence locations=1-173,196-988,1022-1190,1230- 2056,2078-2466,2488-2506,2529-3528,3553-3801,3824-3863
atgccgggattccgacaactgaaccggaatacgatgcagaaatatacatccatcaagtgcaagggttatggaacgtcaaatatcccggtgagtacaaaattttcatatttaacgattaccagatacgaccaatcaccaaatctgatgtcaccgactaccaattccccattcttctctaccacaacaacaaccactttgacggcatcaaaaccctgtccaaattcttcaataaacgttactattgcctctcttgtgaaagcgtctacgagcgcaaatctcaacattcaatgaattgctcttcactctgccatggatgtcgggaggttggcgtcgactacccatgcgagccacaacagggatacttcaaaaaatgtgagcactgcaacaacaatttctacaacaaggtctgctatgaacgtcacctacacaaggatctatgcaccaaatttcagcgatgcgaggactgtggggtaatttataatgtaaagtatcacggtaaaacaggtcaccaatgcggggaaaagttttgtcgactttgcaagcaattccatgtaaaagaggatgatgaggataatccgtgcagtagctgttttatccaacccctaaaaccccataaacttaaaccatacaggatcatcgcttatgattttgaagcgacacaggataaaaaagtaggtaataaattcgaacacgaggtaaactttgtgtcggctaccataatttgtaccgattgcatcaatggaaattggaaggactcacttaaaggatcctcttgcaaaatttgtggaccccaccgcacaatcaccttcgcaccattcgacttctcaaacacgatagtggaccaaaaagtcaccactaggcacccgctgcgcgactttgtccaatggctactcttcgaccacaacaaaaaatttcccacggttgcctttgcacattttgggggccgctacgacatgaccatggttatcaaggaagtcatttcgcaaggtaaaaatttattaaatatttaattaatttttatcaatcaaggaattcacaaccccgacatcatcaaacaagggaaccgactctacgaactcaaaattaatcaaaatgaacacgggcctcaaaccatacttcgcgacagctacaaccttatgcccatcaaattatctggcctcatcaaatcctttggtctcaaaatacaggtgaataatattctttaaaattcaattaatttttaattattaggataaacaacattttccacacatgttcaacaaagcatcaaactatgataatgtcctttcccatcttcctccacgtgaagaatactgtcctgatcaaatgaaaatccccgatcaacagaaatttgacaattggtacaatagtaattacaaccaaccttttaaccttaaggaaaaactccctgaatattgttgcaacgacgtacaaatactcacccatgccctagtggaacttagacgtgaattcaagcaactcaccaaaagagatggaaaacacggaggaattgacatcctgtggcaagcaatgaccatcgccagcgcatgcgtcaagaactttgcactcaatcatctgaagcctaactcgcttgccatcgtcccggaaaaaggctatacacctcaacagaaccaaagtgcccttgccatcaaatacttggattggtactcacatattaacaacgtcaacatccaaacagcacactcccgctatggtgaatatgtctttaaacgtgagggtcaggtgtatcaagtggatggttatataaaagggactaatgggaagagggataaaattattgaggtaaatggttgtctgtggcatgggtgtggggaatgttttgaggacttggacgaagagacgaggatgccaaatgggaagacactgcgtgagataagagagagggaggtaaggaagcacgagattattcgccggtacgtcgacttggaagttgtatgggaacatgaaatcaatgagcagctaaaaaaggacgcaacaatgaggggctactttgacaattggaaggaccgctcaccaattaaaatcagagacgcatttcatggaggacggactggaccaatgaagctactccacacagcaaagccgggacaaaaaatcagctacaaggacttcaccagcctttatccatggaccaacttttctacaagttatccactcggtcacccaaaaattatcaactttagattaaatgagcaaactgtcaactggcgagctccatccgacaatccatacaagggacttttaaaagttttacttttacccccaaacaggaatatcaatgtgaccgtaatgcccgtaaaatttgatgagcgactcctctttccactctgcgaaaaatgtgccaaacacatcaccaatgaacacccgaatggcctcaaagacgacaactactcgtgtccacacttcaatcccaatgaccgtgcctttgtctctacctgcactcaccttgaattgaatgctgccttggaggtcggctacaccgtcagaaaactcttccatgtcctgcaatacgaccaatggagcgacaacatcttcaaatcttacgttagcgaaatgatggccctgaagatccacgcaaccggcttcccttcatggtgcagcaacgaagaggagaagaaggaatacattgaggagaaccgtcagcgatttggaattttgttagacaacgaaaagatgaaggctgaaccagggaagcggtacatcgccaaactttgcctcaactcactctggggccgcttctcgatgcgaaatctactctcaaaagcaataatcaacaacgacgaaagcctgattcgccaatataccgacgacaagaaaatcgaattagtggacttggaaatgatggacgacgacaacgatgtttttatgctgacttaccgaccaaaagaagaatttgtcgacgaaaataaatactccaatgttgtcatctccctcttcacgacatctgcagctcgcctctacctctacgatgccctcaaaaaagttgccgacacccccgactgcgaaatcctttattacgacaccgacagcgtcatctacgtgcaccccgaggacaacgacccactcccgacaggaaagggacaccttggagaactaacagacgaaaaccccgaccacaatatcttggagttcatcagcgctggctgcaagaattatgggatgaagctgcaacgcaaggacaccggtgaaatagaacacgatttgaaaataagagggttcacccttgatgcacaaactattcaaaaaattcattacgatactgttaaggaccaaatcttacgctatggctccgaagacccccctgaccctatcattgtaacatatccccattttattcgtcccaaccttatccaaggcaaagtgtacactcaatctctaactaagcattatcaacctgtcttcacaaaaggtattattaatgattcattccaagtcctcgaatttggttatcgcaaatgataagtatgcattctcaattaaattttctgtatattagttttcttattgttcccttcttttctttctctctgtttatatcactcatgtgggacggaatgacccctggttgatcctccccatcactccaggccatccatctgagatgaaggtggacgagctgctcattattgtaatgcgcagcctggtgcgtgagtgtttgggttggggaccgaagggtgaagccgttccctgggtgtgtttgctcacttttttcaaagggaactctaagaattctgatattccttcaaatctatcaaaagagttgtatactttctttttatcatttctctttattctctattttacacttgtatttttcatttgaatgtttattcagaaataaa

SEQ ID NO: 78341 - DNA, 1050 bp, Heterodera glycines
  misc_feature (1014)..(1014): n is a, c, g, or t
  Genomic contig location: Contig_ID=SeqID_2184; Location=6..1055; Strand=-
  SCN-specific regions: Sequence locations=1-245,268-614,667-801,827 -1050
tgaaattcaaaagtgtgctgatcctcttaccgaattccgttcatgtgtacaccaatctgttgaagaggccattcagaatgcacaaaacaccattggaggagcaaataaagtaggtgtaattatttcttcggagcttttagaccagggagacatcatcatgcctataactccaattacatcaaatgtcgtggacgccattttcaaccagttttgtaaagtggagcagagcaagtccaaacacgtcaacttatatggggccccttttgttgtcaccgtaactgttctaaacactgaaggcctaccacgacgacgaacgaccaaaggaagtgcccctccaattcactcttcccaatcacacatcttcaaaattaacaacaacgacaattattgccttttttatgcactggaactgatgcgctactactcattatatatcaggggagtaatttcaaggaaacaatttagatggctcaaagataatcaaacaactgttcttcgtcaaaaagtactacttttactccgcgatgccgggattccgacaactgaaccggaatacgatgcagaaatatacatccaccaagtgcaaggattatggagcacaaaatatcccggtgattattttactttttatattgatttttattaatgaaataaattacattatttgttacaggcgagtataaaatattcatctttaatgactaccaaacccgacccatcacaaagtctgacgtcaatgaataccaattctctattattctctaccaccacgacaaacatttcgacggcatcaaaacactttccaaattcttcaataaaaattattattgcctctcttgtgaaagcgtctacgagcgcaaatctcaacattcaatgaattgctcttcactctgccatggatgtcgggaggtgggcgttgactacccatgcgagccacaacagggatacttcaaaaaatgtgatcaatgtaacaacaatttctacaacaaggtctgctatgaacttcacctacancaggatctatgcaccaatttcagcgatgcgaggact

SEQ ID NO: 78342 - DNA, 1237 bp, Heterodera glycines
  Genomic contig location: Contig_ID=SeqID_2185; Location=415..1651; Strand=+
  SCN-specific regions: Sequence locations=1-7,83-446,748-1060,1082 -1093,1131-1181,1203-1237
atgaaagaatattttgaattagaaaaatgtaaattttatagttgtaatagaaaattattgaaaaatttttttttttttataagttgaatattggtaaaatattggatgaaagggtaatgtagttgcaaatttgttagtttaaatattttttgacggagcgcacaagcaaagaatgttggtagaattttcgcgaatgaatgggagaagttgaattttgctagtaatagccggctatttataccctcacaagtgggcggagcttgaccttcactcaagcatgtggtcatttggcacattggcaactaaattgttcatgtcatggcatatgcgctcaaatggcctctgcgtgcggtcaaatggcacgcgcgagcgctcaaatggcctggcatcccttcactccctaaaaggcacgacagctgatgtccgtccatccaatacgatttgactttaataattatttaattaattaattttatatttttttcatttatttttaaatttttatctattattttaaatttatttaggtaataattttttaactattattattttaacaatttaattttaattaaatttaattttttaattaatttattattattattatttatattttaataatataacaattttaattttactcttaccttattttaattttatttattttaaccataattaattttaatttaattttgaattatttgaattttatttcaactttaattataataattcatttaactaaaattttaaatttatcacaatcgggctctcaaatagcccctgcgggcgctcaagtggtagcatacctacactcaatagaatttgagttacctctgaccaacagctggtgctttccattatcaccagcgagcgctcaaatggtccctacgtgcgctcaaatggcatacgcgagcgcttaaatggcacacacgcgggcgctcaggtggcatgcgtcccttcccttccctataaggcatgacagctgacgcccatcctctgcctccctttccttctctaataggatttggcgttgggttttatccttcagatgttttttcaattatttacctcttctgggattggatatatttattataggtgttttttaaaggtttaaatttggtactgaaacgtccctttccattgggactgaaatggcggggctgaaaattaagggccaaaatcttggggggtaactactaatattaaccatttttcattgcatata

SEQ ID NO: 78343 - DNA, 266 bp, Heterodera glycines
  Genomic contig location: Contig_ID=SeqID_14313; Location=1988..2253; Strand=+
  SCN-specific regions: Sequence locations=1-13,36-51,94-122,144 -149,171-266
atgggcaataaattagaaattgaacaaaatgtttcaaaaagtaactttttgaaatataacattttttaaaaatattttgaaacaaattaatttgaatattcacagagcgcaaattttatacaattgctgataaattggaaaagatgaagcattattatcaaatgaaaaaacaaaatcccaaactcacggatagccaaattgcccaagttttgaatgtgtcaagagcatcaatgtacagaattaaagctgaattggagaagttttga

SEQ ID NO: 78344 - DNA, 138 bp, Heterodera glycines
  Genomic contig location: Contig_ID=SeqID_14313; Location=128..265; Strand=-
  SCN-specific regions: Sequence locations=1-110,132-138
caaaacgtcgtcggccgaaacgtcgtcggaagactttttgaaccataactttgttcattgtcaatcaaattaagcattgttggtgttgttcgatagctctgtgtgtttattattaatagcttacaaatatcttcaaaa

SEQ ID NO: 78345 - DNA, 1202 bp, Heterodera glycines
  Genomic contig location: Contig_ID=SeqID_14315; Location=495..1696; Strand=+
  SCN-specific regions: Sequence locations=1-8,33-48,70-353,375-732,754- 1202
  Gene Ontology: Mol. function=helicase activity; Cellular component =nucleus; Biological process=establishment and/or maintenance of chromatin architecture
atggacgcacaagcacaggacagatgtcacagagtgagtttaatttaccacaacagggaacaatttgaggggaattcatttgctatttctttttcagattggacaaactcgaaatgtcaccatttatcggctcatcagtgaaaagacaatagaggaaaatattctgacgaaatccatgcaaaagcgacggcttggggagatggccattgaccagggcgaattcacgcccgacttcttcaaaaacaccggcaatctgcgggatttgttcagcaacgagacggccgttgccaaaataattgcgcccgttgtggacgaaccgaagaacatcaaagacgtcgaagcggtaaagaagggaatttttaaggttattttgcatatatttaggcaatgaatcgggtcgaggacacacaagatgcaattgctgcacagcttgccaaggaggaggacactgcagaagtggccgaatttgacgagacactgaacggcgcttctaccagctacgacctgagagacattgacagtccctccgagcagtacttggaattaatcagcggggtattacaaaaattagttgaaattttcggaaatcttgcatttgtagctgaaaccggtcgagcgatatgccgtcaatttcatggccgacgagtataaaccaatgctggacaaagaagtcgaggaggccgaggttggctcaatccttcaatcattcggaatgcgatcgtatttcacaggcaaaaataaaagcgaagcaaatggagttcatggaaaagcaacggaatgcggacgtcggactgttgtccgacacaatcgacgaaaatggcagcgccgtcgggggaaggaggcgacggaaagaggaggaactgctcgacatcgcctacaacgcctccacgggccccgccgctgtcgatgaggtagccaaaatggcgaaacgaaagttggccagcgccaagagggtgaggggggcgcagacgacgacaacgacggcactccgttgttgtggcagaagatgtcctccggggaaagtgtaggaaggacggccaaacaaaacaacatcgaacagcgcttattacgagtcacacagtccacaaattatatacctattcaccccacccttcgttttgttgctgaactgttatttcctcccccaaacgcacggcccaacgcatcgcaagactttgctctttttgtttgtaccatagaaa

SEQ ID NO: 78346 - DNA, 1831 bp, Heterodera glycines
  Genomic contig location: Contig_ID=SeqID_14317; Location=419..2249; Strand=+
  SCN-specific regions: Sequence locations=1-74,96-601,624-780,811 -1215,1237-1261,1283-1431,1455-1643,1677-1717,1739-1788,1810-1831
atgacaacaaaagggtgcacaacaaattcattatggaggtcagaaaggaaatgttatcatttgcatccaaaaattcaaaaggaactgcaaaaactcgattatcttacggttatcgacgatggctctcacgacgatttttttctgctcgaagtggcaaaatgcaacggaggctttgtgatatccaacgacaaattcagagaccaccgcgtgaggacggaagttccggacggacttcgccaaatcattgacaatcgcagcgtccccttctcttttcattatgtcccaattgacaaaatcggaaaaacaacgttggctgatcccgcaaaattgggctatttggaattggaattcactctcaaaccgccgaatatcagtgagtcatccaacaccaaaatccgataagaagggaaacaaacgcatattttgtattattttgcgaatttaaaaaatgcatgaaaatctatgagtccggatgaaaaaggatcagaaaatggagacatctaagaaaatttagtatcaaattaaattctatagtgaccgttaacttgggatagaaaaaacttgcaataaattgttcttgtgcatccaattaaatcaaataacgatcccaggattaacactttcccagttgatattcactgaaaataatttattatgacaaaaaaattttgaaaccctaaaggccaaactccctttggttattagcggcgggataacaactggaaaagtgtccgaagatttacccccattaccggatttatggcttggagtatctttttgaaaaaaacttaaattaaaaattataattttgctgggggaacaaaggtcgtggacatttgtccttttttcaggtgcaatgttttcactaagtccttccgacccctcttatggcatggtcttctcacaacgaattctcagaagtgagaaacgcgccctcgaaatgctggaaagattggatgtaatgtcggagtaccttttggtgagttatttgccaaaaaaccgcttaaatgtgagttttagcaattaatgtgcgaaaacctcggagtcaaacgctctctcaaacacttaaaaatgcccgaaatggaaagaatgccgatagagttcgaaagattttggcgtttttatgatttgcatcaaaaatgatttggtcattcatatttttaccaaaaatatctattgtttttgttttgttccggtgtattttacaaatagaaatataattgttttctctccctccttccactctcacacaactatttctccctctctctcatttctttgtcagttagcaaatcggacggtctcccgtgtctctgatttccactctgttcaaatgcacttccgcgtctccgaactgctcgcttttgtcgtgtactgccaccaatgaaaagtgtctcaattccgggtccaattggacgaccatccgctccatcctccattcttccaccttatcaaggagatcttcgatattgtggtgacgattggttgtctctcacttttggaccgattagcaatacataaaattcaataggcctcacctgaatcaactgcgctccattgatcaccgacatctatattgataaactcagcaaccgaactcgccgatgtttaattcgccgataaattattgaagaaaaccgaggaaaatattttctttattaattttaaaaaaataaccgaaaaatgttcattgaggaactaattggggtggccggaatctttataatacttttgtgatcattaagaccggatgggatattgtgagttatatttcacaatttgttaagatttttgggattttcacaaaaatgttcgagaaacaaaaactgca

SEQ ID NO: 78347 - DNA, 228 bp, Heterodera glycines
  Genomic contig location: Contig_ID=SeqID_14318; Location=290..517; Strand=-
  SCN-specific regions: Sequence locations=1-107,129-228
atgcgtcgtgcgattctcaaatcgcgtcactttcgccttccctccaacgaacaattggaaatgcatcttgaagcgagtctgtccaccttcggctctcgtctttacatttgccctgatgagcagcaaaagaccgtcgcgaggctatcaatggaaaaaacggggccaaatggagtggagacggaccccctgagggcatttggatactgcgaattgctaatgggaccaaaa

SEQ ID NO: 78348 - DNA, 1047 bp, Heterodera glycines
  Genomic contig location: Contig_ID=SeqID_14319; Location=270..1316; Strand=-
  SCN-specific regions: Sequence locations=1-109,132-169,205-645,672 -709,734-772,813-1047
atgaattctcttaaacgctttcaactcccggagcaaggaacacgccagcaagaagagttggattccgttgaaccgaaaaacatcagcgatgtggtcaacttcaattcggccggcgttttttatgttttgggaaaagtgacaaatatgcagtaccgtgtttacaaagtccaaattaattaattaattaaattattattaatttttctgtttttaggcatgcccattccgttccaaggggctcatttgtcgccgaaaattgtccgatgataacatgtgtgaggcttgcggccaaaaagccattgcccccatccacacggtgtttgtccgtcttctgctacaggatgttgaacaagcagacattgctcaacgtgtcaccatgttttcgagtgttgccgaagagtttttgggaatgaaagctgctgaattgctcgccaaggagaaggagccggagagccttgcgaaacatttggacgatttgattgctgtgaagataattgcgaaagtcaacattaaggttgttttttttgcaatttattacatatttgacaaaccacaacataggcgaacagtcagacttacactggatttgattggattgtcaatttgttcaagaagtgccctggaaaaaatgacagtgatgtgccaaaagaaaaagatgatgatgatggtgacgttgatgagattgctaccaaaaaaacaaagaaaaattgagagagagagagagagagagagataacggattcattttgttgtgagcttcaaaaaaaaggatttaatgtgtcctttactcttttaaaaatccattaaaaatgcattttattgttgaagatgttgagacacaaactccaaaatggtcttgatgtgattgcaattttgttttttcttcgtgaattcaccatgagacaggattgcacgttgacaatttttcgtaatgagcacagagagatttgcagttggctctatcctagtggtggatcgtcaactctcctcataacaatccaattaacgttgttggaaaagcttggcccatatgcgtttgtcacgtaa

SEQ ID NO: 78349 - DNA, 948 bp, Heterodera glycines
  Genomic contig location: Contig_ID=SeqID_14321; Location=56..1003; Strand=-
  SCN-specific regions: Sequence locations=1-24,46-134,156-731,760-948
atgctcagttctggcagtgaccctaatgtgcatttggtacttttgagggatttgttcttcgcctgctccacccaaatttcctcttcttttcaacccgtgagtcattcatttgctatcgtagaaacccattttggaacacagaaaaacaacgaagaaacagtgcaaaacattgccgaaaatgaggaaaacatcagtgaagaggttgctgagggaggagaacactctctgaaaaatgaggagaaagtaccgaacaaatcggggcaaaataaagagaaagcagcgaatacaacgcaacggacacctcccagtttaggagtgttgcaggtattgtaattgcccagtttcgttcgtttgaatgtcattatcagggctgccagctgatttggtaacagttttacataaaaatggctattttaaggattttccaaaaaatcagcatatcaaaaaaccagcattgatccactgaaagcagcaaaatgctgataaatcagcagagttggcagccctgtcactaattctatgaagagagattcgcatttaatcattggcaattggtttctctaatttcagctttttttaattgaacgcctcaaatgtttttgcctttcgttggaatcactgaacgaccaattggaacttggccttcgttccgtttcctcctgtttcacgcctttcaacttttttacctccgttcgtcttgaaaaggtttattttttattttttgctgtttcaattttattttaaattaaactttttattcagcttattccaaatgttttcacaataattttgactttacatcgtccattgaatgcttcccaacttaccgtaacggcactgctggacattgccgaacaattggttctcttttacccacaaccaaaatttctgctcgagttttttcgactttccatgtcggatgctctaatgacggtaaatgaattataa

SEQ ID NO: 78350 - DNA, 1286 bp, Heterodera glycines
  Genomic contig location: Contig_ID=SeqID_14322; Location=52..1337; Strand=-
  SCN-specific regions: Sequence locations=1-136,158-454,542-698,726 -872,894-1286
atgagtgggcgaaatacttttaggactaaatgcattgcaaacaaggcaaactgcgcgttacagccggctctgtcatttgtgcagacattcggcgccgacattctcagctgtatggtcaacccgtggcatttgatccatttgcaactgcttggcccaagggattttgaaaaggtggcgattggactgtacgtgcgttgcaaggtaaattctttgttattttttttcctgaaaatggataggcggggtgggggaatctgtcggtgccgaaatgtgtcgccggattcaattgctttccccccccccgagaatttttttatatttgttaacttagaattttttaaagaaaaatcggggccgttcgcttctcccctctggacaaattttcctgaattttttagttttctaaatttggggcggggatgaggaggggggacgaaacaaaatatcgccgccgaaatttataaaaaaaatttcaaacaaatttttaaaggaaaaattcttagaaaatttttttataagaaaagttaaattaaaaatttttgaaaaacttcagcgattttttcgaaaaattttccaaaaaaaaaatatcaatgattttttcatcgaaattttcttataaaaaattttctacgatttttttcttgaaaatttctaactttgaaaaattttctttttaaatttctgcggcgatattttgggctggggaggaggaggagtgggcttagcgcacccggccaggatcgattgggggttctgtatgtacatgcaatagaagacttgtttctcttctccaactttctcttcaaatttcgcatgtcccagtgaatttggtaggaagtgggagaaaaggcactttttgcgtgaatttgtctagttaaccatttctgattttcctttttttttgcaggttaaggaactctgttctgtcgagcgcatcgaaagggtctcatgggatgcgagtccgccgtacgaaatctatggaaggcaaatgcaagtgctgctccatttctacgggcccagccaaacgccgccttcgcccatttcggccgttcagtttccaagcacagaaattgaccgtcaggtggtcgaacagcagcggaaggttggtcatcaattaaattatgaaaatctttcatttaaatggattttcaaaagcttaaactgaaaaattttaactaatatttttgttcccgtttcagtgccgcacttttgttcccccgtcgggcaatcacattaagcgcaagagtgaagagttgcaaaacgcgttgtacaaaatccattattaa

SEQ ID NO: 78351 - DNA, 1134 bp, Heterodera glycines
  Genomic contig location: Contig_ID=SeqID_14322; Location=1684..2817; Strand=-
  SCN-specific regions: Sequence locations=1-190,241-524,548-965,987 -1134
accgatttgaattgtataattaacattaaatatttttcatttttggcacatattttagccttttttgagttttagcacatattttggggatttttggcgcatatatatgtacagatttggcgttttttagcacatataaatccgttccctgctaattagataatttttatggcattttgtgcctttttcaagaaaataaccattttaaaaatttatttacatatttttgtacatatttttggcagccctactaatatgaatgatgctttttggcaaaagatcagtccgcggaagagtgtgtccaagtgtggcacccgtgaaacagaagaaatcactaaaatgattatacacaaattttttgatcggctgaattttgagtttaaaatgaattcgccagaagaaagtgccgaacaaatgagtgaatgaaagactttggttttcttatttctaagtaatatgaaaaaaattggacaaaatcttccttattttagctttaaatacaatgcctgccattcgctgttgttgattaattattaactaattaaaagcaataataaattaatgatgctgattggttgatgggattagcttattcgttttgcttaaatacgtttttagtcggaaaaatgccatccatagaatggcatatccgatgttggcatttgtagtcaaatattttggaaaaaattggttaagtctatgcatatattgcaaaattcaacagcttccagccttcaattatttaaaattcagaggaaatacaccagtgaaatatccaacaatttcctcttaaaaggaaaaaatgttgcgtttcggcaccgcgtaattaattgttttcatttacaccgtgccatgttcgtcattgccgcctccgcttcttcccatgccagcaacaacagcgaatggcaggcattgagtgcccagtttggtcagcaaatcagtgaaattgactcgaaatgtgccgagtttggcattggcattgccaaagtgccatatgacggccccaagggtaaaactaataagagacaataattcattaattatgcgatctcttaaggtgatcactcccaacgaaatgtgcctggcacggacagtgtgatttctatgcccggattgaccggctcacacaaacaa

SEQ ID NO: 78352 - DNA, 251 bp, Heterodera glycines
  misc_feature (225)..(225): n is a, c, g, or t
  misc_feature (234)..(234): n is a, c, g, or t
  Genomic contig location: Contig_ID=SeqID_14323; Location=55..305; Strand=-
  SCN-specific regions: Sequence locations=1-8,31-251
atggctaaatgggtaagaattgggaagaaaaaggcgaataattagtaataaactgcaaaatggcagcaattttcacagaatttaaggatgaacctttgtcgatgttcggtgaattcgaaaaacgcagagaaaaagtgtacgaagagcggagagagaaaatggaagtttggagtgaacaaaagcggaagcgaaaggctgatgaagaaaatgaagaggaggagtggnaaaataagngaaatggtgataattga

SEQ ID NO: 78353 - DNA, 645 bp, Heterodera glycines
  Genomic contig location: Contig_ID=SeqID_14324; Location=835..1479; Strand=-
  SCN-specific regions: Sequence locations=1-59,108-362,392-494,520-645
atgaatggaggcattggaccgcaaggcaaatggtcgaatttgtccgtaatgctaatgtaattttatctttattttattttattttaaatttattttaattttattttttagattttgtcttcagtcaattgctccgccaattcttcgtctcgtcttcagcaaagttcttcggcatcagtttatggcacatttgaggctgaaatggccggcaaacaatggcactccgccgccggttggtgccggcatagcactgaagcaaccgaagcgaattggatgagaactgtgccaattacaccacaaaaatattaattttgattaatttgtttattgtattcattggcttcgaatggataaaatttgtgtattatattaaaaaaaaaataataattttcggtttataaaatcatctaatttcaaaatgccaaaataggcaaattaaataacaatctattaaaaatatgcatgccattataacatatgcccatgtattacagttataatttaatatatattaatttagggagaaataattttttaacatttgccaatatgtacgtcaaagttaacagctgcgataattggttttagtaatagaaaacggataaagtaattacaaatttggaatagttcaaaagagaaaataaa

SEQ ID NO: 78354 - DNA, 1073 bp, Heterodera glycines
  Genomic contig location: Contig_ID=SeqID_14325; Location=390..1462; Strand=-
  SCN-specific regions: Sequence locations=1-164,186-802,827-859,881 -1041,1063-1073
atggaaatacagtatgcacatttggcgggatactgtgtggtttgctggttgttacatgaacctgttgatcgcgatcacacggtttgcctgtgtgggttcccgctccaatttcgcatgctccggcgccagttcacttgttggctaatcggaatggccgtatgggcggtagcattggctcaatctttggccacaaacagtgcttcatggtcagaattaaaacacacatacaagttttatagctgatcatctattagtgccattccaggaagggcacaatgagtggggaaacaacagaccccacctcaccctcataatgaaatcagaaaattaaaaacttttaaacaaaaaaatggaagataactcaaaaaattaaattaataggttccatttaacggactgatttaatctctaattttatatctacattcatatgtatttagtggataaaaattagttggtgactaagaagtgatgaatcattttatgccatggtagccttaggtgttctctaatagattgcaaaatgtaaaaaattgaataaaaaatttagaatttacaaatttaactgttttttacaaacaatctagcaccaaaaaagtaattttatcaaaacatattaggtttgttgccgtttggtatacggtcggaacatacggaatgagctgtgattggtcggcatatgccaaatcaggcacccgcacttattatgtgacgttgaatttgctgaccattgtggcatatttgctcatttacatctcgacagctgtgattattttcacgaaaaaggcggtaaattaccatgaaaatattattaaatttttaattaccatcaattaggtccgattgcgatttttcaaagcaattttgaagccaaaaagttcgtcaaatgatggccaaatggccaatggtcagcagcagaaaaataatggccaatttgtttcgaccgttggtaaaggagctaatgagccaaaaaggctttctgttgctgtcgacgttgttggacttcatccaaaaaatgctcgagtagcgctgcaacaacgaagcctgaggtgttaaatagaaaaagaaataaa

SEQ ID NO: 78355 - DNA, 1891 bp, Heterodera glycines
  Genomic contig location: Contig_ID=SeqID_14326; Location=659..2549; Strand=-
  SCN-specific regions: Sequence locations=1-141,183-768,790-790,821 -929,999-1368,1390-1490,1577-1764,1788-1832,1854-1891
  Gene Ontology: Mol. function=glucokinase activity; Cellular component= soluble fraction; Biological process=cell glucose homeostasis
ggtgaagttgtccgccttgtgctcgaggacctgacgaggcgcggcctgttgttcagcggtgaccattcacaaattgcggagcccggctgcttcccgaccaaattggtgtccgacattgaggggtaattggatttttgtacgtattttttaaataaaattatttaaaaaataataataattaactaattgctgcaggcaaatgcaaaatgacgacgaggagaacccgttccacaaaattgaggagctgctgcaggacattggtgcacattttattgttttaatccattgaaattgataacattcaatggggccgtttaataattagtctataaaattgaaaaaaaaatatcccaaaaaagttgtgccgtaaaattttcggggaaaaaactcagttttttttggtaaattttttgaaattacgggaattttttgcagactaatagaaaatgggagcaggttgtttccccccgcatcgtttccccccccccccccgagaaattaaaaaaaaattactaacttcgaaattttttaaggaaaaaatcaaagtttttttataagaaaatcataaaaaaaatttcgaaactttctttggtgaattattaagatttttcaaaaattttccaaaaaatctgaaaatttcatgaaaaaaaatttttcttagaattttcttataaaaaaactttctggtttttttctttaaaaatttagtaaatttgcccccccccctcccccgaattttttaaattttcaaacagtgtaatttcaagaagaaaaagttttggaaaatttattcccaaaaattgctggaaattttacaaaacgatttgttttaatttttcgtataagttttttaaaaaaaaatttctgatcatctaccaatgtttaccatggtttattttttgaccccactcccattcgggtaacttgacaaaaaaaaatttaaaaaaaaattttttttgaaaatcttgaatttcttaaattaaattttttaaatttttcaggcatttggaactcgacgcccgccgactgtgccaacgtggcctacgtgtgttcgctggtcagcgcgcgtgccgcccacttctgcgcctgtggcattgcggcgctgctgaagcgcatgggacggcccaccgtaacggtgggcgtcgacgggtccgtctaccgtttccatcccaccttcaaattcctgttggaccacaaaattgacgagctggtggagggcaagtatgaagtgagcgtgtgaggggatacggtagattactgtatttttgagagacggtagcataccgtatttggtggccggcgtttggcgaattaaatttttcgactattaaatgccaataaaccacatttgtcctaaaatttaaaatatttaagagcccctcccttttttgttgatttaagtaggagaatacttttgaagcaaaatttaagcatttttggtaaaaattcgactgttttgaacgggtgctctacttttgccccctccccagatttttttttaaatttactaactgaaattttaaaaagaaatttagtaagttttttaataagaaattttaagaaaaaaaaaaattttcgaaattttttttcttagaattaaaacacaaagattaaaaaaaaatttcttgggcgcaaaggtgggcgctgccgacaatgtttgaattattcaatttttttttaccaaatcctggaggattcaaagcaccgaaaaattggaccagcggagttcaacctccgctgcttgcagcaattgccgtaatatttcccctaatttcccccaccaattccccctcagttcgtcctggtgctcagcgaggacggcagtggccgtggcgcggcagttgcagcggcggtcgcctcacggatgaaccgcattatgtgcgagcatcat

SEQ ID NO: 78356 - DNA, 450 bp, Heterodera glycines
  Genomic contig location: Contig_ID=SeqID_14328; Location=219..668; Strand=+
  SCN-specific regions: Sequence locations=1-298,321-450
atgtggtggtttcacgaaattccaacaccaccgcccccgcaatttcttccaacccaacaaggccgactgaaaatgcgctaccaagggcacgattactacaaaaaatttgaaggagccaatgggcaggtgtactggaactgcgtccgttttccgcagaggttgggcgcgtgcaaaggcaaggcacaggtggtgaacggaattgtacggcaacgaatccgcacaaccatccgcctaacaatcatccgcctgccgaggaatgtaagtcggaagaatgagtaatagtaaactttggatataatttggccaatttttaggacccaaaatgtgacaacacacaagaaacggtggaccgtacgcaaccaaagaactgagcacggaatttccctaaaaatggcattgatcagtcatccccccaattgttatttgtgatcggataattgaaagcgcaaa

SEQ ID NO: 78357 - DNA, 1186 bp, Heterodera glycines
  Genomic contig location: Contig_ID=SeqID_14328; Location=1721..2906; Strand=-
  SCN-specific regions: Sequence locations=1-64,86-390,420-807,848 -869,891-1186
gaacgagaggaggcgtggaaggagtacgagagcgaaagactgccccgtcaacttttgccgctgccaatgccatcccctttgaccatggatggcactgccgcagttcctggcacgtctcagcagccgcctttcggcacggccactgacatggcgcacttctccaacgcattgcaactgcgacaactgcaactgttgcagcttcagaaacaacagcaggcggcacaggtcgcaaaaaatttgtcatttttggtgcaacaacagcagacggttcggtcgggagagatcggctacttcacgcaaggttgggctttttgttgctattgggagttaggggacactttcagacgtcatttgccccgacaaacaattaaaaataatttatatggagattgaattttttgaaaattttaagccccaaaatattttttcagtgatgggccaattgactgttgcgtacaacaacgaccccatctacaaactctgcttccaagtgccgggaatgcaggccaagaccgcctacagaatcttccagatcaagcagttcctcagctatttcatcaatctgatccctgccgaggaccttggcgagatgaacagcgcaaatgcatttgccaattatttcaacggaattttgcaggtgaaaaaggcgggaatataagattttttcttgaaaaaacagtgaaaaatgtactccagtggggaggttttgcggtaccgataggcaccgacagggaaatttttgaatttgagtgcggtttttagcagattttgtccaaaaagaccaatttttgcgatttttagcaaaatttttcactttgtgcccactctcaccttgagatgggaacgtagtgccattcgataccaaatttatttattgctcatttttccttttgcagaatgccatcaaaggaaaacagtctcaagaatctgtagaggagaaggccatggcaagttgttttttagttattattttgtttaaattgctacatttgtgactgtccggcccggtttatgtatatttttttccggaaagataatttattttaccatcaaaaatattataaatcagattactctggccactaccatcgaaattgcaaagccccatcagcggtgtcaagcgggaattttgttcatccaacagacgttccccgaagttatgcaacatttgaatcattcccagtga

SEQ ID NO: 78358 - DNA, 584 bp, Heterodera glycines
  Genomic contig location: Contig_ID=SeqID_14329; Location=1..584; Strand=-
  SCN-specific regions: Sequence locations=1-73,104-254,276-286,308 -384,407-584
  Gene Ontology: Mol. function=transcription factor activity; Cellular component=nuclear heterochromatin; Biological process=electron transport
caaactgattttgttgatggaaattatcaaaaaatgcgaggccatcggagacaaactgtgagcacaaaaacccatataaaattaaacttttaaaatgtaaaataagcttctttttttattctaggctcgtgttctcccaatttctcaactcaattgcactcattcgccgaatgctcgccttttacgctgacaatggcaaatggtttgtggacggacacgacgcactgatgcgacagggcgaacggtggtcgtggaaaatgagtcagtcacttcttttcacaaagacaccaagcccaaagacgacaatatctcaaattgcataaaaatgacatttcaccattttaggacatgactatgacgtcatcgaagggtctgtttcatccaaagacagagataggtaaaacgacagaattcgttcgacccactctccgtttaattattttctgttgttttagaattcaacgggaatttaacgaccctttgaatttgcggtgagttcatttaaattttcaatttatttaagtgaatactttttcagaaaacgtctgctgctgatctcaactcgtgctggatctcttggcatt

SEQ ID NO: 78359 - DNA, 1061 bp, Heterodera glycines
  Genomic contig location: Contig_ID=SeqID_14331; Location=685..1745; Strand=-
  SCN-specific regions: Sequence locations=1-222,244-1061
atgagtcgtcgtgaacagcttgaaaggaacatgaatttgaagaaaccacgcatggcattaaccgacgatagcattgtagctgatgagatagcggacgcgcgggaggcagaaatgcgagccgctgccacagccgattcagatgcgagcgcattcagcgacgaagagaacactgagccagtgaaatttgaacgagggacaacgcaaaaaggggcactgtatctttggcagagaggtcagtcagtaatttagagcattcgcttatttactcccaattttagggtacaaatttgtcaaaagaagtgcatttggttcagctgttgtcagaagacatgtcaagctaccgtccgccttgatgatgagcaacatttgactggtcgtttgggctcaaaggaacacaatcattgcgttgtatttacccaacaatcagcagacgcgggaagggcacagatcaagcaagccatcgaggtgaatccgcaattgaggccatctcaaatgcgagcacaagtcagagcaggaacggcagatgagacgtttgaccagttgggcacaaatgatgcgttagacaggatggttcaaagttcggtcattgatacaaccaatggaaaatttcaataatttgtaactttagagtcaaaaacaagctagtctgaaatgtaaaccgagcaaatccgctcgaaattcgattcgcgccagagttattgaataaggacggtgaatcaatactgatatacgacagtcggacggcgcgagtaaacgaggaggatgttgttatggtgttcagccattcaaaagttttttgtttaaaattttctttatttatttttgtttgtttgtagcttctcgacgtattgagacgtaatcgccgttggagtttggacgggacttttcgttcagctcccacacaatggacgcaagtcttcatcgttggagcgtacgttgacaaacggatggtggtctgtgcacaagcgctactcccagggaaaaacagtcgattctatcgagaagcgctcagtgccatcaggaacgccgtcgcatctgctcccgcaaaaatttacgcttaa

SEQ ID NO: 78360 - DNA, 2644 bp, Heterodera glycines
  Genomic contig location: Contig_ID=SeqID_2186; Location=1130..3773; Strand=+
  SCN-specific regions: Sequence locations=1-253,275-307,330-454,476 -799,821-1188,1210-1217,1246-1304,1326-1408,1431-1748,1770-1850,1872 -1879,1901-2040,2081-2138,2160-2644
atgaaacgctctgcttctgcttcttcgaaaaaacaactgattgataaaaaatatttaattaatgttattgacgacattttttgcttcttttatgccttggaattgatgcgctactactcattacacaaacgtggaataattaccgaaaagcgatggcgatggattaacaacaaccaaacaacggttttacgacaaaaggtgctgcaactactccgcgatgccgggattccgacaactgaaccgaattacgaccctaaaatatatatacatcaagtgcaaggcctttggagcgtcaaatatccaggcgaatacaaaatattcattttcaacgactaccagacacggcctattattaaatcagatgtagtagactaccaattcccaattctactctaccacaaaaacaaccacttcgacgggattaaaaccatctccaaatttttcaacaaacattactattgtctctcttgtgaagctccgtatgactctaaatcaacacatacaatgaaatgcacttctttatgtctcggctgccgggaggtgggggtcgactatccttgtgaaactcaacagggatactacaaaaaatgtgaatactgcgtcaatatattctacaactacaattgttatgagcgccatcttcaaaaagacttgtgcaccaaattccaacgctgtgaagattgtggggtcatttacaacattaacgttcatggtagagaaggaagaaatgcgcaccaatgcggagagaaattttgtaaactttgcaagcaatttcacgtaaaggacgacgacgagatgaacccctgcagtagctgcttcatacaaccgctgaaacaacataaaatcaaaccgtaccgaatcatagcatacgactttgaggccacgcaggacaagaaggtggagaacaaattcgaacacgaggtcaacttcgcagcggctaccatcatctgcaccgattgtatcaacaatagcagttggaactactctctgaaagggaaaaactgtgcgatttgtggcccccaccgcacaataacattttcgccttttgactacactaaaacaacaatcgacaaaaaaatcgtcacacaaaaaccactgcgcgaattcgttcactggttattcgttgaacacaacaaaaagtttccaacagtcgcctttgcacactttggtggccgttatgatataacattgtacatcaaggaaattattaaacaaggtaataaatttttaataaataattatttagtttattcatataggaatgcgtaatcctcaaatcatcaaacaaggcaaccgaatttatgaacttaaattaaaagaaaatgattgcggacctctcacgattctgcgcgacagctacaatcatatgcccatcaaattatctggcttaatcaaatcgttcggacttaaaattcaggtgattaatagtacattttttaaactataattatcaacactttaaaacaaaaaaaatttgcaaaagtttaggtaatcattttctttgtacaaaaaaatttctttgacaataatttattactagggttggagaaagtatggatttctatatttttctgggtgtttattttaggctaataaacatataatagtatttgtagtttagtttgaaggttctaggacatattttttatttccatattccatatttttgtcaatatttcacagttttgtccatattttatccatatttcaacattttttttcggaaagtatctaaaaaaattcccaacttaatcaattttttcaattttcaaaatgcataatttcttaataatgccaaaaaaaacgtcaaaatagcactaaaacctcgagatgtatttgatctgtcaacaagagaaggaaaattattgattttatgattaaaaataaatgtttttatgtaattttacccatgaattttacataaatattttggcaatttcgtccatatttttagagttcttcgtccatataatccatatttttaatcgtttttgtaatccaggaaaagcttgagatgttttgatctgtctataagagaagaaaaaaagttaattattttattgaaataaatatttaaaatgagtctacttgtccatatttcttagaactctatttattacttatattaatgcataaaaaattttttgatctaaatataattttaggataaacagtacttcccacatatgttcaacaaatcggctaactacttcaacgtcctaccacacctccctccacgtgaagactactgtcctgatcaaatgaaaaaagccgatttacagaaatttgataattggtataactacaatcgcagtcaaccattcgaccttaaagagaaactacctgaatactgctgcaatgacgtccaaatccttacccacgccctcgtcgaactacgccgggaattcaaacaacttacacaaagggacggaaaacacggtggaatcgacattttgtggcaagccatgaccatcgccagtgcctgcgtcaaaatttttgccctcaatcatctaaagcccaactcacttgccatcgtcccggagaaaggctacacccctcaacaaaatcaaagcgcactcgccgtcaaatacctcgactggtactcccacatcaacaatgtcaatatccagacggcacactctcg

SEQ ID NO: 78361 - DNA, 967 bp, Heterodera glycines
  Genomic contig location: Contig_ID=SeqID_2187; Location=36..1002; Strand=+
  SCN-specific regions: Sequence locations=1-193,233-675,697-698,729 -785,808-967
atggatgaagaaaacgaggtgtatctgataagctacaaagagaaggaagaatttgtcgaggaaaataaatattctaatgttgtcatctccctctttacaacatctgcagcacgactacatctctatggaattttaaagaaagtggcagacacaccgaaatgtgaagttctatattttgatacggtaatttgacaatttaaaaaatatttaaattttatgaatttttattttaggacagtatcatctacgtccatcctgaggacaacgaccctctgccaaccggaaagggccacctcggtgagctgaccgacgagaaaccggaccacgacattttggaattcatcagcgcagggtgtaagaactacgggatgaaggtgagacgaaaggaaaccggtgaaattgaatatgacttaaaaataagagggttcaccctcgatgaaaaaacaacacaacgtattcattatgatagtgttaaaaaccaaataatcaaatatgtatctggctcacccgcatcaccaatttctgtcaattacccccattccattcgccctaatttgattcaaggcaaagtgtttacccaatccctcactaaactttatcaaccctctttcactaaaggaattgtaaataattcttatcatgttcatgattatggctatcgcaaataattgtctattttttcattttatttgtaagagaattaatttcaaaatattaaaaaattaattctcatttgttttgattctcgtttggtttgtgtatctaatttttattgtttgccttctatgtacaaaaatataaatatgtttgctcagagatacgaaacttagacttgggtgtagtaaagtatttaaagaaattgaaaaggaaaaaaacaatatgtttgctcagagatacgaaacttagacttgggtgtagtaaagtatttaaagaaattgaaaaggaaaaaaacttaggaagatatata

SEQ ID NO: 78362 - DNA, 425 bp, Heterodera glycines
  Genomic contig location: Contig_ID=SeqID_2187; Location=2314..2738; Strand=-
  SCN-specific regions: Sequence locations=1-342,364-425
ctttattctcttgcattttccgtggaccttcaacacttaacccacaaaaacaaatgaaccgaattcgaaaagcattcgacagtactcagcggcaatgaatcaaacattccggagaagatcgcaaaggccgaggtttggtgaaagaatttgaaaaattagttttggagattaaataaaaaaacaaccaattagcacgtgtcatttcccagtcttttagcctcaacaccatgacattgagaaaccggtgtcctccttgaaattcggtggtggcgcaacattgttccccgctgaatacgccgacgacgttgacctctacttgcgacaactcgaaagacgcaccccgctggacttcgactttctgtccgtgcacaaaaccattgacggacgaatgcggcaaattctcgtcgactggcttgtccatgtcc

SEQ ID NO: 78363 - DNA, 301 bp, Heterodera glycines
  Genomic contig location: Contig_ID=SeqID_2187; Location=1649..1949; Strand=+
  SCN-specific regions: Sequence locations=1-301
atgcatttgtggatttatatttatgggtttcgacattgggctagatatggtaacgctatatttgtgacacttgtgtacactaaatttgggggaccagacacttgggggtggggccgtgactcgacacttggggaccatacagttggggaccctacactttgggatcgtacagttggggaccctacgttaagggacccgacaattggggacctatacatttgggggaccgtacatttgagggtttatcatttgatgacttgactcttggtgacccgacatttggagatttcaaacagaaaaa

SEQ ID NO: 78364 - DNA, 1544 bp, Heterodera glycines
  Genomic contig location: Contig_ID=SeqID_2188; Location=2596..4139; Strand=+
  SCN-specific regions: Sequence locations=1-278,306-446,468-590,612 -758,780-953,975-1286,1309-1324,1367-1515,1538-1544
atggaaattaattttgtaattattttcatcttatttctaatcgtactaattgacggaattgatgaagatttgtttaatgatttgtggaaaaatcttaagccatcgacctcaaaaaacatcaaaaaaccgatatttggagaaattaatgcgataaaggaagaaatagttgttaaaaatgaaaatgatgaacaaggaaatgccaatcaaattgaaacggaagacataaagccaaaattattacaaaagattaaaaaggaaaaaacattggaagaacaaactaataatttaaaaataaaaataaaaatgccaaaaattgaattggacaaattgagcgaagaatcatttggaaatgagtttaatgaggaagctgatcagaatgtttcgtctgctgatcacaacgattctgttgatgaagcgtattataatattatggtaattcaacaatcctgtaaaaaattatttaaaaattcattggttctaagttttgcatttctaaaaattttaatgatttaattaggagtctgaaacaagaaatgaaatggaaattttgaataaatttaatttaatcaaaacggaattgcgaaaagaaagtgtttataaaaatttgacaaatgttcaatttgagtgcgaaattgcgaaaaaattgggcacaaatcgaaacaaaatttctaaattgaagaaaaaattaggacaaaaaagagagaagagaacggaggaaagtgaagaaacaaaaatggaactgattagaaaatttgatcaaatgagaaaagaaaaaatttgtgggcttaaatatgacgagaagaaaagatcagtaattgaacgtgaaattgctaaagaattgggaacaaatcggaataaaatttataaattgaagaaaaaattaggacaaaaaagagagaagagaacggaggaaagtgaagaaacaaaaatggaactgattagaaaatttgatcaaatgagaaaagaaaaaatttgtgggcttaaatatgacgagaagaaaagatcagtaattgaacgtgaaattgctaatgaattgggaattaatcgtcataaaatttaccaatggaagaggaaatttggtaaaaaaaaacaataacaaattcactttatacttactgtctcattaaggtataataaagaaatttttatttacaaacgaagaaaaaatggaaaaacttgagcaatttgaaagaataaaagaagaatttaaaaaaaaattcaatttcgaacccaatagaaaaattgaatcaaaaatagcggaaaaaattggggttgtgtttgtaacaatttttaaatggaagaaaaaattcggtttaaccactcgtaatattttaattatttatatttaaaaaaaataaattaaattgcttttattttaaggaaagtccaaaatttattcggatgctgaaaaattggaatatgtgaaaagaagtgaggaaatgacagaaagaaaaccaatgatatgtgagaaaaaaattgccgaaactttgggcattccatataccaacttaaaacgatggatgaagaaattttgcagcaaatag

SEQ ID NO: 78365 - DNA, 254 bp, Heterodera glycines
  misc_feature (250)..(250): n is a, c, g, or t
  Genomic contig location: Contig_ID=SeqID_2188; Location=1..254; Strand=-
  SCN-specific regions: Sequence locations=1-62,84-151,174-254
ttttgggttgctatttatagaaggggtatataaagggagtgaaaggaccatttgattgatacattgtatcaaaaatgcaaaaaccgataatcgtaaatataattgctctcgctaatctcggtaccggaattaaactaaactctctgacgatcaccgaatgcgaatttaagtataaccctagaaaattcaatgccgcggttatcaaatgtacaactcctatcaaagccacggcattattatgggaatccgngaaa

SEQ ID NO: 78366 - DNA, 219 bp, Heterodera glycines
  Genomic contig location: Contig_ID=SeqID_14333; Location=211..429; Strand=+
  SCN-specific regions: Sequence locations=1-79,164-219
atgcatttgccggatttatggacaatctttatcgagaatacaagaagaatggaaaaattggtgagtttattgcaaattcaaaaattattattatgtttaatatttattcttttaaaatatatcctaataaattgaaaacttaattttttaaattattttaattgtcagcatatagcaattaaatcttttataatcaaggcctggatttatatttattaa

SEQ ID NO: 78367 - DNA, 366 bp, Heterodera glycines
  misc_feature (7)..(7): n is a, c, g, or t
  misc_feature (55)..(55): n is a, c, g, or t
  Genomic contig location: Contig_ID=SeqID_14333; Location=1167..1532; Strand=-
  SCN-specific regions: Sequence locations=1-129,151-366
atggganaatataggatagtattgaaaaatctgtgagtcgaaaccttaatatatntaaaagcttttctaagctattgcttcgcgattagacaatttccaaaaaagttatacatgaaaattgcgaaaaagttttttcttaataaaatgttttccaggcttgaaaatcttttcgctttttgtaaggctaatagagcatgtgaagagctttcgaatgataccaacaatgttggatttggattacaaagaaaaaagctatagtggaaaaggaaaagcattgctgcgacccaaccgtgccggcccaactgagcgagtccgatatttacccatatttagcattttttaacaaatataaatccaggcaataaa

SEQ ID NO: 78368 - DNA, 91 bp, Heterodera glycines
  Genomic contig location: Contig_ID=SeqID_14334; Location=354..444; Strand=-
  SCN-specific regions: Sequence locations=1-91
aactagcggggtcagcgccttcggcgcatcccccgctaggtaatacgattgtattgtaagattatgtttgataaaatcgactggctcggcc

SEQ ID NO: 78369 - DNA, 925 bp, Heterodera glycines
  Genomic contig location: Contig_ID=SeqID_14338; Location=42..966; Strand=-
  SCN-specific regions: Sequence locations=1-145,167-260,290-327,357 -450,473-925
atgtccgccgacagcacaacgagccgtggaacatctgtcgtccccggtggtggccatcgctgcgttcattgcactacttggacagctggcgcgtgtacgcactgcgacgtgaagcgctgctgcaaaagcgacgccgccaaaacaatcgacaaccgacgacaacgacgcgtaggtgagagagagagagtgatgaagccaaatgaatttgcaatttttactacataataatggctaattttattggcaaacagatggacttttattaatatttttctatatttggcaccagaaatttgcaaaattgggttatggttattttggattaacaataaaataaataatctattaaaaaaattcatttttgttttttcagtttcaatgattcgtgttttgcctatgaactcttccctgatgaacgggccagtacgaagccaatctacagtgtgctcattattgagtaggggaacattttaaatttataattgaaacaataagcaaacaaaaacaattagccaaatgtttttaggcctttctccattgccggtgcttctgcgcagccaaactttgcccttctgcacaagttggccaccgattgcagaagccgtggcacacagctgctgctggccactgggacgccgagttgtgtgaggatcaatcaggcgagaaagaagagaaaattctaattttgttttttttatttcatttctccccaattcttttcagttcgttgccgaatctgatgaaagtttgcgcgttccgcaagatgtgccatgatgttttcttatttatttacggacaactcattttgttgattgtttgccttttcacccaaagtttgtccccatcttgtttattatcacacgcatttttgtttattgtgtttctattttcaccactttcacttatgaatttttattttaataaa

SEQ ID NO: 78370 - DNA, 1766 bp, Heterodera glycines
  Genomic contig location: Contig_ID=SeqID_14340; Location=85..1850; Strand=+
  SCN-specific regions: Sequence locations=1-373,416-495,517-571,593 -619,653-752,782-821,851-855,879-897,919-969,991-1038,1066-1198,1220 -1278,1300-1330,1371-1420,1443-1480,1503-1680,1725-1766
atggccgatgtgctcgcgaaacaaatattcatacaaaacatccaaacatttatggaaatcgcgacgctcatttgcattttgaactttgtcattggcattggcactttgccattgcttcctcatgcggtgcaaaaggccaaggtgtgtgccataaatttgtgccaacatttccttgctttgtgcattagtgatttctttgtccgcacaaaatttttcaaatgcggcaggccctttcacaaaggcaaggaatgcattctcatcaacctggtaatagaggttaattagttttgttggtgtggataattagcttttaattattgccgtctctgcccgatcattaagttagaacaaatttgacacaacttttgcaaagaatttaaatataattaaacaaaaaaatttaaaaaaaaaatatcaattttccttgtcctaactaatttgaaaattgggcgatttttaaatttttggactaattctgaactcgaatgagaaaatctttttagtttaattatgttaattctaaagaaagtttcgactaattatttttctttttacaattttttcactttataaaattcgagtcactaaaaatttgccttctataaatacaatatgcttcttttaattatttattaatttaaatatataattaccgctgatgcaaaagcaaatgaactgggcaaaattgacgaacaaataaaaattagagcaaaaatattggaaataaaaacatttctttccatttctaggggaataaataataaatgaatatatattttttctatatcttacccatttaatagaactatttcttatgtaataaagcataaaaatattttatgtaatgatttgctaaaatcaataaaagaaattaaaaggaattttcttttttcattttacatcgcttcttctttataattgacgtgtattttataattattccaataaatcaattcatacataaatcataatttaaatgaaaaaataatttctttttttttgtcttttttcaatcaattaattttcgtaattctaacagataattattactttttaaaaatttgcaaaaaaaagcacatgggttttttttttgctataattaggaattttttaaaattttgcattcagccaaaaaatgaaccgagaatgtcaatgaccataacatcaatcgcccaagacaactttatatgaatagtatatttaaatctttgcaaattcccaagtcgcaacggtgtatgacgtcactcaaaaactaatgaataattttctgtcaaaaatttttattttgatgattctttgagcaacgatccggcacatcatttaaaaaaggaaaaaaaataattaaaaaaaaataattaaattttaaaaaactcaactgcgcaagttttccttgcttctgcctaggctctccttttcgttttgctttgtggtgtaaataatttagatggtagaatatgaaggtctgagtggagacaaaaagaatttatttttaattaatttttgtgggaaataattcaattgaaattttcggttttttttttcttgggaaaatactcggttggtcccatttgaaaacccagcagctctctgtactggatgtcttagtcccggttttgcccaaaattatcggtcccgttctatactaaattaaccaaaaagctttattatttttcgcttgccaaattttatacaattttatttatttacaaaaaaattaatttattcttcatttatgaattttcttttctctcgttattggaaagtca

SEQ ID NO: 78371 - DNA, 630 bp, Heterodera glycines
  Genomic contig location: Contig_ID=SeqID_14340; Location=2083..2712; Strand=+
  SCN-specific regions: Sequence locations=1-244,295-532,554-606,629-630
atgaaatcaatgtcagcatactgtatcatattgttcagtgctcttgtgttggcggtatatatttaatttaacacacaaaataactaattgttattttcctccagaaacgacgaaagccgaagagccgaagatgggtttgtgggatttgttgtacataaacacaatttaaattcaagttaggcacaaaatcctgtgtttcctggacaaaattttagaattaattatttcaagtaacaaatattccatttaaaattatcaaaaaatgatttaatagatttaaaaaatatatattttgctaattaatttagattttcctaagcaattaattgattttttcaaagatttatttgttttttaaaacaaaattcaaaaaatccatgtccaggcctgtatccaaggttatttataagtagggatacgatttttaggcaaaagcctattttttcctgagatccccgtggcctgaaacgcacgaaaaacatgattttttgggctgttgttaagctacttttcgacttattaatgcctattttctaggcttttatttttaaagcctaaaaagcaaaaaaaattttgaaagttttttctgactattttggcgtttttccaaaatttgttaaccaaaatgca

SEQ ID NO: 78372 - DNA, 345 bp, Heterodera glycines
  Genomic contig location: Contig_ID=SeqID_14341; Location=542..886; Strand=+
  SCN-specific regions: Sequence locations=1-345
taatcgccaattcattaaatgtttttttgtcggagattttatcaacttaaaagggaaagaaggaaaagtgagagactaacgaccaaacgaaaaccatcgattcgatcgtaagaaagaaggaacgcatttctctctgttcttttgccgtcccttctccgatttttccctcctccccatttattcatttctcctcccaatttcttcctcaaaatgccctcctccgttggcccctcttcctcttccgatttgctcatccgtcttttcctcctcctcgactcggccgttcactttgccctcggcgctttcctcttcttctgtccgtccacctgtgcccatttccttttg

SEQ ID NO: 78373 - DNA, 982 bp, Heterodera glycines
  Genomic contig location: Contig_ID=SeqID_14342; Location=638..1619; Strand=+
  SCN-specific regions: Sequence locations=1-686,709-730,752-913,936-982
atgggcgtcgggattggaccagccgaaatcggagaaagatgtcagctgtgccaacgacggaagtgggacgaaggcgaatgggacatatcagcagaagaaaatggcctagagaacggtttttgctgattgagacgagcttttgtttccaaatgatcataattttgaatttatctgtcaattggcgtaacgacagtctgcccgcgtcccactcaaatttcggaccaatgatattcgatccgcaaataaattgatcacacaaactcgcttgatccttccgttccttcccttcaaccgctctcgaccgctttttttgttttcctgaatcgattggttacgctttcccatggcatattgatcagcaaaagcatgggtctgaccagcggattcgccactttctctttcccttcgtcttttcttgcttctttttagctttcatctgacaaatgttttggcccaaatccattcactaagccgccagcattttatgatttcatctcggcatatttgataaatcattcgttttaatttttgataaattcctaaaatgtctgaagagcaatggagcggcgagtcgagcaacagcaacgaatcggagggagtgcaccacagagaggacccccattttgaacaggtcgaggaccaaatccgcgacattcaggcgagccgaccttcccctgtcccaatctctgctcgctcttaagacccaagctgaccgtttgctcttcggttcagtatttttgcggcggcccaaaggattggctgaaaatgccgtcggtaaaactttgagagtaatgagttaaaaaatgccgaattctttggacatttgttttacagtccccgaaacgccatcggaagtggcggatttggaggggacaacgcgccaaatcgcagagacaatcgaacgcatcgacgatttggaggagaagctgaaggaattgttggagcacaaagacaacgtgatgggagatgaagtggacagaaa

SEQ ID NO: 78374 - DNA, 106 bp, Heterodera glycines
  Genomic contig location: Contig_ID=SeqID_14346; Location=42..147; Strand=-
  SCN-specific regions: Sequence locations=1-106
atgggtgtaggagagggaacggacggcggagaaagttgcggcgatgccaccgaagcatccgaaagaagaaaaatattgcattggaaaatgaaacaggcggacgatg

SEQ ID NO: 78375 - DNA, 2617 bp, Heterodera glycines
  Genomic contig location: Contig_ID=SeqID_14347; Location=266..2882; Strand=+
  SCN-specific regions: Sequence locations=1-881,903-1061,1084-2617
actgcattcttccaaatcagcccaattttaaaggagaaggacgcgtttcaattaatgacattgatgctaattatttgcgaagacaaacggtaaaaacaatgagcaaactttcataggtacctaatctaaacatttttcattttaggcattgaaagaaaccacggcacaaactattcctgctttgatggatgcgtggaatgatttgcttcgggctcgtcagggctgtttgattgtttatgtgccaaaagaatgtctttcccaaatccgtgaccaaattgtggtatcgctgcacattgatattattgtttgttcccccaaacaagtgagcttcgtattttatcgttttttaaagataatttagggaatcaaatttgtgtttacaagaaatcaagaaaatgacgatggacttccttccggcgctcatctgttcacttatcgctcaaacccacaaagttcgacgaaggaatggttgccatgttctgaagaacccctccaattgtgtgtttggcgttttgagataactgtgccaaagcaattgacggccgtgtgttgtggcgatttaattgttagaattttgctatagaattttgggtacttatgcagtttattacagattaccaaagattgttaataaacaaaatatttctgacaacttaaactgcataagtgcaccgcatcttgagctaattcagttcctttcttcacttaaacttatattttatgatacaattccaaactccgacgatgattcattgaagacgctttgttatcagctgctcgtgccaacttctgctgctaatatcggtttcgcaatcggtgattttcaaattcacgtgcagccagaaatgcccgaggcatttatttgtttccgtaacatttaaattcctaagcatttttcagattattaactttgtcgttccggagctcattccgctcttaaaacacacaatgaaatcgctgaatagaatttttgtctttttcgaagaacttttgtcatgccgatttccgtatagtacctattggcaaatttttgtggatcaggtccttgatggagtgtccactaaaataataataattttaattcaagactcccgatgaggtcacctctttcgccggacttacaattttttccattcgtctcctttatcataagaaaattttggacatggttcaaggcactcgaaaattgctcgccactgcaattgctcagcagttttttggctgttttatcgcccaaagaagcttcaacgaactttggctcctcagaggactctctgggtttttttctattcaataatttcgtgttttttttttttttgcagttttttgacaggtgtttttgttgaacgattttttggtgccactgaaagcaattaccaactgaacaaattgctgaaggattcgtgtgattacgaagctcgttttggtgctattgctcttcgtcccaatgccaatcacagccaatttttcttcgaccccaattgtcccgaaacgtgttctccattttatttggatgcgctcttccgcaaaggccatttggtcattcgaatgttggagaaaaggttacccaaggagcagttcgttaaggtcatttgtgtttctttccggttaaaaattcatttgaaggttttgcaacgaattctttccctgggggtacagtacagtcagaatttgtatcggcctgtcgaatggacgcacatgctaattaacacggcgatgtttttgcgggttatgactgatgttactgggaaggaattgccttcctttgtcgaacaatggatcgattttggtggatttgttaattttcaggtctgggatttaattgttgcttatgtaattgacataatgctttaaggtttcccacattttcaaccgcaaaagaaatatcattgaattggagttgcgtcagacagttccgcttcaaaaaggatgtcagaagtatgttttatttatttatttttgcacttttccatttattgctcttttaattttttcagttacaccggccctctcacaatcgttgttcaagagcttgaagtatcatacgttaattcttttctttcaaatagttcattttcagggtcattttgctcacactatccaaatagacgccgccgtttctcgccacgacatccaatgccattcaaaggggcgtaaactaaagaagaaacggataatgctcgggaccggagaagaggtcgacgtcgacctaaactcgatggacttcgattcgccagtgctttggattaggtttaatttaaaaaattcgatttaaatgctttcttacaattagagtcgatcccaatttattactttatcgtcaaatgtcaatcaaccaaccgttttatcaatgggaacttatgcttctccatgaaagggatgttctagctcaacaacaagccattgaaacactttgccgtttttccgaacacaaaacaaagatacttttggaagagacagtccgaaacgacaaattcttctaccggttggtggactttcatggcgggtgcaccccaaaatttcgccgccgaaatttcgccgggaaaaattacgccgccgaaatttcgccggacggaatttcgccaaaaatttttttgaaaaaatttggaaattttca

SEQ ID NO: 78376 - DNA, 315 bp, Heterodera glycines
  Genomic contig location: Contig_ID=SeqID_14347; Location=961..1275; Strand=-
  SCN-specific regions: Sequence locations=1-108,130-315
tacggaaatcggcatgacaaaagttcttcgaaaaagacaaaaattctattcagcgatttcattgtgtgttttaagagcggaatgagctccggaacgacaaagttaataatctgaaaaatgcttaggaatttaaatgttacggaaacaaataaatgcctcgggcatttctggctgcacgtgaatttgaaaatcaccgattgcgaaaccgatattagcagcagaagttggcacgagcagctgataacaaagcgtcttcaatgaatcatcgtcggagtttggaattgtatcataaaatataagtttaagtgaagaaag

SEQ ID NO: 78377 - DNA, 632 bp, Heterodera glycines
  Genomic contig location: Contig_ID=SeqID_14348; Location=994..1625; Strand=+
  SCN-specific regions: Sequence locations=1-175,197-408,430-632
atgccttcttttctgccaatgcttttcctcctcctctccgtccaattgctctcctttttgccctgctccttctccgcttcgctttctgttgctcccgcttacaccaccaaagacacgtgcctttccgagtcgagtgccagcgattcgatcagtgcgcagctgaacaaaccgatcaccgggggccaattcactttttacggaatcggcggacaaggcgcgtgcgggttggacattgccacggtatggacgatgatcggacaaaattgtgaattgactgatcaaaaatagacaccgaaaagtgatcagagacaggcatttggggcaacaaatttgacaattattaccgtaattagcaaactttcgtgccttttagcttaattaatgcaattacatagaaacaattggtgcttataatttatttcttcaaaagtacatcaattttaacattgaaaggtcacaaatttgaattttccgcccaattttagcccacaaaatctgccgctggctccggcacacttttcaactccgacgccgcgtgggttgagtcgtgtttgccggacgcgcgttacttgctcaacgatttggtgtgcattaaccgatgcgtcaaaatcgaatacaaagggaacacgtaa

SEQ ID NO: 78378 - DNA, 1659 bp, Heterodera glycines
  Genomic contig location: Contig_ID=SeqID_14349; Location=125..1783; Strand=+
  SCN-specific regions: Sequence locations=1-109,131-949,991-1119,1167 -1173,1197-1377,1400-1400,1422-1504,1527-1535,1557-1605,1631-1659
atggccgccttgaacgcagctgttggtggtaaggaagtggcgtcagccacaccgattattgagtttttggaagtggcgtcagccacagagcaaattgaattgattgagacggagactattccgcaaaatttggagtcatttgaagtagcgtcagctatacagaaaggagtgataatggaaacggcgttagccgtcgagaaagtaattgaaaccgataagactcgtggtatttccgcaggtcttgaagaagaatttgaacgaggcatggaattgggagaaggtcagctgtggaaagaaacacagaaaatattgaaatcgaaactattcaagacttcactgcgactcaattctccaatgtctcgtggtcagagccacgtgccatcgcttcgcctgtgccaatgtcttcaaatgaagaacattgcgcggaaggcggtgttttgaagtatttggtgtgtcaaaccgacgtgaaaagtgtcgtgggtaggaaaaagagtggacaaggtccattttttatgggaattcctgatattttggtaagtgccgagagacgccttcaaatgggagacacagttgtggtcagtaagtttgagtggaagtagggatttgaaagattgtcctatgacttaaacccggttgattcgttgcgctcgtggttcgtacaaggcaggatcaacgttcaagcggttgccataaaggtggaggtgataaaataggtcattggttcatttcaacctggttttgtaaccgacttaaaacgatacagaggtggggatttcagatcagccaccgtcatatctgcgcaaatgcttcgcccccaaaccatctatgcccggcaattaaccgaaatcagtccaggttgaattatgcttaaccaactcctttaccttaatttggccaaaatcacaagtccacaagcattggttccacttaattcttcgtgccattaatcttaattttaataatttttatttaatttaaaaaatatatttaccaaaatgcgttcacttcgcgcatttttataatttgttattatgaaattttttcatttcttattgcaatgcatatggaaattaagttaaaattaatgcgcttcataattcttcaagaaaagtaaatgtgtttaattttacaataatttatatttaaaaaaatattatattaaatttgtgaaagtattttttaggttttaaaatatttgcttgagttgaattggtttgaaaccctctacaatttattttattcaatttgaatttgtttgccattttgtttaaaattcataacacttatatttttggttttctatcgcattttatttcatttttcaatgatttgtttttgatatcaattttatttttaactagtttaatgtcagattttcagaaaatatcaatcatttaaatttggtagtttaattattttaagagatttttatgttaactaactcacttctttttttatttagataaaatttccattaaaattaatagagccaggaattttgaaaatgccgggcccgggctcgggcttcggcaattggccgggcccgggccgcccggtcaaaaaaagcccgttttaccgggcgttccgggcccggtccaaaattttggccgggcgcccgccgggcccgggcttttttcaaaatttttggaattttgatta

SEQ ID NO: 78379 - DNA, 411 bp, Heterodera glycines
  Genomic contig location: Contig_ID=SeqID_14349; Location=635..1045; Strand=-
  SCN-specific regions: Sequence locations=1-411
ccaatgcttgtggacttgtgattttggccaaattaaggtaaaggagttggttaagcataattcaacctggactgatttcggttaattgccgggcatagatggtttgggggcgaagcatttgcgcagatatgacggtggctgatctgaaatccccacctctgtatcgttttaagtcggttacaaaaccaggttgaaatgaaccaatgacctattttatcacctccacctttatggcaaccgcttgaacgttgatcctgccttgtacgaaccacgagcgcaacgaatcaaccgggtttaagtcataggacaatctttcaaatccctacttccactcaaacttactgaccacaactgtgtctcccatttgaaggcgtctctcggcacttaccaaaatatcaggaattcccataa

SEQ ID NO: 78380 - DNA, 1336 bp, Heterodera glycines
  Genomic contig location: Contig_ID=SeqID_14350; Location=185..1520; Strand=+
  SCN-specific regions: Sequence locations=1-16,39-604,633-819,857 -1024,1081-1097,1119-1336
atgttaaacaaaattaaaatagctccctataaaaatatttgttccgaacaaattcgcaatggagagaacgaagaagtcgaaaattttatgaacacaatttcggaccttgttgttggtgagaacatcacaattgattcggtaagaagcaggtcaactgcctgtttttatgaagggtcaattcgatttttttggcaaatttaaaaaaaagacgaattcttcaattttgaaaattttatagaaaataaagattttgggatggaaaaaatacaatttgttaatagatttttactaaaaataatttttttgtgatttttaattcaagcggtgattttaattacacggagaatgagccgatatttaatgaacaaatagggccacaagatgacaacttgtctgaattatccgtatgtgcggcggacaaaagaagccacgggagggcttctcggttagaactgctcggttctgacgtttaaatttattcttgagttaaagggcacgctcaaacagtagtgtcagtgtggcgtcaagcaaaagtcagcgaaaaagtgccaaccgagctgatcggaagaaatccggagggcgggtgaattaaatttaaaaaagcataattaaatgaaaatgttaaaggttttcgcaaatcggaaggccctaccgaacgaattggcacaaataattgaagcagaaagggacgcatttgaaatttcaaacgtttttgcggtttatacccatcagaacggggaaaaatggaaaaatgctattttgtacgatggttaggtacataaatgcggggtatttgttggttaccgaattaaggggaagtctctctctctttctctctctttcacctttctttctcatgaatcccgacccattggattatctgagttatcatatcttttttagatatgcagagctttggtaattcagtttttggggaaggattctcatcccgacccattggactatctgagttatcatatcttttggtatgcagagctttgacaatccagtttttggtgaaggatctctctctctatttctctcgctcgctctctctctctctctatcattctctctctcagtttatcataatgatttaatttttacaaattgaaattcaggatatgacgagtcgaaggatagttgggtgttatcccaggatacatatgcattggaatccgtggccaatttttcaattagtgtctcagcggagctcaccttgacagcattgctcggggggccagtacccgaaagttttaaaaagatactaatggcgaacgataaatttgcgcagggtaataccttttcggatacttttctaaaattttgtatgtga

SEQ ID NO: 78381 - DNA, 205 bp, Heterodera glycines
  Genomic contig location: Contig_ID=SeqID_14351; Location=256..460; Strand=-
  SCN-specific regions: Sequence locations=1-205
atgggcattaaaaccaatatacaagggggatggatcaaaaaattcattatatgcgtttttcttgaaaatggacactgtgggatggtaaatttaatcacttgaaaaattaattttataatctaggtctgaaaagtgtaaaacaattcttcaacattaaacattattattgtatatattgtgagcagacgtttcgagaaaaaataaa

SEQ ID NO: 78382 - DNA, 467 bp, Heterodera glycines
  Genomic contig location: Contig_ID=SeqID_14351; Location=619..1085; Strand=-
  SCN-specific regions: Sequence locations=1-5,28-142,164-274,296-467
atgggaaaaaatgaaaagggttgggtaatagaaaaaatttcgtatgatctatactgcgaagctctgagtgatcagctaataattccgcctagggatttggtacaaaataacgcagatgtagtgctggaatccttctatcatattcagcaaagttttgatgaaattgatttattgaatgaggaaatatctttgatcataactacttatgcagccccaaaaggatctggtattaaaaaaaattgagtataaatcatttttaattttagcgcaatcaataaatcatttgtttggattaaaagaaagcgggagattgttagtcaaaaattctgataattactgtctttttttacagtataatgttgagcaaattgtaccaaataatagggactgaaatttcataatctcaatttaggaaaatttatagcaacggaaaaagacaaaaaaattttgctgatgatttaattaaa

SEQ ID NO: 78383 - DNA, 390 bp, Heterodera glycines
  Genomic contig location: Contig_ID=SeqID_2189; Location=1..390; Strand=+
  SCN-specific regions: Sequence locations=1-323,345-390
aggacaagaaaagaatgaagttgatgcctcatgaaactcgtgaattggttatgttttgtcgaaaatatccttacataatactcataaaaaatacaaataattcaacccacctattctatgaccacattctgaaaaaaatcccagaaatacgaggaaagatatgcttggtcacaataaaataaaaaatggctagtatgtaaaaatttgcggtcacaaataaaataaaaaatggctaatatgtaaaattggcgtccagaaatttttagactaatccgaagcaaagcacgaatgaattaaagaggcgaaagaattcacagtatcgtttctaatagggaaatattgacagaatattcggctaaaaacgggtttgatcatttttagcgcattttt

SEQ ID NO: 78384 - DNA, 3417 bp, Heterodera glycines
  Genomic contig location: Contig_ID=SeqID_2189; Location=1..3417; Strand=-
  SCN-specific regions: Sequence locations=1-580,602-1838,1860 -3073,3095-3417
aaccctgtccttatgggcaaaaccaaacgattgtggtcccgcggcattccattctcgacaagcaaagccgcctgcaactccacgtgttttgcgacgcttccgaacacacctttgccgctgccgtctacatccgaagcgagactgctgacaactcccaagcgaacctaattttcgccaaaaaccgcctccggccacgaacagcaaaccagcgcttcaccatccctcggctcgaactcctcgcaatcctcgtcggcatccgcgccatgcgtttcgccgagaaagagctccgccgtccgatcgaagagcgacatttatggtccgactcccaaattgccctctcatgggtgaagtccgaggagcccaaagctcaattcgaacagcgacgactcgtcgagattcggcaaggaccaaccaccaccttccatttcgtcagaaccgaccaaaatcccgctgacatagcgacgagaggctgtactccggccgagctctgcactcgtcaaatgtggtggaaagggccggagtggctcacgaatccggaaacggaatggcccgacgagttaacgttcgcaacgccagccgactccccttctgccgatcccccgtttgaaaaatcggagaccaagaccctcatggccaaacaaagtccgctgccccctcccctcattgatccggctcgtttcagtactatgctgacccttctcggaacgaccattctcgtcctccaattcatcgggcgtcgtcgaccaaaatggctcaaaatcggcacctcgtcaatcccacggggtggccctccgacgggcgattcgttcagagcagccaggactttcctcatccgacaagaccaacgaagctcgctcgacggctacgacaaacaccccactgttttcaatgaggatggccttttgtgcctcaaaacccggctcttgcacgcgaacggtccgcccactctcgcctctcccgtccttctcgaccgccactcatccctgactcggctaattgtccaagaaatccacgccgacctcagacacgccggcgttgactggactctgactgagttccttggccgttattggatgcctcaagcacgacgaaccattcgtggtatcctccgaggttgcccgtcctgccggcgaatcacggcacccccttttgcgaggccaaccatgccccctttgccctctatgcgcgtcaaaccggctaatccctttgaattcgtcggcctcgactttgctgggcctacctcatctcgactaagcgacggatcgctcgccaagacctacttggtcatcgtcacctgttttgtcacccgggcagtatatctagaggcaaccaccgatctgtcagccccgagcttcatcaatgtcttacgacggttcatcagtcggcgcggccgaccaaagcgaattctgagtgacaacgccccgacattcgttcaaacgagcaaggctctcgacattctgaccggccctccgcccgaaaccgacgccgtcacctttgccgcgcgccgaggcatccagtgggacttcattcccgcctatagtccatggatgggggcttgctacgagcgactaatcggcctcgtcaaatcctgcatcaaaaggacgatcggtcgacgaattctcgactacgacgatttgagcgcattccttgccgaaattgaggccagcgtcaacagccgcccgatcacatgggtgtcagatcaaccggactcatcgaagcccctcactccgaaagaccttatccagcccggcctccccaacgacttggagatcgtcgactctgatctcgactacgacgattgcctctccggtcccgcgcgtctcgcagcactttggaaagcttaccgggaggccgccgaccatttctggctcaaatggagtcacgagtacctcctcgccatcagagagcgcgccggatggactcataaaggtccccgccttcgaactcccaccgccccccacatcggccaattggtcatcgtcgaagaggacctccgccccggaatttatggccgatgggcatcgtcgttgcactaaacggctcactccctaacgtgagaagcgtccagttgcgaatgccaaatggacaaaccgtcacgcgaccaatcagccgtctttgccctttggagaccgaaaaccagatcccggaacccgccccggacgccaccgtgtctatcccgactgatcaaagcggcaaagaccctaaaaccgccgaatcgcacgcgcaagagatgccgcctgtcccaccaccttccggagaaccaaggatcctccccggcatgcttacacgacgcaaggcgcgacttctcgggattgctccaaccacaatgatgatcaccatcatttccatcattttagtgtgggcccaagcctccccagcacacgggatttggccatttgacccagaccataccgaatcaacccccaaatccgattgtgtcggaaaccatcttaactgcactcgacgaggcgtcaaaatttcctctaatcccgtcgtccaaaagataacgatctgctgctccaactcgtgtttcgatcggttagccgcgtctaacatcaattacgaactgccctccgatcttatcgtcaacgattacggctgttccgcaactttcggcctttcatcgacccatagttgcaccgccgaaatcgcctgcccagccatagacgaatgcgaattgataggttgctccctctgcgtcgatcagcttgctaattggagatgtaacccccggctctccctggtcttgctcttcatcaccgggtcgttgatcagttgtctgatcgggtgggtcgtctgtttctgctcctctgcccgggtggtgttaaatctcggctaccgactcaccgcactcctcctctcctggcctctacgactagcgttcttcatcgccggccgaccatggacacgagaagaccgagagcttgttgccgaacgcctcgaactcggggttcaacgggtcagacgacagacgcggcagcacggtcggcgagctcagcgagcggcaacccgactcatcggcattttaaaaatgcgctaaaaatgatcaaacccgtttttagccgaatattctgtcaatatttccctattagaaacgatactgtgaattctttcgcctctttaattcattcgtgctttgcttcggattagtctaaaaatttctggacgccaattttacatattagccattttttattttatttgtgaccgcaaatttttacatactagccattttttattttattgtgaccaagcatatctttcctcgtatttctgggatttttttcagaatgtggtcatagaataggtgggttgaattatttgtattttttatgagtattatgtaaggatattttcgacaaaacataaccaattcacgagtttcatgaggcatcaacttcattcttttcttgtcct

SEQ ID NO: 78385 - DNA, 515 bp, Heterodera glycines
  Genomic contig location: Contig_ID=SeqID_2189; Location=2367..2881; Strand=+
  SCN-specific regions: Sequence locations=1-450,472-515
gtcagagtccagtcaacgccggcgtgtctgaggtcggcgtggatttcttggacaattagccgagtcagggatgagtggcggtcgagaaggacgggagaggcgagagtgggcggaccgttcgcgtgcaagagccgggttttgaggcacaaaaggccatcctcattgaaaacagtggggtgtttgtcgtagccgtcgagcgagcttcgttggtcttgtcggatgaggaaagtcctggctgctctgaacgaatcgcccgtcggagggccaccccgtgggattgacgaggtgccgattttgagccattttggtcgacgacgcccgatgaattggaggacgagaatggtcgttccgagaagggtcagcatagtactgaaacgagccggatcaatgaggggagggggcagcggactttgtttggccatgagggtcttggtctccgatttttcaaacgggggatcggcagaaggggagtcggctggcgttgcgaacgttaactcgtcgggccattccgtttc

SEQ ID NO: 78386 - DNA, 5634 bp, Heterodera glycines
  Genomic contig location: Contig_ID=SeqID_2190; Location=155..5788; Strand=-
  SCN-specific regions: Sequence locations=1-268,291-1815,1837 -2650,2672-3331,3353-3981,4003-5418,5440-5634
atgtcggaactcattcgtcaacgtctcaccgccgaagtccgaaccctttcggacctcgtcaagcgcctccgacaaagggtcgggaggctcactgaattcaccaggatggcgccagaggaaatcccgctcgccgaggagaccaaactcgccaagggcgtacgaactgaccgacaattgctacagagaagcatcgaccgcgtcaatggcatgctacgagaatgttttgaccatattcagctgctaggcgacccgtttctgaagcaggcggaggaggacctcctggccgcactcccgaccttcgacgacgagcaagccgacccaaatgtcgaagaatggccagtcatcactcttctctctaaagcccagctcatcctcgacggcctccaagtctacatcgaggctcgattcgacacgacggacgccatctcttctcgcagcagcagtcgtgtttctgatcacggggccgacgacgaaaaccggatccaccgccaacggcaatccaccgacccaccgactcaggcacagccagcgaatgcacatcagccgtccaattcggctcgagccgatcaaaacctattcaaccagcgaaccccggcattcccgcttaatctcacatttccccgagcatcgaatcgccccacccatcgatcggaacctcaccatggccacttccgacagtcgaccaatgacgacgacgcacttcgggtcagccgaatcgaaatcccgaggttcagcggatcggcagaagaatggatcacattttgggccgcctttgactttgccgtccactcacgccaataccccgccttccaaaagcacctcctcctcctacagtacctcgagaagggatcgccaccacgacggatgattgaaggttacccaccgtcagacgccaattacagcacagtcgtgagcattctacgagaccgctacggcgacgtcggcaaccgacgagaccaactcaatgcccagcttctccacctcaaacctgcccggaacaacctcaaggagttgcgccaactccagcaagagatcgagcggatctgcacccaactttgcagcctcgagcccgagggggagctctcgccaatcgccaacagctcgctggtcaccaatctcatcaaaagcaaacttccaccaccagtactgcttgacctgatccgaatggagcgcgagagctacacttcctggacggctcgaaattggcgtgagggatttgcgacaatcgtcaccgacaaagagcaggtggacttgtgcgtccgcacattccaggacatggacatccagccccgcgaacgtcctcccgaacgggccccctctcgtccgggtggtcgttcttttcgaccaccagcgccggagcgacgttatttggagaacactcgggcctttcctgctctcgcccaacccgtctctgccaatggcatcagttgctccctttgtgagcaggagggacaccgtccgagtgcgtgccagcgatacaccaccgtcattcaacgccggcgacgacttgaggaacaggggcgctgcctgcgttgcctccgtcaagaccacgtcactcgcgattgctctcgtcaagatcgatgttcgaaatgtcaggcgaacgaccatcacttcctcctctgcccgtcaatcgaccccccggggcgaaccaaccatcgacaagagaatcaagagcggaatggaaatgcgtcccgcaacgtcagtcgtgccacgggagccaacgccgaaccggtccgaccgagagcgactcccaccacaaccgcactgctcgtgtgcgacgagggcgaaagcattcccgaggcggtatgcgccgccgcctttgaccccctccccgtcgacagcggcagttttcccgtccccaaatcgacgagagtagctcatttgatgactcagacccttaaggcgtcatgccaagggggcccacccgacggaattcctgcttttgtcttccacgaccctggcagccagtccggctacataagccgggcaatgacagagaagctccgaccccctcgactctcagagcacctcctccgaattcacaccttcggagactcccgccctaagaccgtccgatcagcaaaattcgccattcaactgcagcgcctggacggaggctgggagaccctcgagctcaacgtaatcgacgagatcacgaccaaaatcaaggccctccagtgggacaccaccgatggacccctccccccaaatgccgtcctcaaggtcgtcgaaaaggcgccggacattttgatcggcatccgggaattttggcaattctttattggccgttcaacgcttcactccgggcttcacctcatccaaacaattttcggcccaatggttggtggtgaagcggagtttcccgagaccccacggcacaccccgacaattgccatgctgacgtcccaccccagtaacgtcgagtcgttcccctcatcccgcgccgtcaatgacttttggagtctcgaggcgattggaatcaccgacgaccccaatcagaacgacgaccaagttgccatgcagcaatttggcaataccgtccgccaattgccgtctggccgttactccgttcgcctcacttggcgggaacctcggcctcccctcccctcgaattgggccatcgcatatcgccggctcctctcaacgaccaagcgtctgcaatgctctcctgagcttctcgaccgttactccgccgaactgacacggcaaatggacgccgacattattgagttgaccgggcgagacaacgacgagcatttcttgcctcaccacgccgtcatcaatccaaagaaactgcggatcgtcattgacgccagtgctcgtgccaagggcaccccaagcctcaacgactgtcttcaccgcgggccagtgttgctccccgacctttgcgggattctcctccgcttccgttcagcgacaattcctgtgttggccgacgttcagggcgcctttcatgccatcgaagtcgaacccgaggacaggcgcttctgcaaaatgctttggctgaaaaaccctgcccgtcccgtctcaggcgacaatctcttgatctaccgctacaaacggctagttttcggcgcgacatgttccccctttatcctcgccgctgttctcctccaacacttcgacaagcacgagcacccattcgcccaagcgttggccgcgaatatgtacgtcgacaatctcctcatcgagtgcgagacggaggaggaagcaatcgacaagtcgtccatcgccaaacaaatcctcaaagacgccgacatgaacctcagggagttcctcagccactccccaaacgtcatgaagcaaattcccgaggacgaccgactcgacaaaacaccggccaaagttttgggcctgacgtgggacaccctaagcgaccgcatcactttcagtctcccaaaagacacagacgccactgctacaaggcgctcagtcctgagcatcatcgccagcacgttcgacccgctcggactcgtcgggccatgtcttctgcccgccaaacggcttttccaacggctatggggagaaggaaccgcctgggacgcccccctccccgacaccgaggcgcaaacttggagccaaaccctctccctctggcaagaccaaacaattttcgtccctcgacactccattctcggcaaccaaagccgcctccaactccacgtgttttgcgacgcgtccgagcacacattcgccgctgccgtctacatccgaagcgaggctgccgatagctccgaagcgaacctaatcttcgccaaaaaccgcctccggccacgaaccgcgaaccagcgcttcaccatccctcgactcgaactcctcgccattctcgtcggaattcgcgccatgcgcttcgccgagaaagagctccgacgtccgatcgacgagcggcacttatggtccgactcccaaattgccctctcatgggtgaagtccgacgaacccaaagcccagtttgaacagcgaagactcgtcgagatccgacaagggccgcccaccacttttcatttcatcagaaccgaccaaaatcccgccgacgtagccacgagaggctgcacaccggcggagctccgaactcgctacatgtggtggaaagggcctgagtggctcacgagtccggaaacggaatggcccgacgagttaacgttcgcaacgccagccgactccccttccgccgatcccccgtttgaaaaatcggagaccaagaccctcatggccaaacaaagtccgctgccccctcccctcattgatccggctcgtttcagcactatcctgacccttctcggaacgaccattctcgtcctccaattcatcgggcgtcgtcgaccaaaatggctcaaaatcggcacctcgtcaatcccacggagtggccctccgacgggcgattcgttcagagcagccaggactttcctcatccgacaagaccaacgaagctcgctcgacggctacgacaaacaccccactgttttcaatgaggatggccttttgtgcctcaaaacccggctcctgcacgcgaacggtccgcccactctcgcctctcccgtccttctcgaccgccactcatctctgactcggctaattgtccaagaaatccacgccgacctcagacacgccggcgttgactggactctgactgagttccttggccgttattggatgcctcaagcacgacgaaccattcgtggtatcctccgaggttgcccgtcctgccggcgaatcacggcacccccttttgcgaggccaacaatgccccctttgccctctatgcgcgtcaaaccggctaatccctttgaattcgtcggtctcgactttgctgggcctacctcctctcgactaagcgacggatcgctcaccaagacctacttggtcatcgtcacctgttttgtcacccgggcagtatatctagaggcaaccaccgatctgtcagccccgagcttcatcaatgtcttacgacgattcatcagtcgtcgcggccgaccaaagcgaattctgagtgacaacgccccgacattcgttcaaacgagcaaggctctcgacattctgaccggccctccgtccgaaaccgacgccgtcacctttgccgcgcgccgaggcatccaatgggacttcattcccgcctatagtccatggatgggggcttgctacgagcgactaatcggcctcgtcaaatcctgcatcaaaaggacgatcggtcgacgaattctcgactacgacgatttgagcgcattccttgccgaaattgaggccagcgtcaacagccgcccgatcacatgggtgtcagatcaaccggactcatcgaagcccctcactccgaaagaccttatccagcccggcctccccaacgacttggagatcgtcgactctgatctcgactacgacgattgcctctccggtcccgcgcgtctcgcagcactttggaaagcttaccgggaggccgccgaccatttctggctcaaatggagtcatgagtacctcctcgccatcagagagcgcgccggatggactcataaaggtccccgccttcgaactcccaccgccccccgcatcggccaagtggtcatcgtcgaagaggacctccgcccccggaatttatggccgatgggcatcgtcgttgcactaaacggctcaccccctaac

SEQ ID NO: 78387 - DNA, 515 bp, Heterodera glycines
  Genomic contig location: Contig_ID=SeqID_2190; Location=1158..1672; Strand=+
  SCN-specific regions: Sequence locations=1-515
gtcagagtccagtcaacgccggcgtgtctgaggtcggcgtggatttcttggacaattagccgagtcagagatgagtggcggtcgagaaggacgggagaggcgagagtgggcggaccgttcgcgtgcaggagccgggttttgaggcacaaaaggccatcctcattgaaaacagtggggtgtttgtcgtagccgtcgagcgagcttcgttggtcttgtcggatgaggaaagtcctggctgctctgaacgaatcgcccgtcggagggccactccgtgggattgacgaggtgccgattttgagccattttggtcgacgacgcccgatgaattggaggacgagaatggtcgttccgagaagggtcaggatagtgctgaaacgagccggatcaatgaggggagggggcagcggactttgtttggccatgagggtcttggtctccgatttttcaaacgggggatcggcggaaggggagtcggctggcgttgcgaacgttaactcgtcgggccattccgtttc

SEQ ID NO: 78388 - DNA, 837 bp, Heterodera glycines
  Genomic contig location: Contig_ID=SeqID_14354; Location=241..1077; Strand=-
  SCN-specific regions: Sequence locations=1-256,278-597,619-721,743-837
atgttttccggtgccactgaattcatagctaaccaagcgttcacaagtgcactttggaacattgccgaatccggggtacaacgagcagaatatttggtgcacaattacctgctatcaccgacagcaggtcagggaaaggaaaaaaggaagtgtaaataaatgtcaacttgtcttttttatgttcattttgttttgtttttttgttaaatttttcattttccgtctttcatcttaacatattggctgctttgaaaactaataatgtcatctgttaacaactttgaaatcttttacagccttttcaaaatcatttccacctcagagaacggcatggacacacaaaaacagtcgccttcatctaaaaagatttattatgtctcattcaaccaagactgcaccattcttgtggtcggacacgacgacgggtacagcttctacaatttgcgctcattggaacgactggagaaaatttcggactcgcgaggtccttctgatattcacatccccatcctcaatttatttatttatttttggttttgttttcagtgcctgaacgcgcatgcattgttgagaagctgtacagcagttcattgacctgtgttgtgtcgatgaaaagcacgcgaaaacttcaggttcatttttctccaaactaacataaaaaccgatgtttcctggcgtttatattgggttactatctttctaggacgctcttccgatttgtaccaaaaagcaaagttaaaaaagtttctttacataatcactgtaatttcatttttcatttattgtaatagcagaaattcggacgctattttaaaagggacgatttgatttattaaa

SEQ ID NO: 78389 - DNA, 830 bp, Heterodera glycines; identical to SEQ ID NO: 14355
  Genomic contig location: Contig_ID=SeqID_14355; Location=1..830; Strand=+
  SCN-specific regions: Sequence locations=1-479,501-502,524-830
  Gene Ontology: Mol. function=chloride channel activity; Cellular component=integral to membrane; Biological process=transport

SEQ ID NO: 78390 - DNA, 1702 bp, Heterodera glycines
  Genomic contig location: Contig_ID=SeqID_14356; Location=110..1811; Strand=+
  SCN-specific regions: Sequence locations=1-133,159-195,221-713,735 -754,779-875,917-937,959-1016,1076-1259,1282-1337,1359-1702
atgtccaaaattggcaaattgattaggaaaagcagaaatttggaggcaattcccgagtggtatttggacacgaagcacttcaaagtcgacgtttgccccaattttgaaaatggaaaagttgtcgacacttaccgaggtttgtttatttatttattgaatgtcagcactttccaaggctaattcttttttttcatcaataataaattatttaattatttttgttttcttcagataccgatggaatcgaattggtcaaaatgtacgaaggttttctggaggacagcaaattgtttctgtcaatccatgcgaaaggcgtgagcaaagaatcgctttttggggaagaaacggtggaaattaaaaatgaaaatttgaaaattgtgaaaaaggcagccctttggctaattgacaatttcgttgatgaatttttagcctatttggacaatttttttgaatttggcggcaaccaaaaggaaaaagaccgaattttgaatgaaatttggcaaaaatgggtcgaaacgaatgcaaaaatgcaaacattcaaggaacaggggcaattgttttgccatatttacgttttttcaatgttttttctgagtacaatttggcaaagattgggagagaaggagcgaaagaaaatggcaaaagtaatggcggaaaagcgatgggatcaaattgtaagcgaaagtcactttggcacaatgttcggttttttgcagatatttgaggacaattttcggaaaaaaacattttgaaaagatttaaaacaatttatttttgtatttcttttgacattataagtcgtcaacaaaagaccaaagaacttaatttaatcaccaattaattttaaattgtaaaaataagctcgtgttgacgacttaataaaaaattaaaattattattttttttattaattttagaagtaaatttttctgtgtctacacaaaatataatcctttttaaagaaaattttatgttttccggaaattgtccgcaaatgtcccactgcgtttaaagtgatttaattaagtaaaactaattaatttataatattctttataaataattaatttttttacatagaccattttcgcgcttcgctggtacggcaaatcgtccttagaattcggccgttcgtccgcggcctttgcgacttgcgattattctcagtgggatgaactgcttcatcaccgcaacgcacaattagtgcacagtttgaccctttttcggctcatcaaacgcttcaaaggatttgcgcattttctgtgccaaatgattaaaaaagatacagtagaaacaaaggaccgtcttctgctgctgttccgatccgtggccgaatttgattggcttgagaagcaattcccaatgattttgcgcatcggtaattaattaattattcatttgaatgaccctaattatttaattaacaatccctttaatatgctaattaatgaaaaatttagaggaattaaactttcgttgtcgtttacatttctatgaacaaatgttcaaattcaaaagttcaagtgatttgcacagatacagcgaattccgaatggctttctccgttttgtttaaacaattgtccgttcgcttaactgctaaatcggccaaattggcccatccgatgctcacagaagtaatgtttgtagttcatgaagacattttccgagaaatggcacttgcgttggcattttgtcgctga

SEQ ID NO: 78391 - DNA, 1358 bp, Heterodera glycines
  Genomic contig location: Contig_ID=SeqID_14357; Location=27..1384; Strand=+
  SCN-specific regions: Sequence locations=1-21,254-463,485-490,528 -868,890-1037,1059-1358
  Gene Ontology: Mol. function=protein binding; Cellular component =axoneme; Biological process=N-linked glycosylation
atgaagaggaatcttctcagggaaaaggaaatgaaagggatggatgggaaagaggtggaagaagaggaaaaggtggaagaaaagagtaaaagagaggacgaggaagaaggtaaaaaggaaaaggaagaaggagaaaggaagaatggatggctgagagagaaggaagaaaggaggaaggaaaatatgagggaaaaagaggaaaaggatggaggaaaagggaaggatgagagggaggaaaatggcgaggaaggaacggaggagaaagtggaggcaatgaggaggaaggccgaagatggagagaatggaaaaaaacatagcgacattcccgtggcaaaatgccaattttttgggatgaatggcaaaattcaaaaagcgaatgaaagggtcaaaaaggaaaaaaatgatcaacggaaaggaggaaggccaataaatgcaaaaagtgcgaagaaatcagagacacatcaaacaaaagaaggaaaagcatcgaatgaggaggaaaaagaagcaaaaagcattgatttgctgatcgaaggttaattcgggaagatcttcttggccagtaattgccaatggttaacttcgctcttcagactagtggggtccgatactaaaaatcccgagactcgaaaccgagacgaagacccgagaatcgagacttgaactcgggactcgagacttaacccgagacttgagacttagacccgagactcgagaccgagacttaaccccacgattcgggagattttcagacattaccacggacgaattccttttggaaaagcaccgcaaaaatatgaatgccaacaatgatcacaatttggacaacgaattgttggccaatttgagtgtttacgcacacgaaattaagcaacagatggaaacgtacaaacaattgtcaaattatggcactgaatttcgaaattgggcgaaaaatgtggcgaatgaatggcaaaataaaatgagagagaaagtgccaaaggagagaaatgagcggattgaactaatgaacgaattgtgccgaattttgcacagaatggcaaattttggggagaaattttatgaccaaaattgggacaattgcacagaacaaatgcaaattatgtgctcagaagtgaaaggacagctgcataaaaggcatttgtcacggcaaatcaccgaaaatgaccaattagagaaggaatgggccgaattgactaaagagggacaaattaaggcaattgacacactttggggggagaaaaatgggaacagaaaagccaaagggaacagacggaaagaatttgtggcatttttggagcaatggaggaaaatgagggaccaaatggaattgggtgagggatttagttaatgattgggca

SEQ ID NO: 78392 - DNA, 1850 bp, Heterodera glycines
  Genomic contig location: Contig_ID=SeqID_14358; Location=1517..3366; Strand=+
  SCN-specific regions: Sequence locations=1-126,312-435,459-643,665 -735,757-1062,1085-1106,1145-1717,1739-1850
  Gene Ontology: Mol. function=transcription factor activity; Cellular component=nucleus; Biological process=transcription from Pol II promoter
atgccgttttcccccgttcagaccgctgcactgcaggcgcagcacgcggcattgcacgcgaactcgacgaatcggccaaattatggtgcgcttgcggtcacgtccacgacgacggcacgccaatttcagcagcagccgcaacaccaccatcatcagcaagcagtacttatgccagcaatggcggcggcggcagctgctgcacaacagcaacaacaccatcaacagtttcagcagcaacagtcatccaatgcatgccatcaacaaatgcagcaacaacagcaaactcagtaccaacaacagagtcagcagcaacacaacgccaatcttggtaggtgttcatgtggacggatatgattgaaatcttgacaaaaacggagacggaaaaatcaaataagttgtcaattgtcccaatttttttgaaattttgcattttttagcccactctatttttggaaatttctaatcaaactaacctaggagaagaaaaaaaatcgggcttggttttcagatcgattcgactaaaattaagacaaactgtttgggtcgcaattttggttaacttaacggcaatctgacacgaaaccgccaacatagccaaattaaatgtaaaaatggtcatggcagattatccctaaatgaattgttgatcaatcaatcaatctctatgctctcgctgaagttgcttctcctttttgtaggactgagtttgggtgatttgaacggatgcttccgcagcaaccaaccacaacaacatcaacaacagtcacatcttttgcatcataatgactttgtgccgtcatcacatgacatgatgatcggtgctggcaccatcggcacgaagctgtacagcagcgcagccgcttcaccaccgccatcgtttggcccaattggtggcactgcaggcgctgtggcaccaccaacaacaaccagcacagcgacaacggcactgtcagcgctcggcacttccgtgtccagcaacaatttgcacgcaatgcttggcgcgttggagttggacaatggcgggacacctccgcagcagcagcagggccatgtaagtttaccaatttattttacattcaaaagccaatttttcagggttaaatgggatttttaaaatttaatttaaataggtaattattaatttgcaacgaatttatgtatgtatatacaatcattcctttttcgtcatttttagaaattttacggcattttttgaatgctaaaatttcattgttaaggacttacataaatttgttcaatgtaaatgcctgttttttttttaattttcatttaacttaacatttttattgcgcgttggcatcgatcgctaatggcttagttggttaactgtttgttttctctattgttttcatgccggttcggtccctcgccagtgctcatgattattacaatgttttggttgtctgtcaatgattatcaaaaagatcaagctcaacaggcttgaaccgaccctgtagacaaccactttaactctctctatgagacagacatttaaattttttcaaaattagaacctttttttcaaaaattgtttttggtaactccgtcactcactctctctgctctttcagttctcttctgccatcagcaccgatttcaagctgggcggcggctcctcctccttgcttctgttgcgctccacctccaatggctatggtgccggtgccggaagtgccgtcattcaacaacagaatgccgccaacaccaacaccacgagcgctttctcgccatggcgtatgccgtcgagcgctgtcgatgcaatgtcgcagaatgacttcctggacattctgtcatccaccagcccgtcaccttattgtcagcttccggtg

SEQ ID NO: 78393 - DNA, 440 bp, Heterodera glycines
  Genomic contig location: Contig_ID=SeqID_14360; Location=1915..2354; Strand=-
  SCN-specific regions: Sequence locations=1-412,435-440
ctccgaaatgtcctccacaactttcggcccaatcgctactccgtcttggacacgcaaatgctcagttcggcggatggttggcaagacattgagggaatgccgaacggatcggaagcattgatcagcgaaaaactaacagtgccgaaaacaatcgtaacgaaagagcaacaaaaaagaccaatcggagggcaaagggcgaacgattacggaagcgtaagggaaatgagtggcggaaggagcgacggcaggacggagacggcacaaatcggctgacaacgatgactttcatccctcccttaacaccacaagaaaaaacataatttttgtcccatttttctttttgctattgtccattttgaaagcgcaaattattatagttcatgtttagaaacggaataaaaaaaaactataaccaaaacaaaacaattggaaaatatgaa

SEQ ID NO: 78394 - DNA, 1637 bp, Heterodera glycines
  Genomic contig location: Contig_ID=SeqID_14361; Location=1..1637; Strand=-
  SCN-specific regions: Sequence locations=1-493,515-733,759-1280,1303 -1390,1417-1637
  Gene Ontology: Mol. function=nucleic acid binding; Cellular component= mitochondrion; Biological process=embryogenesis and morphogenesis
atgggtgcgaccgtggcacttgtccgcctttagttgcctttacgacccgattggagtcggcacttccattattctcgccatcctccaaagcttcgtctccaattacttaaagcgtcgtggcatgctcgacttgctagagaattccgaccgcactgatcactttcaccaatcgatcccaacgcattcaggcggctgaagaagcctccaaaatgggcaccgaatctttgtaatatgtgcggacagtgcaagcattgaatggacagggaaaagcgtaccggacattctccgaggcgatgcgaaagccccaccgaatggccatcacccgaggcactcactcacttcgatgggctcccttttggccattcattgagaagcaattgcctttaggcctttggacttctctgtcgttcgccctcacttcctccttcgtcagcttcaacttcggcttcacctattgcctgggaatgcttctgatccgtgccggtcacaccaccccttttgtactgttccaagttgtcgaagctcttaacatggcctccttcatgataatggccgcggcagcgtatttccccgaatatttaagggcacgcttttctgcggggtgcgcccatttgggaagggggcatgaaatagcgcactttcaggcttatgttcgcaatgatacggctaaagccgcgcattaacagtctctccgacaaaggaatcaaaacggcatgcacattttaattcaaagtttttattttgtggtttttaactttagcccatcgaaggccgtctcgaactcaaatccgtccaatttgcctatccaaatgggcaaaaacaattggcattggacggactgtcattgtcagcgtcggtgggcaagcgaattgccgtggttgggcccagcggatgtgggaagagtacggtggtacaactgctggaaaggcattacgatccaatcggtgaacggacggacggagtctttgaatcgaaaaatccccttcaggtggctcaatttgtgtggacggcgtggacattcgccagcttagcatcaaacacctgcggcattgcatggcgctggtaaatgaggcaggggcatatatcatcaatttgaccaaaagtgcgcacagacgaaacgccaaaaaaccccgttaatttaaaaaatttgtcaagatttcccttgtaaaaaaggaagagccgatctcgagttaaaaactagacagctaaaaataaactgtgattcgatagagggggtcaaactatgggcctatgcaaaatttcaaaaaaagttaccaataggaaaaaattttttccaagggcaaagtttttttctttttctctcattttgacgcactatttccatgtctctaacatataaaataacacatattcatttttttgctaataaacaattttttaaaacttttgattaaattagaaatattctttagaattttcctttcaaaacgagcagaaaaaaaaaatcttttggtttactatagactaagttagaagcatacaaaatttaattaaaaacaatgataaaacaaatagtgtctaacctcagctgtctgttttttcattggtgcattgttcactttattttcattaacttttaatagtgtctgactcttacagtgtctgttgtttcttca

SEQ ID NO: 78395 - DNA, 284 bp, Heterodera glycines
  Genomic contig location: Contig_ID=SeqID_14364; Location=43..326; Strand=+
  SCN-specific regions: Sequence locations=1-154,176-284
aaatttttaaaaattttccagcaaataatggaatttttctcgaatttccccccaaacgaaaattaaaaagtttaataggcaaatttcgtaacaagtagcactcaaatttccaaaaaaattttccggcggcgcctatcggcaccgccggacctacattttccactatttttacaagtttttttccttaaaacggccaaaatttggtcatttttagtgaaaaaaaagtgcagttgttacccagcagtggaaaaaaagtaattggttaaatagcaaaaaaaaaagaa

SEQ ID NO: 78396 - DNA, 1561 bp, Heterodera glycines
  Genomic contig location: Contig_ID=SeqID_14366; Location=92..1652; Strand=+
  SCN-specific regions: Sequence locations=1-22,46-300,323-508,530 -789,838-947,985-1088,1130-1561
atgtgtccatcgctttggtttgggccgtgtccatctccgtggccattccgctcgccttcggtgggttggacaaatggctctaaatttgatcacaattctgataaattagcaaattttgttcaggtgccaatcacattgagagtgaacacgagtgcgcattcacaaacccaggcaaatgatgaagcccaaatcaagcatttaaaaacaatactatggacaatatgaaacatataatagtgatcaacccttctcgatcattctatcatcactcatccgatcagtttttgtaaataagaatcgaaaaattaattaattaattaatcgaacttaaagacacccaaagaatttaaaatttttgaaaaaaaatcgaacgaccctcactcatccatctgatcaatcctttcccgatcacctctcttccttatcaacatcgctcagtcactcttatttcgtcgctaactaatcgtatctgatctgttttccttgctgggtcaacatcctgtccaatcatccatattctccattttcactccgataattctcccaatcatctgatcagtctttgccagatcacttccatgccccaatttgtacagtgttcatgatcagctcctcggtgttgtccttctttttgccctgtttgaccatgattgcgctgtacgcggtggtgttcaggcgattgcgcgaacgcgaaagcgcacgcaccgcgcggaagcgacacgccgcactcagcgggactgagacggcactgatctccaacgcactgatgggcggcgcgaaaatggcaccatttttaattaaaaacaaatttatataaataatttatttaatttttaaggcacgccaaatcgcgcgcagccatctaaaggatcagctgctgttggagctgagcattcaggtgggacattggcattgccatgcttaattacttttttgaattgttggccataaataattaaatttaaaatcgtttaaatttaattactttcaatttcattggttatctccaaatttgctgcttcattggtgctaatttcccccttctgcttcttcagacttcctccttcccaaccgccagtcgttctgatgaggaggaagacgaggaggacgatgacgaggaggaggaggacgaagaagcggtggacgcgggcgaatccgtcgccggacgaacgcattggcaccgcaacgacaagcgcggtttggcggcacaagtggcgcaagagtgccacaaacagcaccagcgaaggcccaccttcggcctaatgatgaacggcggcgcaatgccattcgcgacggcaccgatgaatccactgcaggtacatacagccgagggaggaacagaaggatgaactgacacaatttgggaccgttcgggtattacaatcctcgagcattttagcacattgacatacagatagactaattaatatatatcaattagcgaatgtttcaagcttttcttccctgccgactcaattcattaatcaatgtttaattaactgtttgtttaatcttaattgcttctgaccagcagataatcagtcaaaaattttccttttaa

SEQ ID NO: 78397 - DNA, 1339 bp, Heterodera glycines
  Genomic contig location: Contig_ID=SeqID_14366; Location=1753..3091; Strand=+
  SCN-specific regions: Sequence locations=1-165,188-520,570-779,802 -1303,1325-1339
atgcttttgatgccctttcagttgccttccaccgctttgacggacgcggagcgtcgcgtgaaggggtggcagcgaaagcgaacgctgcgactgatgcgccgctgcaacactttgccctccaccgtaatgcagcgacagacgacgacgacggcgccgcatgggacgacacaaaaggcaacgaaaaggacgacaatggcacggggggaaagcgatgcaacccaggaacaacagacaaagtcggacacgacaaaatgccaacagcaaaggcatgagtcaccaaaacggcaaaaaagtccaatcggagacatacaaaacgcaagcggtgttagtgttgaacgggtactgctcgaaaatgatggtggccgggagcaattctgtaaagatgttgttgccacggcggatacaaagggccttaatgagtgggacggcgaggaacggtccccttcgcccacccttgtgcatttgtgcagcagtttcggcgatgagttgggggagtgcttcccattcatcgaccaaaatgagcaacaacaacaactacccgaggaccacaataacaacagcaacaaaaatgccgtgagtgtcaaactatacccaaccaattaattaattcactaattaccccattagttattgcttggtgacgagtcgactcccgacgacacgcgccgctgtgttggcttgtcaaatggaaaagcagcagaatcggatgacccatcgtcatttaatgccgcggcacttaaaatgcaacagcgaaatggcagcagcaaacgcggcacagtgaggcgaacggcgacgacgaaaaagctgcagaaaggcgcaacggaaaagacgtgccatcgaaacggtgatgggcagggcaatttcggcatgcgacgaacgcactcggaacggcatccagcggacaccaaaacgcagcaacggattaggcggttgtcagccgatggaagcgcgtgtgcttcttgcgcgggatgggttgtcattgtcgggaacgaagacgaaaatggtgccaaaaacaatggcaccgacaatgatcgactaaatggtgccgaatataataattatcgtaatgataatgacaatggcactaccgctgcgggatcgccaacgtttggcacaaacattgagcaacggaaaaagaaaagcaccgcgcgacaagtgacgaaaggtcggcaaagtggcctttcttccacttcaaagcacttttagacgctaaatacgggtcaaaatgcgccgctttttccacaggtgccactttggcacttcgcaacggcggcggatgcagcgcgacaccgccgctcctcctgcaacaacgacagctgcagcagaagcggcacaagca

SEQ ID NO: 78398 - DNA, 1297 bp, Heterodera glycines
  Genomic contig location: Contig_ID=SeqID_14368; Location=438..1734; Strand=-
  SCN-specific regions: Sequence locations=1-70,93-172,234-422,445 -447,478-692,724-776,803-831,868-953,975-992,1014-1092,1115-1211,1235- 1297
atgaatgaagtgaacggggagggtcaacatcgcgggtatttatgggcggaaaaaggggcgtgacataaccaagggaaaagggaaatacaataaagcaaagggtcaaaatgggtaccggccaattgggtcccaaccctaacatcattaaatattttaagtggcttaattaagcattaaatttaaaatataaatttatttaatttttatattgtacttttaatttatttttttatggacaaatttcacaatatcaaaatcatttcttaatttttagcacaaatttcacactgcatgcgttgatagatggtgagaataatattaaattacataaaataatggttttattaattagagctcgatatataaagtcgggacggatgattttttgtaaaacattagttaaaaaatgagtcaaggtttagaaaatatgaaattttgtaaaaagcctaatattattattaatcaaattattattttggcttggatctttgccaaaaaataaattaactgacggacggactgtccactgatcgagattgcccactgttcaggacaccaattacctaattacctaggcttactcaaaacccatcttgcccggtctgtcgcacgagcgttggtgggggaggaagcggcggcggcacgtcatccgcacgaaactcgtcaggaggatcatcaagcgtaatttttttctattatttgaataatttaaaaactaatattggtgagccggtagcattccgggttttggctagatcaattcaaaattgatattgtttaaaaaatttataaatattttattccgaatatataatttcaagaaatgttgcaaaaataaaatgttacaaaaccaaaattcaaagggtcgattttttagaattgtatttttttgaaaagaacaaatttttggaaattataaattcttctagagaatatcttaaagctatcaaatgatactaagaattaaatgatttaaatcattttatgatgtttataaaaagctcaaaaatgaattaaatatgacatgagactttaccaatttgcacttttatcgtttcttaagaaaaaacatatagtctcacaaattttgagtattatatatatataattttaagactgataatcatatatcaccagtgcgaggaataccaccacatggataccatcagcctcattatcgttagtaattacttattttgaattcaaaattgttaaaaaatattttattttatttcagagtcaggaatggatgactttcctgttcacattcctcccgataactttcaacatagttatg

SEQ ID NO: 78399 - DNA, 377 bp, Heterodera glycines
  Genomic contig location: Contig_ID=SeqID_14368; Location=2202..2578; Strand=+
  SCN-specific regions: Sequence locations=1-377
atgggagacgcatcaatccaacgattgacggatattttgcagcagttgttgactgcacaacagcaaaacgcgccaccggcacagaatgcctctcaattgccaacacttccggacgtggaatgttttgatgctagtcagcatagtggctgtgaaattgaggactggctcaagcgatttaagttcgctcttgactgtgccgcgccgaaccttcaggacgagttgaaggtgaagctgttgatgaccaaattgtttggtccgacgttcagcgaatattgtaagtccgtcttaccgagagaagtgaccgacttcaattttgtggagactgcagagaagctgaaggcattgttcagccgacctcaatccgtctggattgacag

SEQ ID NO: 78400 - DNA, 67 bp, Heterodera glycines
  Genomic contig location: Contig_ID=SeqID_14371; Location=1..67; Strand=+
  SCN-specific regions: Sequence locations=1-15,37-67
acgatcgatgcgacccaaaattggtggaattggccaaaagtgttcgatgggataagctgatttgtag

SEQ ID NO: 78401 - DNA, 661 bp, Heterodera glycines
  Genomic contig location: Contig_ID=SeqID_14371; Location=809..1469; Strand=-
  SCN-specific regions: Sequence locations=1-324,346-661
gatggtgactccaatgacttacccactgtttatctttctggtacgcttggttgacaccctgaaatgaaacagagaactgtaacagaagagtgacaagactacagtatttgtgttatagtttggcaattagagaaagagaatttaatccgattttatatggaggaaagctctttcaacagtattgtgttgatgaatatgttaagattgaaggagacagaatgagttggataaagaacaatcagaaaaggattttagctgatgcttacaagaatattgacaatatgttgattagaagagcacaagaaagaggtttgccactgggaaggaagtttttcttcctccaagtgtgacaaatagtccgagatatgttgaaaagcattttcaggatgctatggcagttgttcgacggtttggcaagcctgatatatttttgactatgacatgtaacccgcaatgggaggagatctctgagaatctgtttcatgaacagacatcaattgatagaccagatttggtagtaagagttttcaatttgaaagtgaaagcgattatgaatcagataacgaaagtaaagatttttggtgaagtgattgcgtggatgtacccggtagaaaaccaaggaaggggactgccgcacattcatttgcttttgacattggct

SEQ ID NO: 78402 - DNA, 1363 bp, Heterodera glycines
  Genomic contig location: Contig_ID=SeqID_222; Location=271..1633; Strand=-
  SCN-specific regions: Sequence locations=1-565,587-793,815-967,992 -1050,1072-1244,1266-1324,1349-1363
atgccgaaggactacgtccacgaattgtacaaaacaacgatcaaccaaacgaatagcaatttggaacttcatccattgatcttccacgcatggcaactcgacaatgagtctgaagcgacacgcttcccgcacatcaacgaattcatcaactcggagcagttcaaggacaagctggaacagcacattacggcaaggactgaagctttgggcgcgttgaagggcggaatagaaggattcaccatgcgctggctaaaaggcctgatcgacgaagcaatcacatggtggattcgagtcgcctgcgtttattcaaccttcctcatgctgcgcgacattgttctcccatgcactctggcgtatttgctcaatcccatccgagtgactcttctcagcctcgttggagtacgcccgcatccgacattccgacccaccgtttccaaaccactcgggatcgaagagggaatgccgctgcgtgaaatgccacgaacccccaaaccaccagcgcgcagggcagagcaccgatccatgtcaccaatcaaattggacatgatcgccagaacggctcggtaccaacaaccacgaacacagagccatctcgacctcacagaagactcgccctttgggaggcccagacgaaaagaattctgacgggcccatctttttcacgccggaatgtcggaactctgggattccgactgccgatcaattgatcagcagaattgaagaaaggaagtggcgacccttccccctccctttcacatgcgtcacaccccgttccactcctctgcccccatttccctccaaattgttaattgtttttctgcgttccttccatgcctcgcgcacaattaatgaccaatttgtcaaaaccgcaacttttctgccgccgtccccaattcggcgaatgagactccaaagaacgatgaacccccaaatttcccgttttccgcccattttgttcatctgttcattttgtcccccgtttttcatttcgtgcccaattttcggcccattttcgttctgctcacatttgccactttttatttaactttattgttatttaagcggccaaaaatgcccccaatttcacaaccaaaattcattaggcatttttgccgtttctctcccctcccttccatttgcctttaactgtgataaccccattcgtgatcattctttgacccccggttattgatttttgttctgtggccccagtgccctccatttcctgtcccatcccggtgcccaattccatttgtgataattccccggtgatggcatttctgtgatcaatttgtgataattcgttcaccatttcaaaatttttgtttaattacccaagtttgaggtcatttcccggaataaa

SEQ ID NO: 78403 - DNA, 1240 bp, Heterodera glycines
  Genomic contig location: Contig_ID=SeqID_222; Location=1834..3073; Strand=-
  SCN-specific regions: Sequence locations=1-1240
atgacgtccaacaagcaacgacaattggtccataaggacgttaaactacgtcaccaattcaagcaaaagcactcgagcatgcagctgacagcacgtttccggaagcaaattcacatgtcctcaacgattgaggaggttcagcagcgaatgaaccacaacagaccgcaaccgcggaggtcacaacagaggggactaaggccaactcaagcgcctaaaatatgccaatccgggatggcacagtacaagcagggtcgagggatccgccttcaccctgcgtcttctgcaatggcactcactggaccacgacgacgactcagcgaacaacccttgcaacgagagcaaggacacgaatccagtacgtcaccagggcgagaacgcagaccacgaaagagccaacgacacgccccagatcgcctcttcgcaaaaaatcatcaagcccgagcagatcacctttgcatggcattgttccttcgtcaccatcgagaaggaatttccaccggtcaacaagcggatctgcaaacaaatggccattcaccaggaatgcccattcgccaagtctgaaatgacgaatcacgaagcacaattgtggtcaacgaatgacgaattggaagtcaacttccctggaccaatcgccggacttttcaaaggcgaacaaatcagcacggcgacaaactgctttgctcaaccagcaacacttttcgtaaaacggcacaatctgcagatgttttcgccagtccaccaagttcagaactgtcaatacgcaaccgaattctgccaactgcccgacaactcaactctgatttggaaatcaacctgcaatggcaacgaatgccaaacatgcgactacgagaaggcggaagtcatcaacggaaaattcactgcggcctacggagaatcaatggccatttggatctccgaagatcaccaaaaggcattaactttcgccaaaaatgcgccagaactcatcgcctgcgatggcacacgcatcgtcatgtccgaacagaacttcggaattgccaaggagcaatacgacgacattgtcagcaccacgacaagatggaagaggcatccgaccagaacagctcgcatcacagctctcggcatcccaagtggcaacaagcgtggcgttaaatcagcgaaacacgagggcagccaacccgactctccaggccagacgcttactacggcaaccaaacgtccaagctcgttggatcggcgaaacgacaatggaggccaatga

SEQ ID NO: 78404 - DNA, 1822 bp, Heterodera glycines
  Genomic contig location: Contig_ID=SeqID_222; Location=6934..8755; Strand=-
  SCN-specific regions: Sequence locations=1-935,957-1165,1187 -1339,1364-1421,1443-1768,1808-1822
atggccattcaccaggaatgcccattcgccaagtctgaaatgacgaatcacgaagcacaattgtggtcaacgaatgacgaattggaagtcaacttccctggaccaatcgccggacttttcaaaggcgaacaaatcagcacggcgacaaactgctttgctcaaccagcaacacttttcgtaaaacggcacaatctgcagatgttttcgccagtccaccaagttcagaactgtcaatacgcaaccgaattctgccaactaccagacaactcaaccctgatttggaaatcaacctgcaatggcaacgaatgccaaacatgcgactacgagaaggcggaagtcatcaacggaaaattcattgcggcctacggagaatcaatggccacttggatctccgaagatcaccaaaaggcattaactttcgccaaaaatgcgccagaactcatcgcctgcgatggcacacgcatcgtcatgtccgaacagaacttcggaattgccaaggagcaatacgacgacattgtcaccaccacgacaagatggaaaagaggcatccgaccagaacagctcgcatcacagctctcggcatcccaagtggcaaatagaaggattcaccatgcgctggctaaaaagcctgatcgacgaagcaatcacgtggtggattcgagtcgcctgcgtttattcaaccttcctcatgctgcgcgacattgttctcccatgcactctggcgtatttgctcaatcccatccgagtgactcttctcagcctcgttggagtacgcccgcatccgacattccgatccaccgtttccaaaccactcgggatcgaagagggaatgccgctgcgtgaaatgccacgaacccccaaaccaccagcgcgcagggcagagcaccgatccatgtcaccaatcaaattggacatgatcgccagaacggctcggtaccaacaaccacgaacacagagccatctcgacctcacagaagactcgccctttgggaggcccagacgaaaagaattctgacgggcccatctttttcacgccggaatgtcggaactctgggattccgactgccgatcaattgatcagcagaattgaagaaaggaagtggcgacccttccccctccctttcacatgccccgcgcaccccgttccactcctctgcccccatttccctccaaattgttaattgtttttctgcgttccttccatgccccgcgcacaattactgaccaatttgtcaaaaccgcaacttttctgccaccgtccccaattcggcgaatgagactccaaagaacgatgaacccccaaatttcccgttttccgcccattttgttcatctgttcattttgtcccccgtttttcatttcgtgcccaattttcggcccatttcgttctgctcacatttgccactttttatttaactttattgttatttaagcggccaaaaatgtcccccaatttcacaaccaaatttcatttggcaattttgccgtttctctccccgcccctccatttgcctttaactgtgatggccccccaattttgatcattctttgaaccccccgattgttgatctttgatctatggcccggtgccctccatttctgtttctcccggtcccattcattgatttctgtgatttcccatttgccccagtaccgaatgcttcctttctgaaaattttcctgtcccatcccggtccccaattcatttgtgattaatcccccggtgatggcattttatctgtgatcaattttgtgatattttgttcaccatttttaaatttttgtttaattacccaagtttgaggtcatttcccggaataaa

SEQ ID NO: 78405 - DNA, 2772 bp, Heterodera glycines
  Genomic contig location: Contig_ID=SeqID_222; Location=3468..6239; Strand=-
  SCN-specific regions: Sequence locations=1-448,471-1858,1880 -2216,2242-2772
atgtctgggccaatacaaaaagggatcatcaatgcactcaaagctctcgacaatgccaaaagcgccacttcactccttctacaccccgacccggacctgtcaaactgggaaaatgccgtcaacttggaggctcaatttgatcgcgtcgtcaaggaaattcgctcgatggaaatgcagatggacagtctacgagacttatccaacgcttggattgaacttctcgcccgcctgaccggagacgacaaagacaacggcgaaaaagaatacatcaaattcgacaaaaatgagaaaatcgccgaacgatacgacgcagcatcaaccaaacttcgggatttgcgagatctcgaagcaacactcagtgccgcagccaaactgcacagaggcagagccgacagggaagcaaaggcggatcaattggccaatccgcagcaacaaccgcccatgccaccagcaatggcagcaccaatgacaatgccaacattcacagcaccgctctaccaattccagccaattcaactggataaatttttcggccaaaagcgaaaatggcccgaattctacgaatccttcaaatcggcaatcggcagtcaatcaatcagtaaagcgcagaagctgaacttactccgcaatatactgggcggagaagcgcgagaactcatagcgggcttccggttggaagacgcaaactacgagacggtccttcagctgttaaaggacacgtacggagctccggaggaacacatcagaagtcttcacttcgaactggccaatctcaagccgtgccgaagcctccgtgagaccaaagactttctgcttcaacttgagcggcttacaagggagctgaacaatgccggagaggacatcgagggaccgcaggtgttcctcatgctggagaagaagctgactccaccattcctacgaagcatcctcacaaagaaaggagaggatccggcaaactggacgacaaccaaattccgggatgtgctaaccgaagcagtccggaaagaagtccaaatccaagaagtgatgggagaatatggccatcactacgtccaaccaaaagcagaagtcgtctcagcagcacctgtacaagcaccgagaacaccaaaccaaaggtcacgaaggcctaaccaaccaatggcactgcgtgatatgacatttatcgcctcatcactggacgagggtcacagacatcaagggtatgtaagccaacagcacacacaacaagcaaagaaacactgccaacaaatgcgaaaccaagtacagagcgtcaaaaagggtccgccatacccctgtattttctgcaacagcaatcattggcatgacgaatgccaaaacgtcgacacactcaaccaacggatcagcatcgtcagagaaaagaagctgtgcttcaagtgcatgaagccaaaccaccgcgcatcaaattgcgctcgaccatctaagtgctatcactgcaaacgtcggcatcccacggcactctgccgagatcagtacaaagccgagaatggcatcaacacgcctagcacctcttgcagtgaagagaagccaaatgccaacgattgcaagcgatcaacagtgatcgaacaacaacaaatgtgtaatgccatccaaagcaaggaaaccagagcgttgctaatgacgacaaaagcaacgatcttcaatccgtcacggccatccctcagcatgatgggaaccatcttcattgacccgggaagccaccgatcattcatctcgagcagtgcagctgaacaattggatctgaacgtcctcagcacggaagaatgctacttgtccagcttcggtgaacgagaaccgaagcgatacataagcgaccgcgtcgcaatcggcattttatgccccgaccaggacaggttcattttcaacctgaacgctttgaagttcctgctgaatgatttgccggtactacaactaaacgcattggataatgacgaacttcgacaaaagaagctttccctgccgaatgagtcacggcaaccggacattctcctcggaatggacgtttggcaccagctgaatgttcaaccaattgaacaactgccaagcggatttacgatttgccaatcgaaaatcggcaatatcatcagtggaacagggcgaatcaagctcaagcaaccgtccaacatctctttcgtgctaatggtcaacaacgatgaatcgccacaaagcagtaaagcggctcagaggcagaaaaacattcaacaaaaagaaaaggacgaactgagacggcatcaacgcaacaaactcttgtctagcattgcaacattgcgatcaagacggaagagagaatcggctcccatcagctcaaaatcaatcgtgattgatctttcatcagacagcgacgcatccggcattgagatcatacaaaatccagtcagggatagacaagccaaatcaccaaatgagcattcaacggcaccaattcctatggcagtgcaatggctaacaccaacaaggaagagttcatcagttgccaagcgaccagcattttctttcagcaaacaaccaaaaggaaaagcagcgaatcccgcacaaacaagccaaacaaatgaactcaacagaaaaatgaaagccttgtcgccaaccgcaagtggatcaggcgccaaccatcattgcgtcgctacattggccagaagctcggactcaacaacagtaattgataagggcagtcaacagaattgcccaaacatgagctcggcaacaattagtaagacaccatgccaacagcactcgtccgagaagacgttaaactaa

SEQ ID NO: 78406 - DNA, 957 bp, Heterodera glycines
  Genomic contig location: Contig_ID=SeqID_2192; Location=2081..3037; Strand=+
  SCN-specific regions: Sequence locations=1-23,46-49,71-102,124 -306,328-641,665-807,830-857,879-957
atggtgtttgaaatagcggggattttacattaataaataatttatggcgtaatgtatttaataatatatacgattcaaaaaaacgtttgttgattgtaaacacaataaataatttgaatatttgctatgtaagctaattaaaataaaacattttttgcgatatttttatgcaaattttattaatatatttgtctaattcaattcttttttagcattgtatttttaaagtcgcaaaatctggaagtgagccgacaatttcaaaaatttcgttcgtcaaaattattgacaaattgcaacaattttaccaaatcaggtttattttttaattaactttttttccagcccttaggcttgggtaatgatttatgagagatgtagagagtaaaaaaaattgatttaaattaactgtttctcatcccttttttttgatacagcaacaaaattcgatttgtcgctggccagttggaccttggtaacaaaaagatgacgcgcctgtggacattcagtcgggcgctgcactgaaagatgcgacgtccgctttggtcggcatcggcgtaatattcgccgtcattagattgtacgaaaggcactataaactcaggtaaaatgcctaaaaattaagttttacggggaatgggaccaaaaaaaaaaaaatttataaaaagaaaaatgctgctaaatttcttgcgaatttcaggcaccacaaagcaatgaccgcttcctaaccaactcggactctccaaaatgtgtatccacataattctcttccagagcctctcagtttgctgctgtgcaattacagcgacattttgatgtgaaaatgatttttaagcgattataaaatttgatttgaaattctaccatttttgtgtttgattcaaatataacgtaaaaaaggcatatattcaagagcggaaaaaaactttgtaaattgaacgacccaaaagacttaaaaca

SEQ ID NO: 78407 - DNA, 2009 bp, Heterodera glycines
  Genomic contig location: Contig_ID=SeqID_2192; Location=3831..5839; Strand=-
  SCN-specific regions: Sequence locations=1-1216,1238-2009
atgtttttgagtggaaaggatgatgagtcctcgattacggctattgatagaaaactttggcaaggaaaggtcactgtaaaaatttctgacttagaaaaagttcaaaatgacatggggaaattggaagatggagtgaatagagcttttcgccacttgaaccgttccttaaaccaaaaagtcacttgggtgaatgatgttgtggctaatacaaatgccaattttgaaacgctgaaggtacaattcgagaccctaaccgaaagagtcgatattttggaacgtgacaatgatggggcgacttcaggtggaacttttagtcttaataatcaaaacagagcatcgctcgcaccgtttgtgatgccaatgggcaatgcacagcccaaccaactcatgccgaatcaagtgccaatccagcaactgtcaagcgaagacgaagatgacgggccgactctttttggcctgaacatgctaatgagtggaccggcagtagggtcaggtttggaaatgttcagagaagagtcagtttttgcatttgacgattgggctgaacgttttaaggactacctttctgtgtcaggcaaggcttacactgagcgcgaaaaagtcaccagactcaaattggctctgaaggacacgccactggcattgtttaaagaattattaccagcacaaacggacactctcgacacagcactgagtgaacttcgacggaaattggactcccctcaacgtcgggaaattacaaagcgaacattatcattgtgcaagcaaagggaagatgagacagtggcacaatttctgaggcgtttaactccgttggtggatgcgacaaattcgtcattgaccggtaattcgcgaaaagaaaaaatttgcgaagaatttttggatagattgaaaccaaatataagctttctcattcgtttggtgggattgtcacgagcaaaagatttggacttggtaagagcacaagctgaggagttggaggctttactgctgatgagcaagggtgatgagacagtgcgcctctctgacgtagtcaacgcgctaaacaatcagtcatcacagtcccgttggtttacagaagcgaacctgaacaatgactttgctggacagtgggcatcaggtaacaatgtcagaggattcagttctttttcaggatcggatgaacaaacccagcaacaagggggaggagaaggacaaaatcgatctcgcaactggggagaaagccatcaagaacaatttagtcaaagaaattggtcaagcaatcccagatgcgattattgtgaccgcgttggacatgtggcttacaactgctatcaacgccgtgccaatttcagtcaaggaagatggtccaaccaacagccacagcaatcgcaaggacaatggcaaaataggcagagttccgttaacatgatggatgtcccaagttcctcgaatgcttcagctgaatttttcaaaaacttggctcaggctttgctagatcttaaaattcaggagcgtcgcaattacaaagacgaagagccgagatccggagcaatgaatgcacttacacacattaaacccgaaacggaagtaaaaaagtgtcaagttggtgaagaactgtcaaaaaaaatcccaagcctgtgggccggaaacaaaagcaaaccgtcttaaaacagcaaactgggaacggccaaatgtgcgttcgaaagtcgcctccttaatgcaatttcattaatgcttattggaatgactttgccactcactgctgctgttaggcctaatctgccgatgtctccttgtctatagcaaaagtctggcaatttactggtgctctaataccgatttgtaggtaataagttattcaatccatgcccttcgctttaagaaatatgttcatgtgaatttgaacattgcttgatttagaattcattatttaatttttttttgtgaatgattccgaattcaaactggggcccaggattacaatgtaattgttggttctgatgtcatagagaaattgcccaaataaa

SEQ ID NO: 78408 - DNA, 541 bp, Heterodera glycines
  Genomic contig location: Contig_ID=SeqID_2193; Location=90..630; Strand=+
  SCN-specific regions: Sequence locations=1-6,29-93,116-180,203-541
atgacaaagcccaaacaaaatgagaaggacgggaaaagcgtgaagaaaggacagcgtgaaaaggccggacaaaagacgacgaaaacgatgacaaagcccaaacaaaatgagaaggacgggaaaagcgtgaagaaaggacagcgtgaaaaggccggacaaaagacgacgaaaacgatgacaaagcccaaacaaaatgagaaggacgggaaaagcgtgaagaaaggacagcgtgaaaaggccggtggacatggcgagaaggccggcggagatggcgacaaggccggcggagatggcgcgaaggctggcggacatggcgagaaggccggtgaacagagcgagaaggccggtgaacagagcgagaagactggcggacagggcgagaaaaaggccgatcaaaaggaggaatgggcgcatcaaacacgatctccgattgggtacagcccaaaatctagcaactaaataaaatgttttcttttcaggctgttccaaatacgattgttgcaactacgcctgctgcaaatatgccaaaaaaaggtggcaa

SEQ ID NO: 78409 - DNA, 508 bp, Heterodera glycines
  Genomic contig location: Contig_ID=SeqID_14372; Location=41..548; Strand=-
  SCN-specific regions: Sequence locations=1-321,353-508
atggttgataaatgccaccctctttggcgctttaaggagcccgtcaatggcgaagaatgccacaatcgacagccatcggcggaagagtgccaaaacaacggcgtcgagacggctcacaatcatttatctccgactcggaaccgtacaattatcagcctgaacggaaacgacgactcgctgacctcgtcgaacaccaacaacgaaacggggcaggaccaaaatggggaagcacagcgccaaggagcgccagcgttttccattgttttggaccagcaacaagttaaggtagtacgggtggtgggattgagttgttactttttggtttgttgctatttaatttcatttccaggatgaaatcaacacattgcgccgatcgaaattttccactctgaggacaacgaaaatcattgcccaggaagtgcaggattaccaagcggagaacaatttgtacgagcaaatgtgcggctacaaacggttgcgacaacagcaccacaaggagttgaagcag

SEQ ID NO: 78410 - DNA, 52 bp, Heterodera glycines; identical to SEQ ID NO: 52019
  Genomic contig location: Contig_ID=SeqID_14374; Location=98..149; Strand=+
  SCN-specific regions: Sequence locations=1-52

SEQ ID NO: 78411 - DNA, 1132 bp, Heterodera glycines
  Genomic contig location: Contig_ID=SeqID_14375; Location=206..1337; Strand=-
  SCN-specific regions: Sequence locations=1-373,395-414,436-545,567 -820,901-1132
atggccgagcgtgaacgccgggcgccaccacacctgaacgtcgcctccaacttcttggtgagtttttgcatggaaaaaaccacgagttttggttcacctatgttgataagcattaaacagtggtcgaattcagtgaaattgcggtccaaaatttagcatatatgccaaaaaataccacaaaattaataaaatggtacacaatttttaggcatataaacgcaaatttatagggcaaaaatatgggaaaatgtttgttcagctgtgctggccaatttttgaatactgatatgatatccgctgatgccccccctgcctcaaaaaaaaacgaaaaatgttacaaaaattattttcacctcggcttaagttttcaagtttgtgctaaactcttgtatctccaatttgttatgcaaatgaaattttatattttccaatttgccaggtttacatgtggaatgtgccggtgggaatgcgcgggcgcgagctcaaggagaaactcagtcagcaaatcgggccggtaataaaaagggatggaaaatatttaaatgattttgtccccattttgcaggtccgtttcgttgaaacgttcgaggtgcgtttatgcgctttggggttgggttgggctgcagcaaaaaaaaaaaaaaatttgacagtttacaatcgaataaaaaaaaatcccttttcatagggaaatttaattgttgtgccaaagattgtattcggtttagaatttaaaaaacaaaccgagttttatctatttttttaagaattgaactgcatatgttctgtatcgggtgcattacgatccccacatcgaaaattgaaaaaaaaatttcaaacaaaaataatattaaatttaaggctatattattatttattcaaaattgttttttattaaaaaatctaacgatatgaattttttttaatttttgggcgaagctgctcatttgaaatctctggtgcacattgctctctgtataatctgtcggtgttttaggcgtggaattacagacaaagtggccatttgatcgtcgagtttggctcgttggcttcggtggaattttttgttgagatgatggccgccgatcgcattccgtaccttcacaagcccgtgggcttccaggatctcatcacg

SEQ ID NO: 78412 - DNA, 1212 bp, Heterodera glycines
  Genomic contig location: Contig_ID=SeqID_14375; Location=1878..3089; Strand=-
  SCN-specific regions: Sequence locations=1-524,552-938,960-1104,1127 -1172,1196-1212
atgttagaattctcttgttttctcgtattattacattattcagactttgtgctttcgaatgataccaaccagatagggtttgtttgaacatgaacaaagttattgtataaaaacccgggattgtccaattgattggactctcataaaagtcgattggactcataaagtgcattagagccaaaataaacgcattttttgggggtaattttggcggttcattcattgttcataaatctgagagtaaaattcaaaaaaataaaaaaattgccaaaaatataacggtcattcaaaataacaactaatgcaattttgtcattattaattgtcaaaagtcaagaactgttttaggatacatgacttgtgttttacaaaatgttttcatgcgagtcgcccgaaacttttgtttttatttttgctcttccgtgcaatgattttttctccatttttcctaaattttagcaccggggcagaaaagcagggatttgtagtagtttttgcgccgaaaactgaattcacaaccagtggaattttttaaaaaatgttttttcttgtcctaggacactcatgcgcacaacaaatgtcgtcagttggttggcgatcgctatgacgaggagacggacaccgtgaccttcaaggcggacaagtccggtttttctaactataattggatctacgaaatatgaaaaacgaaacttttatgagggtataggcatatttttttggcaaaaatactcctttcatataattgtacaaactggaccgaaaaaggccagcctttcaaattatcgttaatcattagagttggtcgggaccgtgaccaaaacacgtaaaactgagtaccgaagtcacggttttggccagtttgaccatgaccgggaaattcccggtttttcaacctcaaaattcccggtcccgacaaaccctaataattatcacatttcatttgttaaattttaaaatttttcgttactgaaagcaattttttaaaataatctcagctgccccctgcggcgtcagaacctcgactacatcgcatatctgctcaccgcagtgtaccatgagtcgcaccgagttgaaccatgggaggcgtcgatggtggaccaggttggacggtggtgatgatgggcttgataaaaaagacaggaatgtgggggagtaggcctctctgccagaatttttaaaattaattttcagacaaattcgttgccatga

SEQ ID NO: 78413 - DNA, 338 bp, Heterodera glycines
  Genomic contig location: Contig_ID=SeqID_14376; Location=347..684; Strand=-
  SCN-specific regions: Sequence locations=1-171,200-291,330-338
atgtcccaactctaccgtaccattccaacggagtttgatgttaaagagaatacggtagcaacggtgccgaaaggacgtaagagaaagagacggtaagaattggcagaagaatgaactctaagaaaattcaaaaagatgttaagttgttttctacttctaccagggaatttcttaatctaatttaatttaatttaatttatcgagcaaaccaaaggcacattagtgctcttacatggtatcaaaaagaaaacaaataaatttgatcaaataaaaaatacaaaatgaataccgtaataaaatatataaaaataaatcaaatgttaaaaattcacaggtga

SEQ ID NO: 78414 - DNA, 1341 bp, Heterodera glycines
  Genomic contig location: Contig_ID=SeqID_14376; Location=1474..2814; Strand=-
  SCN-specific regions: Sequence locations=1-543,583-1012,1035 -1192,1214-1341
  Gene Ontology: Mol. function=protein binding; Cellular component =nucleoplasm; Biological process=skeletal development
atggcttaccgtatatacatttcattacggtgttaccgtagggcggtgctaatcgaaattttggcgacgcgcataaaccgacaaataacggcgctgaagcaggcgtatgagcagttggacagaaggcatcagcacaatcagctggaggaggacatcaaagcgaagacgaagggacctttccaaaatctgttggtgtctttgctcagctgctctcgcgaagaaagtgcgcccgcaagcattgtattggcacacgacgtaattaagtggcaaattggaaaaaattaataaaataatcaattagcacatacataaacaacatcattaaatggcaaattgaaaaaataaaactattatttcaagaaaacaaataaaataatgaataacatgaaaaatgaaagcaaataataaaaaagaggccatgaaactgttcagagagggcgagggccgacggggcgttaacgccgtggtgttcaaccaggtgtttgccactcgcagcttcgcccaggcaaacaaaacttatcaaagcctttgccattaccagacaataattaattaaaattaatatataatcaattatttatagttgaaaatgtttcacagttttaacaatatgattgcaaataatttgttaaaaatttcagcttcgggaaactttcgagttttaccgacaagccgcgcaccacgagattgaggagggaattaagcaagaattcagcggtcacaacgaaacggggtaatgggagaaggggcgggaaccaattagtgatgatattgtataagagaaccaaggggagacagtctaattaggctaattggatccaatgtttataattatttggatttttaatgtcatttgctgttaatgctttcatttccagtttcttggcactaatcaaatatgtccgcaacgcttctgtgttttttgcggatttattgttcaattcgatgaaaggtaaatttaataattaatggatcaatcaatatttattaatcagaacaatttacttatttaactgcattaattatttattaatctctctgctttttcagggctcggcacacgcgactcggatttgattcgtctggtcatttctcggtctgagattgacctggctgacatcaaagtgctttcaaatttaaattctgttaattgaatgttcaagaaatcaaaagccttaattaattcttatttatagatttaacaataatatttgccatcccattaagcacgcttttcacacgttgcacaagaagagcctggaggaggcgatcaaaggggacaccagcggagcttaccgagacgcacttttggcattggtcaagggcaacacggagcagtga

SEQ ID NO: 78415 - DNA, 418 bp, Heterodera glycines
  Genomic contig location: Contig_ID=SeqID_14377; Location=72..489; Strand=-
  SCN-specific regions: Sequence locations=1-418
atgcatttgattaacttaatcgccctctttttcatgcttttcggtaagtcaattgtttaaattcattagcgggataattgggtaattattttgctaatcgtttcaaggcccatccgtccagcaatacacaaaaacgccaacgaatgaggacaaagaagcggctgtcaattgtcacaacaaattccgatcgcaattagccctgggcaatgccgacaataaattgggcggcaacaaaatgccaaaggcgggcaacatgcgcaagtttgaatgggacgaaaacttggccaaacttgcggatgaatgggccaacaaatgcacattatcgcactcgtggaacggctgggcaggcgaaaatttggcaatgaatggcggaacattttcgaacagttcgatacaaattgataattgtggctactaa

SEQ ID NO: 78416 - DNA, 3521 bp, Heterodera glycines
  Genomic contig location: Contig_ID=SeqID_14379; Location=107..3627; Strand=-
  SCN-specific regions: Sequence locations=1-24,46-157,180-180,229 -302,328-952,980-1000,1024-1058,1080-1395,1437-1637,1660-1710,1732 -1761,1826-1849,2061-2129,2152-2193,2237-2322,2434-2503,2527 -2556,2588-2910,3048-3093,3116-3413,3438-3521
  Gene Ontology: Mol. function=structural constituent of muscle; Cellular component=cytoskeleton; Biological process=regulation of striated muscle contraction
atgggccgaattggagtgggagctgccggcatccaacggcggggcaaaaattcgtggctacgaactacagcacaaggaccaacattcgaacgaatgggtgagtttatggagtatttggtgtgtattgtaattattgttgagttttttttctcgaagtgagcagctcgcttcccacacccgaaatttaaaaaaaaatttagaaaaaaacgaaaatttttataaaaaatacaaagaaaattttcatagcattaggattatgcgttgaatatcctaaaaaaattgccccgtttttgtgaaaattcaaaatttaattttttttttttttttctttaggttacatgcaaaaaatccgcgacctggtcaacaaatttcaaagtgcaaaatctgagcgaccggggcgagtacgtgttccgcgttgcggcaaagaatgcggcgggttggagcaaaccgtcgccccaatccgaccgaatcaaattgcgacaacgctatggtccgccgggaatgccaattcaagtccacgcacaatccattggtagagacggaacgccaaaaataatatttttgattttttacaaaaactcaggtcctaattgtgtgacgctcacttggcaaccgccagctgaggacggtggctgcaaactggagggctaccttgtgcagaagcgagaatggggtcacgaacaatgggagatggcaacaccggatatggtacggtatttccatatacaatagtcacaacgaatattttaatgggtcccaataaaaagatttttttattttaattacaatttcgttaaaatttcagtgtccattgaccgagtttttggtgcccgggttgcgcgagttccaggcctacggtaattgtttttaaatgtgtacttcactttctcccgcgtcgtcccccccccttcgaaaattttcgtgcgatttttctaaaattttatgatgaatcattaattttttttttaatatttaatttgttagtaggtaaacaaaaaaattttttcaaaaatttctttttgaagaattccgtgtcattgcgctcaactcgcacggacgcagtccaccgtcgttgcacacgttgcccatcaacatcgaggagacggctggcgcttgcccgaccattgtgataaagtcagcagagaaatttcaaaaaaaaaaaattagtgcctcttctttttttgatggtgacacaaatttaaagacatggcaaaagaaaattattgacaattcaattttttcgattaaataaaaatcgtgaaaggaaaatgcgtcagtgaatcagtgcaatttcgaccttttgtaatacaatacttaatgctacagtagtaactttattataaaaatactgtattactggcaccttttccactgacgcattttccaggagccctcaaaatattactattttttaaaattaattttcatttaaatatggcacaaaaatttccagcaaagaagtgtctgtgcagaagcccagtgttgtgccgttgaaatcgcagcgtgccaacgaaaaggaaaaggacgccacgcaaatccgaactcctaaaacggcacaaccttcgtctgcacatggcatcggaccatccttgggtaagaaatgagtttggatggaaaatcttagataaaaggctttctttaccagttcggcatttagttcaaaaacgattatccgcttgtctctttttcaattttaatttaaaccgtttcattttttataatttttaattagttcaaaatagttaaacattttccacggacatttttaatttttaatttaatgataatttaattttaaaatatttgtactttaattatattatttcttcactaaaaaaggaaaattaaaatttacttttttatcaaattaatattttcatttatttaaatatatattttttaaattatgtatatatttataatattaaatttatattaattttttaattttttaaaaataattatttcaaactaaagaaaataaattattgttttttttttcaaattaaataattatattttcacataattttatatagaatatgttttattaaaataatgcattttgtttcagactcatcagcaggccaaccattgtcctccaccgcccgtcgtcgccagccgcgcagaagtaccagaaaggatgccattgaattgacccccttggacatacagtggttggttaaacaaaacaaaaaatgaaaaaaaaaaagtttttaattcattttattttttagttgtagcaagaacttgacgctgccacgacccaaaaatacggtaagcaaattcggttttttttaattatttattgggaattttgagaaaaattattttttaaaatttttataatgaactgaaaaaaaaattttttttaatgatgcatatttttgcattttataaaatatttacaaatatttttttttgattttttttcaatgattcctcttctgttgatcatgtttccgctaaagcatcaatattcaaaatttttttctaaaattgatcttttttctttgtaaaatttttgctttaaattgtccccataatcgaaacaaaacttttaaatatttaatgttttaaaaaatcatgaacaggagcggaccgcgtccggtggcggaaggcgacgcgttggcagcaccgcggcggaccggccggcacaggcggcagcagcggcttacgctggggacgaagaggcaccgaacgaggaagtggccgacagtgagggggagcagcagctgctcgacatgacgacggttgaggtgggaataattttgaggcgggagggggtggggccaaattttgcttcttgccactttttttctctgtgtttttttttaattttttttggaggggggggggtggtaagatccaatggtgccaataggcagacgccccgtggaaattttgcaaaattgaatgcaatttgctaattgattttatttaaaatttatttagttttataattaaaatttttgtatttttttttatttttaaatttttaaataacatttaattaatcaactttaattgatttaatattaattaaacatgcataattatcattaattaacgaatttatgataacaaatattattatttttatccgtttttgggtatttataaaatccaaagcttttttagactcaaattttttgtgtttaattttttattacaaaagacccagaaattaaactttactctttgttgaaataatgagttaatattttccaattttttaggtgcgctgcgcggacgaaccgctgctggccaacgcgccattcaatgtgccagggcggccctacccaccggattcactgtacaccacctacaactcaatcatgctccattgggcaccaccgttgcgggacggaggcacgccgatcactgaatacgagctggagaaacgcgagcatggcaccaagctgtgggagaaggccgacaccaatgccgaccccaaagccaacaccaaaaagcagtgggagaaggacgcatttgccaatgtgccggacacacgattcaag

SEQ ID NO: 78417 - DNA, 492 bp, Heterodera glycines
  Genomic contig location: Contig_ID=SeqID_14382; Location=806..1297; Strand=+
  SCN-specific regions: Sequence locations=1-236,281-363,395-421,446-492
atgattagggacaggtatcgaattatatttataccaacgatcaaagtatgtatttaaaatagcaaaaaattgacgaaattattgaataaaaatgaaaatttgcattgcaaattttaaagaaatcaaaaaatttggaaaagaaaaacatataaatttgttgattaattttagaaaaatttctttttttatgtggatggattttacggaggtttttaaatgcatttttgaaaatgagcaaaaatataacaaaaaattttagttaaaaaataaagaaattttagtggatttgttggattgattcgaatatgcggggttttttcttctcaaaaattgtgttcatccttctgagtcgcatatttacgtttattcaatactttgtttttctttacatctcaagtcagtaaattgaaattttcagctgcacatttaattaacattttcattgaattctgtttaccatttgaattaaaaattatatgccattagcgtaaa

SEQ ID NO: 78418 - DNA, 1183 bp, Heterodera glycines
  Genomic contig location: Contig_ID=SeqID_14383; Location=1111..2293; Strand=+
  SCN-specific regions: Sequence locations=1-35,57-466,507-637,686 -703,725-771,793-901,923-1111,1137-1183
atgaattcggctgcgctggcactaacagattccgacctaaatccaggccgtggctttctaaaattcattacaattatttttggattgatgctgtgttacgagattctccaacaatgttatcatgctggtggactcagcctattagaacgccaattaattgcaaatatggttagaacgcgaacgcctcaggcaattaaatgtaaagagaatttgcagggggaggggggggggagggtaaatggaaaaaccctaacccgaatattcgtgatgttttttacaacacaaaagcggcatcgcgagggggtagtactgtaattcaattaaaatatttcatttgagcggcgattgatgctttcaatgcgttggacgaaaaattttatgtggcgaatgaggaaggcaattcttgcccaatttgtaaagagattgtgcccgggacaatggccaaaccgttgtcatgtaatgtaagaaaaaaaacaaaaaaaatttatttatttaaatttaaatatgcaaattttagcacattttccacaacgaatgcattttagcatggtattttttgtatttgtacatttttaaagagaaaatcatttttattaaggcttagcaatcatttcacatgtccatactgccgctttggtaatattttaaataattataaattattcgatttttaaattattaaattgggaaaacagttttcctgaaatttctttaattgcctgaaaaattttgttttatatcaattcctgcagtaatgctttaaatcaagaaatggcaacccaaagtgccttcggcgtttcgtcaaatggccaagagaatggtgccacaaatggaaacggagtagcccaaagtactgctgctgtgggaaacccacccgaagtggtcattgatatgccatcggatgggcaaaacggtggaaacactgttggaacggggacggacggtaccgaaacaaatcgacacaacaacggcacggcaaatgtgggataaattggtggacgaattaagcagatggggtcgacgaacgggtgatagattgacaaacagtgattgttcattgacaaatgacaaattgttgtcatttgtcaaactccaaaaaaatgttagagataaaaattagaaaattctaattttttgtgcgctgcttaatcccttagaaatagcttaaaaattcttttaaaca

SEQ ID NO: 78419 - DNA, 656 bp, Heterodera glycines
  Genomic contig location: Contig_ID=SeqID_14385; Location=145..800; Strand=-
  SCN-specific regions: Sequence locations=1-48,71-157,185-236,309 -333,371-566,588-656
atgaatatatttctagtactattcttgggcacttcgcgacagtgcaaaaatggtgtaaaaatggggcgtttcgcgacagtgcaaaaatgggcacttcgcgaaacgtgcaaatttaaccgaaagagaccgggcctcatcagtacggtgtctctttgggttaatttatttaaattaattattatttgtgtttcggccctaaaccgtatacacacaaagccacagcaatcaagcaaagcaaaataaattttattaagcaaactaaatattttatattggtttttaatttaatcttttaactaattatatttgaatatgattaatcaacgtaatttgttagtagcattttttaaatttattttgagtttgcaaggcttcaacatttgcattattctgtgtagaatcagttacacaaatacaagtctaaacgttttccattggctaaacaatatagcaagataaggggaaggttttcttggcctttgtggatttctttctgcttcccgtttgcatcctgaaaacagatcttatgaacgtggtgatgttttgttagtcgttcaaaaagatcgaagatatattcggttttaaaatcttcttcctgtataagcatttcaccgccgctaatggaaaatgtcaaggggaacaatgccgataataaa

SEQ ID NO: 78420 - DNA, 248 bp, Heterodera glycines
  Genomic contig location: Contig_ID=SeqID_14386; Location=226..473; Strand=-
  SCN-specific regions: Sequence locations=1-248
atggaaatttggtgcaaagtggaggaaggaggattagtccttctgggaaagtctatctttactttgtgtgtttatttaacgggtgcaggcgcagagggtaagttttttgggccagaggtttagtttgaatattaattgttttaggcgtgtacatcgcaatcataacgggacgtggcagtggggattgtgctatgagcataacccgcacgaacaattcggctggctttgaggtttattacattttttga

SEQ ID NO: 78421 - DNA, 635 bp, Heterodera glycines
  Genomic contig location: Contig_ID=SeqID_14386; Location=1006..1640; Strand=+
  SCN-specific regions: Sequence locations=1-358,404-462,484-635
atgaatagcagtgaagaaacaacggaaaatgttgggatgggcggaaataaggacgaacggcagacaacttcaaaagatgagaccgacgaaagcagcagcgaaaatcaacggaatgaacaacgccaacgacaaatggactgcgaaaaggaggactcgaggtgagcatgggctggacaatgcaaaaacagtcaatgaaaaactgaaaccgaaacatcggaggggggggggtgagatgaatttgaccaccgaaaactaaaactccatgctttgaaacccaagacgaattaacaaaggaattgggctaattgagcatatttgagggcaattaacgcaccaaatgtgtattttccaattaacatttgttttcatttgtccaggttcgaatgcaatatttgtttggacatggccaaagatgcggtcagtttaccagcgacgatgccttttcactacgttttcatcaaccgttccatttttgccttaggtcgtttcgatgtgcggccatttgttctgttggccatgccttttccaatggatggacacgcgtccctatcgccagctgtgccccgtgtgcaaatcggcgattagcaaagacaaggttttccatttttactgaatttatcggaatggacaaccaa

SEQ ID NO: 78422 - DNA, 167 bp, Heterodera glycines
  Genomic contig location: Contig_ID=SeqID_14387; Location=399..565; Strand=-
  SCN-specific regions: Sequence locations=1-167
tttctaacggaccgtacacagcagggatgtgccgagccagacaaaatccgattccgattaaatcgccgattccgattatggccaaaaatccgattaattgcgattccgattacgattccgattcggcacatccctggtacacagctcaacagtgttcttcagtctga

SEQ ID NO: 78423 - DNA, 1318 bp, Heterodera glycines
  Genomic contig location: Contig_ID=SeqID_2195; Location=4740..6057; Strand=-
  SCN-specific regions: Sequence locations=1-17,44-1101,1134-1147,1184 -1318
atggtgatgcgacgactacagcaacaacaacaacaacaacaaccccaagaagtgcgcgaaattgtggttgaacaactgctggacccgctgtacaaggacacaaggtcggccgccgccttcaccagtgtggagccgctactgcgtgaggcacagcgagtacatccaacaaggggcatacgacgggcggaggtgcgtcgctatctggcgcgacagcgagtgtacacgctgcaccggcgtgccgttcgtcggttccgtcgcctgcccacgctggcgtccggcctgcacaccgactggcaggctgacctggccgatttcgtctcgcttcggcgcaacaaccgtggcaatgcctatctgctggtgtgtgccgacacgctgagccgccagctgtttgtggagccggtgaagagcaagcagtcagtggacatgatccgcgcttttgaccacatattcaaacgggccggctacgtgccatggaagctgatgacggaccagggcaaagagttcaccgccgccccagtgcagcgctttttcaacaaaaaagaggtgcaacaccattgcatgcacacctcaccccagtggcacgccgggattgcggaacgggcaatccgcagcatcaaggtggtatagactagacaaaaaaagaattgttatttacttttactattcataggagcgactgtatcgatacttcacccaccgtggcacccagtgctggaccggtgtgatacagcagttggtgtcggcgctgaatgcgtcaccgcatcgtgccctgtctgggctacggccccgggacgtcaattttgcaaacgcggagcaaattcgacgccaacaactgcagcggttagccaacaacgtacgcaaaaatagcaggcaggtgcggggacggaatccgcggcctcctcgcttccacgctggagaccgtgtgcgaattgagaagcacaagcatgtgttcaaaaagggctacttgccacgcttcaccgatgaggtgttcactgtgacagaggtgcgagactcacgtacgcctaccacgtataaattgcgcgacgacaccggggagctgctcaccggctggttctacgcacaagacttgtgccttgtgctcccgcccccagccccaccacagcgcccaacacaacaaggggcagaggcatctgctgctgctgccgccgcagccgccgtcgtcggtcccgtttatgacattgaacgggtgctgaaaagacgacggcaaggacgaaatggtgtggagcattgccttgtcaagtggaagggctactccgcagcgcacaacagctggatccctgctacatcaatcatataa

SEQ ID NO: 78424 - DNA, 1146 bp, Heterodera glycines
  Genomic contig location: Contig_ID=SeqID_2195; Location=3533..4678; Strand=-
  SCN-specific regions: Sequence locations=1-412,447-507,549-778,800 -999,1021-1146
atgtcctcatcatcctccttctacattgtcttaccgtcaaacacacaggttgagggcaaccggaccaactccttccgcgtacgtttgccacgcaagctacagttcggctcacagtggagcgtggggttggcagtgctgctgtacccgcactcttggccctctctgggcacaacggaggagcaatttgtgcgggtcgaatggcagaccggggaacaggtgcgcatccccgtcccggccagcacagtgcgaaaccccagcgaactgctcaccagtttgcatcgcgcattgggtgaaggcagtgagaaattggccactgagctgcgccaaatccagctcacctaccaccagctgatcagcgaagccgagtcaagtgccaaaacacaactggaagcggcaatacgtgaccgtaaaaaacagcagcaacagcaacaacaaaaacaacaacaggagaatgcgacggagaagaagcaattggaaaagcgtgaaagtgcaaaacctaagcctaacgagaaaggaaaagatgatgatgatgataaagaggaagaggaatggaagcgtgccgcgtacaacagtctttaccgtcaatcgctcgacaaattggttgtggaccgaatgagtgaggcggagcgtgtgcagcttcaacgacacctgccagtggggctggagctgtgggtgcagtcctaccgcaaggcacgcctgtcttgccgcttcaactttgacgtggagcagcagcgcttccgcctggagcttgaccagtcacggatcagacaggtggagctgtcggatcaactggcctacatccttggcttccacaagcgccacctgtctgcaccgctgaacgtggcgcgctaccagccggacatgaaaggcggtgtctcatccttttacgtgtacgcgccgggactcattgagccggtgatcatcggcaacgtgtgcgccccagtgctgcgcatggtctgcattcgtggcgcccaaccggacgacatgatcgaagaggcatacaccactgtacaataccatcagctgatcacaaaagagattgccgagattttcatcgagatacggacccccaccggcgcccttatgcccttccagtatggcacctgtacactcacactacattttagaaaatcacactatttctga

SEQ ID NO: 78425 - DNA, 1014 bp, Heterodera glycines
  Genomic contig location: Contig_ID=SeqID_2196; Location=23..1036; Strand=-
  SCN-specific regions: Sequence locations=1-750,782-853,877-1014
atgaagcacacaacccgcatgctgctagtgccggaggaactgtaccgctccttgttggccaggagctcggctcctgttgccgacgcatcctctgcgaggggcggcttaccgcagcataccacgccaattgagcacacggcaaagcgcatggcgcgcgctgcacacagcggcggcatcacccagagcacggatggcgtatctccggcatcgaaacaacaacaccttctgaacgatgacgaacggttgatccattaccaacaggagttcaagaggttcaaaaaattgctggaggatgagcaggagcgtccagcgcctgttcgtctcacccaactgcccaccgacgaagcctcgaaggggctgctgcgcgatgcactttccgaggcggcgcgaacaattcaacaacaacaacctcaaccaaaacagccggcgctgcaccaacaacaacagcagtcgtcgcagtctgattcgtcaacaatgaggcagcctccacgtcgcagacaacgaccagccaaaaggacacaccgtacgacatcagcctctacggatggcgccgaagctagccgcttcccgtcatcgtcatctgccgtctcattgttgacacgcactgataatggaggaggaggaggaggagctgagacgactgagcgtgaagacagccccaacgacgaccgaccccaaaatgtggcggcagttgaccccgcaaggaaaggacagcgggaagaagcggacgtgcaactgcatccatcaacatcaacagcaccagcagcagcagcagtcttacgtgacactgagcagaggaaacgacaagccattgactatgcgttacgcaacgcgggcacgctgggcatcggagatggacagcaggtgtaccggctgatgcaaggcgcgtaccgtccgatcaagaacagcgatttggatgctttactcacttttcattttgctgagcccaaaccggagaaggcaccgcctgggtacaaaacatttattggcaatgctcgacaagacccgcgcatg

SEQ ID NO: 78426 - DNA, 1230 bp, Heterodera glycines
  Genomic contig location: Contig_ID=SeqID_2196; Location=2458..3687; Strand=+
  SCN-specific regions: Sequence locations=1-70,94-156,188-612,643 -683,714-1230
atggacacgtcgtcacacgaatctgatcgcaaggccggcgatggtgctgataatgctgatgcacctgcagcatgccaacagcagcagcagccgagtttgaccgcggacgaaccgctgttggtccgacagccaaaggaagcacctgcgcaccagctaatgaagaaagaggaggaggaggagaaaccgcgacaggaaagcgcgccacttcctcagcccacacacaatgatgacgtcagcaaatcggtcagtcagtctgttgccgtccaccacaatgcacagaacaagaaattgtcaaaacaaaacaaaaaatcagtcgctcgtttgttaagatgacgaagctgagcagcgatagtaatgatgaacatggcggtggcgatggtggtgatgatggacaagcgttgccgaccgaggatgacggggtgggcggtgctcatctcccgcccctcttgttcatcgatgaggaggaggaggaggagagcaccgagtcgcgcactggggatgacgtgggccgagacggtgacggtcagattttcactgaaaaagtgaagcaggaaggggaggaggaatcaaccgacggtgacgttgacatggattctgtcagccatgacacgtgcagaagcagcagcaacagcagtagcagcaccatgagttcgtcgttgttcttgctgcatgactgtcatatgcaccaccactacaaccgccaccaccaccacgacaacaacaactgcaacagcccgccgcgaaaacaagcggcgacagagctgctcaagcttccgctcatcgactatttgtgtgggctgaacaacgggtgcagtgtgagagagctccacacgctgcttcagaccaagagcccacgtgcacacatgttggcccatctgcaacagcgctgtctgctgcgcaccgtccatttgcggcccgccgagcgcaacattgcgctacatgcgcatgccctaagtgccctaagtacaaacctgacctttgcatgcggcggttatctcaacctcacagtaataattttgtttaaagaagcgccgcccgcattctgtttgtttttttttgcctaggtgcgtcagtacttctatgccaaacacggtgtccgtttgcgccacccaaacctgccggcgctggttgagcgcggtggtggcgcacacatgtcctattatccgctagagtgtgtgcaggtgcatgtcatggtggcatcgcccacggaccccaacgagacggaggaca

SEQ ID NO: 78427 - DNA, 1529 bp, Heterodera glycines
  Genomic contig location: Contig_ID=SeqID_14390; Location=149..1677; Strand=+
  SCN-specific regions: Sequence locations=1-244,282-403,428-599,621 -632,669-902,937-1180,1202-1529
atggtcaaagaattcgagaaggtccgcgaccaccccgacccgagtgcgatgctgttcacctgcatggactcaaggtgtgaggcaggctgaatcggaatcccggactttttttgggctaatttgcaatttgtttttttgaaccagtaattttattcatattaataattagggatgtcaaaaatatgtacaaaaagtggtcaaaatatgtacataaatatgtaaaaaaaatcccgaaatatgtcccaaatatgtaaataaaatttttaaatggttatttttttggaaaaaaaattcttcggaaagcgtgaaataggcacaaaatgccataaaaatgacctaaataggcctagaatcacattttagtattttaaaaattagtttggttaatttttattttcacaagaaattttataaaatttaaaaaattctcaaaatatgcaataaaaatttgaaattatgtacgaaaaatttgccgaaattttggatttttttttgaaaatttccgaaaatttctgtaaaaaatccacaaaatatgtaaaaaatgtatgaaaaagtccgaaaaagtccaaaatatgtaccagatatgtataaaagcccgaaatatgtaaaatatgtaaattaaactcccggtttttgtttgcaaacacaaaaaagaaagtgtttttcctactaattagagcatggagaatccaggaaaaaatatgtatttacataaaattgacatccctattaataattttttgttctaatttttatgcgcattgatctctcatccattgaaatgtctttgcttttcgtcctcaggttacaaccgtccaaatttatgggtgctcagatcggcgaattgtttgtcgtccgcaattccgccaatatggtgccggtggcaaaaagttttggtgtgcaattaattaaatttttctaaaatattttaaaaaagtgatttaattgaggcgattccggcggagaagtgtccgtcaccactgaaccagcagcactcgaattggcgattaggtgcaaaaacagtttagttgattatgttgtatccatgtaattaaaaggcgtggaaatgtccgacgagtggtcatttgtggacattccgattggtaagcagcggacggactgacaaattagcccagaaatatttgtgaaaatagttttttcaaagggtgaaatcattttcaaaattcttttggttaaattccgccgattggcccattcgccattcattcattttccaataaaatttcgctctaattttctgctcgttcagcaaggcgatcaacacactttacgacctttaccatgggcgtccgtttgacgccgagtcgccgatggaccattggctgcgacggaacggacaccaaagtgtgcagaaattgacccaactgctgatggcggggcccggaacagagttggaattcgcatcggagaacggactgatggcattctgcgctcacattgaccgaacggaccaactgagcgcggtggacaaactgtcgcaaattaacacacttcaggtgggcaattga

SEQ ID NO: 78428 - DNA, 968 bp, Heterodera glycines
  Genomic contig location: Contig_ID=SeqID_14391; Location=216..1183; Strand=-
  SCN-specific regions: Sequence locations=1-157,179-368,390-623,646 -744,766-857,910-968
atgccctccttaagcggatcgaattggtggtgggcaccgggccaaaaagcagctgaggaagcagaagcattcagtgccgctgctgctggtcaacccaccaatgagcagatgcaacaagcggacaatgagcaaactgtgcatttcgtggccacaactgttgaagcaatgctttcacaaattccgggcatttcccgtgacattttggcgtcgattaatctgtcacaactaatttattgccaaaattttgctgcgatggttggcaatttattgctgcaaaattatgaagagaaaatgccacagaaaattctcaattcactgactttgcccaatgaatatttgcaatattttgagaaaatttatcgcttaaaattattaatttggagaaattggcggacaagggacagatcggaagatatgttttggagaaaaaactgctgaatttgcgaatattcgccgatttctttctgactctgtccaacatttgcaagacgaaacagaaccaaaacaacgcattggccaacagagaaattacgtggataaaattggcaaattcaaatggctttttggagatttgttttgagcagttttacaagcaaatagcacaagcaattattgaacagggggacacagaaaatgaagtgatcggtgtgatttgattggcattttttggtaattagtttagccaaatgttgacacattttaactagaatgccacgggaccgggacctttttgggttgaaaaaccggaatttttggctgggaaaaccgggaaaaaaccgggactagtcccggtcccggtcaaaaccgggaccttggtactcagttgtccgctaccaggtcccgatcccgtggcactctaattttaacaaaatatttgattgtattgtaaattaatataaaaatattatagggtaaaatgagcagcaaactaaaattcataacatttaaaaaagttctaaataattaaa

SEQ ID NO: 78429 - DNA, 458 bp, Heterodera glycines
  Genomic contig location: Contig_ID=SeqID_14392; Location=3325..3782; Strand=+
  SCN-specific regions: Sequence locations=1-458
atgaacaaaatatttgccaacgattctaaggctgtttttgaggatgatatgcatatcggcgaagccttcgatgaagttttcaaacagatatacgagcaggaaaacgaggtatgtaaattgttactctttgttggtcactaaaatagtatttttgatttaagatgccattcgacagatgtagagaaatctggaaagaagttgaacattctgaaaaaacgcttgtccatgaaaccaatcatttgttgaaaaatcaaggtgttgattttactatttctggtcttttaagttttacgataggtcttcaaaattccatcgaaaccgaaatgaaaatgctcaaggatgctgaggcttctttggatgctttgaagaaacgtgaattggagttggttcgccattacaaagacaaacaaagcaaaatcctgtcttcgctggaccatggcatgcaaatcttgatttaa

SEQ ID NO: 78430 - DNA, 956 bp, Heterodera glycines
  Genomic contig location: Contig_ID=SeqID_14393; Location=398..1353; Strand=-
  SCN-specific regions: Sequence locations=1-15,59-137,159-203,225 -784,812-956
  Gene Ontology: Mol. function=transcription factor activity; Cellular component=nucleus; Biological process=cell fate commitment
aaccaaaataatggctttttatttcaaaagaataatttattatttataaacatataaagtcgtataactaaataacttccggcatacttaattataaaggtaaaacatttttggaaggtcacaccggcactaatcagctgggaggtgtcttcgtcaacggaaggtgaccgacccatcggcacaattcgccactaaatgcctttcccctcttcagaccccttcccgaccaaattcgccagcgaattgtcgacttggccgaggatgggatgcgcccttgtgacatttcgcgcaatttgctggtaaattgggggggggattaatttgcgatcgcgaagttcgaaaagggtgatcagaggaagagatttcagagaatattcgacgataattgggtgatcattgtgtttgcaaatgttaaggtgtcgaacggatgcgtttccaaaattctcgcgcgtttctaccaatacggcacaatcaaaccgagggcaatcggagggtactgaacggaccgatcaaaacattgacaaaaatggcaaacttaagatcaaagccacgagtggcgaccagagaagtgtgcgagaaaataaaggcgagtttaagacaaacggagaaagaaaacggcgaaaagacatttcgggcacaaaacaaccaaaaaaaggaattatttggtccacaaatccaaggcattttgatacacttttcatttgccatttttcgtttgtttttccgtctttcgtctcgtcctattggttcgttttaggtgtacaaagatgcgcagccgtccattttcgcctgggagatcagagaccggctgaagcaggacaaagtgtgcacggacgagacactgccaagtgtgggtggccaactcagtcccgcattttgtcattgtccctccgtttgttcaggtctcatccatcaatcgggtgcttcgttccatccaaacgcgaaaagaatcaacg

SEQ ID NO: 78431 - DNA, 706 bp, Heterodera glycines
  Genomic contig location: Contig_ID=SeqID_14396; Location=1155..1860; Strand=+
  SCN-specific regions: Sequence locations=1-33,56-86,110-200,222 -241,263-264,286-292,359-461,484-486,526-636,658-706
atgtacattttaaaactgacaacaatcatcctcttattttgtttaatttattatttcaatgttatgtcagtgatcggcgaagaaagtttttttttattaatttaattaagtcgaaaaaaataaatgtttattgaatttagtacctaaaaatctaagtttatgccgtaatgtttttttttcaaaatttgaacaaaaaattgacattttaggaattctttcttttttatattaaaacctgattttttggataaataaagtttctgaggttatgttttaattaataagagctcagttaaatataaaaaattaattatttttgagattttttcattttttatttaattatttaatttttttacaggatactcaacagccaccggtcgaaacgacaactgaaatgccacaaactgcagcaggagaagcgcagcttggtgaattgaaaattgtgcccgaattggccgactcaacaccaacaaaaaacaatggtatttttaattaaaataaattttttaaaaacaaaattttcagcgacaaattcaagtgattctaacgatgaatccaatggtatggatggaaatgttttttgcttatatttattatgaatttaataaggaaaggtattgaaaattataatgcttaaatatttttaaaaaatttcgaaaattcatttttctcgttcaaaattatacaaattttccgaatttta

SEQ ID NO: 78432 - DNA, 1421 bp, Heterodera glycines
  Genomic contig location: Contig_ID=SeqID_14396; Location=2594..4014; Strand=+
  SCN-specific regions: Sequence locations=1-171,208-356,390-564,586 -614,636-658,680-884,907-938,986-1026,1048-1061,1083-1129,1192-1421
atgttggaccacataaagtctatcatactaagtgagatgttataccaacgacgtgttgaccaattcaagtgccgacatgacttgaaataccggcttcaaagcaacttggaccttgtcaagcaaattttcatgaaaatactgtacaatgacagtacacaggatggaaaagaaaaatttaccatgtccaaaatgttggtggacggtggcttgaacagcttgaaattgttgctctcatttgctgctcgtctctcagccgctgtgggaggtgtactatccaattttttgtataaaattgcgactcatactgtagtatctctcaaatactgtgagatccccaaaaaacggtgatagattttagacagaaaaattataagaaatgagaaaaagaataggtagaaattttcttggaataaattgctataattctaattgtttttgacagttttgtttttttttaaacttaataaaatcagactaattctcgattgaaatcatttaggaaacaatggcacaaatttgcgttcatttttggctgcctattcatgccttaaaaatgtgtcagcggatgaaatgtaaaataaaaaactgaagattgtttttttgtaaacatttattttaaattatacagaatttttggctaccgtattgaactaaaagtggacacaaatggtaacacaattcttgtccgccttggctggaaggagtacacagttggccaacaactgatcagcaaaagtaactaaaaaatttattggcgaaatgtttttttttaattttgagattaatgcaaatattttcaattttatgttgttattaagctaataggcaatacaataaactcccataaaaagattaaagctttaaaattcaaaaaaatcaagggctttcatatttttctttaaaatttggaggaatttttgattttttttgtgctttacattaaattatttaaaatgattaattaataaaattatttacaaaattagaaatccaggaaaagtaaagacctttacaaaatttataatgaacaattttaaagacaaatttgatttttttttaaatcttaaactatcaaaaaacaattttttagcaaattcaaagtttacaaatttataattgacaattaagcattaatattttttttaatttttaaattcacaaaaataatttttaattttaaaatgattttttctagccaattttaaatttcttcaacaattggccaaaacggaactgagcccgcaggatgtcgtcaatgtgtgccaaaaaattgacaattcggttggcattggcgctgccatggaaggcacagaaagcgcagcaacaaaattattttcggcagttgcagcacattttgaagcgtcaaacaatgaaattcatcaaaaaaatccatctggaaaaggctaattgaaaaaatttaa

SEQ ID NO: 78433 - DNA, 827 bp, Heterodera glycines
  Genomic contig location: Contig_ID=SeqID_14397; Location=324..1150; Strand=-
  SCN-specific regions: Sequence locations=1-827
  Gene Ontology: Mol. function=heat shock protein activity; Cellular component=extracellular space
atggacaaaatgccaatgcaagtgttggatgcaattgtgccgttcattgacttttacgaccatttgaacggaatcgactcgcgcaaaagcattttcctttttttgaggtaataagttttcttttcaattagggatttttgagtttaattttttcaaatttttaagtaacggcggagccaattccattgcacaacgaacgttggaatattacaacagaggaaagcccagggaagagatcaccttccgagaaatggaggagatcattcagatcagtgcatataacgaaggtccgatttgaaataaattatcggctttttgttatattcacccatttaaaaacattttgcaggcgatggtggacttaaatcgagtcgccttatcaacaaacacctaattgattattttgtgccttttttgccgctcgagagaagacacgtcacaatgtgtttcaaagattatttgcgttcactgaacgtaaattacacgccggaacagctcgaacgacttactgactcaatttcggtaaatgtttggagaaatggaaactcatcatttatttgatttatttcgtctgattattctatttttagttttttccacgtgaagcaccaatttatgcttctgctggctgcaagcaagtcgttcagaggaccgatttcatattggaggagttgataagggaatctcggatgattaataactttagtgacgaactttgacacatctctttcaaactaatattgttttgtttgtattttcaacgggtcgaaaaaattttttttttgagttttctattttattaaagagaaaaattagaactcaataaa

SEQ ID NO: 78434 - DNA, 211 bp, Heterodera glycines
  Genomic contig location: Contig_ID=SeqID_14397; Location=1..211; Strand=-
  SCN-specific regions: Sequence locations=1-13,40-211
tgggtttttagataattcattaaaatataaaatatagttggtatcaaaaatggttatgggttttcattaaacaaaaatttgatttcgcgttcatgagttcgagtcgaccatcatcgaatccgacgaggcggtcgcatgtggtccgttggtgccgagagtaatcgaactaaatgacatggcaatgccatccaattgacccttgttgatctga

SEQ ID NO: 78435 - DNA, 292 bp, Heterodera glycines
  Genomic contig location: Contig_ID=SeqID_14398; Location=51..342; Strand=-
  SCN-specific regions: Sequence locations=1-292
atgactgaagaaggtgcaaatacgacatttacggctgctttgattagcgatggacgtgctgaaaatcagttggagcaaaagaaacccagccaattgcattccctcccattttccatggattttaatgggccggcattggtctccaaattcttccagactgaggatggcgctaatgggctcaaagcagcactgttccgaggacatttgcttttgggcaaaacggtcagagcgccggagggttttgcgttttatgcagtcaaagagagtgaacattcacaatcagaagagggag

SEQ ID NO: 78436 - DNA, 73 bp, Heterodera glycines
  Genomic contig location: Contig_ID=SeqID_14399; Location=151..223; Strand=-
  SCN-specific regions: Sequence locations=1-73
atggttcgtttcatcacggcaccgaaccttttggctagtcagcaatcgttgcctatcttgccagatcggacgg

SEQ ID NO: 78437 - DNA, 1060 bp, Heterodera glycines
  Genomic contig location: Contig_ID=SeqID_14400; Location=737..1796; Strand=+
  SCN-specific regions: Sequence locations=1-298,322-346,370-374,399 -454,477-531,569-654,676-749,782-871,911-917,946-1060
atgagttggatcgttttttcctgtccaaactgcaatggcctcaactgcatgaggcccgttaactattccaaacccttgatctgtgttcatccttccatcaaaaacctgaccgactatctccaaaaggaacccacggctacaccaaattgtacatcaacaactttgtcatttttgttgataatcatcaccgtgatgctgaccattattttgctggaccatgtaagtctgagcaaaattgatagaccaaatctccattcaaatcagtgttagggatttaataaaatttcgtaaaatattattccctttaaaagagatattttaagcatatttggcgcaattttgatattagaaaatttgaaaatcttttgaatacggtacacaaacacacatatatacaagggatgtcacagaccaagctctgtacgacggttgactgggacaggggtgctaccggactgttttttataagaaaataaggatttctaggcgccgacggagaaaaaattttggaatttgcaaagaattttgttttgaaaatttattcattttataatttatcacattttcccttttgttaccaaaccctgcccccacccttcattatgcccccccccctttcagtttcacaaaaataaataattctggtctctttaaatttagctttggtcaaaattgagccgattatgggacgactacaaattgcgtaaagaacttgtgaaacgtcgcaatcagaaacgtctgtttttggatttttcattaattatttaattcattttaattcgaattaaccaggctcgcgaaaccatcagtcgcaacagcgtccagcacaaccgttgccgttatatgttccgccagtgattacgggggtcagtttattaaaattttagaattgtttaaaaaaaatatttttccaagtgaattagaattaatttttaaaaaattccaggtcaaccgtcaggagcaagtggcactccccgcaatctctgtggcagtggttaccgatgtgccaaaaattgagcaacatgatggagacgatgatcaagaattggacctgcgttag

SEQ ID NO: 78438 - DNA, 864 bp, Heterodera glycines
  Genomic contig location: Contig_ID=SeqID_14401; Location=755..1618; Strand=-
  SCN-specific regions: Sequence locations=1-71,93-637,677-864
atgatgccaaataagggcaagcgctccatcgcaaagctttgcctaaacaatttatgtaatttatgaaaattcaattcgatttatttaaaatattttcttagggggtcgtttctctttgcgcaactttggattgtcgcaaacgcttataaccaatgacccagtcgtgctcaccgaatatctcgaaaaccgatcgctagaggtcacagcaatcgatgagctcgatgagcagcacattctcatcagctacgagaagaaaaaagaatggattgaggagcatgcatgctccaatatcggtaatagtactactactaaagatttgtaaaaatttttgactcgtaaaaaaatttttttgttaagttatttctttgtggacgacttcggctgctcgcctcctcttgctgaaggcgatgcagaaagtggtgagagcaccttcttgccaactcctttataccggtaaaaatcatatattctatgtacataaatacaattgttcagacaccgacagcattattttgacccatccggatgacaattgtccactgaagaccggcccacaccttgggcaattcacggacgaatacccaaatcatgagattttggagttttgcagcggtggcgcaaaacaagtaaattttgcttttttatttttacaaaataataaattttatgaataaatgtgttcagtacggactcaagctgcgccgcaaggatgcacctgccgacgcagatcttgagtacgtgctcaaagtgcgcggcttcactctcaactatgatgtcatcaagaaccaaggacttcgttatgagacattcaaggagcaggtgttacgatatgcagagacgggagagcggcaacaatcaacgtga

SEQ ID NO: 78439 - DNA, 678 bp, Heterodera glycines
  Genomic contig location: Contig_ID=SeqID_14402; Location=810..1487; Strand=-
  SCN-specific regions: Sequence locations=1-316,364-535,559-678
  Gene Ontology: Mol. function=ubiquitin-specific protease activity; Cellular component=nucleus; Biological process=pathogenesis
atggactcgaacaagagcttttacaacaaagcagaggacaaattggcattggccattgatgtcataactgttgatgagccaaaaatggagaaattcatttccgatcccaacaaatccaacggcacactttcaatggaaattgaaaaagtgtcggaatttgcgcgagaaatctttgagagtcaacgtaaaagcgaaactgtgcacatcaaaggatttccatggaaaatatgggcaaaaatcaaaacgaaaaatgaaagcactgacaatgagaaatggttggccattttccttttgtgcgatgctccaaaagaaggtgtaaaattactaataattaatatatatattaacaacaattaattaattgatattgagcagaaaattggagttgcaaatgttcggcaactcttcgaattgtgtcgcaaaagagcggcgtaaaggatttaaggagagaatttactaatgaagatacttttaacaataaaacgaacaactggggattctctaattttatttcaattgctgtaagtgacaattcaaataaatagtgcccaattaaattttaacataattaaggaactgatggacccaagcaaaggcttttacgaccaaagcgaggacaaagtgacattggccatcgatttcactgtgaaagaagcaaaaacggaggacgaaacataa

SEQ ID NO: 78440 - DNA, 2347 bp, Heterodera glycines
  Genomic contig location: Contig_ID=SeqID_14402; Location=1712..4058; Strand=-
  SCN-specific regions: Sequence locations=1-98,130-261,284-326,348 -494,529-570,592-642,670-674,696-1187,1209-1210,1232-1350,1372 -1607,1639-2139,2164-2232,2255-2319
  Gene Ontology: Mol. function=protein binding
atgccatcgtcaatggatcggatgaaacatttgttgagcacgggtgagcattcggatgtgcactttttggtgggggacggagacgcaaaagaggcgagtttaattaaaaataaaaatttaattttatttcaattgcaatttcattaattatccacgttttttaaaggttttgccagcacatcagcttattttgaagagcgcttccgatgtttttgaggcaatgttccgttttgacgccaaaaaagaaagaccggaaaatggtaaaaaaaaataataattttaagggaaaatgccaattatgttatttgttcttcattttgtctctgctaatttccctaattaatttttcaattagtttctggtaattgtcctgatgttgtggagatacctgacattgaagcagaagcgttcaaagtgatgttgagcttcatttacgcggacgatttaagtgatttgaatggagacaatgcaatggcagtgctttacgccggtggatttatttttaaatttttaattattttttaattagccaaaaagtacaatatccctgatttggtcgaccggtctttgcaaattccaatccctgaattgcgcaatgttttctttgcgtatgcccaagctctccttttcgacttggaggtgagaaaaacaaatttatttttaataattagggttgtaaattatatggactaaaaaacgcgaaatatggacattaaatatggactaaaaaagcccgaaatatggactaaaaaggccaaaaatggccaaatatggaccaaaatatggataaaaaatgccaaaatatatgttgtaaacccccaaaaatcccaaaaaaggtgtgcatatttaatatttgcttaaataaacctaaaaagtacaataaacaaccaaaaaatggggtttaaaacttaaaaatgcatattttgtatcaaaaacacctccaagtttgccaaatttcgaaaaaattctcattaaaaaaaaagaaatgttcgcaaaaaaatgacgaacatatttattgaaaatgccaaaatgacgacgaaaactcaaatttttcgtgttttgtggggtgtaatttttaaaaatttccaaaaagttgatctttaggggtgtatttttcgtttttttttcatttttcttgtgaaaatttccaaaaaatggccaaaatatggactaaaaacccaaaaatggcgaaatatggatttattcccgaaaacccccaaaatatggatttatatggactaaaaaccttcaccaaatcaaaaaattttaacgcagaaatgctatttttaagcccctttcttcatagcatatgcgcagaaaaaatatgttaatccatataatttacaacccttattaataatgcttttgttcgaattcgggtttgttgagctcgaaacttgtcgaaattgtgtgagattcatgctccaagtgtaagcaatttttaaggatttttccatcaaatgtttgcgttacatttgtcaaaatgcggctgacttgttcggatcagatgaatttttgcatattgaacagaaaatattgtgcaatcttctcgagagtgatcgtttgttactcaacgatgaatttgaaatttggaaaattgtaatttcaatttaattttttattttcattttttaatttcgatatttttttctatttaggcactccgttgggccgatgaaaaatgtcgtcagaatggcattgaatgctcctcgggaaatcgtcgttccgtacttggtcctgcactgttcaaaattcgttttcctaatatccatgaggaggattttgcaaaatgcgtcggtaaaatttttgaaatcgggaattaaattgaatttgttttggttgatatgaaattttacctttaatgcttgaatttcatacatggacaaggagggtcagaaatttttacataaaatttatgggaaaactggacaaagagaactgatgcctacagggtaataaattttgaaattttacagttcaatccggtgtgttaacagagaaagaagtgctcggcgtttatcagttcaattcccatccgtttctgtgtcttcgtggagtgcccgggctgtactcgttgaaattcccaagccatggacgaatttttaattggaacaaagccaagggcaaccgaagagggacacttgccttggaaattgaaaaaatgtcggaatttgcgggagagtctgtcgggagaagcagattcagtgatgccgtgtatataaatggatttccatggaaaattaaagcaaaaattacgaaaggcattgatgagaagaaatatttgggattttacttatggtgcgatgcaaaagaaggtccaattttaattactattttaaaaatataa

SEQ ID NO: 78441 - DNA, 751 bp, Heterodera glycines
  Genomic contig location: Contig_ID=SeqID_14404; Location=555..1305; Strand=-
  SCN-specific regions: Sequence locations=1-615,637-671,694-700
atgaccatgactgtacgtgatttttttaatcgtttcctaaatattcggagacttggaccaaagtgtaaaacacaaaagatttcaacattctttcacaggttcagttgcaattttttcctcctcccgaactatgtggtctaaatcacataagtaccgaaattttggtaaatttatgttagtgaccgaagaagcactagccaattgtcaaattaattaaaattctattccataattattaattcaacatttcagcaattggcattgtggcggtacagcaacggttgaagagattgcgaaaacggtgttaaatgaggagcaccggtgaacagattttgtatttaataaacggatttaaaattaaaattatgggttttcagtctttttctgtccggcacccgtcgtggccttttgacctttttgcacagccaacgccaattgttcgtcctctcaaatggcgccgtttcactgcgcttttggccctcggactatcagcgatttgagaaggaaatttggacgagaaaaactgcgcactttcaaatgccttttccaccaaaaccatccggacgggtgaagagagagagagagcgaaatttgaacagaaaatgccattcccttgttaagatgcccaattggtccggaaaagtgcccatataaacacaattgaagcaaagaaagaatgattttttgttattttacaatgttattttaatatttatttactactttattttaattatttgtaaaaaataaa

SEQ ID NO: 78442 - DNA, 995 bp, Heterodera glycines
  Genomic contig location: Contig_ID=SeqID_14405; Location=968..1962; Strand=-
  SCN-specific regions: Sequence locations=1-372,497-621,655-778,904-995
atggccaccaatttgagcaccaatcgcagtgaaaacagtccacagagggcgcgcattgattttgacgacagcggagcgaacgattcatttggcagtggaggacggagtgtcggtggacgtaaaaagcgaacatctgcacaaaacatagtggaaaaaaagcggcaaagtcgtgcggaagaaccgtcagttattcattacaacaaacacggacttggacatatgcgaacccatgtttttttaattcaagttctgaaggaatttctgggacccatgcagatagcacacatttaataataaataaaccatcataaattcaatttatttagtaaacaaattactgccgaaattgaccaaaatgatggaccaaatgttgaagagaagaaaaataaaaaaaacgatgaaaaggaagaaaaaagaagagaaacaaaggatgaggaagtaagtgagaagagcagcgacagagaggaggaagaacaggaagaggggggcggagaggtcgaactcttttcagaggatgaccgaattgacgaagttggggaagatcaagacgtcgcagagggagggacaaaggcgacactcaaagggacgggaaatgacaacggcactgtaatgcgagaccaaagtgatgatgatgaggaggaggaagagggcgaaattgtggaggaaggggcggaggatgccaatgagtggtgagtgataaatagaatagtacaaaatggacgattatattgaaacaccagtcataggtccattagaataacaaaacaacgaaactaacctccctcttttggcacttctttctccccctctttcgtttcctcttccccctccctttttctgtccttcctccactctcactgccttccccttctctcctacccttgcgctatttccacccctctcacctgaagcatgcaaacgggcgtcacaaaaacaattttctcggcccatacataagaaacaaaccttcaaattaagtaaaaataataattaaa

SEQ ID NO: 78443 - DNA, 2126 bp, Heterodera glycines
  misc_feature (6)..(7): n is a, c, g, or t
  misc_feature (16)..(17): n is a, c, g, or t
  misc_feature (23)..(23): n is a, c, g, or t
  misc_feature (25)..(26): n is a, c, g, or t
  misc_feature (29)..(29): n is a, c, g, or t
  misc_feature (32)..(32): n is a, c, g, or t
  misc_feature (35)..(37): n is a, c, g, or t
  misc_feature (43)..(44): n is a, c, g, or t
  misc_feature (48)..(48): n is a, c, g, or t
  misc_feature (50)..(54): n is a, c, g, or t
  misc_feature (80)..(80): n is a, c, g, or t
  misc_feature (84)..(84): n is a, c, g, or t
  misc_feature (87)..(87): n is a, c, g, or t
  misc_feature (93)..(93): n is a, c, g, or t
  misc_feature (98)..(98): n is a, c, g, or t
  misc_feature (108)..(108): n is a, c, g, or t
  misc_feature (131)..(131): n is a, c, g, or t
  misc_feature (149)..(149): n is a, c, g, or t
  misc_feature (152)..(154): n is a, c, g, or t
  misc_feature (164)..(165): n is a, c, g, or t
  misc_feature (172)..(174): n is a, c, g, or t
  misc_feature (193)..(193): n is a, c, g, or t
  misc_feature (195)..(199): n is a, c, g, or t
  misc_feature (203)..(207): n is a, c, g, or t
  misc_feature (209)..(209): n is a, c, g, or t
  misc_feature (223)..(224): n is a, c, g, or t
  misc_feature (227)..(227): n is a, c, g, or t
  misc_feature (234)..(234): n is a, c, g, or t
  misc_feature (243)..(244): n is a, c, g, or t
  misc_feature (246)..(246): n is a, c, g, or t
  Genomic contig location: Contig_ID=SeqID_14405; Location=183..2308; Strand=+
  SCN-specific regions: Sequence locations=1-489,511-593,615-877,1003 -1126,1160-1284,1409-1860,1882-2126
acagcnncaactcggnncaaggngnnagncancgnnngcgccnnccgncnnnnnaaacgaagcggagacacaaggcaagngcancancaaagncgganggcccgacanaccccaaaaagccaaaaaggacnaagccccgaacagggccnaannngccaaagggnngggccannnggagacaggcaccatcggncnnnnnacgnnnnngnatcaaacgaaccgnnggnccagggnctattccgnngntcgaaagttcggctgatctgtttcttcatttaggcatgtgtttatcatcagtaagcgttggctttgcttttgcttttgctcttctgctcccccccccccctccctttagacatgactttcggtgaccttctcctcacaggttcgacatggcctcagtttttctcttctcacaaaactcattcagttttttgccatcccaatgagtttttgatcagaaaacatgaatttctgcgccacgtcggcctctgttccatcattcacgtgcgtccgccaatgtgcgtccgttggactgtcatttgcgcttttccttttagttttgcaattggatcggtttggcggtctccgggctgtccctcactcttttgaatgttcgtcacattctcttcatgctttctgctgatcattaccatcccaggtggacaaactgatctacttccggtggcccttgtcttatgagagagcgatgtccaaacggagagcgatttgcttatgcggcggagtttggatcgtttctctggggtttttggattttttagaagtttaattattatttttacttaatttgaaggtttgtttcttatgtatgggccgagaaaattgtttttgtgacgcccgtttgcatgcttcaggtgagaggggtggaaatagcgcaagggtaggagagaaggggaaggcagtgagagtggaggaaggacagaaaaagggagggggaagaggaaacgaaagagggggagaaagaagtgccaaaagagggaggttagtttcgttgttttgttattctaatggacctatgactggtgtttcaatataatcgtccattttgtactattctatttatcactcaccactcattggcatcctccgccccttcctccacaatttcgccctcttcctcctcctcatcatcatcactttggtctcgcattacagtgccgttgtcatttcccgtccctttgagtgtcgcctttgtccctccctctgcgacgtcttgatcttccccaacttcgtcaattcggtcatcctctgaaaagagttcgacctctccgcccccctcttcctgttcttcctcctctctgtcgctgctcttctcacttacttcctcatcctttgtttctcttcttttttcttccttttcatcgttttttttatttttcttctcttcaacatttggtccatcattttggtcaatttcggcagtaatttgtttactaaataaattgaatttatgatggtttatttattattaaatgtgtgctatctgcatgggtcccagaaattccttcagaacttgaattaaaaaaacatgggttcgcatatgtccaagtccgtgtttgttgtaatgaataactgacggttcttccgcacgactttgccgctttttttccactatgttttgtgcagatgttcgctttttacgtccaccgacactccgtcctccactgccaaatgaatcgttcgctccgctgtcgtcaaaatcaatgcgcgccctctgtggactgttttcactgcgattggtgctcaaattggtggccataggatcaactggcggcgaattcgaggtaaaagcaacagtcgaagtctgaacaagtgggggggggggggggaagggagagcaaactcttgacaatttgagacgggaaacctttgtaggtccagcagatgcttccaatttggagggtcggtcgaacgcaggggtggcggaacgggaacgcgaacgggaggatcgtcgctccatctctatctgtttgtgagtgaaaacggaccattttgcatcattcaaattcaaacctcttcaagagcattcgcattgaattccgcttccgctccacgcaatcgcctcgagcgacgagctgatgatggtgtctcgtcctcggccccac

SEQ ID NO: 78444 - DNA, 132 bp, Heterodera glycines
  Genomic contig location: Contig_ID=SeqID_14407; Location=299..430; Strand=-
  SCN-specific regions: Sequence locations=1-132
gcgcccgtttctaaatttgtttggctattaaggcagcttcgagacctcagacgggcgcttcgcgcccgtttctaaatttgttgggctattaaggccgcttcgcggcctcagacgggagcttcgcgcccgttt

SEQ ID NO: 78445 - DNA, 242 bp, Heterodera glycines
  Genomic contig location: Contig_ID=SeqID_14407; Location=300..541; Strand=+
  SCN-specific regions: Sequence locations=1-242
aacgggcgcgaagctcccgtctgaggccgcgaagcggccttaatagcccaacaaatttagaaacgggcgcgaagcgcccgtctgaggtctcgaagctgccttaatagccaaacaaatttagaaacgggcgcgaagcgcccgtataagcccaacaaaatttaaaaaacgggcgcgaagcgcccgttcgaggccgcgaagcggccgaaaagcacaacaaaaattagaaacgggcgcaaagcgcc

SEQ ID NO: 78446 - DNA, 605 bp, Heterodera glycines
  Genomic contig location: Contig_ID=SeqID_14408; Location=1538..2142; Strand=-
  SCN-specific regions: Sequence locations=1-56,79-468,590-605
atgcaagtacaatcagcaaaaaacattcgtggcattgcgccggtggaaatgctgctcaaagcttttgagttggagttgggtgttgtgccagacaaagcattccagcacgagcttcgcttcgtggctgagtaccaaaagggccaatcgaaactgcaggaattggcccgtgtgcctcgcaatgagtgagtgactcattagcgtagtgccaatctcggacagcaaaaattgtgccgagactacaccccaattttccagcgagagcaaggagaagcagacgcgtcacgagttgcattgggcgctggtgcttatttttctggcagaaaatgccgaatttttggacaaaaagagccaaacgttcttgtacgacaacagccagttgctactgtattcatcgcgtcaaatgatgctgaacggagagacgagcgaatttgtcatcactatggagaaatttgtaatatggtcccctttgagagagataaacggagagagagaaaagaggagagatagagagagacaaaaggagagatagagagagagtgagagagataaaagaagggaaatagaaaagaggagagagagaaagaaagaggacagatagaaataaa

SEQ ID NO: 78447 - DNA, 829 bp, Heterodera glycines
  Genomic contig location: Contig_ID=SeqID_14409; Location=781..1609; Strand=-
  SCN-specific regions: Sequence locations=1-174,204-237,355-395,419 -446,468-799,821-829
atgattcatttgcataatgcaaatttgcatcaattgaagatggattgtggtcttccatcagttggcgagggagaagggcaaaccaaatttggaatacttactgcttttttggtgggttttatttcaaaatttggaaatgcgagtataggaggtgattattttatgaaacattgttttaagaaaaatacatttgaaaaaatttggagtttgtatggagtaaaaaatttcaatgttttcttatttaaaaaactaaagaaattatgaaaatttaaaaaaattttataaaatttctgaatttttcaaaaaattattttttaaattttaataaaaattaatttaagaaaaaattattttgcttatatttcaattgttttaaagttttttcaaaaggacaattttaaaccaaaatttttgtcaagaaaaaataattaatttttgagaataagattttgtgaaaacttttttcaattcttgggggtctattttctgaaaattttcacgccgatttttaggggtgtatttttcatttttcttgcgtttttgttaaggatttttccgaaagtgctgaaaaagacgccaagaatggcgaaataggcataaaaataagcattaagcacaaaaagttcaaaatagacaaagttaggcattataaaagtcatcgtagacaccccaaaccaagcggaaaaggcgttttttgtgcttatctttgcgtattaagtgcgcagaaattttaggcatttgcctaaaaatggaagccataatgatgagatttgacataaatttgttataattataattatgtctaaaatcaaaaacattcacaaataaa

SEQ ID NO: 78448 - DNA, 295 bp, Heterodera glycines
  Genomic contig location: Contig_ID=SeqID_14410; Location=929..1223; Strand=+
  SCN-specific regions: Sequence locations=1-295
aaaattattcatttacttcggatgagcgtgccatgcaaaataattttgtggccaatcttcatcaaaatggcatttcgtttttggcagattatgccgcactttggctgctcgggttggacatgcttcaaatgtataacaaacacgaacagcagattaagttgttcattagtcgaagttgcagctgcaccatggaagcatgggtaattattaattaattaaacggggataattaattcattataatacctctaaaaattgacttatttaaatcaaaaataatcatatgataaaaaaa

SEQ ID NO: 78449 - DNA, 1010 bp, Heterodera glycines
  Genomic contig location: Contig_ID=SeqID_14411; Location=535..1544; Strand=+
  SCN-specific regions: Sequence locations=1-42,64-379,401-457,479 -554,576-636,658-1010
gtgcaaggacaaatgttgcttcttggagatcctcaagtgaacgaaaatgatgataaaataaaattcactcaagaagaggtagatctaatattatatccatccctaatggaataattaaaaaaaacatttaatttaggcgcccgaaatacgtttcgattggtgggctttgccgaagggaagtgcgccgttggactgtgctcgtctgtttgccaaagataaaaaatacattggcaaaatggtaagacgacgcatttgtcgtgaggaagatcctactgaaaatgacttggatatgtcctgcacggctattcaaagcagaaaccgattttggcacggtgccaaggatgaccaacaaggggagcagaatgagaaggagcatgccaattacccaatggcacaaattcgaacagtgtacaaggcaagaaatggggaaattgggattaatattggatgtgaatattcaaatggcctgaaacccattcggccattggtttgaaaagaattcaattttctatgggtataaatggagcaaaggtcaacttgggtcccacatttccatgcttattctttggatttttgaactattatctcttttgtctcaaattattaggtcaattttggtcccggcatatgaacgacttttaactctttttcatgtgttatgtttgtgaaacaggctcacttggaaacccaaaaaaaaaaatttaagatttccaaattacgattatttactcttcccttttccattctcttcccaggactatgtggtggttgagttggaattcgccgccactttttccccgctcaattggtactgtttcgtcgtcgatgccgcgtcccccgcgctgtttaagcgccgcgtgcgcgcgttggccaaatgctttccgaatgtaattatgggagacgagcgcccgatgaaaagtgacggggagggcatgatggaggcggtgttggactgttttgagcgattggacacgccaaaacgcaaatgggaatatgtcactctgttgcaa

SEQ ID NO: 78450 - DNA, 858 bp, Heterodera glycines
  Genomic contig location: Contig_ID=SeqID_14412; Location=759..1616; Strand=-
  SCN-specific regions: Sequence locations=1-229,251-509,532-795,823-858
ctgaatttaagccctattaattcgctttaatattaaaaatggacgccaccaaatggcacacttttgtcaaccaagtggccggtgaatttcccattttctgtaattaccgaattcgccttcacggcaatgttaagccacgggcccaatcacaaaggcggcgatttgtggccaagacggaaatatttgggccaaatctgacaatttcaatgtgatttccccgccccttccctttcaatatcttttgttttttcttagttggatccaatggaagcgaatgtggcagtgagcgcctttagaaatgtacaatcattggccattggcccaattaattactttttttagcccggcgttttggcaaaccgtggcttagcctgcgaaggagtgacgtgcgtaataacataattttaattacttatgcccactctttgcttaggtatccaattacgcagcccccgtccacgaccaacaacacttgcctcagcggttcgatccaactcactaattgccataattagacaaatgttcaggagagattgacggacagcacggcgttacgattgcaagaacgaacagagctcatcaccacttcccgttgtttcgttaattaaaaatgaaagtgttcagcatttctcgtcggagtgaccgaagggacggacacggacgtcggccgagtggaaacggtttcattggcccagcaattggccactcagtacggctggtgaacaacgcattgatgcggatgaatacaattgttctacactgatgagcatgggctataattgttctgacactgcaattatttgtgtcatttctattttctatgaaaattaattggataaatgcaatttattcgctaaa

SEQ ID NO: 78451 - DNA, 1635 bp, Heterodera glycines
  Genomic contig location: Contig_ID=SeqID_14413; Location=233..1867; Strand=-
  SCN-specific regions: Sequence locations=1-76,102-235,259-326,368 -485,521-705,735-1299,1322-1470,1499-1635
atgtactgtgccgtcagttactgtaagtttccgccataatgtgagaaagaaggctttcatttatccaatttgattcattattttaatttaatttaaattttgtttagtcaaaccaaacagtgtgatgggcgaagatggcttctcaatggaagtgaaataattcgctaaatttgcatttttttaattgttttcttttctccgctgaaggaatcgtaccgcacggtgaccaaacacgggccaatcgaaaccttcaaaagggacctgaacaaagttggcactggcaaattttggatgtacacggaggaatatttctacccaaggcaatgtaataaaattcaattgtttttttaattaattaatatttttagtaaataccattctttttagtttatattatcaaagttgggccttccttcgacaacgaaacatcggtggaagaagcaaacattcagtatatggtggtcacaggtcgggcacagccttcataattaactaactaattaaccaatcaattaattaactgtttctattttcagatgctgggaaattgtctttgactgtttacgcgagggacccaatgcttttctttcaggtcaaaatgaaaaaagggagaaacaaacacagaattcgaattcacaaatgattccagaaatataacaaagaatgtgtggactttttaaaaggtaattaatcgttttaatttcctttttaatttattttaattaattaaatttgaaattgtttagagcaaggctttggcgggaaactcttttggaattcgccgaaaccaatttaccagggcaacgactgcgaatggccctcggagaaagaagtgtttgcacgaaggcaagcaatcatcaaaatcaatcacgaaattgaaattgaaatccagggtactcaaaaactacgagcaaaacaaaaaggcacaaatggcaacggctgccaatgccaccgaatcgccggcacaaacatttgcggaaatggtcaaaaacccatcgatggcactgcaaaaattgatgcaaaattaccagtgaaaagcacatttattatgtacatataatttgaaaaaagataaataatatgatttatccgaacgattcatttggatgcgatgtccgccaaggaaaaatcgacgattcgaaaaatacaaaatagatttgagaccttggaactttgtcggacgttgagcaccgtagcagcgatgttaaaaaatcgaaattttaatgtgtaaattttttatgaaatgacaattaaatgttgattttgagtgttcatttcgactttggttgacttcgactgtaaaatttaaaaaacaaatttttgatgagcaaaaggtgaaaatttttttccttaccaagtattttaaattataattatggttaggctcagttttatatgctcgagaatatcggccaaaaaagttttttttgtcggaattaagcattgaatcgaaaaaaccagtaaaaatttaatgttggaatttaaattttatgaatttaggcgatataacatttaatgcccaaaattgtggtttaagctaaaacttcaaattttatattttccctgctaatttttgctgagcggacgaatcgtcagccggaagaattgtggtcgaaaaaatcgtacaaaaataaa

SEQ ID NO: 78452 - DNA, 1592 bp, Heterodera glycines
  Genomic contig location: Contig_ID=SeqID_14414; Location=889..2480; Strand=-
  SCN-specific regions: Sequence locations=1-159,181-1074,1096 -1199,1221-1360,1389-1412,1435-1456,1485-1516,1538-1551,1576-1592
  Gene Ontology: Mol. function=heat shock protein activity; Cellular component=endoplasmic reticulum; Biological process=response to stress
atgccgacttcatcttcaccaacaaatttgcttccattgctttacggttcgtatgagaggctcaaaaaacatgcctgcgacattgacaaacgattgctttattcacttcgccgtctcgacaattttacgcggctcaactttttggtggaagtcgaatggaaaggaaaaacaaaaatgcaggaagggaaagaagaggatgcatacatcctgtacagccgagccatggccatttatcttatgataagtgagtcaattgacaacgaattcaaacgaagccgcggtggttatcttttttatgatgtttcacagcgtatatgtgcggattttgacaaagttgctgcgagtttgcaacagcggtttatggagggacaaggcgatgagcctgaattttgtgatccggtgggactgcgttgggccgaaatcgttgaaaacccgatttccaaaaatttggactgtaataaggtctccaattcgtcggatgaccaggacaaaattcggtccctttcgcctgcaaacgcaacagaacttgtggcaaccgaaaaatttttaaccaaaattaaggcggacaaagaaaaccacattttgcacataaaggacaagacggacaggggcattgggatgatgaaacatgccgtgaccaataacctggccaccgttagacagtcaggcaccagcgagttcatctccaaattgttcgactcgtccatctcatcaaagcagaatcaggatttagttactcaatctctgcacctcaatgaggaagcacgcaactttttggagctggataagctgaaaaagtctgaaaaaaaaattggcagcagtgagacggacaataaaaatggcctaatgagaatttggcgattagaaaagttcagcgtgaaaaatggacgaatcttattgtcagtggagagtgcaaagtggctcaaaacgtggatcttcatcaaaattcccgataaaattcttttggacaaacacattaaaatttttcgaggacacaaatgcccacatttttaaaagccgtcacgacactagctgaaaaccttgaaccccaccattcggatgccgaattcgccgttatttttacttaaagacgaggggaccgtctttcttagaggccggggatgtagtattagtgactctttgaccctttatttgattgtttgaatttgtttggcataatgtttatttgaattcgacccaaatattttggttttcttcaagagtagttagtggatttttttggttatcgtcggtgataatttttagccgttttgttggtcgtcgatttatttgtgtttttattaatttgttgttgattgaattttatttattttggattgtcttttaattatttgttgcataaatttattttgtttggtattggatttttaaagcaggttttggccaattcatagactatttgtgcaaaatttagaagtgtggcaaagaaacccccgacaaattgcttcttcttttccaacaaaatgttaaaaccaaaatatgaatagccttagagaaaaataatttctaaattataaaatagctttaaaattatttctaatttgctattataattaaggcaacataataaa

SEQ ID NO: 78453 - DNA, 1600 bp, Heterodera glycines
  Genomic contig location: Contig_ID=SeqID_14415; Location=140..1739; Strand=+
  SCN-specific regions: Sequence locations=1-93,115-325,362-730,752 -1136,1158-1190,1212-1563,1585-1600
atgaggaccacaattctttaccattgtcgatatctttcatttcattgcttaggacttaatgatttgatgggagcgcacgtcgaatggaaacgcgaaatggaaatggaaatgatgcagcgaagccaaaacgccaaattggcggccgtccgaaatttgcacgactttcttttaaatgggccaaaggagccgaggtttgagttaagcaattcgaaattcgcacaaaatgattgttggcatttcatttgtctcttttagcacttcgtttcggcaccctttcattgtcagtgccgaggcccgtgccgaatgtgaccaaattttgagtcattttgagaagagaatggaggaagaaataaaaaagacaaacactttgttaagttcgaccagcaaatccaaagaaagtacgaacgaaatcgttttatattttaatcatttttaattcattttaggtccacaaaagaccaaaaacgagttggacgcattcaaaaagctttacttgcaaattttgtttcgcctttttcgagaattgtatcggcaaagtgccgaaaaagtgaccaaaagtgggcagaaaggcatacggaggcaaagggcggagaaggcgcagctgaaaacgatgaacgaaggtgggcaaattgggggcgggaaacccaacacaacctcaaaatggcaaaatttccgatccgtaaaatggttccgattgaccaatattgtcccgattcgtccaacccatttctttccctttcctttcgcagcctttgacattgtgccggaaatttcggaattgaaacggcactgttttttgggcgccctttggctttgcgacggacaatcggttcgctttttcgactatttgaacacagaaattggctgctcttctttggatggaccgcacatcaattacatttgtcacattgccatcgcagccaaagaagtgaccgggggaagcgaattttgagactattctcgtcctttttgaaccttaattttcgagaagtgttgacatttcccctttatttagtcggcaattttggagccgctcattgaattgaccacttttttgccctccaattatttacacctcgccaaaatactcaattcgttggcattgatttatggtggtcattccgtaaaaagaattcaaaaacaaattcaaacattttacttgttaaagggaaggcccaagattttgataagttggagaaattgtggaggaaaatggacaatatgaaacggaatgtgccatacgaggaacagagcagccgaatgaaggttaaaattggcattgttacattttgccaaaaaagcgattttagctggttttggcaaggattgagcatttctatcggacggcaaacagaaaagtgccgggaactcttctggcggcgctgaagcgattgagcggtcagccgtactttatcagtgcacacgcgaaaaagagagaacggatgaacgacacgaaaggacacagcgacgagagaatgaacgaaaattgacgaaaagagcatccatcttttgtcgaaaggacacatttcattaaataaaccgcttcaatttgagcgattttacatatttttatttatattttcagaatttgaaacgagta

SEQ ID NO: 78454 - DNA, 446 bp, Heterodera glycines
  Genomic contig location: Contig_ID=SeqID_14416; Location=410..855; Strand=-
  SCN-specific regions: Sequence locations=1-160,187-241,263-446
tttaaatactccactaatattgactattctctcggctcattgggacacgaggaaatctcgtgcaattacattgatctttcttacgtatgtcaactttcgtttgtcaaaaccttcttttcttcagattcgggttaatagtccggagcttgtctctgagttcgacggaaaaataagcatttttgtggacgcggtcgatcgaactgtcagcgacggttatttcttgactggttctgcctcaatatccgccgcttgtgcagctccatcccaaagagagggacggatttacggaattggtcagtaaaacgaatattttactaataattggctaaatcgtgtttcgtttgaagatcgttgggaaacacttttccctgtgcaaattaaattggagttttaccagcgaaggaagcgacagtggctgattccggaggacacagccccgtgggaag

SEQ ID NO: 78455 - DNA, 1948 bp, Heterodera glycines
  Genomic contig location: Contig_ID=SeqID_14419; Location=1116..3063; Strand=+
  SCN-specific regions: Sequence locations=1-811,833-1948
  Gene Ontology: Mol. function=ATP dependent RNA helicase activity; Cellular component=intracellular; Biological process=negative regulation of cell cycle
atgccggtgccgagcattgaggagctcaccgaattgtgcaaaatctgggagattgatttggcggtgggttgcaaagtcaatccggcagccaaggcaaagccttgtgcgcatgggtatgtgctaagcatcgaaaaaaggtcattatgtgtaggatacgaaatcgatgctaaagtgattttttcctaccaggaagcgaaggatcaggacgcgcaggaggaatttgatcaaatgcgctgcggtgagctcgacggatgcgttgaactcatcccgcagacgtccgtcagggccctgcaggaacggatgttcacgctgcggtccaatgactgctcgaaagtggcgaaggacgaggcaaaggtgggccgaatcatgtcgattttattgggccgaccggtaaaaccggaaagcccaaaggccaataacccattaatgacttttggggctctttcaaaattgaaagagggacagatcgacacagcgctgtgcatgctcgacgaggtgccgcgccttgtcttccaacaggccgggcccggcaccggcaagacgttcagcgcggcgtcgatcgtggccacggtcctggccacggatcccacggctcgtgtgttggcgctggccccgccgaatgtcgccgtcgtcaagctggtgctggagatgcaggatgccctggccgccggaaaccacgtggagccaatgcttgccttgttctccgggacaggtaagttgagatatgccaaggaagttgagcggatttccccccacctgctcgccaccgcggtggaggcacaggactttcaggaactcctacagaaggaccaagaacgcgtcaaggtggagcggtacctggacgcctgcgagcggaacccacgcctggcccaggaaatggcagtggcgaaaattgtgcaggagcacaaaaatcgccgcttgtgcttcgccaccttgtccttctgtgagcaacttccggcactgtttggggagacaacgcatttgatcatcgacgaagctggacaggcgccatacgtccaaatcctcaacttggtaagccaactcccctgcctaaccaaggtactgatcaccggcgatcgccgccaactgcgtgtccatttgccctccctgccgatcgcaatccgtgaggacttcggcatggacatggtcatccagaacctggatgtggcgcgagggacggacgtcacaacattgtcggtctgttttcgctcgcattctgctctcgtccgctgcacggaggccggcttttacaaaccgcacggcgagctgctgactcctggacgcgacgactcggagcgggcactcatgaccgaccaaacggccttcaaattgccgaaaaagggagtccctctaattttggtccaccagagcacgcctgcgcaacgcgacgaagtgtccacctcttcggccaatcctggccaaaccgacacagcgatgagagccctctggcgtttggcgcgggccttccccggcacactcatccgctgcatttgcttctacgccgcccaagccctggagattgaacggttggtggcccaacaagaaatcccggacattttagtgacaacagcggacgcgacacagggccacgagtcgtcacttgccgtcgtcgtcacaacatgctccgtcttcgacggtggagccgactctcagcctttctgggctgatgccgcacgggtggacgtcgccatctcccgcgccagccatggaatgatcatcatcggcgatttgctgctgctcaaccggacggagacgtggcggcgctacctggaccaagcgacgactgagacaacagtggtcggtccggagtacttcgacttcgagcagttcaagaaccccgacaactactacgacaaggacggacagctgatctcagccaacggcggtgcggtacggtcagagcatttctacagcaagtacggtaaaaatgtgtggtacaacaactccg

SEQ ID NO: 78456 - DNA, 1023 bp, Heterodera glycines
  Genomic contig location: Contig_ID=SeqID_14420; Location=49..1071; Strand=-
  SCN-specific regions: Sequence locations=1-904,927-1023
atgtctgaaccgattgattatctttctaccgattttcattataatggaaaggcaatattctctgcaagttcgtcaaaattctcgctttctatgaccgcattttctaaaatttagaacagcttggagtgttctcttatgattcaaaaaaagggcacttggaaatgggatgtgccaatctgaagtatgtgtacgaaggtttcatgaatcggaagctcaacattgaccttactcaagggatacacaagcaaatagagaagtggcgttcagaaagtgattaggttgtcatcttccaattgagcaattaaaattaaggcctcgacaaagttttcgattggttgctcaattcctacgacgagggcagctctctcgaggaggtcaaatgcttggaatttcaaaacaatttcctggttttaatgcaggctttaaatggctgtgaattcgtcagtcgcagaggcccaatgagtcgcattgccatttctccatatatttggcaatcgctgaacgacaaaagtcagaagttggcctgcgttaaatataacggtgagtgattgtccattgtatcgtttattctttccttttcagatgttattttcatcagagaattcactcgtccggacggggaagacgacaaaagcaattggaacactttcgtgcaaaaagcgtccttcgccggacgaaagttcgagcaattaatcacaatggacgaacccgagggaggcgagcccgacacaacggcacctgtggatccgaaccccgagctcgacggaatattcaaaggtctattgcaggcattccttgtgttgctatttgccccccccccccaaattcagccaatctcattgtcgagggtcgttcgttgaacattttttacggctgcgaattcgacgcactgagagcatcagacggaaagttcattgagctgaaaacacagctcaaattcgtcggtttcggcaagtacttctctttcaaaggtgccttttcacatttggcattgcttttgactcttttcattttcagcactta

SEQ ID NO: 78457 - DNA, 1657 bp, Heterodera glycines
  Genomic contig location: Contig_ID=SeqID_14421; Location=91..1747; Strand=+
  SCN-specific regions: Sequence locations=1-1097,1120-1231,1253 -1295,1319-1424,1446-1657
atggcgattgtgcacagccctccgtctctacgcaagcgcttttgtgaggtataaaatttctcaaaaaaagagatagacatttttctgggatagagtataaatgtaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaactaaaatggcgattgtgcacagccctccgtctcatacgcaagcgcttttgtgaggtataaaatttctcaaaaaaagagatagacatttttctgggatagagtataaatttaaaaattccctcaaaaataaaaggtctattgcgctccgccctccctatcatgctcgagagcatttgtatgtgtataaaatttatcaaaaaaagagatatcccaaaagtcgggtagcctttcatggatccagattcagggcattttctgaacatggatttttgcccaggaaatttcagatccaggtcatgaaaaaaaattacagattgccaattttaaaaataacataatacagattgcaattttaaaaataacataaagacattcagagttcactatgggtcaagcccagtgttagacaaaattgctcataacgccaaatagcgcatttggcgtaaatttttgcgcgctatttcaaaatttcactggaaaatgccttttttgtattttttattttgatctgccataattcgcttcattcccaactaaactgaacaaatttggtatctaaaaaaagtttttgaaaagtagaatctttttctaagcgaacgttaagtaatttgacatctcagaaaaaagttgttggagtttcaaatttttatcacgttataactcaagtcctaggccgccgtttctaacaaaaatgctaaaactattaatttctctattgattctaaatgtccaaagtgattttgtatccttataaccaaaattgttagcatttacgaatttgatgttttttgtgtgttagagatgtgaaaatagtacgccagcacgagaggaaaagaaatgcaaaaattttaatcactccataactttttagttaaccctttttttgcccttaaaaacccttacattttgttccaaatttttttctctatcggtattcaaaatttggtgcaacttgtatgcatagaaaaaaagttatatggagagaagtaaatgttgatttttacataattaaaatgaagagatagtacgccaaagtgagagaaattacaaagaaaaagagaaacgacgagatagtactaggcttttctctgcacagtggagttgacccatagtgagagttcggagtcgatcgaagtgggaatcggtcactttatgtcagatgccattctacaaatatcatggccaagtccaagaagcataactactacaatcatgaaatgaagagtgcattaatcacttaaacaccgtaaaactacttaatcggtattcattttagattatgaaaagtgatttatattcacaaattgatagaaaatttgaagaatcttctacttcgaatgaagggtcagataatgagctcgtagctgatgataatgcttctcttaattctatgtaatctaactcaattaa

SEQ ID NO: 78458 - DNA, 208 bp, Heterodera glycines
  Genomic contig location: Contig_ID=SeqID_14421; Location=2718..2925; Strand=-
  SCN-specific regions: Sequence locations=1-208
atgtcaaacttttcattgctttcgactgaaacgttggacagtcgtcgctgccgacgaacagccgcggacgaagacgccgaaacggaattggcaaaggattcattgtcagaagggaaagcgacatcgaggtttggcttaaaaaattgaaaaaaatacaaataatttgactagaattagtgtggcaaagttcgtaatttttttcagttaa

SEQ ID NO: 78459 - DNA, 1526 bp, Heterodera glycines
  misc_feature (1515)..(1515): n is a, c, g, or t
  misc_feature (1518)..(1518): n is a, c, g, or t
  Genomic contig location: Contig_ID=SeqID_2198; Location=1137..2662; Strand=+
  SCN-specific regions: Sequence locations=1-16,38-71,104-114,136 -232,271-393,415-463,485-609,652-674,722-842,864-878,901-1102,1124 -1162,1212-1214,1236-1526
  Gene Ontology: Mol. function=monooxygenase activity; Cellular component=microsome; Biological process=gametogenesis
atgaccaaaaaacgctgtgccattgtgggagcagcagtaagtgggctgccatcagctcggtaaaacctttgaatatttaaaataaaaataaaaattaattattcaaaaaaggtgggcattggcttatgactttgagccggtgatttttgaacgccttgacaaaattggaggcctttggcgctataagcctgagcaattcaacccagaatgtaagcatactaaataaaaaagcttaaataaatttattaaaaaattattttatataaaaaagcaacaaatcttttaagtggcgagtgtaatgaaatcgaccgtaattgacacgtcaaaggaaatgaatgcgtattcggacttcccgccgcccgaacacttcgccaattatatgcataatgtacctaattattagtagggctgctaattttatgtaaatacatttttttcctggattctccatagcctaattagtaggaaaaacactttcttttttgtgtttgcgaacaaaagttggttatttacatattttcgggttttatatgtacatatttttatacatatttcacaatttttgtacatattttcattttttttttacatattttgaggatttttgagaatttatagaaattttttgtaaaaaatttaaaaaaattttttgaaaatgtatccctaagaaatcgaatttttttttcaaaaaatgatttatcaaaaattaattttttaaatactagcatgtgattctaagcctattttggtcattttatgcctaggtatttcactttttacgaagaattttttttcacaaaaaataaccattaaaaatttttatttacatattttagtacatatttgggggtttttgtatatttcatacattttttagcatttttatatatattttatttacataattcgcaaattttcttacataaaattagcagccctaattattagtttattagagagctaattttgagcgtatttggacaaaaaccgggtccgggtattaaccggtattgaaaaaccgggttcgggtccgggccatgaatttttatgccttttttggcgttttgtgcctttactggtcctttgcggaatttgcagaaaattctttaataaaaattcaattaaaatgaaaaaggcaccccttttaattatttgaaatcccaattaaaaaaaattttaattttttttttgttttttttattaaaatatttgtcaaaaagtgttaatttttccaaatctctttcctttactaagacacaaatgctcgcttatttggagctctacaccgaacatcatgggctttaccaatatatacggtaggcacaataataatacggtagacacttaccaatgtcaattgaataagcaatttattagatagtaatttagtcaaatattgttatttcctttgtatatccctcaatgtttggcaattattcccccacagtttccacaacaccgttctcgccatacgccgggcggacgattattcccgaaaaatgggcgttgacctgnccnaggcatgc

SEQ ID NO: 78460 - DNA, 1425 bp, Heterodera glycines
  Genomic contig location: Contig_ID=SeqID_2199; Location=1..1425; Strand=+
  SCN-specific regions: Sequence locations=1-54,76-911,933-1425
  Gene Ontology: Mol. function=monooxygenase activity; Cellular component=integral to membrane; Biological process=gametogenesis
aaagattgtcaaatttgaggaccaaatcaaattcgaaggagacattattcactcccatgacttcaaaaatagcaaggaatatgaggtgtgagaatggcacggagagaatgatgtcattttaaagaagctcaagcgaataatttttttgaaaataggacaaagtgaacgttgtcgtcggggcgggtaattcggcgatggatttgaacgtggaattgggtcgagttggcaaaaagtgttatttgtccactcgtcgggggcgcatggattggcaaaagagttggcgaaggcggaatcccaggttaaatggacaaaaaaaacaaaaaaaaaacatttacatgccgcagaggactgtctgttcaacacacgattcaaagtttgtgtgctcaaccgcattttgccccaggccttcactaattggctgttcatccgccagtgccaaaagcgctttgaccatgcaaaatatggcattatgccaagccacggattcttcaggtcttgcggggccacacaatctcggaaaatttgaatcaattaaaaatgctttcgaattttatcacttcagccaacatttgaccgtcagtgatgatttgccttgccgaattatcacaggttcggtgcaggtcaagccggacattcgcgagttcacctctcatggcattgtgtgggcggacggcactgtcaccgatgacattgacaaaattgtgatggccaccggctatctgttcaactttgacctggtggagaacggacaattgatcccggtaaaagacaacacagtttggctctacaagaacatgttggcaccgcaattggccgattggaacactttggccattgtcggactcgcacaggcactttctccaatggcaatgaaccgcttggatttccaagttcctattagccttccggtgccattcatcccgttgccgaaatgcaagcgcgactgttctttgccgctctgtgcggcgatgccaaattaccaacgcgtgaagggatggagcacgacattgacagggcacaagctgaattggcaaaagcatttgtgaaaagcactcgacacaccatcgaagtgggggagggtggtgcctttcgctgtttattaaactacacaggtcaattacattttgttcatggacgagttggccgagctgatcggctgtcagccgaatcccgtggactttgccttttcaaagccccgtctcgcccatgcccttctctttggcccaaatgtgtcctatatgtaccgattgcgcggcccaaaagcatgggacggtgctgaggaagtgggttgaatacagtaccaaacacacacctcgttacagtaccagttccagcagcataattctgcactttttctctcaggcaattcttgacatcccacggcgcatggacatgtgtttgtcgggaagaaaagtgaaggaagcg

SEQ ID NO: 78461 - DNA, 645 bp, Heterodera glycines
  Genomic contig location: Contig_ID=SeqID_2199; Location=1096..1740; Strand=-
  SCN-specific regions: Sequence locations=1-74,98-113,135-313,336-645
atgcaaaattcaaaaaaaaacaaaaaacaaattaacactaattgtaagtttttttttgctaaattttcaattccttattttttcagttttaaaaaatgcgacttgaaagactgttaaattatgaattttatcattgttatcccatagtaaatgtgcaatgaaaaaggagtgattgacagttcgaacgatgggccgaatgaatgaattgttgtgaattgtgcattaaatgagtgctctcagcaaatacactccgatcaccattatggcgacaatcagtgccaaaacggaacgaatttcggcccattccgttgtcggcgcttccttcacttttcttcccgacaaacacatgtccatgcgccgtgggatgtcaagaattgcctgagagaaaaagtgcagaattatgctgctggaactggtactgtaacgaggtgtgtgtttggtactgtattcaacccacttcctcagcaccgtcccatgcttttgggccgcgcaatcggtacatataggacacatttgggccaaagagaagggcatgggcgagacggggctttgaaaaggcaaagtccacgggattcggctgacagccgatcagctcggccaactcgtccatgaacaaaatgtaattgacctgtgtagtttaataaa

SEQ ID NO: 78462 - DNA, 363 bp, Heterodera glycines
  Genomic contig location: Contig_ID=SeqID_2200; Location=1570..1932; Strand=+
  SCN-specific regions: Sequence locations=1-363
  Gene Ontology: Mol. function=alpha,alpha-trehalase activity; Cellular component=extrinsic to plasma membrane, GPI-anchored; Biological process=trehalose catabolism
atgcttttccagaacgactcgaaacattttgttgacagaccactgaaaaaggaggccaagaaaattgtcgaagagttcacatcgacctttggcggcaacgaattggacgtgagcaaaatgaacgaacaacaagtggaccaattggccaaattcgtccgtgaaaatttcggcagagccaacggagtgctaatagcgtaaaaattgatggaaaatggcaatcaattaaaaaaataattaagttatacgcccgaagattgggtggaaagcccaccgaaacttgaacggataaaagacgcggagttcaaaaaatgggcaaagcaattgaacgaactgtggaaggagctgagtcggaaaatgccagat

SEQ ID NO: 78463 - DNA, 1098 bp, Heterodera glycines; identical to SEQ ID NO: 2201
  Genomic contig location: Contig_ID=SeqID_2201; Location=1..1098; Strand=+
  SCN-specific regions: Sequence locations=1-1098
  Gene Ontology: Mol. function=alpha,alpha-trehalase activity; Cellular component=extrinsic to plasma membrane, GPI-anchored; Biological process=trehalose catabolism

SEQ ID NO: 78464 - DNA, 1330 bp, Heterodera glycines
  Genomic contig location: Contig_ID=SeqID_2202; Location=127..1456; Strand=+
  SCN-specific regions: Sequence locations=1-586,614-815,837-1135,1178 -1330
atggtgaagaacatgtgcttgaactttgcggagatggtcaaccgtttcggttttgtgcccaacggcggacgcatttattacgacaaacgctcacagccgtctttcttcacattgtctgacaaacaaaccgttgctaattgcatttcctaattattacttccccactttagcatggtctacgattatttcttggccacaaatgacaccaaatttctccactaagtgttgccagtgcttgaaaaggtcagtgcaataacttatcaacgccataattacttcctgataagccaaatccaaattttcattaaggaacttggccattggagcaaaaatcggtcggttgaagtcgaagtgggcggaaagaagcagacattttaccaatacagagcggacagcaatgtttaaacagaaagaaattgagtcaaactgaagcccattttcagattccccgtcccgagtcattttgtcaagacgttcaactcgtcacgaacatttcgaacacacaaaggaaagccgacatttggaaaaacgtggcatcgacggccgagtcgggctgggactttagctgtgagctttaattgcaattttagctaattaattaattaatgtgcataattcatttagcacgatttatgaaaaaagacaacagcaacaaagccaacccgtggaatttggtcaatttacagaccacggacttattgccggtggatttgaacgcgttaatttgtggcaatctcagaatgttgggagaactcttttcaaaaataggcaactttactgcattttaattgggcatttggccaagccaattaaatgtaaatatttttcatattctcttcttaaatggttttaggtgacaatgcaaaagcatcaacttatgcggctgagcataatgagtttcgaagcgactttcaacggttattctataaggaagagcacggcgtatggtacgacttcaacattaaaagtggaaagctgcacgaggagtactacggtagtgtgacggtgccgttgttcacacagtgttacgacaccgacgatgttggcacggcggaacggatgtacaaccactggagaaaattggcgtactaaagcacaagttcggcgtgccgaccaggtgcccaatttagcgcttctcatcagagatggaatggcataaacacattttattttcagcaatgtaaactccacacaacagtgggacttcccaaacatttggccggtaatttaaggataaataaacataaataattatgaaaattggaattaacttcagtctttggcccatatgctcatcgaaagtttgaggcgatcgggaaacaaaaagtga

SEQ ID NO: 78465 - DNA, 390 bp, Heterodera glycines
  Genomic contig location: Contig_ID=SeqID_2203; Location=1026..1415; Strand=-
  SCN-specific regions: Sequence locations=1-155,177-328
  Gene Ontology: Mol. function=structural constituent of epidermis; Cellular component=intermediate filament; Biological process =epidermal differentiation
atgggatcatgtcagatgtgtggtggtggcggatttcctggaggatacggctccatgggcgcatacggtaccggattgctgggcggaagttatggtggtagcttatatggtagcggaggatatggtggaggactgtatggaggaggtttatacggtggcggaggatatggtggtggattgtacggtggcggattttttggctaaaaatttggatccattataaaaatttaattttcccaaattattgcaaattatggaaggaaaatattttcgaattactcatttcagtgacttttttattattattcatctctctgtttgttttttgttttatttacataattattctaaaataattttaattaatttaatttatttttgaaaaataaa

SEQ ID NO: 78466 - DNA, 666 bp, Heterodera glycines
  misc_feature (666)..(666): n is a, c, g, or t
  Genomic contig location: Contig_ID=SeqID_2204; Location=140..805; Strand=-
  SCN-specific regions: Sequence locations=1-428,450-666
atggccgatcgatcggcgctgacttcgcttttttggcacttttttttggccgcttttctgttggcctcacaaaatctaaacggcattaaaggacaagcgattttaccgcaaaatcaatgccctttcggcgcaacgccagacggaggtaaaaaaagaagtcaaaaatgctcaaaaggcttgatttgtaattagtttgccctcttgggttttgcatcagccgaaatgaaaggtgctacaacggaatttgctgctttaataatcagtgcccggccggctattacagagagggaggtgagcaattagcgaagaaaactttttttaaaattattaattctgaataaccattttaataacccttttcagcgtgtaattatttaaatttctgtgtcgacccaagggaaacatgcattcaaggagtttgttgtgagtttgggctttcaatttaaagccggtttttgggtggtccaaattaatccggcatttttctttactgtccaaatgcccaacaattaagcaactcttgttcacctttcaaacttgtcatagtttgtatattctattttaggtcagcctttaccaataaatccaacttataccaacaacccgacttatcccatttatcccaacaacccaacatatccaatttatccgacaaatccaatttan

SEQ ID NO: 78467 - DNA, 387 bp, Heterodera glycines
  Genomic contig location: Contig_ID=SeqID_14422; Location=521..907; Strand=-
  SCN-specific regions: Sequence locations=1-108,131-387
atgcgttatctgttgagaattaggaattataattttctcacaaagatcggcaaaagcagtgttgtccaatcgcaagaatcccctccatcgcttcttacggattcaaagccctttaaaaaagtgctcaattctgccgttcaatattacgaggaatgtattggcctggtagaagtccacaaagcccgcgacgaagtcaaccgagtcagtctttttgcctttgttttatgccgaatcttttattatttttcgtttttttagtgcgaaaacaatttgtttttggcacaacaggcgagaagagaaaaacagggcgaaataaagtcattgcaaaaccgattgaaagacattcacagcgaattggacagaactcagcgaggcgaagacaggtga

SEQ ID NO: 78468 - DNA, 537 bp, Heterodera glycines
  Genomic contig location: Contig_ID=SeqID_14423; Location=1720..2256; Strand=-
  SCN-specific regions: Sequence locations=1-280,303-379,401-490,514-537
atggtggtcaccaacaaggaatcgccaggcagtaaaccgacacacatgcagaaagccaaacaacatcgagagagtaaaacattgagaaggcacaaaatcaacaagctcttgtccagcgctgcaacgttacgaccaagacgcaagcgagaatcggttcccaacagcacaacaccaatcgtgattgagatcatacaagacccagtcgcggatcaacaaatcagcttatcgaacaaacattcaactgctccattgtcgaaagaactgcgaaggccaacagcaacaaagcagagttcatcaaattccacgcgaccagtatcattccgcaagcgaacacaaggaaaagcagctccttacgcaggaataagccgaacactcgaacacagcagccaaacaaaagccttgtcgccaacaactaaagaaaagagggcaaaccaacaacacgccatggcactggaaggaagtaccgatccaacgacaaatacttatgattggcaatcagcgaaattctccaagcatttgctagccaacaatcaataa

SEQ ID NO: 78469 - DNA, 1216 bp, Heterodera glycines
  Genomic contig location: Contig_ID=SeqID_14424; Location=785..2000; Strand=+
  SCN-specific regions: Sequence locations=1-190,213-510,581-991,1033 -1216
atgccttaccgttcgccggttggttgccaatgcattcgccataccaaagcatgcacaacggacactgacgcttcacagcgaaggccaactgtaagtgatcgagcagaatttatgatcaaattccttgaactaattagtccttgtcagctggtcttttttctgcattgatcactttctactgatgatttttgattgattatggccaaacggctggtggtcatttggggggcaattagcaataattaacaaattatcatgttcatcattgaattgctcgttttgtcaccttaatgcactgctggtggaaaagatgcgaacaaagcgacaattggacgaccgtgccgttgtcgtcgtcgccgcattgctcgccgcgcatgtcactcagacaaatggcacatcgcgctgagcaatcgtcggccgggcacttttcgggcaacaattgttcaatgcgcacttttgtccaaaattgcacttgatgatgatgagattcatttgtcagtgccataaaccaaataaatgtaaaaaattaaaaataaaagttcgaaaaatctttaaaaaattaaattgtataaaattaattcgtaatttatgtaatataaaccaaaaattaaaactgagtcatggaaaaacattgtgactaaaactaaactcgaatctgtttgtccaattaaacgaagcgcaaccttggaagattttacaagtgattggaaaagggaagagtcgaatgattacatcgacaattgatcggaaaattgattggaaaagtgattggaaaagtgattggaaaaggagtttggaaaagtgattggaaaaggagtttggaaaagtgattggaaaaggagtttggagaaaataaacaaaaaaaaacgcgaactgaaaaagaaaggcaatgaaaatgaattgcgcatggaaatttgaacctttgaattactaacaaaattcagaaaaataacttttgaatgaattattttaaaaccattggaattaccgcaaataaaaaaattaaataaaaattaaatgaaattaaaaaaagctaaaagactaaatgcatctgaaatatccgcgcctgattatatggccaaaactttgttgaatatttaaaatttcagcatcttacaattgatgaaatttttcttgttaattgtattatttaaatgttaagacaatggaaaatcactcatttaattacaatttttaaatgaattgtgcaaattaa

SEQ ID NO: 78470 - DNA, 889 bp, Heterodera glycines
  Genomic contig location: Contig_ID=SeqID_14425; Location=871..1759; Strand=-
  SCN-specific regions: Sequence locations=1-106,128-153,175-538,564 -586,626-685,738-889
atggggggggggaagagggaggtaaggaaaatgccaagaaaatgaaaaataatcggcaatggaaaagcaaggaaaaagcaatagccaaaaaatgccaacttgcagcaaatcatcaaaaccaaaagtgaaaatcaatgctcgcatttacgtaagtaatttttaacaataaaataatggcaatattagtaacattttttctttaggaatgcctttctcatttttatggctttatggcaaagcttgaaaatgtgcaaatttcttaaacagggctcggatcttaccaagtcactttccaagtacataacgggggaaatttgtgaaatccaagtacacataaaaatgtgaacaaaataaataaatgaataaaaaaagacattcatatgaaagaatcccgatttccaagtacaatcttggaaataagtacagtttaaagtttccaagcaaaaaagccgaaatcaagtacgtacttggcatccaagtacgaatccgagccctgttcttaaattttagatttggagggaccgaacttaataaaggataatctatttaataattatttattagaattaggaatttcacattttgcaaaaaataataaaatttttaaagaaaaaatattatttttcctaacaattcttcatttaaaaaaaatgcagcccaaaatgcaaaaattattttcaaatcattcaaatttcactttgatcagatgggaaaaatgaatgaaaaaggcaagaaagtaaaggacaaaaggcactcggaagagacggcactttttgatcaaatgacaattagtgaattgaacgagtacgaagttgggcaactgatcgctaactcggcaccaccggtacggtcaattgaaggcatttgccaaaaaagggacaacatttag

SEQ ID NO: 78471 - DNA, 1252 bp, Heterodera glycines
  Genomic contig location: Contig_ID=SeqID_14426; Location=106..1357; Strand=+
  SCN-specific regions: Sequence locations=1160-1171,1194-1252
atgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatgttcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattgtcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaacctaattgctcaaaatttatttcgcacatggttacaccttttgaaattatgaggggatcgttaccttcccgaagcgcaagtataagcccaacaaaa

SEQ ID NO: 78472 - DNA, 371 bp, Heterodera glycines
  Genomic contig location: Contig_ID=SeqID_14432; Location=352..722; Strand=+
  SCN-specific regions: Sequence locations=1-371
atgcgaccttcaacttccaacctggactcaaaatctattatcgattcctacttaaattcgacggaagattgtcagtttttattgcgagcattaggtaggattttcttttgtacttgccttccaagtataaacttaataggtaacttgttttagagaaacaagcttttgagaatgtggtcttcgctttacgcgctcaaggaccgctaacacaatacactgagttacttttggatcatctgaagacggcgttgtcgtaagtgcaacaaatctcttcaagactatttgtttgtttacagtattgatgatgatgaatttaacataaaaatccgaattgcttctaataatccgcatatctgtcgtattgcccagcg

SEQ ID NO: 78473 - DNA, 411 bp, Heterodera glycines
  misc_feature (9)..(9): n is a, c, g, or t
  misc_feature (16)..(16): n is a, c, g, or t
  misc_feature (38)..(38): n is a, c, g, or t
  misc_feature (50)..(50): n is a, c, g, or t
  Genomic contig location: Contig_ID=SeqID_14433; Location=292..702; Strand=+
  SCN-specific regions: Sequence locations=1-50,79-214,237-411
atggagttngtaattngtagaaatgtaatgggtaaatntgtggaaaagtnataaaaaaaatttttttttctaaattttcagaaaggataagaaaggattggtgcataagctgaagcgacgctttgcactgttcgccaaaatggatttgcaagaaacagaatgttgggaattgcacgaacgcttggccaagctaaaagtggatgaacgcttggccaagacaaaggtggccaagaagaagaagaagccgaagccgaacaatttcaagcagtttgacgccgacttcggcaaggccatgatgacgaaaggcccggtgtttgtggaggatttcatcaaagcgatcctcctctgaaatctgatcacttgctaatgaggggctaattaatgggggagaaggcggcaaaacatacaaaa

SEQ ID NO: 78474 - DNA, 1258 bp, Heterodera glycines
  Genomic contig location: Contig_ID=SeqID_14439; Location=991..2248; Strand=-
  SCN-specific regions: Sequence locations=1-438,460-574,596-685,707 -977,999-1049,1071-1258
atgaagcaacggatttgccatttgacagcaacgcacaaaacgactaaaagaccaggcaaaccaaaggttagaacggcaatacaacgcactgaaacaccggacgaaggccatggaaaagtacaaggcgaaagtggcagaacacagccaaaagataagccaaaggaaggaaagcgaattggcggacaagcagaaactgttggacaaaattcagagaaaagtcggaaatttatgaaaaggaaaaatgaaagaaaaattcagcaagaaaaagggacggaaaattacgaacagtgcaaagagcaagtgagaaggagggccatggaactgtgctcgccacgacccacccatttgtgggcacagactttggccgactttggccaaatgccctccgatttggcacttcagcagaggtcgtccaattcggacagaacggtcgagggcgaagcggaagaagcgagcggaatcaaaggctgtttccggtgcggaagcaaagtgagaggaacggaagggaaacgaaacggaagtccttcccaatttccaaggaaatcattcggaatgacctgcaacttttggcccacattatgtcggagaaacacttggccaaagctgaccaaaagtcggactcacttttacaaaacgcagtgatcagctacgattttatggtccgctaaagaaaacccaaataataagaataataatggaaaaatcagaagaacgaattggagagaatgacttcgttgccacaaaacttagaagaaatttccgaggaaatgtccaaatcgatggacgaaagcttctcattgggcaatgcgccaatggacaaaataatagcaagaaatgcggaaatgtccatttctgatcagaatttaatgcagcttttgatggtcgacgaaatcaaagagaaaagcaatgccaatggaacgaagaaaaaacgggcgaaaaggcgccaaaaaataattcggtaataaattgggaaatgcaaaaaataaaatttaaaaaaacaaatcgaagggaattcgaaacgacgacacaaaaggaaattggcgacgattggagcagagaaatgggacagaaaacggcggcacagcaaaaaagtgccaaaatattgaatattttgcagacaaaggtcgaaagattgggaaattcagcggaggaggggcaattggaggagaacgaactgaagggagtgcagcggaaagtcacggaactgatcagtgccctgcgaaatgcgcacaatgccaaggcacaaaatgagcagtga

SEQ ID NO: 78475 - DNA, 138 bp, Heterodera glycines
  Genomic contig location: Contig_ID=SeqID_14439; Location=2333..2470; Strand=-
  SCN-specific regions: Sequence locations=1-105,130-138
aagcgattcacccaaatccgagaaaggaatcgacatgcgcatttggtccgaaaggccgaggaggagcggcaaaagcgcattgaggagaacaagcaacagagagaggaagcggagaagcggcggaaggacgcggaagag

SEQ ID NO: 78476 - DNA, 403 bp, Heterodera glycines
  Genomic contig location: Contig_ID=SeqID_14440; Location=279..681; Strand=-
  SCN-specific regions: Sequence locations=1-403
atgacggaagaagaggagagtttggcacaagaggaggaaagtctgaagaaagagatcgaggaggaggtgaagcagtagcaggacgaacagtaaacattgttgacccattcaggaagagaatttgccggacttttcggatgattttgtggacaaagacaatttggaggaattgccagagaaaagggaggacgaagcaattggcaaagagggagcacagagtgagtgggacggaagagaaggccaaactcaggcgaacagtgccgagccgagccattatagaaacccgggagagttggcacagctccgggcaaagcttctttcgccgacgaagcgaaggcaatcggcgattcccggggaaattcaaatggtaaccaaaaaatcgcagaagggccgaagacattga

SEQ ID NO: 78477 - DNA, 161 bp, Heterodera glycines
  Genomic contig location: Contig_ID=SeqID_14441; Location=595..755; Strand=+
  SCN-specific regions: Sequence locations=1-36,76-161
atggaaaaagaaatttggcataaaatgcggctaaagtaaaattaaataatatttttattttttgtattatttttaggatgcgccattcgaatgaagataaagctaattatgatataaagaaagcgaacccgtcgagtcacagagaaactgagaatttttga

SEQ ID NO: 78478 - DNA, 611 bp, Heterodera glycines
  Genomic contig location: Contig_ID=SeqID_14442; Location=1..611; Strand=+
  SCN-specific regions: Sequence locations=1-2,26-48,70-541,563-611
  Gene Ontology: Mol. function=opioid receptor activity; Biological process=regulation of protein activity, epigenetic
atccccaaaattcgggtccccaaatgtcgggatccccaaatgtcgggatccccaaatgtggatccccaaaagtcgggtccccaaatgcgggatccccaaagtcgggtccccaaacgtcggatccccaaatgtcgggtccccaaatgtcgggttccctaagtgtcgggtccccaaatgtcgggtccccaaatgtcgggttccctaagtgtcgggtccccaaaagtcgggtccccaaatgtcgggatccccaaatgtcggatccccaaatgtcgggtccccaaatgtcgggttccctaagtgtcgggtccccaaatgtcgggtccccaaatgtcgggtccccaaatgtcgggttccctaagtgtcgggtccccaaatgtcgggtccccaaatgtcgggtccccaaatgtcgggttccctaagtgtcgggtccccaaatgtcgggtccccaaatgtcgggttccctaagtgtcgggtccccaaaagtcgggtccccaaatgtcgggatccccaaatgtcgggatccccaaatgtcggatccccaaatgtcgggtcaccaaatgtcgggttccctaagtgtcgggtcaccaaatgtcgggtccccaaaagtcggg

SEQ ID NO: 78479 - DNA, 3384 bp, Heterodera glycines
  Genomic contig location: Contig_ID=SeqID_2205; Location=513..3896; Strand=-
  SCN-specific regions: Sequence locations=1-180,202-435,472-945,969 -1062,1084-1314,1337-1726,1748-2032,2054-2059,2081-2414,2436 -2576,2598-2835,2857-2867,2890-3171,3194-3384
atgacttttgtctacgagtcgaagcttcggaaagacaacattgtgtacgacaaagaggttgggcttcaacatgaaatcgaacagacattccaaagtcctccggtgaaacgctcttacaattcttcgcctcgttccagtcccaccgattcaaaccaatgttgctgctcgtgtatggtgagtctttttcatttaattttttgattctaagttgagagatctttgaaggaatcttactacttatttcgtcgttttgtttgattttatgaaaatttccaggaaataattggcggccttttgtacaattgctcaagatgcaactcttcctttcattccatttgtcattttcccgctcttcccattaacaaaggcagctattcttctgattggatttgtcatcgttgtgaaatggaagtacaatacaacagacggtaattgttttttttagtttttacaaaataataaatatttttacagtcatgtgccgaggattaaatggaatttggtaaggaatttcattaatggatttacaataaaatgcttttttggtcctttttaagtttcttaattttgggaattacaaaatctatcaattttacctaatttcgttataacacataatttttcctcacatattactactactcttccaaaaaaaaagtttttctaaatttaatgtattttagggttttcaagaaaaagaagatgtattaaaccaatcattcgttcgcttcttactccgcttatccgggaaagatggtgcgccgtccgaggatttttctgaatttgtgaactccttaaaggcaatcaattctcgtgaattttctcttgacaaattgtgcgtcgatgaatgtttttacaaattgcctttcgatgaacttttcgcaaaagatgagccaaattcgaagagatgtttttactgtaaaaggttaacactttcgaatttgcctattttattttgtacaaaataactaaataaaggttcgtcgagaagaggatggtttcttgcgacttttgcgacgcttctttctgtttcgactgccccaacccgccttttactgcactgccaaatgaacgttttatgtgctcacttcacatcgaaccattcatcgtccttaattttgtttcttcgttttacaacttttctttaaggacgccaatttattggattcgaaacgggtaactgaccgaattgccctttggaaaaggtacaccgaactgccaaagtccgaaacgccttttcggtccgttatttcgtgtttctacacaaaagttagagaggataacacaaagcaacatcttaaattgaagtcaatgacaacaaaaaagcaacaaaagactatcaataaacccttcaaaatcgaaagtctgatcaaaagggcttatgccgttgcggaacaaaacttttctggagattgctcaaatagtcgggaagaaactccgattgatgttggcagtccggacgatgccagactgtcaattgcagttgaggctttgatgaaaatgcataatcagacggaggaccacgatatgatggagtttgcaaatttataataatgtctaccaataataatataaaccgatttatagtgattttcttcaccccttcaccgtatcagaatccaaatttgactttgccatcggtttttctgatgtttttgtgccgaaaatggaagaagacaataaccaactgccgctgctttcttttaatccaagtaaaccatatttatttctttgaatatttataaatgtttcaaaactgcagcacttttggacagaacacagcccattttcgcctcccttaaaattttgagtggtgctgacaaaagcatgggagagagcgactttctgattccaattcattcgtcttttgtcactttgggtccattgaaagtgaattcgcttcatcacatcaatttgaggttttccgtccgtctttgcttccaatcttttttgaatgtttcttttagtcattttacgcactgcaaaatgctcaccaagcaacaggcgttgattttcttcgacagggtctttcttttcttttctctattcatttaaatgggtttaaggccaaactttgtttcgaaattgtttctgccaatttgttcgactgcgattcttttccgtcctccaaatgcatgcaaaagaatgcgtctcgtttcgatgatttcgtttccgagtgcacctgtcaaagaatggatgcggaagatggcgatgaatcggttgttcttcgattgttggaatcgaactatgaaattgtaccgtcgcgaaagtctgcagttttatggaacggtgcgataattcgtattggatgtttgcgttttcactttgtaggcttaggcattttatgaatgaaaagcaccacttcatacataaaatgggggatgggggatcggtctgaccgtttacaagcaaaagccggggggggggcggcggcgatgaccagctttagaaagggagtcctgccatttaaatcgatgagttttaaatccccttttgcgctgcgcttttttcaaaaaaattcagtgaaaaggagggaacgtttgcaaattctagtgtaattgttaacagatgtctaaaaaattattattttttctgttttgagtcattttttaataatttgaactgaaacgattttcggaatacaattagaagatttattaatccaaatactctgataaatatggtatttagccttgaacattccgagcgcctaaaagacgcccgacccttataatgttgttataatattgcccttatttatttccccaattgttccctactttcctttcattaactaattggtttcttatcttttttattaacttttaatgtaaaatatatgtgtaaatttatttaaatcacttgaaaacaataaacaattgatgaacacatgcatttttagcataagttcatttcgttttacaccgtaacgcattttaaagttgtggttgtcatagagattcttttacagttattttaatctttgattttagcattgcttccttcattctgctaaagtgtgtgccgtccccattaattttttatttaatttgtgaattgttctaagacgccttctgttactttttctctaattataaagcatttagagctcacttaaacgatattctattttcagacgcactaagcaaacgaatatggcagatttggaccaaaataatgctcggaatgaaagcgaaggacggagcgaaagtaccaacgaaatccgcgcgccgatcaccgaagcagaaattagggcgaaagaaatggtgatgccggacgatgtgctcggattgaactgcattactgaaagtatgatcacaaaacaaaaccaaaagtggcattccctttcagatttcctctgccgacccgaggataatgtctacg

SEQ ID NO: 78480 - DNA, 1988 bp, Heterodera glycines
  Genomic contig location: Contig_ID=SeqID_2206; Location=355..2342; Strand=+
  SCN-specific regions: Sequence locations=1-103,125-284,306-659,681 -839,861-864,887-891,934-1053,1075-1264,1286-1733,1755-1786,1809-1988
ttactttcgcctcaacacaccgctgaaacggcagatgttgctgcacttcagaggatcacttcggaaatgatggacagacagacaattagccaactcataaaacgttttacaaaaacaaaacttattaccaaatcaaaattccatttagcaaaacaagaagatgagccgggctttctgcttgttcgtgccttctccgaatttctctatttttgcctttaccattgctacgtttttgcccttctctccatgatggtctgtctatttttacccgttaatttgagttttcatttgtccctttcttttttcagatgtgggcccttctctaccattctgtgttcggccttctcttccttttgctcacttgtttcctctgggccctcgtaaattcgcgcaaatggacattcaaattgtcccccattcttttggcttacgttgaggtgactcccaaacaaaaggacaatttgtttttttatttgtttcttttcaagttccttttgttggttcaatatgtgttcagcatgaatttacacaaaaatgagcttggacttcccgaatcggtggaaatcattggcttcaaacttgagcaatccaggactgatgcatttatggcacttttgttgaaggtgggacaaataataacactgaacacacaaattcccaccctttttaacttttttcttaccgttgccttaaagatcactttttcaagtggctaaagtccaaaaatcaccgactgacagaaatgaaaaaaaaatatcaattttcttttgcctcgcaatatttgctgatgagaaaagatcttttgtatgtcaatgtactcaactgataattttgaggacatatataatttaattttaaatcgagttcaaattaatttcttttttccctcacattttatattttttactaaaagctaaatttattataatttaaccgaattttattgctttttggtttttcgctttttaaagccatttcaaggagaaccattgcaataaaaatcctaatgatgagggaacgatataatattatgaccatgcagtgaatagtcaatatttaattctttattgttttttcttcagattatcctcagtcttccacttttcattcttttacgtttgcatttgcgcgaggattattataactctttgaacggacgtgaacgattccgacaagtcaattacggcacattcgcagtgaacgacagtcaaaggcacgtaaagtgccggaaattcacactttcgagggcaaatgaggtgaagcttgatacatttgagcaacacaaaaataaattgtgaagtctcattttcaaattatttaggacccatttggctgcatttcatatcttttgacaaagtattggattttcctagcggtcttttgcattttggtgaattcgccaataatcggtgccagagggggcggcgtcactttcttttccatcggatttctcacctttttcattgtgttcattcttcttcttatcgtaagctaatcatacttttttacttaaatcttctctttttttcactaattaggcatctttccgactcttccggaaagtcgtcttcgcatttttcaccgttctcatcatttacgcttccgttgttttggtgtccatttatctctaccaattcaagggagtgcccgagttttggcaaaagtggacgcacataaacgaaacggtgtgggaggacattggactgatcgattacaaagcaaacgaatttgggttggattttttaaataaaaaacattgagtaacagttttattgggatattattgccattttagacttctgttcactaatttgacaaaactcatctctctcctcgtcgtcactatgctccagctgaaattcttccacagcccttggtcccgactcgtctccgattccgcagaagcgtctcatctcgaatgcgtggagaccgttgacaccgtacgcgccggtttgtaaaaacggaatcgtataaaattcatggcacct

SEQ ID NO: 78481 - DNA, 1215 bp, Heterodera glycines
  misc_feature (1203)..(1203): n is a, c, g, or t
  Genomic contig location: Contig_ID=SeqID_2207; Location=504..1718; Strand=+
  SCN-specific regions: Sequence locations=1-187,210-641,666-1215
atgatcggctacgatgtgctcgccttcgtgttcattgtgtttcagctgagaattctccattcgtggttcttccaacgctgcatgatcgagtttaggtgtgaggtcatccaagccaacaggtgagcagagataattccattcatttaatttaaaagttgtgtaaacaaattctaaaataattatcgctatttatttgccttttaggggtgccattcttatcaaccaactcattgagaaggaaatgcgtgaacagactgaacaacaaaacaagaaacttcacgaaatcaaagaccgaacggcagcgatccgaaaacgatacgaggaacagcaaaggcggagcactgggattagctttttctcgccccaaacatatggacaaggtccatttttgtataagtactttttatataattttttgctttgcaaaaattagcatttgttttttaatttcgttttaatttgttttgatcaatggtctatttctgtttcgtattattcgacccgttccgatggtctgcagtctttttctgacactttctttcgttcctctctaatgccatcactaatcattgtccaatctctctcttttgctttcaaattgggtgattagtcattactcccaaatgggtggtttcgttggtgttccactgattgtgtatgttttgtctgtcctcagtgtttcggcacagtccttcttcactcgtcgagcgtcttccgacttttgacgaagacgaccccttaccgagttacgacctccgactttctgtcccgtcttccgtccctggtttgttgtatttgcattgccttcttccgtgtgctcgactttcgctctctttcccgcacttcgcttttgtttttcgtttgctgtgtttttgtttctttggaataatatttaattttgttatttaggggactattaaaattctcgttaagtagcataatatttgttattggtgttggtttgtgaacattggcaattgccctaatgtgtttttttttgtaacccttccttatacagtaattacttttctgctattcttttgcctttctgctttattaatgcgacttttcccttggatttgcttttaacattttttattttgtgatattttttttcttatagccaaacgttctggcgactattacatgtttgactacgagccggacaaagatgaattagtcgtaccaattgagtcatttgtntcccgaaggtaa

SEQ ID NO: 78482 - DNA, 148 bp, Heterodera glycines
  Genomic contig location: Contig_ID=SeqID_2207; Location=1026..1173; Strand=-
  SCN-specific regions: Sequence locations=1-5,30-148
acagacaaaacatacacaatcagtggaacaccaacgaaaccacccatttgggagtaatgactaatcacccaatttgaaagcaaaagagagagattggacaatgattagtgatggcattagagaggaacgaaagaaagtgtcagaaaaa

SEQ ID NO: 78483 - DNA, 471 bp, Heterodera glycines
  Genomic contig location: Contig_ID=SeqID_2208; Location=1998..2468; Strand=-
  SCN-specific regions: Sequence locations=1-104,126-471
atggaccaaaaccaaagtgaccaaatggtaaatgagtttggcaaccaccgcctttctcagataaaggccgcgatcgatgacaatcagcagagattggatcagaatgatggcgaccatcattatagggatgcgattgctctgaaaattccatccagtgtcagatggcggtaagcaatagagaccggaccgagcagagcccagtaccggtttttaccgggcccggatatttttgggtaaatccggagtgaccagttttccggcttgaccggtttttgatagacccggaaaccggatgactctgaacatccgatctacagtaaccaatcagtgcctgaatgtccgaaacaacgtcgcctgtgccgccttcgccaaaagatgaatagccaaaaacaacaattaacatgcacaacacgtccaggaagaacatcagcggatagaggtcgcggatgtaacggaatttgggaaaaatga

SEQ ID NO: 78484 - DNA, 1333 bp, Heterodera glycines
  Genomic contig location: Contig_ID=SeqID_2208; Location=349..1681; Strand=+
  SCN-specific regions: Sequence locations=1-155,185-343,365-677,699 -1197,1219-1333
accaacaaactcaagaagatgaggagaccgatgttccatcgatgcgaaaactccccagacaagaaattggaactgagcgccaagaaaagttggcaggtgacgagacggaaaagaaatcgttggaggagaaaagtgaagaagagtcacgagccaaaagttggggtattgttttgtttttcgaaacatttccatttgtcagtcaatttcccttcccaaaaggtcaaacaattctttctctgttccttttcgccttgaaattgttccgttcactgatcggatgggtctccgcctttctcaaccgacggtctcgcgagcatcgatacgttgaatatgtgttgaacaaagagaaggagaagctgaagcaaatgatgtgcaacgtaaatgcccttaatacgcttttacgcttttccctccttttttcttttaggagcttttcaatgggcaaattacgacttcggcattgcgcgaccgatgggaagcgcacaatatgcatttggtatccagtgaggcggacatcaaaaggttggccgggaggatttgatggattataataaacaatattagtatttatttgtttcaatcgcttaaaattgaggtttttaggttggaagacgaggcgctcaatcgttgggagcagcgaaacattttcgcccgttttatcactgcgattggaaattgcatcgccgcccacaccgacataatttgctactgtttcgtgatcattgtgcacgggtacactgccggactgctcactttgccacttcctgcgcttgtctttctttgggggacgttggccagcccgcgcccctccaaattgttttggattgtcatgttcgttttgaaatagcccagctaaattttcatatttcattataggataatttacaccgaattcgaaatcgtggccaaattcgcttttcaattcggattttggccttggaatggggacacagtcggcaataacaaagtgtacaagacggagtatgtgttcggagttcagcgcattcagggctttgccggcaaggacgtcgccctgctcatcgcactctttttccaccggtaaaaacgaaatttgtgaggaatttcacacataaatgggctttttttaagttatatgttgaggaaatttggactttggagagacgcaagttccgacagattgattaacgaaatgcccaaaaaacggatggacaatgggtcatcttcatcatcatctgctgaaaaaagtccacagaaatcgactcaatcgacggttgttccatcgtcgagtggagaaaactttgaatcggtggccaaggcacaacaggaacaggtaatttggattttttggtag

SEQ ID NO: 78485 - DNA, 1158 bp, Heterodera glycines
  Genomic contig location: Contig_ID=SeqID_2209; Location=58..1215; Strand=+
  SCN-specific regions: Sequence locations=1-457,479-1158
atggcgactggtggtaaaatgggattcggagagattgtgccgaaactgagtcaggtgaccgaatgggacacaatggccaatcaggtggacacgagtcgtttgtgcataattaggcttactgatttccttcgctttttcagtccctcgccgaaggcttacgctgcgagataaaacagacgtgggacgggaagccgttggatgggcacggacccatcaaaatttggatgcgatggcatttccggcgaatgttcgggcaaccccacaaaagagtggtgagacaatggcattatttgcttgggatgccggcaaaaattcgtcatccttaattctttttagattcgcgtggagatagaagctccgctcgtcgatgaccccgaaccgcccagcgaattcgccggcatttgcacggatgtgagtaaattaggcaggggtcgatcggtacagcagttgcacatttttcaagctgtacaactacgaatgtgtggagctgttctttgccaatgacaagggcttctacacggaggtaattaaataatttgtaaattaacttttgaacttgggggcgtgggaatggcattttgtcctcattggattggcatccgtttctgagttcacacatttctcattgtcaggtggaagtcggtccgcacgggcattggctcgtccttctccacaaaggctacagacaatgctttaacagtggcgacaatttgcaattggaagtgaaaaacgaatggaagggcaccgaatggcactgccaattggaaattccgttggcatatttgccgggaagtaagccaagcaaaagccactcattctgtcccgttctttgtttgcttcagatgtgaccaaattcaacgcgtacgctttgcacggttctgacgaacagcgccatttcgaggcactgcacgcggtcaccgacggcacactgacggagccggacttccacaatctgatgttttttggcaaactcgacacgaaacgaatcattccggatgggtacaatcggacggtgttcaacgacctcaaatacggcgatctttgggaagaagccaccagcgacaaatgaaaagccgaaatggacattttaacactttttatcgttgtgtatttatgtgcttttggtacttatcattctttgtttatggttgtttacga

SEQ ID NO: 78486 - DNA, 129 bp, Heterodera glycines
  Genomic contig location: Contig_ID=SeqID_2209; Location=1393..1521; Strand=+
  SCN-specific regions: Sequence locations=1-129
atgcaaactccgaatgaattgaccgccggctccggtgtcaccaatttcatcaaatgctccgtctgcgatgcaaaatggccctataaaagtgggcatttcccctggggctttgccattcgttgcacaaaa

SEQ ID NO: 78487 - DNA, 189 bp, Heterodera glycines
  Genomic contig location: Contig_ID=SeqID_14444; Location=1..189; Strand=-
  SCN-specific regions: Sequence locations=1-189
ttagaaacgggcgcgaagcgcccgtctgaggccgcgaagcggcctcaatagcccaacaaatttagaaacgggcgcgaagcgcccgtctgaggcctcgaagctgccttaatagcccaacaaatttagaaacgggcgcgaagcgcccgtataagttcaacacaatttaaaaaacgggcgcgaagcgcccgt

SEQ ID NO: 78488 - DNA, 499 bp, Heterodera glycines
  Genomic contig location: Contig_ID=SeqID_14446; Location=2348..2846; Strand=+
  SCN-specific regions: Sequence locations=1-3,26-109,138-280,302-499
atgttcttctcttttaaaaatcatttcctccatcatcaattagaacaaaatgccaaatttggcattggctgttccggcattaccattcaaaatccgccggtcaaatcgaagcagcaaaaaatagaggaaatttacggcactcaaaacaacaacattatgccaattgttacgctgctcagtgttttgtatgtgtgcagtgttgttgtgcaaacagcttgtgcaatgccaatgcaaatgttggtcatgtacacgcccatcaacagttacgaaggtggatttaaattatttcttgaaatttaaataccgaaaatccataactctcgacaaatgctaattaatattaaatgtgagaatttggtaaattgccacattagcaaacatgaatcatgataattattaataattttggtgggtattgattaagcaagctttatctgttaagaataagctttatgaaatatgaatttttagaaaatccccgacaaaattacttgcccaa

SEQ ID NO: 78489 - DNA, 171 bp, Heterodera glycines
  Genomic contig location: Contig_ID=SeqID_14447; Location=23..193; Strand=-
  SCN-specific regions: Sequence locations=1-8,30-171
atggtccattcctttttgcgttacagtatattgtttgtcatttcatgctttgtgtacggtcatgatgatgaaaacgacaatcatatcattggtgatgtttatcttggtgacgaattttggtaccaactttcgccgatcactgatttgcccacaattgatggagtcgaattt

SEQ ID NO: 78490 - DNA, 1284 bp, Heterodera glycines
  Genomic contig location: Contig_ID=SeqID_14447; Location=1869..3152; Strand=+
  SCN-specific regions: Sequence locations=1-24,47-440,466-489,541 -541,563-620,642-672,694-751,773-783,815-1026,1056-1284
atgaatttgcacacaattttctccgtgttattgtgtgcgctggtgttgtcctgcgcagtcggaaagccaccagcaaaaaagggccagcaaagtaaaaaggctgacgtcatagctaaagccgctgctggtgaaccggccgaagtaaagaacgatggcaaagcaaaaaaatcggctaccgtcgtgcctgtcgcggctggaccggtaggcgcaagtaacgatgccaagggcactaccgccggtggcaacaaggcaaccggcgacactggcacgactaaaccaagcgccggcggctctgccacgacagatgatgatgatgatgacgagagtccttctccttcggccgccgccggtggtgcaacgacaaccgatggcaaggctaaaccaagcggcgatggcacggccaccactttgtcgggtggcggtggaaaggcctccagcgcggcaaaagctggcagtggtggcacaactgtgcccgccaaggtcattcagaaatttaaaatatatttattttgaattttttgttaaaaaaatttatataaagggagaggaaacaaccgcagtaaaggtggacgaaaactcgaaaggcactgatgagacagagaaaccggaagggtaaaattaattttttgtcaaaactttaataaaaaaatttatgaaatagaatttttcgaattcttgagtctgtttttgtttaattagcctttttaaattggaaagcgcccaattcatactgttttttgacaaaaattaatttctcataaataaataaaatcgtcaaaaaaattaaatgggaaatacatttttatgaaaggaagcacccgaatttttttaaaaaagagacactcacaaattgaaaaaaaatcatttttattccttaataccccaatttttgatcaaattcagctcaactgatgccaccattactggcgacacgtttacaaaggtcaacaaaatcgcggacgagatcacagagtgcgagttttacttcgttcatttggaaaacgtggtaagaaaaaaaacaaatgcatttttaattaaattattgttttttaaatgcccaaatttttttcacattttgcaacagaaagccaacgaaaaggaaaagctttggacacgaaccaaacaagaagcggagatcgacaccgaagagatggcagaagatagcgtcgattatcgcattgtgacgcccgccatttccaaggaccaaccggacatgggcacattgtacgagcaagacacggatgatttgccctccgatccagatagaagggcaaggaggaatat

SEQ ID NO: 78491 - DNA, 680 bp, Heterodera glycines
  Genomic contig location: Contig_ID=SeqID_14448; Location=963..1642; Strand=+
  SCN-specific regions: Sequence locations=1-118,148-374,396-680
atggaacggaaacagaaacgccttgaggaggtgacggaaggatttaatattgttttatttgggctgcctttgcagaaggacgaaggcgagctgagcagcagtgactcggaggagccgaccagttcagaggaggaggaagaagcggcgaattctgccgacggagcggcggcccccaaaaagtcgggcgcgcgattggtcgcttctcgcgaacgacgccgcacgcgcagagtggacgagcagaagcaagttagtcgacgggacctctacaattgcactatcgcccctggggactcctattttgcctgttggttggtctgaaatcgaaataaaatatcctttcatataaaccatttttagatatccttctttggtcaaaattgaaaaggatatttatgtttttcttaaaatcaacatttactgtcatactaactttctaaaaataatgattagatttgatatcagattcagattttatccaaattgattatttcccattttggcccctttgcgtaacgagcggggagatgctgacattacctgacaataagcaatggggcggggggtcatgcaccgaacggcgcctaccgtcaccgccgaacccaaaaacgtttttcttaaaaatttgactggaaatagcaaaaatttagtcaatttttgataaaagctgttaacaaatcgta

SEQ ID NO: 78492 - DNA, 885 bp, Heterodera glycines
  Genomic contig location: Contig_ID=SeqID_14448; Location=2518..3402; Strand=+
  SCN-specific regions: Sequence locations=1-245,283-513,547-667,689 -839,861-885
atgtccttaaatgggacctatcttttcaacctgagcttgtactgctccaactccatgcatgaagttcgagctgtacaggtttgttgcgatcccagagaccaaatctaagaccatattcgaactcaacatacccgatttaccttgtttaattaaattcagaatttccaaaaccacttaaaacattatgttacttggtggtcttgaaaaatgccgtttttggagaccactttcagtctcggctctccaataattcaatttttgtaattaaaattttatatttttgtgttcttatagtcctaactttgctctatttaatcactatttctctggctctgtatctcttttatttttctttaaatcagccatcaaaaatacctaactctaaaatgaccatttttacttacttaactctaactccctacttttccattggtattgatctcttgccagaataatggcaacatattattgataataatggcgggtatcttgaatcatgattgtgttttgttgaaattaaaaaaaaaaatttaataaaaaaaatttgggtatcaaaaattatgttccaccctaagtacgggataatcacctctaatttcgaagttttttcgtgcatatttttgacaaccctgctcataaactacagaaaaaagagcccacaaagaagattatttataaaattattaatgctaaaggcgtagaaaacataatgtacctaattaggaaaaataactaaattttaaatattttagaaacgcccatctcaaattttaaatttatatttggtcaaaaaaacttaaaaatttttcggttcgattaaccgaggaatttttagaaattgccatttaaagggtaaaaaattgaaatttactcaaatccctaaga

SEQ ID NO: 78493 - DNA, 825 bp, Heterodera glycines
  Genomic contig location: Contig_ID=SeqID_14450; Location=1859..2683; Strand=-
  SCN-specific regions: Sequence locations=1-86,108-426,449-556,578 -669,691-712,738-825
atgcgctcaaaattgttgtggccaatgttgacattgcgcaggcggagggcaacgaccgtcgcaccaaaagtggcaaattcactttggcccagctcagagccaccgacggtgaggcggccgccggcactgggctcaaatttagggacacgaaatcacaaaaataattaggtccaaattaacgaaatgtataaattttgaagacagtctattggaggggaaattgtcaaaattgccaaatgtgtataatattccattgcttccatttctcaggcatttgccctctccaaaacggcaccaatcagttcgactcgcagaaggcaaggactaaaattattataatcatcattgtcattaagcaataattaatttttattattcctattctttaatgaatgataacacaaaaattattctgatcagaaaaatgatataatttccataaatctttctttactcatttgtcagtgaatttattaaacttaattatgagccttaattatttttaattggataaatcccgtgtccccgggtattgctggactcaaaaaaaccgagtccgggtcttgaaaaagccgggtatccgggttccggacccatttcggatacccggacccgttttaccctagttcactcatttatttgttgggaaaagatttttctctccaaatatcattggattttcatttttgtccagtaaggttcaccagccaaatctctctctctctctctctctctctgtccaatgatcggtagctttatccaaggcctaatcagtgtatcaatttcgcgtgttttgatcaatgccgctgagacagcaaaaataaa

SEQ ID NO: 78494 - DNA, 1348 bp, Heterodera glycines
  Genomic contig location: Contig_ID=SeqID_14452; Location=969..2316; Strand=-
  SCN-specific regions: Sequence locations=1-129,151-162,184-192,214 -635,659-692,714-1292,1314-1325,1347-1348
atggataaatttgaaattttgaaatggattgaccaactcgacaaacctatggctgatttaataagaaaattgcacaaatcagtcaacgaattaagtgcttcaattaatgaaggtgtatttaaaaaaataatttatttatttatttatttagattctttggaccaaaatgcaaaaattcaaaatttaataagtttgattaaagaaattgcaattggtacggcaaatcgtttgcaaatctcaacaaatgaaattatgccaccggcagatggacaacaaattgatcagaaaagcatgctcgaagagttgaccaaattttggcacaaatttagggaaaatggggagcaaaattgtaattcttttttgttaacattaaaattgtgtttttattcaaaaataatttgttttttgctcatgaaaaacgcgaacatcaacaacgaaacaagcgcatacttaagctgataatgagtttcacaacagacggagtcgacggattggcgaacctaaaaaaatgcaaaaagtttgtgagcgtttcaaatcgtcatacatataattcagataaattacggcatttttggtccccgtcatgacagattactggttttagtgatttttccctaattttaattatcaactggaatttttaatttatattttaaaacgattaaaaaacaaaaattcaacgaagttttattcgtttttaaaaacttttagatggtgaatagtttttgcattcattcaattttcatacagaaacccaacgacaaagacgccggaagaagcgatcagtgggaagcacagttggcgtgctaattgttggcggctttttttgcattttggctatttgggctatcgggaaatattgtaaagattgttctcccgaaaatcagcaaggagaagacatcgaaaatggcagaagagtagcggcacgagaaattcagccagaatcacctgaaggacacatgccgccaagacgagatcgatcatgtgaaagaaaggggaaggcgaggcagggacgacatcgatcacggtcaaactcgcagacgcgtttgagtaagccaaatctggctggaagcccaggcccgtttaatcagatgggctgggctaatttggagattttttttgttcctccaattttttgtttacaatacgatttgcaaaagttatgcgtcgggggggggggaatatgcctttttaggtaatttaaaactaatgaaaagtgagcaattcagaaaattttggtcatatttttgaaaaaaaattccaaaatggcggttatccgaaagcgaattatcttataaaaaataatttttttaggtaaattattgtgaaaatgaaataacttaataaa

SEQ ID NO: 78495 - DNA, 146 bp, Heterodera glycines; identical to SEQ ID NO: 61784
  Genomic contig location: Contig_ID=SeqID_14453; Location=951..1096; Strand=+
  SCN-specific regions: Sequence locations=1-146

SEQ ID NO: 78496 - DNA, 217 bp, Heterodera glycines
  Genomic contig location: Contig_ID=SeqID_14453; Location=574..790; Strand=+
  SCN-specific regions: Sequence locations=1-217
tgtcgtggcgacaagaaatttgcgtcgaactctgcggggtgaaggggacgggaaggggatgaaatgggcgaggcgcgcagagtagccggtcgggggaacgtagggggtcgggaccgatcggagagcgatgagtcgtgccggttttcgtccaggcaaatagaccaagttgggcacaattttaataagagtatgtttattgtgtcgacctcaaacttgg

SEQ ID NO: 78497 - DNA, 1245 bp, Heterodera glycines
  Genomic contig location: Contig_ID=SeqID_14454; Location=375..1619; Strand=+
  SCN-specific regions: Sequence locations=1-513,537-838,860-1108,1132 -1212,1234-1245
  Gene Ontology: Biological process=protein biosynthesis
atgcatgaaggccttgcgaatgtttgtctgatcggttcttcaatgaccgtggtgaagtccaaaattgacatgcaggttggtcggaacgggatttatttaattgtctttttagtaattaaaaattgtttgtttttttcagatcgctcgcaaacggaagggactgacctcgcaacatgacaaaagtttggtcgcctttatgaatgcaatttgtgccgcatttgttcggcacgtgaacatcgaagtgacttccccccatttctttttcactgccaaaatctctcgccgattttcagctgatcaaatgcgttgttgtcgctagtccgggattccttcgcgatcagttcatcgagtttttctggcagtacatcgaacgcgaagggctaaagcagcagttcgccccgcacagaggtaaatttgtgctcgtccattcgtcaagcggcttcaaacacgcgctaaaagaagcactttcggacgccactgtcagccaacggcttagcgatacgaaggcactgatttttggaaaaaatggcattttccaatgttaggtcattttaggcacaggccgaagttaaggcattgaacacgttcatggagctgatgtgcaccgacccacagaaggccatctacgggtacagacacgtggtgcacgcacgcgaacaacagtccatcgacactttgatggtgtccgactcgttgttcaggcaggcgaatgaatttggcatggaaataattggcagaaacatttaaaggtccaaagaaattgcccagaggaggaaatatgtggaccttgtggagagcgtcaaggatcaggcgagaatgaagcttattggccaccgctttatatattttttctctcttttagggtgccaatgtgctaattttctcgagtatgcacgtgaccggagagcaactcacccaattggtgggttttattggcattaattgccataggcatccaacaaaaagacggacgaattgttttagactggtgtcgctgccattttacgatttcctatcgccgatttggacgacgaggagtgggaacaggagagcgaagtgccaaacgacgaggccgagagggaagagaacggacggacatgagaagaaagcggaggaaaaagggggaaaagcaccactcgagaattgtttttttcaaatttcattgttcccaaatgcctaaaatacataacaaattttatgtgttggttgaccatgaatatttttgtaattatggatgaagagcaa

SEQ ID NO: 78498 - DNA, 464 bp, Heterodera glycines
  Genomic contig location: Contig_ID=SeqID_14454; Location=1679..2142; Strand=+
  SCN-specific regions: Sequence locations=1-132,196-464
atggcgcgtcctttcattggctttgcgtttgatgccttcaaacggcgtttgggtgcccatgacttcccatttctccgtggtttcatccatggattcaattagtggggcttgcttaatttactgaattattccaaaatttatttaaatttttaattattttaaatgaatttaacacaatataatttcataatttttgttttcaagttatgatgcccaaagggtcaaagaaattggtgccgaaagggccgcggccgaatgggtcgtccgttgtgaggggaaagtgaagtgggaaatgccaaaatggccaattcaatgtttataatattttgctttctcagatttgaccattccccccacattttctccgattacaacgctttgcagcggttcacttccgaattggacccgaaaagagagtccgaccgcgtccatttggtggccgtcgatgccactgactcgtgcat

SEQ ID NO: 78499 - DNA, 1198 bp, Heterodera glycines
  Genomic contig location: Contig_ID=SeqID_14455; Location=391..1588; Strand=+
  SCN-specific regions: Sequence locations=1-193,217-348,371-478,608 -1006,1057-1198
atgcctgctgttgattgtttgaatggatatcgcagttacattaatgatcgcaatgcagagttaattatgggagatccattgaacccaaacatggaaacggatttcgattttgctggaaatttggcgctttttgacaaggctgttagtaattacaatagtaataggatacttatgcagttttaagattaaagctaacctttaaaaaataattttaagtgcaattattacgctgtcattgcatgatttatgcggggacccaaacaaatttttcccgcccgcaggggtgcaccccaaaatttcgccgcggaaatttcgccggacggaatttcgccgggacataatttcgccaaaatttttttttaaaaaatttggaaattttcaagaaaaaattcttagaatttttttatatggaaattccaatgaaaaatttttgaaaaattttttagtgattttttggaaaatttttcgaaaaacttactaatttatcataaatttcaaaaaaaatccttaaaattttttctaatttttttttgaaattttcttataagaaattctatgattttttcttaaaaaatttctaagtctaattttttgattttatttttttgcggcgaaattttgtctcggcgaaattccgtccggcgaaatttcggcggcgtaatttcggcggcgaaattttgtcccgtcccccctgaaacacacctccccgtcccttggcaccgttccgcccgcagcagcactgtcagcccgttttggcacgcgcttcgcctcgtcgcctccctcgtcatcgtccgtgtcggaagggcatgcgcagtcggagcattcgaaacgcgagaatttgcttttggccggcattttggtcaacggcgggtccaaacagccgatgtggtagtggcacttgcacgtgtcacagtaggccaacagatgggcatcggttgtctgtttttgttggggggggggggtaatattagaagcagacatttttccttccgtcgtttccccaacgaaaaatttgaatttttttttcatttaatgtttaaaatttttcaaaaaaaagttgagaaaaccacaaaaatttttcttgaaattcttgttgaaaatttgaaggtttttgaaaaaagtctgtttaaaaatttccaggagggaaattaagtgcacccaatttacacaccgactcaaaaaaacgagacacgtgaca

SEQ ID NO: 78500 - DNA, 3592 bp, Heterodera glycines
  Genomic contig location: Contig_ID=SeqID_14457; Location=1..3592; Strand=-
  SCN-specific regions: Sequence locations=1-234,259-282,305-359,388 -595,635-666,692-713,765-795,817-1348,1370-1455,1497-1502,1524 -1539,1570-1633,1655-1658,1740-1797,1820-2134,2157-2214,2236 -2391,2469-2656,2678-2736,...
  SCN-specific regions: Sequence locations=...2766-2793,2816-2866,2888 -2899,2921-3592
  Gene Ontology: Mol. function=GPI-anchor transamidase activity; Cellular component=extracellular space; Biological process =embryogenesis and morphogenesis
tgatcggcacaaagtgaggggggggggggcgaatgactgtcattttgtcatttgtcatgagaacggcgagcgaaagggcggcgaagaatgaaaacggagtgacacaccacaaaatccccgcagacacaattagcacctcccgaaatgaggtcatcccgagtgcgcaagcgaagtgattcctttccatttgaatttacataaattgaaaatgatttgaagcaaaattaatttggcaattaaaatttaaaaatttaaaatgtctaaaaaggcgtttaaatatgcaaaaacaaaattgaaatcacatctttttaaagggcctgatcattttgttttgttttttttcagcaaattaattgatgatttgattttcttttctaaattcttcccattatttttcctcccattttatcttttgccgatttaattgcaatttcattcaactaattcttcttttttcctttttttcgcttattaaattttatcagtttcaggagaagaaatcagtcgccatttttggtaagaaaaccgcggaatacaatcacaaattaattaacgtattccattatcttttaatttgattttctttgctaatatgtaatataaattttaaactaaaataaaatgtaaaaattaaggaaacaaaaaaagaaatgctaaaaaataagcaaattctttttgttgttattgtatttcttttccattctcggacaaagtatttttataaatttaatttaattaaataaaaatgataatttaaattaaaagggccgaatcggacgaggaaggcgccgctgaccaaaacatttgggccgttttggtcgcggggtccaacggatggtggaattacaggcaccaggcaaagcaaaagcctaacactaaagacacgccattaattaaccaattaattgctgctaattgcaggcggatgtttgccatgcgtggcatgtgttagtcgaccacggagtgagcccggacagaataattacgatgatttacgacgacattgcgcacaacaaaaggcacggccaattcgcaaaattaccctaattagctgtgctaatgagttcagaaacccttaccccggcaaactcttcaacaatccgacaatgaaagatgtgtacgaaggcaatgcttctgatgaattgcttaaactttgcttattctcgtcttaatttatttaggcgttcgaattgactacagaggcgacgaagtgacaccggcgaatttcaaggccattcttctcggaaacgaagaagcggtggaggggaagagagtgctgaaaaggcgggtacacaaaacattgatggatttgaaatgatcagtaaagatagtcggactgattttcgataaatcaaagggcaattagctaaatgatagtccgactaattgttgaattagttttggtcaaaactgattgctttcaaatgactcttttttctggtgacacaaagagccttaaaatgattaaaaaatattttacattttatttgaagtttctaatatgattttatttgactttttcctacttttttggtaagttaattagtttttgtacttttaagaaaaaatcgaccaactttcagcttctttcaggcaaaaatgttgatttgaaatctccccaatcatctccccttttacaatgagtttttaaaatttggaaaatattatttttttttgttattgtaatttaaaatcaatcgtttttataaaatgcaattttataaattgtttttaaaaatggtatttttacttttggctaattttgcttgtctttttggtggggttttcgtcctttctaattccatcccactgattgattgcttatttgttcctcatttagcaccagcaatgacaaagtgttcgttttcttctctgatcacggcgcttttggtttggtcgcttttccctacggcggcgattacactgaaaatatcgtaactttcttccctttttaatatcgtaactttctcttccaacagttaaccgtaaaggaattaacgcaaactttgcaaaaaatgcacgcgaaacgaatgtatggccaaatgacattttatttggaggcctgcgagtcgggatcgatgttcgaccagaaaattgcacagcaaataaacggttcttcctcatcaataccaacaataaatgatttttctgatcaccccttaattaccctctaattaccctccttttccttccccccccccttttgcccattgacttttccccttcctttctgtcgccgatctcagtgttcgccgtcactgcttcgaatgctttcgagtcgagttggggttgttactgtgacacaccaatcgtcggcttagagtacacttgcctgggcgaccttttctcagtcaattggatggaggactcggacagacaggtgaaacagcggagggaggagagaaagagaggggggagagagagagaaagacagagagatggaggggagggggaaaggggaagagagactgatcacgagtattgatcagttgttgttcttactcaaaggcaaagaaaggaaagagtaaaagtcataagccatgccatcctatccctttaacaacatttttttgtcttttttattaccgtatttactgaattaaatcccctcccctgaaatacagccctttttgatttgtttatttgtcaataaagaaaaagtccacaaaagggaaaaatccgcttacattgagaattcgacttttatttttccggtcaatcttacagaaatgaaagttttaattttatttttaaattgatttaatgagtttatttcaataagctttttatcgagttggttccaaatttttgttacccgccccgcaaaaggtataatttttttgcctaatttatctttcgagttaagtctataaaagggaatgttaaagcgtttagaaggtttaagtatttcaaagggattcagatctgttcggccataaattattttatgagccatgaacagatcagaaagctttcggcctgctttcaagtgttggcagttgaaggtattctaatctttgttggtatggaatgggtggaaggctgcatttgaaaagaactcttttggtgaaatatttttgacatttttcaattttttaaatattttttagaagagatggattccaaacctcaggagcatattccaataacggtctaacataagttttgtacaaaataatccaaatcctagaagattttgatttaataacccgaaataaagaacgcatacgtaaatatgcattctttattacttgtgtgacatgattggaaaattgcaatttattatcaatatttatgcctaaatccctaattgtatccacaacatttattatatttccatcaattttatatatttctttggggtttttattccccaaatgaatacaaaagtttttttaattgagattctgatctgccatttattttcccattctgataaattatgcaatgctttatgcataatttctgtttcggttcttgctttataacaaatatacaatttaacatcatcagcatataatttaattcttactcctgatggcaaagcatcaggaagatcgttaatataaatcaaaaataataaaggtccaag

SEQ ID NO: 78501 - DNA, 1477 bp, Heterodera glycines; identical to SEQ ID NO: 14458
  misc_feature (1456)..(1456): n is a, c, g, or t
  Genomic contig location: Contig_ID=SeqID_14458; Location=1..1477; Strand=+
  SCN-specific regions: Sequence locations=1-89,124-507,530-758,787-1477
  Gene Ontology: Mol. function=alpha,alpha-trehalase activity; Cellular component=extrinsic to plasma membrane, GPI-anchored; Biological process=trehalose catabolism

SEQ ID NO: 78502 - DNA, 673 bp, Heterodera glycines
  Genomic contig location: Contig_ID=SeqID_2211; Location=20..692; Strand=+
  SCN-specific regions: Sequence locations=1-389,433-532,560-673
atgtccgtccgcaaatgtccgtccgcaaatgtccgtccgcaaatgtccgtaaggctccctcggggggacgagggctttagagggggagagagttgatggcccactattgtttgcccatgtcgtacacacattttgtggtggtggagtgccgttaagagaattaatggacttgggccttaaaccaaacaaaaaaaacttttttgttcacatggattttttcagggtaaaggaatggaaaatgtgttaaaagtttttttttgttttcaatgtttaattaagggaaggaatggtggtggatgggatgaacttttaaattttaagtaaatgaaagcaatttccaataattatataagctacttcagacctgatgtaaagcaaatttacaagggataaatttaaaattttttattaaataattatttgaaaatttttcagtgtaattgtaaaagggtgcagaagtgccgtgctaaaatgaaaagtcgaaaaacggttttgaatgttttggcacgaaacaatggacactcgagaaaggagggcatgctgaatactgtaatccaaaaagcagaaaaaaacaagtcctaatttgtccattcattaattctcgggttttttgacttaatggaagatattgtctcgagagtttaatggaatttttatgagataatttttttta

SEQ ID NO: 78503 - DNA, 1596 bp, Heterodera glycines
  Genomic contig location: Contig_ID=SeqID_2212; Location=311..1906; Strand=-
  SCN-specific regions: Sequence locations=1-851,873-1596
atgagtgctaaccgtcttttacgatggtcacttatgctgttggcgtatgacttcgagattgagtatgtgaacaccacagaatttggacaagcggatgcgctctcaaggctgattgcaaaaagcaccagtcctgaagaagaccgagtcatcgcgtccatggaatttgagaaggaagccgaaaatttcttcagcaacactttggaaacagtgtcattctcatcgaaggacataatttcagcagggaacgaagacgaaaccatcaaaaaggttaagaaatttgtcagagatggatggcccaatgataaagcaattgcttcggaaacggaagaaataaaattgttctttcgtcgaaaagatgacctctccatcacaaaagaatgtctgatgtacggagaacgagtcgtcatcccaccaaaatttcgagcgaaagtcctacgaatgctccacaaaggccatccaggaataaaacggatgaagcaactggcgcggaaccaagtgtactggccaaaattggacgcggaaatcgaggatttcgttagaaattgtgagccttgccaactcgcggccaaatcacccataaaaacagagttgcactcatggccgaaggcgagcaaaccatggcaacggattcacatggactatgccggcccattttatggaaaagagtacctgctcattgtggacgcattctcgaagtaccccgaagtcttcgaaatgccgacaaaatccacagcagcaaccgtccaaaaattacggtatctcttcagccgacatggccttccagagacaatcgtctcggacaacggcactcaattttcaagcaaagaatttgccgattttactcagagcaacggcataaatcattgtttttcggcgccgtacaacccaatgtcgaacggacaagccgaaagatttgtggactccttcaagagaactttccgaaagttaaaaggggagggagcccttagcgcagaaatcattgaaacatttctgacggcataccgtaccaccccaaatgacacactacaagagtgtaagtcaccagcggaagcgttccttggaagaaaagtgaggaccacattggatttgttgcgcccgccgcagtttcagccaatggagcgtgatgaactgatggagcggcgtttcaacaaaagatttggcgccaaaccaagagagtttggcccaggcgacaaagtcttcgcccgtcaccgaatttcgcagaattggcgtccaggaaaagtcgttaaaaagaccggcgtaatttacgacattaaattcgcagatggtacgaccaatcggtaccatgccaaccaaattcgcccacggcaaattgaggacaagacgacagaacaattgaacattttcaatgatgtcttcggccttccaccgcaggtaagagccgaaccggaagatgtacagcctcaagacgaagccgttcgaagtgaagccgatgaggatgaaatcggccgggcagtcgaagaacagaatgatggacgtatcgaacaggaggaacagccgaatgaggaaaggccgatcactccccgagtataccctcgacggaatcgacggccaccggaccgctacagccctcattaa

SEQ ID NO: 78504 - DNA, 518 bp, Heterodera glycines
  Genomic contig location: Contig_ID=SeqID_2212; Location=1409..1926; Strand=+
  SCN-specific regions: Sequence locations=1-518
cacttggttccgcgccagttgcttcatccgttttattcctggatggcctttgtggagcattcgtaggactttcgctcgaaattttggtgggatgacgactcgttctccgtacatcagacattcttttgtgatggagaggtcatcttttcgacgaaagaacaattttatttcttccgtttccgaagcaattgctttatcattgggccatccatctctgacaaatttcttaacctttttgatggtttcgtcttcgttccctgctgaaattatgtccttcgatgagaatgacactgtttccaaagtgttgctgaagaaattttcggcttccttctcaaattccatggacgcgatgactcggtcttcttcaggactggtgctttttgcaatcagccttgagagcgcatccgcttgtccaaattctgtggtgttcacatactcaatctcgaagtcatacgccaacagcataagtgaccatcgtaaaagacggttagcactcatttggcggattccctttttgt

SEQ ID NO: 78505 - DNA, 1844 bp, Heterodera glycines
  Genomic contig location: Contig_ID=SeqID_2213; Location=471..2314; Strand=-
  SCN-specific regions: Sequence locations=1-1101,1123-1173,1195-1844
tccatccaaaacgagaaaagccgaactatgagagaccaaaaagccaacaaagcacaaagacggagcaacaaaaatgctggaggtgcggtcaaacgaaccatcaccacgcagcttgcccgcagaaaggctacaaatgccgaaagtgctcacaaaacggacacatcgagttgcgttgtgaagcagtgcaggaatggcgcaaaaagaacgccaaaagttggctcaagaaaaatgttggcaatgtccacatagtaacagtcaacattggcaccacagcaaaaccgacaacaaagtcaacattgctaagggtcaaggtctcctttcaaggcaaagtcatcgaatttgtcctcgacagcggtgcagaagttaatgtcataaacgaaatgacatacaaattgatcggcagccctaaaatcaaagcctgtaaagaacaagcagtgctttacgatggaagcacaagaagcttcatcggaaaagggaccggcacattcgaattcaacggagtgaatgttgaacaagaattttatgtggccggcaaagattccctaaatttgctgtctattcaaacaatggacgcatttgggctgctcgacgaattgaaggaaaagatttcctcaaaaatggtgaatatgtgcaaaggcggtaaaaaggacaacgctccaatccgaccaaaaggcaccgaggtcaacgaatacctcaccaagctgaaaaaagctttccccgacgtgttcaaagaagaactcggattttgcacaaaggcaaaagcaaatttggtcctaaaaccggacgcacagccaattttcagaaaggctaggccggtacctcacaactcacgggaagttgtcgagaaagagctggaaaggttggagagcctaggaatcatcacaaaagttgagcacacggattgggcggcaccgattctaatcgtgaagaaggccgacggaacagcccgtatgtgcatcgactactcgacgggcctcaacaacgctctattggaccatcagcacccacttccgttgccaaatgacatttttgcgacgttgaatggtggaaaagtcttctctcaggtggacttaaaagatgcctacctgcaaattgagttgactgctgaagcgaaaaagctatgcacggtcgcaacccaccgtggctactacaaattcaacagattgccattcggtgtgaagacggcaccaggaatttttcaatccgttatggataagctcctggccggactcgagtttgcgacggcgtaccttgatgacatcataattgtcagcaaatcgaaagaagagcactttcaaaatctggaaaaagtgttcgaacgaatccaaagctggggatttcgggtcaaaatggacaaatgttcgtttttccaagaacaaatcaagtatcttggccaaatcatcgacaaagatggaagacgacccgaccaaggcaaaatcgcggcaataacgaatatgccagcaccaaaagacgtcccgtcacttcgcacgttccttggaatggtaaaccattatcaacaatttgtgaagaacatgcgattcatccgccaaccaatggatgaactactgaagaaggacaaagactgggactggggcaaagaatgccaaggagcattcattaaaatcaaggaaattttgtcctcggatttgctcctgacgcactatgacccaaaattggaaatcatcgtggccgctgacgcctcagaacatggaattggcgcagtcatttcccaccgatttccaaacggagcaattaaggccatcgaacacgcctcatcatctttgacacccgctgaaagaaattattcccaaattgaaaaagagggattggctttgatttacgca

SEQ ID NO: 78506 - DNA, 292 bp, Heterodera glycines
  Genomic contig location: Contig_ID=SeqID_2213; Location=440..731; Strand=+
  SCN-specific regions: Sequence locations=1-292
ttccgtagatcatttcgtgaaattttcgcactgcgtaaatcaaagccaatccctctttttcaatttgggaataatttctttcagcgggtgtcaaagatgatgaggcgtgttcgatggccttaattgctccgtttggaaatcggtgggaaatgactgcgccaattccatgttctgaggcgtcagcggccacgatgatttccaattttgggtcatagtgcgtcaggagcaaatccgaggacaaaatttccttgattttaatgaatgctccttggcattctttgccccagtccca

SEQ ID NO: 78507 - DNA, 893 bp, Heterodera glycines
  misc_feature (889)..(889): n is a, c, g, or t
  Genomic contig location: Contig_ID=SeqID_14462; Location=1323..2215; Strand=+
  SCN-specific regions: Sequence locations=1-354,380-574,620-707,729 -779,866-893
atgaataaaatagatgtacaaccgaagcgggatccgaccggcagtcaaaagaatcgtcgcgcaccccaacggcgccggcataccgatgtgctgaatggcatcattgagggccgcgttttgaagacggagatgatgccgtcaagcgtcgccactgactgtaagtttaatgattactactgtaatcgactatgtgtgagttgacactatatgtcaataaaatattatttttaactgagtgaattggtactgtaaataatgagttactttgtattggtgggtttactgtcattagtgtatttggaactactgtcatcagctgatgagcattataacgattacagtaaattgattaacggttttgttggttttgctttttattcgatacctattaaattgactgctttaatttaagtcgagattaactgtgaattgtttggttacttttttattgattactgtaattggctttaattatgataaacttcacttaactttcacatataacagtttctccgaacacgttgctgccctccgtggaaagctcaatggaaaagcattacacaatgccagaaggtaaaatttaaaatttgttaattaaaatatttaaaaaaaaattattgaaatttcagtgaatgcatgccatcagcaacaaactttgctatcctgctgcccgccctcaacggcacaacaaaatttatgccagttgaaaaaccaggagcagcacagtgattccaggtaaaatttggaccaaatgctgattaatttgaacaagaatttgcaaaataatttaattatttatatcaaaaatttatttaaaacacattaaacaaagtatttaataattatcgaaaatttatataaaatacctaaaagttattttaaacaaaanttta

SEQ ID NO: 78508 - DNA, 1806 bp, Heterodera glycines
  Genomic contig location: Contig_ID=SeqID_14463; Location=243..2048; Strand=+
  SCN-specific regions: Sequence locations=1-16,50-427,449-601,642 -643,673-676,713-727,752-798,822-1190,1222-1268,1290-1746,1796-1806
atggatgacgagaacgatggagacgacgtggaggtggaggtggagcaggacgacacggcggagcggctgtgccatgatgccatggaacagccgacgacaagccatggtcctcaacggcacattgtggcatcaaatgttggcaatgcgcaacaacggcatcagttggcacggcaacaacaattaagcaacacggaggaggccgaacagcgcgaatttgacgagtaagtgttgaaaggtggtcaaataattggtcatgggtatggtattgggtgttttttacttggtgaatacggtacagactgttcggaataggccatttttatataattatcatgataaattgcttaaatagagcccctccatatgatggttgtatgattccgtattttcctttttttgagcaaaaatattttttgggcttatgtgcctaatttaaagaatagctaaatttgtcttaattattagtagagaccgcaaaaaaaggcaccaaaaatcgcgaaaaaggcactataataggcaccaaaaattgaaaaaacggcatgaaaaggcacgaaaatcccgaaaaaggcatttaaaaaaattttttctaaggtttttttagggagcaaaacacgtaaaacttaaccaaaaacttaatttggtcatttaaatgattattaaatattttataatgtttttcgaataaggaaaatttttaaacctaaaattttttatcaagaaaaaaaaatgaaattttttgagaaaatttttcaattcttaggggtgtattttctgaaatttttcaattcttagggatgtattttctgaaaatttttcaagtcatttcttaggggtgttgttcccgattttattccattttttaatggaatttacggaaataacgccaaaaaaggcatcaaaatcggaaaaaaacgccaagaaaggcaccaaaacggcaaaatgccaaaaaaggcatttaaggcacgaaaatcccgaaaaaggcaaaaaaaaaggcataataaaagtcaacgtagaagccctcaaaccaagtggaaaatgcgttatttatgcttaatatatcgaaactagtacgcagaaaaaaaaggcatatgcctcaaaatgcggtttctaattattcgatctttaaaatatgttgggcgtgtgaaccgttttagaaagaatatacgaaagaaaaattgttagaaaatctcaaaaaattaatttaaataataaaaatttaaaccaatcttgttgcttctccttttatatgcatgtagttgtttatcatatgtttaaaattttccggaatttcttaggaaatttttttttttggcggtggcgggggattaccttatttagaatttttgaaaactcgaaatgtcaaaacaataatttgcaaaaattgccgaatcgtttcccatatattttgcccaagcatttttcaatttttaaatgtttcaattttgtttttagcctagtacggagctatcaagaacatatgattttgatgcacagggcaatgacaccaattgaagcattttggtgtgcccaatacggcgaagtgggcaaatttatcacattggcacaaattggcatgccgtaatttagtgccaaaaatggagaccaatggaacccacggatgtggacttgttgagtaaagtcgaattggtatgggtaaatttggcaaaaaaaaagttttaattttagctattatttttttttcgaattattttatgcgaattttagcggcggattgttcgataattgaaatatttattttttttttaataagaattattatattaattttttatttccaaaataata

SEQ ID NO: 78509 - DNA, 428 bp, Heterodera glycines
  Genomic contig location: Contig_ID=SeqID_14464; Location=1..428; Strand=-
  SCN-specific regions: Sequence locations=1-97,228-274,317-360,388-400
aaagccttcgacgcaaccaccacgaccctcctacacgtcatggccagactacgcgacaagcacgtgcacaagccaatgacggtggagtataggaggtccgctccagcgccatccattttcagggctagttgattcggcaggtgagttgttacacactccttagcggattccgacttccatggccaccgtcctgctgtctatatcaaccaacaccttttatggggtctaatgagcgggcactttggcaccttaactccacgtttggttcatcccacatcgccagttctgcttaccaaaaatggcccacttggagctcaaacattcaacgactgggttcagagtcaagcaaccctggcttcatacccatttagagtttgagaataggttaaggacatttcgtccccaagtcctctaatcattcgctttac

SEQ ID NO: 78510 - DNA, 703 bp, Heterodera glycines
  Genomic contig location: Contig_ID=SeqID_14466; Location=1064..1766; Strand=+
  SCN-specific regions: Sequence locations=1-235,272-471,494-524,554 -642,664-703
atgaattactcaatttttgtgtctgtaatttttgctgggctaattattgttggtttggatggcaccgatgagaatggtaaaatggagaaaaataatggcaaaaaaataatcaaattcctcgaggatttccaagaaaatgacgcaaaagatgagaatgatttgcagattgactttaacagtgaacattctcgcgaagtgacacaaatgaacaatcgaaattttatcagtgcgaagcaaatttttaaatttttgtttttatttaaatttttttcagcctttcttcgcggaagctcttctaaggcatctgataccccgaagcctccttcttcggcatcggttttattgccaaaagtgcgaaagtttttagaaggaggcacaccaacaatgccatactatcaaatgccatttttgcagcaaaaggtatggcccgccaagggcaaagtcaataaaagatttttcaccaaaagagtggaattttttaaaatagggcaaacactggcaaatcgaccggggaattttgttacatttattataataaaaaataatttaaaatgaagggaataaatacattcaaatttatttgtatgacaaaatttttattccgttttcgcgcgagtgcctgttttagcattagaattgttcagaagtatatgtatagtatattcaggttgaccaagtttttttttcttctaattcaggataa

SEQ ID NO: 78511 - DNA, 942 bp, Heterodera glycines
  Genomic contig location: Contig_ID=SeqID_14466; Location=1947..2888; Strand=+
  SCN-specific regions: Sequence locations=1-942
  Gene Ontology: Cellular component=nuclear pore; Biological process =cell organization and biogenesis
ggtaccggtactagacaaacaggtaccggcacatttacttttgaaaaaaccggtaccggtacatttacttttgaaaaaaccggtacatttacttttgaaaaaaccggtaccggtacatttacttttgaaaaaaccggtaccggcacatttacttttgaaaaaaccggtaccggtacatttacttttgaaaaaaccggtacatttacttttgaaaaaaccggtaccggtacatttacttttgaaaaaaccggtaccggtacatttacttttgaaaaaaccggtaccggtacatttacttttgaaaaaaccggtacatttacttttgaaaaaaccggtaccggtacatttacttttgaaaaaaccggtaccggtacatttacttttgaaaaaaccggtaccggtacatttacttttgaaaaaaccggtaccggtacatttacttttgaaaaaaccggtacatttacttttgaaaaaaccggtaccggtacatttacttttgaaaaaaccggtaccggtacatttacttttgaaaaaaccggtaccggcacatttacttttgaaaaaaccggtaccggtacatttacttttgaaaaaaccggtaccggtacatttacttttgaaaaaaccggtaccggtacatttacttttgaaaaaaccggtaccggtacatttacttttgaaaaaaccggtacatttacttttgaaaaaaccggtaccggtacatttacttttgaaaaaaccggtaccggtacatttacttttgaaaaaaccggtaccggcacatttacttttgaaaaaaccggtaccggtacatttacttttgaaaaaaccggtacatttactttttgaaaaaaccggtaccggtacatttacttttgaaaaaaccggtacgggacatttacttttgaaaaaccggtaccggaacatttacttttgaaaaaa

SEQ ID NO: 78512 - DNA, 2000 bp, Heterodera glycines; identical to SEQ ID NO: 14467
  Genomic contig location: Contig_ID=SeqID_14467; Location=1..2000; Strand=+
  SCN-specific regions: Sequence locations=1-3,25-765,790-825,863 -1057,1105-1130,1161-1319,1343-1400,1527-1545,1600-1730,1752 -1752,1775-2000
  Gene Ontology: Cellular component=nuclear pore; Biological process =protein-nucleus import

SEQ ID NO: 78513 - DNA, 1656 bp, Heterodera glycines
  Genomic contig location: Contig_ID=SeqID_14468; Location=1696..3351; Strand=-
  SCN-specific regions: Sequence locations=1-121,189-321,369-428,566 -962,984-1076,1118-1238,1497-1635
atgcaaaaagaaatgctttcacaaatggaggcggcaattcgcgaaagtctaatggacaaatcggcactggaacaaatgcgtaggagagaacaatttttgatggaacaagcactgaataaagtataaatttaaaaaaataattatttatttaaataataaatgaaatttaaaataatgtataaaaatttgagggttttttttttgtatgcaatttgtcaaaaaggaaactttttttgagtttcttcttgaagcaaccgattgatttattatcattattaaaaaaactctaaaggaaaaaggctttattataacttttcttagttttttatagttttttttaatttaaaaaaagatatttttaatataaacagggaaaaacccaacaaaatttttttttgaaatttgtgaacttgatagcttattttcacaaattattatttaatatcttcaaaataatattttaaaataatttttaatttttatgaaataatgaatttttcaattagcaaaaaaaaattaattatttcgttattaaaaaagatttgatttatttatttcttttttagagtgctcattcattcagtaggttaaaattgagcaacgaagaagcagaaaaattaccaggcacatcagcacaaaaattagagaatgccgaaaaatctgtgaaatttgacgaaaaagcaaatttcatcattagcccttcaccaatcacgagtggcacaaggccaacagcaacaagtctggcacaattgaaaattgtgccaaactcggttgaaaaacggcggaaaagtgcggcggatttgctcaatgaaaatgcaaattacataaaaatggaggaaaagccatcgattaatgaggaaaatccaaagccgcctaagctggtggaaaagcggatctctttgggccaaatccacgttcctcaacaaagaaaagaaatgaagaacgaaactgtaaatttgcaaataataaatttcaaaaaatttctatgaaatagagaaaatgtcataagtaaatttaatttttttttacagccaaaagggcggcgattttgcataccgtgtaagaattttctatagtattttatataataatttatcggattaaatatttatattttcaacagagtctactaaaggagcgtgatggcatttctgagagccaattaagtgatcgaaggcaatatttacgggaacagagggacaaattgttgaagaaaaaaagtcaagagcgcgaaaaacaattattagtaaaaattatttaattattttttatagaattaaaaattaaacaaattttaaaaaattaaaataaattaaaaattaaataataatttaaatgttccttttgtatactctataataaactattaattacttaattggtttaaaaaaatgttatttatatatattctattttcgcttttagtataataaatctttaaaattattttaaaaaataatcattattttgatttattattaaacaaaattatttaaggaggccgctaaacaaataaacgattcgcgtcctcagacagcaaaagcagcacgtgaattgatggaacaaaacagtgaagtggacgaagtgaggcgacgaattgcagcaaaaatcaaagcggaagtgatcaatgggaagtgaaaaatgatggaaattaaa

SEQ ID NO: 78514 - DNA, 337 bp, Heterodera glycines
  Genomic contig location: Contig_ID=SeqID_14470; Location=1..337; Strand=-
  SCN-specific regions: Sequence locations=1-337
aatcggagtaggacaaaacgtcgtcagccgaaacgtcgtcgaacgaatttttcgaccataactttttttctttctcaatcaaattaaacattcttggtattattcgaaagcattcgaaaaatgctattagcctgcaaattttcaaaaatttttatttatgcacaaaaaaatcagagcaaaaaagttcgaattactgggtttttgagttccttctggccataacttttttgaaacttaaccaaaatttttgagatttagcaaattaataataaacacatagagctatcgaacaacaccaacaattcttaatttgattgacagtgaacaaagttatggt

SEQ ID NO: 78515 - DNA, 860 bp, Heterodera glycines
  misc_feature (855)..(855): n is a, c, g, or t
  Genomic contig location: Contig_ID=SeqID_14471; Location=28..887; Strand=-
  SCN-specific regions: Sequence locations=1-130,153-339,363-860
atgaagttattcacactttattgcattctgttttttgtgtccgacacatttgccggctgttttacggggtccaaaacgagcgaagacagcgattctgagcgagaagatgatgccgtgccaaaagcggcgcaagaaacagttaaaagaaaacccactttgaacacagaacttttaagtaagtttatcattgctattgggatttgggtggatttcctttttttcgcaaaatgttttattagcatgtaaattgagattttggcttggataaagaaagccttatatgatctattctcatttcaactttttttccatatttcaagcattttatatccttattcatttcaaatccattttctgcatattcgtaaaaatgcaaatgcagctttaaaaattcattttttttttaaacttaggtttttgaaactcgaataatttttgtcctaatttacctaaaaatcaataccaatatgttcaatatttttctctttaccaaaacgcttttttcttaacttttagataatttttctgttgcttttgtaacgaactaaatgtatttttattttctcaaaatttaaaaaaaaattgtcctggattttgggaaatctatgaccatataataaagccgtgaggtcccactacccagtgccaataagggaatttaattccaggagaccttcttacgcgtccgtaattaggcccctcatttgtcagggcttggaagggaggggattatgatagatgcctggggacgtctcccaggcggagatcgattggccaagtctcttaaatggctcccgactgactcgactgatctcttagctgacttcccagcgcccgggaaggaggagctatcgnagtaa

SEQ ID NO: 78516 - DNA, 456 bp, Heterodera glycines
  Genomic contig location: Contig_ID=SeqID_14472; Location=700..1155; Strand=+
  SCN-specific regions: Sequence locations=1-11,34-88,110-226,248-435
atgcatttgttcccaattttgtcccccattttttcgctgctttttgctggcattgtgcccgtcccaattggtggtagtggcggtagcatttttgcaatctgcaaaaagagtgacgtagaccgaaagaatccgatgccaaaagtgaaagcatttgatacgccagcgacaacaccttcaccgccaactgatcgcacatcgaccgaccgcaaaacgcagggttcttaacaatttaaatttaatttaaaatgaataatgattagagctcgcattttgaggcatatgcctttttttctgctcactagtttcgacatattaagcataaaaaaacgcatttccactttgtttgagtcttctacgttgactttttttatgcctttttttgccttttttggcattttgccgttttggtgccttttttttttgacgttttttgcgaaaaagtccattaaaaatgca

SEQ ID NO: 78517 - DNA, 1268 bp, Heterodera glycines
  Genomic contig location: Contig_ID=SeqID_14473; Location=822..2089; Strand=-
  SCN-specific regions: Sequence locations=1-24,232-411,440-440,465 -526,565-745,951-1186,1215-1215,1240-1268
ttcaatcggctagtgctttaaggttttgtctttgactttgcttcggctagtgctttaaggttttgtctttgactttgcttttttttccatttatttcaatcggctagtgctttaaggttttgtctttgactttgcttcggctagtgctttaaggttttgtctttgactttgctttttttccatttatttcaatcggctagtgctttaaggttttgtctttgactttgcttttttgtccatttatttcaatcggctagtgctttaaggttttgtctttgactttgcttttttttccatttatttcaatcggctagtgctttaaggttttgtgttttgactttgcttttttttccatttattccaatcgaccacgttaattcattctctatacatttagtgtcttatttcatgaaattatattaatttaattttaaataaagaggcaaatttttacagaaaataaatagacgctgactaattagctaacatttataaagaaagtagaaatttgattaaatgcatatacaatatacaaaatattacttttttaaatttgtataaagttcctattttgtctttgactttgcttttttttccatttatttcaatcggctagtgctttaaggttttgtctttgactttgcttttttttccatttatttcaatcggctagtgctttaaggttttgtctttgactttgcttttttgtccatttatttcaatcggctagtgctttaaggttttgtgttttgactttgcttttttttccatttatttcaatcggctagtgctttaaggttttgtctttgactttgcttcggctagtgctttaaggttttgtctttgactttgcttttttttccatttatttcaatcggctagtgctttaaggttttgtctttgactttgcttcggctagtgctttaaggttttgtctttgactttgctttttttccatttatttcaatcggctagtgctttaaggttttgtctttgactttgcttttttgtccatttatttcaatcggctagtgctttaaggttttgtctttgactttgcttttttttccatttatttcaatcggctagtgctttaaggttttgtgttttgactttgcttttttttccatttattccaatcgaccacgttaattcattctctatacatttagtgtcttatttcatgaaattatattaatttaattttaaataaagaggcaaatttttacagaaaataaatagacgctgactaattagctaacatttat

SEQ ID NO: 78518 - DNA, 465 bp, Heterodera glycines
  Genomic contig location: Contig_ID=SeqID_14474; Location=403..867; Strand=-
  SCN-specific regions: Sequence locations=1-247,270-271,293-436
atgccggaccaaatgagatttgggacgagaaaattggaggaaaaaggtggcaaaaaagagaggcggatgaatgagaggcacttgacgaatggcaccagaaaaaggtaagacgaagagcatttctgtcgatcattcttactccatttcagaaggggaatcagccggcggcggtggactaggcgcataaagctataatttgaaaagtgcaagaaaatatgttttaatgaatcactaaaaaaatcaatggattaattttaaataaaaataaacagctattttttattataggtttttatgggcatttgaaaattgcatttaatttgtttgatacgttagcttacttcatttagcacgtcgctgatttcactcatgaacccgtcccaggcatcataagtggcgaaaaatgtcaccatacaaacgtcccatggctgtttggttttaaaatatttaattaaaagaaataaa

SEQ ID NO: 78519 - DNA, 196 bp, Heterodera glycines
  Genomic contig location: Contig_ID=SeqID_14474; Location=2468..2663; Strand=-
  SCN-specific regions: Sequence locations=1-13,35-196
tttggttttatgcatttttgttaaggaattttccaaaaaatgtcgaaatagtgacaaaacgccaaaatagtgatttttaactattttagtgacgaagtcgccaaaatagtgatttctagtgacgaaaagtgacgtccaaatgaaaaaattttaacgcagaaatgcgttttttgagctcctttcttcaaaacaattg

SEQ ID NO: 78520 - DNA, 275 bp, Heterodera glycines
  Genomic contig location: Contig_ID=SeqID_2215; Location=145..419; Strand=+
  SCN-specific regions: Sequence locations=1-275
atgctcctcgccttcgtttaccccgccttgatcgatttgttcacttttgtccctcattaccgtgcggaaggacatcgtcaaaaggcttgttttcgccttcttctgaacctttttcttgccagcgtcggattgtttggcatggtggccggtttatacgcgagcgtcagcaatttgataagtcatggatcgaatgaatgcaatgcgatgacgacgactgggacgccaactattatgtggaacctttataatgggacaactttgtctagcagtattca

SEQ ID NO: 78521 - DNA, 2868 bp, Heterodera glycines
  Genomic contig location: Contig_ID=SeqID_2216; Location=768..3635; Strand=+
  SCN-specific regions: Sequence locations=1-118,140-414,437-503,525 -588,610-1233,1328-1362,1495-1691,1713-1744,1766-1834,1856-1918,1940 -2315,2337-2648,2670-2868
atggccaaattgcgcaccctttgcttttacgttttaattctctttctgttcggcttcaccgtctttgatgttcaaaaaattgtaaattattacaaatttaaatttcgaattctgtcgttttattaattcattgtgtgctgtgccgttaaggtcttccaattcttagacgataacaaagaaacggacatgttcgtggtgttcaacgacacaatgacaatgccaaatgtttgtttgtcttgtggatttgttactgtagaaagtgtcaaacggttacagtaccattcagataactttttgcatttccaaaaaccacgcgtggagtcatttcaaaaccacaaatgtgagtgacagcgaaattgacgacattgtgcaggtgagacgatgatgaatccacacagaaaaggacgactgaaattggagaaatttaaaaaacaatggaaagggaatactgtatgattgggatgggactgtaatcattgcttgggcatactgtagtgggacgttttaaaagaatactgaatccatctagaggggtaccgtaatgagaggagtgaacgaattccacgaccaattatgaaggagtacggtattttatttatttaaatgctacagaaaggtctaaagaagatgagaaacaaaagcgatttcctgagcagtccctgggacgatctgatggtggtcgacgcctttcaggtgaccgaccgttcgttcggctgacagagaaaaatcgccgaaattccatttgcgaattttaagacaatttcttctctgaattcgatggaagtcgaaacgaatccgacagtttttgcgatgactgtgcaaaaaattgggcaaactcagcgaatggccaatgtccgaaagatgtggcaagtaatgtccttgttcagcggttttagcattttccgtgccatttccattggcactctcttccacacagaaatggaacgacgccgtcgcgcaaagggacgtcactttcgacgaatttaggcaaaaggtcggctcggaaacggtgaaacggtgagaaaatgccgtagagaaaaagcaaacgaacgaagcgacagatcgttgaaaaatttccaacggatgggcggcggcgccaattggaggcctatccaggacgtcaaaatcacttggatttcactacgccaaatgtgcttccagccgctatacagcccggacgaattcaaagaccattgaagaacaggtcagagaaagagagggcggtgcagaaacagagaaagaagggagagagagtaaaaggaagagagagactggggataacgaaagagaggaagagagaatggaaagaggggaagagagagagagatatgtgaatctagggaggaagataaagcagtaattagagaggcgaagaggaatgaaaagggatggaaaggggatttagagagaatggagagaaagagattaagagagggtggaaaagaaagataaagacagagagagggaggaaagataatgaaaaggaaggggaaaattgccatttttcttgaggatcaattcttcaaaatgcttatcgttcacggaaaagaatacgagtcgttggactgcatgagcatcgacttccacggtcggcccggggaggaggcgcgctatttggggccgaagggacggacgaacgatggcacggacggagacgtacggacgaggggggcaattgaatttgggttaaaattctgttttttcagctctgtctgtccgaatcacacgaaattgtcgcggaagtgaaagaaatacagactttgctgccgggcgcggaagaagcggaagaaaaatgcatggaatacgggggggaggagcagttcgggacggagttggagtgccatggccaatgccgacttggcctaattcgggtcagctaaataccatttttggttggctgatcagagaactccctccaattttgcaatttaaaatttcaaaaatggactttttgatcaaaaaccatcatccgttagcaaattgaaaaattttgtgaatgtttcagaaaatttgcaaatgcaccgctcgcactttggaaagcctcgccgattcggaaactctacagaattttcccctttgtgactatgcgaaatgcaatttgaagttaaatggaaaaaaacaattaaaaagggtaattagtgaaattaagtgccaccgaagaagcattggaaaattgggaagcgacgctgaaaaattgcacgacggagtgtctgccgaattgtagccaaatcagattcagaataagcaaaaagacgaaaagcgcacagagagacggtgagaaaggaaaagcgaagggcaaagaaagggaaatgaggaaaagcatttcagacagcacagaagtgaagctgttctggggctcgttcgagtatttgcgactgatccaaaagcagaaatggtccttcaacaaattcgtctccaacctcggcggctctttgggcgtttggttgggcctttcggtggtttccatcattcaggtcgctgttttcaaagagcaaatgaatcattttgccatttttcaatttttggcttttcattttgccatttttcaatttttggcttttcattttgccattttcccttttcagttcatttcttttatgctcctccgactgcacaaaatgatgcacaaagaaagtgccgtcgaaggcgaagaaacggagagacagaacgaaccgcgtgaaatgccctcgccctcccgcgccggcggagacaccgaaatttcgatgagtccgatggacggcggcggagggcagcggaagaagcgatgatcggctaattatgcacactaatgggatatatgacgtcaaagcagtcaaacctaaacaccaattcatgccatcattaggggcgactgatcgataaaagaaa

SEQ ID NO: 78522 - DNA, 223 bp, Heterodera glycines
  Genomic contig location: Contig_ID=SeqID_2216; Location=1..223; Strand=+
  SCN-specific regions: Sequence locations=1-223
tcggattgtttggcatggtggccggtttatacgcgagcgtcagcaatttgataagtcatggatcgaatgaatgcgatgcgacgacgacgactgggacgccaactattatgtggaacctttataatgggacaactttgtctagcagtattcagtgatcgcccttctgtttcatttgtaaatatgttgtatttgattgtctgtacataaacatatgaataataaa

SEQ ID NO: 78523 - DNA, 1083 bp, Heterodera glycines
  Genomic contig location: Contig_ID=SeqID_2216; Location=5303..6385; Strand=+
  SCN-specific regions: Sequence locations=1-163,185-218,241-352,374 -436,459-838,864-949,972-1010,1072-1083
atgttggacctgctcaactcattatgcgaaacaaaaagtgccattgcgacgaattgcggcgattgttcgagtgaatggacacgcgcaatcgaagcatggaattcgttttgcccgcacttggacgaagcacaaaatgaacgggttttgggtagtgttgaacgatggctgaaaggggaggaggaggtggtgccggacgagaactcgttgatggagatgaatttggaacatttggtggagaaaatggagccgtacggagatgcacagctggacgggggagacgtcgcactgctgcacaaaatcggactcgaattggccaaggcaaaggaggagaagcggctggcaggaagagtgatgacggctcctggcatttgggatcaactctcgaacatttgcattctgatcggagggtttgtcggtcgggcacagaccgcgactgaaaagcagcagatcacggcactgacaatgtgctgggagaacgcactctgtggccaattggaagagatttatgtgagtgcggtgatgaacgcgttggagcggtggcgcgccggggcgaccaatggcaccgacgcgggagtaatcattggaggcagcagaaaggcactgcaaacgatgaacagagtggcgagcgaagagggacaacacaatgagcggcaaaaaacggccatttcaaagacagagatggcattgatcgctgaattgggggcatatttcgcggaagtgatcgaagcgcagagaaaggcgggggcccaatggaaggagatgagaaaaacggaaccgatcgttggcatggacaaaatgctgaagaaacagtgcaaaaggtcagtcggaaggaccaagcaaacaaaagagagaatttattgtttaagttggacagaatttcgccggaaaattccgccagagaatcggaaaatgttcattagttggtcaaaaatttgtaaaactatgaatttaaaggagacgaaaaaagaaaacaatgagcaaattcgggacaaaatggaggaaaatatattaatgaaaagagaggaagaaaaaaaggaaaagaaaagcacaaagaagagaaaggatgaaaagccgaacaattaa

SEQ ID NO: 78524 - DNA, 1097 bp, Heterodera glycines
  Genomic contig location: Contig_ID=SeqID_2217; Location=829..1925; Strand=+
  SCN-specific regions: Sequence locations=1-1097
atgttggcggcggctgaccagcgacaggacgcggacaaaacggacaacacaccgcagggaggggcgccgctgatgagccaagtgagtgaggggacgcatccgcaaaaaagggacgagaaaaaccaattcgaaatagatatcaatcgctttgtaccttaacgagctcggcatcttgaaaaaagcttgcacctgggttccatattggacctggacatggacccaggaaaatccaggccttggccatatccatgccaaactaataatacacctcaaaatatttatggttatttttgaggatcattttgggttgattttgtttaggtgattgcccagaacattgaggaccgactgatcacttactgtcaaatttacgttccgatcaggcgattttcaactgcttactacgcacactttcggcatttttgcaacgttgttgaataattaattataaatggtatgttaaccaaacattttcaggtccgtaccttcgcctatttcaaactttcgttggcgtacggcgatgatcgcgaaatgctttttgttttggcctggcgttggcagaaatattcgctttgcttcggacaggcgcctgtgcccgcggggagcgcgtgggacggacgaaaagcggcgcgacggtgggaaaggggggaagaaacagccaaattcaaaagcgaatgaaacacacgtttatttaaggggcatttaaagaaatccatttcatccgccctttcagttttttctgattttgtgcccctcttaaaggcgttggaatccgcatgtgctcgtcactcagtcgctcacagaacgtttcaaccgcgacaaggacctgacttggctagttaattacctggtatttaaattttcttgcattttgaggatcattataattgtaccactaataataccaaaaaggagatattttttctaaatctcatgggggaggggacttttatgacaattcataaagttttaaacaaatctatcggggtttttggcgtcgcttatccgagacagaaatccatttgataaattccgaacgaatatgaaacttatttttattttgtggattttcttttagaaattatgaatcggcatta

SEQ ID NO: 78525 - DNA, 139 bp, Heterodera glycines
  Genomic contig location: Contig_ID=SeqID_2217; Location=2876..3014; Strand=+
  SCN-specific regions: Sequence locations=1-139
atgcccggcggatccttcccgccccttcccccgacgacgtcagccaccgccaaacccaccaaacaggtcgttcgttgttcattcattcgttcgctggccgcccccattcaatcgcccgtcgatgacatttcatttctct

SEQ ID NO: 78526 - DNA, 2012 bp, Heterodera glycines
  Genomic contig location: Contig_ID=SeqID_2218; Location=790..2801; Strand=+
  SCN-specific regions: Sequence locations=1-1059,1088-1480,1508 -1628,1651-1953,1975-2012
atgatggaggacgatgtccgccaccaacaacagcagcaaatgccgcgttttgctggcaaattaattggcgacggtggcgaatgtcgcgatggaagtgccgaaggcgccgcccattcgatacatttgaaacgggaggaggaggacgccgcgggagccgaacaacagcggcagagggaagaagcggaagacgcggcggatttgggcgcggacgcactcaaagcacggcgagcagcgcggcagcggaaacgcgagccggtggtggtcgggtggcgcacattggagaaggcaatgcgaacgacggccgaaggtgggcgacagaagggggagcaacagacaatgtacacggccagggggacaaaggacccaaaattaatgaaaaacaattggagtggggagagagaattcaaattaaattattgtaaatatatgtggtaaagtcagaaatatttttccaaattgttgctaaaaagaatttcattcgtttccctcaaattcccaacttcgctgatttttcagattgggtttaatttttaggacgggccaaatttagaaaaatatacgcttacaaattgctaatggacatttttatgatgaaatctgcttcaatttttcctgacgcatatcgacacccctccacagaaatttgttgaaaaacatcccgcaaaaaatactaaatttttttggattttgaagaaaatctgaattttgcttaatttgaagcaagctatgattttcctcaaaattttgcgaaattccttcaaatccccgtgcaaaaattgaagcattgaactcccccaccctcatttttgtattcataaattgaacttgatgaatttactttgaaaagtgcagacagtgacatgtctccgctggagcaattccttctcggctccacgctgctctcccgtctctgttccttcttcgaaatggcatttgccgaagcacagcgccaacagcgcgggaaattcaaattgccaatcaaagactacggagttggcactgacggagtgatgagcgcgacatttccgaggtgattagtcccacaaaacaaagcgattgtttttttttaaatttaaaaacttaaattgattgaaaatgaccaaattgaatcgggttttaacctaattttttttaaagaaaaccaaggggtttacgcacccggtttttagttcgggatttcttcgatttcattactctattcattcatagaaatccctattttgctttttgttcaattcggattaggttcgaaatggatcccaacaaaatggttattcttccatctgaaaaatctccaaaaacagacagtttccaaaaaacattcggcgctgtactttcaaataggaacgtgccgaacccgtcccttttttgtccatgctatctgatcacttttgtatcgctctctgctgtccttcagttaccccatgcccccgtccctcgcttcttcctcgctgcccaatgcgctcggttcgcccggtgaccattctgtccaccagcagtttcacccctccacccattgtatggttcgtctccaactgttcgtctgtccgcagcagttccgtttggtctccatgttggactatggttgtgtgtctcttcgtcaccacttttctttgtccatgtatcttccacccaatgccattttagccaccggcccccaatgtccggctgagtcggacgtgcgcattttcgagcgatttttcgcccgcgaagtcgtccgtatgaacaacgaattggccgtgttcgctttcgtcactctgtgccgtttttgtcacccgccaattttcgcctcctttgcccaactgatgatggcccaaatggtaagaaaaaaggccgagcgctgtttttgatttatttcgtattgcaaaaaggagtcccaaccccggtggccatggcgtgtcgaattggaattggtacacaacgccgaggaatcggcccaacccacgggagccaactctcatcagcagcagcagaagacgcaaaagatcgtcaaaaacagcattcaggcagca

SEQ ID NO: 78527 - DNA, 832 bp, Heterodera glycines
  Genomic contig location: Contig_ID=SeqID_14477; Location=33..864; Strand=-
  SCN-specific regions: Sequence locations=1-646,679-832
  Gene Ontology: Mol. function=ubiquitin conjugating enzyme activity; Cellular component=proteasome complex (sensu Eukarya); Biological process=chromosome organization and biogenesis (sensu Eukarya)
atggatgacggcagagacttgtaccattggaaggcctccatcaaaggaccgcccgagtcgccgtacgaaggaggcaccttccatttggacatcgttttccgtcgcgactacccattcactccgccaactgtgaaattcgacacgatcgtttaccatccgaacgttggagaaaggggcgacatttgtttggacattctgaagcagatgtgggcgccgtcgttgaccatttcgaaaggtgaaatagcagacaaaacgccgacaaaatatcgacaagacaaaacgaccaccaaaaccggactttttggaaaagtgtcgatcttttgtcgtgtgaaaatgggatttttcaaattcggaaatgccgttttaatccttatcccctctccatttcagtgctgctctccatctcttcgcttctctgtgacccgaatccgaacagtgcgctgcggcaggacattgcgactatgtaccgcgacaaccgcgaggagtacaaccgaattgcccgtgaatggacgaagaaccacgcgatgagatgacacgacaaacgaccgatggatgggagaggatgcagaagacaaccgccgaagagggaggaggacacattcaactgaccctattcccacatatgatcccaactgtaaagattgtattattgtatctcactgtatgtacagtattatgtcgcctggttactgtttaagcgaccataattgtctgttgttggttgatcaccattatcaatgtgttatgtctctgtgttatcatttcaaatgacttgtgatcaattgtttcgcctaatatgtattaactgtgatgaaacgtgaattttattaaa

SEQ ID NO: 78528 - DNA, 1117 bp, Heterodera glycines
  Genomic contig location: Contig_ID=SeqID_14478; Location=1..1117; Strand=+
  SCN-specific regions: Sequence locations=1-636,661-688,710-1117
  Gene Ontology: Mol. function=microtubule motor activity; Cellular component=kinesin complex; Biological process=organelle organization and biogenesis
caaaaattcaccagcaaaacgcacagcacgagaactcttcccctttctggtcgatttggccggaaggttggccttttttgtttggcatttaaaatgaattaatcagatgccattctgatcagtcaaaaattgttgtccaattgatttttttatttttatggaacagcgaacgactcaaagggatgccaaatggcggagaaaggcagcgggagggcatccgcataaaccaagtaaaagtgggcagcagccaaatcatccagaaattaactttgctgatcattgatcactctctatgtaattacccatcaaactttgtttgtctaatcagctaaattgtccggttattcgtttctctgagcatattttctgatcagtctgatcactttgactgtcccattcgttgatcagtccctctcaacattgggccgagtgatcaaagcgttgtacgaccgccaaaatgggaatggcacttcatctcagcagaaacaggtccaccaatattagcattgatttcgtttggcaataaacttgcgcagattccttaccgcgactctgtgctcacttcgctgttgaaaaacgcttttggcggcaacagcaaaacgataatggtcagtcattgtcagtggacgacggcacagcaaagaaatgaatgaatgaatggcacccatttttaattgtttggtaccaaatgccaaaatccagtgcatttcggcaattttatgaaatgccagataatttgtcattcattagccaatcactgatcccttcccctccaatcagattgccaccatttctccggctgatctccattatgaggaaactctgagcactcttcgatttgctgacagaatgaaagtctctttctgaaccccgagaacagttgaaaaataatgccaaaaatgtaattcaggcaatccgaacagtgcccgttgtgaatgagtcggccaccgagcgactgatcagaacaattcgatcggagaatgatcggctgctgcgggcgttggagcggggcgaattggaggaagtggcggaaaaggtggacaaaaagcgagagacaatacgaaatttaaaaaacgaagcgagtcaatggcacggtcaaaccaaaactatttgttgg

SEQ ID NO: 78529 - DNA, 1714 bp, Heterodera glycines
  Genomic contig location: Contig_ID=SeqID_14479; Location=459..2172; Strand=+
  SCN-specific regions: Sequence locations=1-222,260-329,382-840,862 -1223,1246-1528,1550-1714
atggttgggctatccaccaatgttcaggaaatgagtgcgatgagtttgggcgagttggagcagtcactgaacgcgtaccgggaggagacgccgcacctgtggaatttgaacgaagacccggcactgagcgatgtgattgtgcactttttggagaaaggtggcacaaaggggggggcacaaaagaaaaattgggcggaatttgggccaaagcgccgatgttggcaaaattttaccaaaacattaaacatttggggaaaaagagaagtttccgccgcaattgattcaattttttgctttcttttttaatttcctcttaaaataaccaatggattaattttgtttttcatttttattaaaatttaaaatgatttttgtatttttgtgcttcaggagacaacaaaatcggtgcgttattttttggctttgtttttgattttacaattcattttccaatgcccagggagtgggcaaaatgcgcaaattcaactcaaaggaatgagcgtaagtttttaatgagttaattagtaccgtggcttaatccaacactcgagtgaccaagtaaattaatgatggatccatcagattctgcctgatcatgcgttggtccgcaacagagaaaacaaacggatcactttgatgccgttgaacggatcagaaattttggtgaatggcaaacgcattttgacggagagggaactgcgacagaacgaccggtagatgaacagctcaaaggggatgagagggaattgggtggatttaatgccattcgtcactttttttgagcattcatttcggcgccaaccatttgtatgtgttcagcaacagaagggagaggaaaagggaagcgaaggaggggaaggagaagatcagttacgaaatggcacaaaaagaaattgcgagacaaaatttgaaaagtctgtcagaaatggcagacaaaaagtcgaaaggtaagaaaagggatgggaaggccttgccctttctcggcattgccattcccgccgatcattgaccgttggctgatcacttttttgcgtctgatccgttcatccgtttttgatcagatgaattggtgctggaggaggagttggtcagtgttttgccgtacgtttaccgggccaattcaatggcggcggaactgaaacaggcgaaacgtttcgaaattgtgctgatgccacaggaggaaaagggcggcaatggccgaggcggggcattgacagaggcaaatttgggggaaaggggaaaagtgagggaaagataagcaaatggaggagagataaagcatgaacaaagggaagccaaaggcaatgaagcaaaaacgatgttcatagaaaaagccgattttgctgatcagatcagtccctcccccttgggtttaatgggcttttttctgatcacttagacaaagtgccataattaatgttcgacaaaagaatcgaatgaatttaatttaccaaaggaaaaaaacaaagttgatcattaattggtccgtttttgcaacagatttgggtgaaagtgcacgacaattcggtggccggcagcagcagcagttcgctgtggtgagtggagaaaaaagtgccaaaaatgccaaattccttttttaagggacatcagccggtagcgaaacgaaaaacataactttgtccacccaaaaaatgccatccaattgtttttcaggttcatgtcccgttactaccgtatgcaggtcggacactga

SEQ ID NO: 78530 - DNA, 1369 bp, Heterodera glycines
  Genomic contig location: Contig_ID=SeqID_14482; Location=404..1772; Strand=-
  SCN-specific regions: Sequence locations=1-168,225-253,296-482,598 -1141,1163-1203,1282-1369
tccgctgctccggcgcgtgaacggaacgcggacgaagtgctcggagaattcgatgccaatcgaattacggcacaacgcgccaaattggaactgcgcattgacctctcccgagcgtacaaatcgttgctgacaatgacaacgacgggcgaaacagcaatgttggacaatgacaacagaaacaacaaaaacagacagaggggagacggaggagcagagggaacagcgccccggggaacaatgagaaaagtagggaaaaaccccaaaagaatgcaatttaatttaacaccaaattaagctgatcggaattgcgaaccgttgggagcatttgaaagaaacgaataacaaacgaacggatgaggaagagggacggacggacaaagaaagtgtttctaataatgaactcaagaagttgctgacaatgaacagacggatgagtgccattcgaacggttgtgctgatcgacgaggaggaggacaatgacggagagcaaaggggaaatggagaggaagtgagagaagcaaagagggacatagagaatagactgaaaaagaagaaactgtcatagagagagtgaaaaagagagagagaaagaaagggcgttacagatggacgacagataaaaaaacctaatattatttctttattgctcttttcagtaccacaacgaagcagagcgacgcaagaaccaaattcggaacagaattgaacatgagtgggtcagtccgtacgacaactacgtgctgacggcaaggcagaaaacggtaactgattttggagatgctgtgggaatttgcggaagtcgtatggtttcgatggttttcggatcggtgatcacgaatctgacattgaccaatttctaatccctgttaaaaaattgcaaaccaaagcactcctccttggtttttaataaatcgtcaaaagtccactctttgcaaggagcgtcgaatgtgtaatcactaaagaagagtcaggacagattcttttttttattcatttaacatttttgcagaccaatgcccgtggaacagatgttaatgggaacatcgttaatggggggaccattcgggccacgacaattgttgagaaactgagcaaaaagagaacgacaaatgaatggaggacgaacgatggaaatacggtggaagagacagtggaggaagagggggagacgcaaaagacgaagcgaaaacgctactcacatttggacgagagagaagaggaagcggaggaagagaaaccgacggtgaaaacggaggaggagggaatggcggaggatgacgaaatcattgtgatggacgcggaggagcgcacctttttcgccgatccggcaaatttgacgcggaaggcacgcaaaaggcagcggaagaag

SEQ ID NO: 78531 - DNA, 591 bp, Heterodera glycines
  Genomic contig location: Contig_ID=SeqID_14487; Location=16..606; Strand=+
  SCN-specific regions: Sequence locations=1-204,226-395,421-591
atgccaggacaattccgaaaaggaaatgtttgcgtgatgcgtgggaatgaagttgtgtacgtggcaccggatcacaaaaccttggatgcaattgcaacgcaatttaaaaaaaaattaaatgccggttttaaagaaatcaataatccaaaggaggacggtccaactctagcagcatgggcgcattatatgtttgtaagtggaatttttaattttaacgttttctaacctgagaaactcagtatatacctgtattattttctgtattcttccgaggtttactatcaaaccactcgaaaaatgctaaattttcataaaattccgacttaaaatttcggttttttaccaggtaaaagcgcattttttcgatgggaatggaagaagtgctcgttgtattatgaatatttgttttttaaaaatgaatctcgaaccacttgtgcttgatagcactaccagaaatgactataatgaagcgttaacgtgtgatgatcactttaaatttgcatcatttattgacaaaatatggaaatccaaaagttggtttcgtctcaaatgaactaagcattctcacaatccctgtcttgaatgctgaaa

SEQ ID NO: 78532 - DNA, 2505 bp, Heterodera glycines
  Genomic contig location: Contig_ID=SeqID_14488; Location=440..2944; Strand=-
  SCN-specific regions: Sequence locations=1-152,202-375,399-497,523 -837,876-887,929-942,964-982,1005-1028,1051-1335,1357-1436,1459 -1459,1481-1523,1549-1608,1635-1692,1714-2039,2086-2249,2295 -2386,2408-2461,2499-2505
atgccaggtgtgccaaattaaaaaaacaaaataaaagttaataaggcggacattgcatctaacagacaaagcgtcgaatcaataaataagtcgaggttttatagagctattaaataagggaatagagatgatgccagtccgagatcactcagataaaaaaattatgtaaataaaaatattttttgaaataaataaataaatgatggatgaatttaatttttatgttttttttcgtgtgagaatttttttacgttttttaattcaatgaaaaatttaattttctataccaacggaccaattgccaatttcaaaaggcattcaagaaaataaggatttattcaattttcgtagcggtggaaaatttttttttttaattcaaggaatttaatagaaaatttcagcattaaaaaaaagatttggaagaattttacaagctcattagtgtctttttcatgatgagcatttgtctctggtagatgatagtcggtttttaactgaaattttaataaatttttaaatttacctaccattattaaggaagagacgtggcactgattggtgatcataaatttgcaactgaaagtgccattaaagaaaatccggattattttcgggaacgaaacgaggctttatatattaaagcaattgaacaatccgagaaaatattggtaaacagaggcggagcactaattatttggcacaaattttttttttagccaatttggcaaaaatattaaaaattccaaggcatgcccgctgagccagagaattattgaaattttaatgaatttttacgcaagaaattgatgaattttttggatatttaaatgatttgtctaaaaattttttaatttttagaaattttaattatatttcaaaaagcctaaaaccaaatgctttttaatttttcgcccccaaatttgcatttaaaaaacaaaaatagaaaatcatgacattttctcaaaatttttatgttatccaatcctttaaaaaatggtttttccaaatggcattttgacaaatggcattttttaaatatgttttgaatttaggaagaactgtttttgagggcattgaaccggtcactgttatcaagaaatgtttacggagaattaattacgcatgagcgtttttcatcatgggatgttgagtatcggatggatttgtacttcaccaatgtgcaaccattcctcgattttcctgttgttgagcaggaaattgagcgagaacggcaaatgcacatagaaaatcgtgtcacttttattggcggaatcacaatgccaaagggtgttgtgccaaaattgaatggggtaatattgggtttttaaaattattagcaaaaaatgtcatgaaatagacattcataataacctggactggttatccaggcctggtttttcctgggtccaggtccaggccatttttcggtaacttgaattttcaggatttttgtctcggaaatgcagcaaatattaaaaaatctagatccagattaggcacgaaaaaccctggattttctggataatattttagaatttgttatttcttgtgactttttttcagttaagttacctgaccgggacttaactggtcgtttgtccaggaaatccaggtccaagtccaacatggaaaatcgaaattttgttaagcaacctttcgcagaggcaagggtgttttcaggatggacttagctttataaaataataatttttagccaagctttagttttctggacgcaaataaaatgccaaattaattgttccacaggacaccaaacaaatatttaaatctggcaacagtgcaaatgaaaatggtggcgttgtgctgctcagttttggctctgtggtggagatgaatgatggcgaagcacacgcagttgcactgaagaacattgtggtggaagtgttcaagcagtacccgcagatgaacatgatcatcaaatggggcaaaagggcgccaattggcacgagcgaacagtacaaaaagttggcggacaatgtgtatgccaagagttggctggaacagtcggcaattcttggtttaaaaaataaatttgaaattttttaaattttaaatttaaaaaaagccggcgggctgaaactgttcatcacccatggcggacagaacagcattaatgaggcagtcaaaagtggcgttccgctgattttgttcccattctttggcgatcagtttaacaatgccgaggcattggcggcgcgaggggtggcaaaagtgattggtaaaatgccaattttaaaatttaatttcttgttttaaatttgttttaaatttttcagacattcgctccaaaacattgaaaaatgattttgcggatgcattcaatgaaatgttaacaaattacacggagtataaacaaaaaatggacgaattgagcacaaaaatgaatgcggttgagccggaaaaagaatttattgaaaagtttcgacaactcagaaaaagcatttaattttcaaaaatttttaaaataattttaaaatgaataaa

SEQ ID NO: 78533 - DNA, 488 bp, Heterodera glycines
  Genomic contig location: Contig_ID=SeqID_14489; Location=456..943; Strand=-
  SCN-specific regions: Sequence locations=1-147,175-488
atggtagcaaaagaaggtattaccgagacacattatgttctgcatcgacaccttgctgaactgctagcagccgacaaagaaaatgttgagcaagtggtaaggctattacacaatttcattttcattcattacagtagccatttaccatatattttcattaatgtttatttttcttcgctaatccttcaattttttcgtgtcgtatcgtatccctttcattaaagtattctttaacaaaacagtaatttatgcatcccatattcagcttcttctcgtccatgaattggactgtgccgagccaactgaagtgccaccaaaatttgatgggcgccttttggtgtggcaccggatgacttttgattgggccgatgccaaaaattgtacggacgcggttcttcagcatagacagcgtgaaagagagcacaggcacatttgggagggtgcaatttttttgccaaatccgaacaaaccaagcgtctcaaaattaa

SEQ ID NO: 78534 - DNA, 1681 bp, Heterodera glycines
  Genomic contig location: Contig_ID=SeqID_14492; Location=138..1818; Strand=+
  SCN-specific regions: Sequence locations=1-332,357-427,488-1304,1329 -1538,1574-1681
atgtacaaaattttcaaaatggtagaagcaaaagtattgggaaaggtcgacaaattggcaaaacaaagcgaaaatgccaaaaatgaaaatgccaaaaatggaaatgccaaattggccggcgtgagaatgataatgatggcaccggctttggcattttcggtgccggaaactgttaccgccgagcaaatttgtgacgctattttaaatgggccattgtacggattgtccgatgcggtcagtttttgttaagtgctcgcagtttttcgagaatttaggaatttttggttgaacgattaagccaaattttcaaaatgaagcgctattgaattttcattatttttttaaatttaaaaattgcctcaaaagccgcgaaattcgctactttaggataaaatcttaaaaaaaatcgtgtaataataagtcgtagaattttttatcataaaaattatgaaattcaataaataaaatgaaaatttttttttttttagaatcatttttatggccatcaaatatagcaaaaattcaaaatttcaaaaattctcagtctgcgcttaacagccaaacttccttaaaaattttttacgaaacggactcttttgctacacagattgaggacgaagcactgcttcatttcgtgaaaggccgtagggatttaaacaaaatattgacccatgtgaattggattttgccaaaaggggcatcgtcacttcgttacacagtaggaaagcatattgctgagtttgaaaccatgctaagtctactgtatttgatgcgcaagcgttggcattgtgccaatgccaaaaagcgcgtcgccaaaatcggcattgaatgcaccaaattgcgccaatacgtggacattatgtatgaatatttgttccgagtgcgctacgcaaagccggcagtgatgccgatgttccaaatgcgcggacctcgattgtaattattaactaattaaccattaattaatggaaattgcaggccccactaattagtagtgataaattaattacaaaaaattaacacttcaagattttttgattgtttaaaaattttcataaattcactttcagggagggttagtaaaaatgttaattaccggaacataactagaaagaatagaatttaaaagttgaaaatatttacctactagtttttttcagaaaatttcaaaaattttgaattttttggcaacaaacatttacatgttgagaatttttgaaaaatttgatcgaaaaaaatcgagtaaatgaaaaattgctttgcttgtacagcagggccccaaaaataagggaaactttggccaaattttatcttaaatttcagttcattccgccgaagcttggccagtatcattggcattttaaatgtcgcttcggcattttattttgcccagaaaatcgagcgggtggtagaaagtgtgatgccctggctacacacgctgaaaatactaaatgaaaatgtattgaattatggaggagcaaatttgggtaatataaaaacaaaacaaaaattagggggacatttggacattccgagcctaaattttagtttatttttatttttttgaaaattacttaaaggatttggaaaagtaaaagatttaatgcgatttataaaaataattcattttccaaaatgagttttccaaagctaatacctctttcagaaagtataaaactca

SEQ ID NO: 78535 - DNA, 88 bp, Heterodera glycines
  Genomic contig location: Contig_ID=SeqID_14492; Location=2043..2130; Strand=+
  SCN-specific regions: Sequence locations=1-88
atgacattccatgaaaatgttgtgcaaatggcgataaatgcgaatgacccagccgaacaataccgaccaagcgctgcgaggcttgaag

SEQ ID NO: 78536 - DNA, 2064 bp, Heterodera glycines
  Genomic contig location: Contig_ID=SeqID_14493; Location=2230..4293; Strand=+
  SCN-specific regions: Sequence locations=1-163,185-657,680-786,808 -1005,1027-1297,1329-1343,1367-1570,1592-2064
atgagcagcgcaaaacggagcattggcgacgccggcggcagcaacgacaaagcgggcacaagtcggagtccagcaatcggcaacaagcagcaaccgcaccatcagcaacacaaccatcgcattcgcaacaacacgagtaacagtcgttcgccaaccaaaaagcggagggaggaggaagaggggacgagagcgaaggtagcgacgaagaacggcaccgccggcagtggaagcaaaagtccacgacggcacagccaacaccatggcgggttgggtgcggcactggaggaaatgcgggagcgcaaatgggccaccatcgccggcccgtcctcatcatcgggcgcaaaggcacagaaattgtccacggcatcggcaaagtcggtcggggagaaggcagtacatcgccaacagcaccaccacaatgacaaaccggcgaagaaacgcgagacgaagggcggcgcacagcgacgggtgcgtttggttgggtggcgctttatattagttaatgtggtcaatgtataaatttccgctgttgtgttcgggtcgcgaccaaatccggagaattttctcagcccgcgagcatttcgtttcccgcgctccccttaaaaattttttttataaggtttcgtttcaagaaaaaaaattctatttttcaaaacctaaaaaataaaaaaaaatttttgaaaactcagttagatttttttaattttcggggacgaagcaacgaagtgcatatttatcggtcctttctttggttgacacagaccaagcaaaaatgcttcgatgatacaaaacaaaattttttgaaatgaccgacaattttttaaaacacgtttccgtttcagttgaccttcgccagcaatcacaaagccaatgatgacgacgcggaggatgacgacgacacggcggcgggaccgtccggcgccgccgacgctggcacttcgtacgcctctgcccaaatgcgggtgcttccgctgagcaaagtgcgcaccatcatggaggcgtcgccgaacgccaacgaaatgaaaattagcggcgaggcaatgttcgcgatgagcaaagcggcggtgggtgaagaagcattttagaatatgatatgtcacgaaacaaattgggcagagcaggtcgccccccccccccccccgaattttttttttaaatttccaagcagaaatttttattgattcccgggccggggggcgacaagacaaaaagtcgtcgcttggataaaaacggaaaatgcaccgaacaaagccctaattctatacggcctcagcctttgccaaaaataaccgctaatatttcaaaatgatttcaaatattcaaaaattcgtcaatatttttttataattttccaaaattaaaaaatggatcaattagtaattttatcatttttggaaagccacttcttcaggaggccttcatttcgatgcttgccaagggcgcttatcagcaaatgctcaccggcagtcacacacggatcaattacaacgagttggccatgttcgtgcatgacactgatgagctgaacttcatccaaggtgaggctccaatttttggaaatctctataaaaatggatgttttttgttttggcctcttaacggaggggtagagggccgaaatcggtcagttcctcccgccaactccgttccagtcaagcacagaacgccataaactcttcggtaatagtaaaacttagtccccccccacccaattttcgaaaaaaaaattatttccaacagatgaaaaatgtttccaagggttatcggggtaaaatgttttaatcaactaagtgtaatagcttctaaacattttgtagcttttcgaatgaagtcaattgaatggtttttcatctttttcatcaataaagacgaaatttatgctttaaacttggctggaatggactctcgggacggactgagccccccaatcggaaaagggtgttttttgctttgaaaatcccgcattataacccgccctcatgttttttaattttttcagatattctcccgcaaaaacacaaattttccgaggtggacaaattaatgacaacgaatcgacggtga

SEQ ID NO: 78537 - DNA, 640 bp, Heterodera glycines
  Genomic contig location: Contig_ID=SeqID_2219; Location=4190..4829; Strand=-
  SCN-specific regions: Sequence locations=1-200,222-308,330-330,352 -406,443-569,591-640
atgtgcagtgaactcgacaccgatgccgacagcggtgatcagagtgacggacgaaatcgggttcagcttgacgcccgcaaggcccatgaagccggccaactccacggtcatgctggccacaacgcaggtgacctgtgttgtttggggataaatggtaagtgatcagaaaaaggaaaaagcaaagcaaagaaacaaatgattaggaagtgctctgaatgagcgggaacgatcagaaaaaggaaattgtatgatttgatgtcagtgatgtgatcggatggtggaatggggaaagtgattagagacgagagaaataatcagaaataagttaaaaagtggacatgaaatgatgtgatcagaagaagtgatcggaaaagcggaaaagtaattagcgaacaaaagatcgaccatgtcaaaataaacaaaatatgatttatttgtcagaaacacatttagaaaggtttggagaatttgaatgaccaaaaaatttaacaaattgtatacaggagaatggggttggggcctcggccagacaaaaaaaaaacttttttttttttttgtaacaaaccaaagcggcgcccacgggttgaaaatgatggtggagataacgcagaagacggacacggaaatgatctaaaataaa

SEQ ID NO: 78538 - DNA, 418 bp, Heterodera glycines
  Genomic contig location: Contig_ID=SeqID_14494; Location=52..469; Strand=-
  SCN-specific regions: Sequence locations=1-1,23-99,124-226,250-418
atgtcttcttcgtccaccatttttgttcttctgctgataattgccatttgcctttcattaacaattgccatgccagcagtggacaatcaaattgaaaggtataaatttttattttttatttttggcattccatttttctttctaatggctgtgccagaccaattacggcactttttgacgccgtaatttcacattccgccaatttttaggaaaatttcggcaaaaattggaagttttatttcttaaaaattgaatgcttcaaaagtgcaaaaaaaaacaacctaattttataatttgaagatttttcaaaaagttttttgttccttttttaaattaaattttaagtgttccacttcggcaaaagcgttatggctacggcggcggtggatttggcggtggaatgggctttgatggctga

SEQ ID NO: 78539 - DNA, 1786 bp, Heterodera glycines
  Genomic contig location: Contig_ID=SeqID_14494; Location=1323..3108; Strand=+
  SCN-specific regions: Sequence locations=1-98,132-266,288-338,367 -417,439-953,982-1017,1039-1069,1115-1393,1436-1540,1563-1611,1633 -1718,1785-1786
atgcctcctcatttttgcatctttataattttattcaatctcatccaaatcacacataatgttccgccggcgggcctacgtggtggcttaagaggcggtaatttttaaaaatattttaataataaataattcaatacttgtatgagggggggggggtcaaaaaaaccatccaaatgaaaatattttttgatataactttgcttaaacgcaaccaaatttttaattcttcatatcattcggaatccctaatttgtaagtgttctctattattcaaaattttaaaaaagtttcgttaagttttaagaaagttatggcttaaaatgttcaaaaacttggtttctttatcttttcagtttataacttttttgaaacataagtaatttttttttgatatttttcagtataataggaaacgcttagggctagctaaaaataccaagataataaaatttggttcgttttgggcgaagttatgaataatttttctgtccaaaattttctatttgatggttttttgactaacgtcccaacccaaaaaacaccccaacaattctttccgatttcagtgttcaatgatgtttattggacttttcaaaatcttgaattttttaattttccacaccatgaagcacgccatgttgtgcttgaccaattatatttggaatattttatggagaaaaatgagcaaaatggaaatgaaaaaaggctaaaaattgcaacattcacccttttttatatgattcgatggaaaattgaacagaaaaaacaatttttattgtcaattcaaagtgtggatgaggatggagaatacacaggcagaacattatatgagaaaaaaaaggctgctataagagggtaattcatagtgctgaactcgagaccgagacttgacccccgagactcgagaccgaaagtcgcgagacccaaaaaactcgagacgcgaggcttttttcaaaaaattttcttattaatttaaaaaatcggttaaaactttcttaaattgaaaaaataaaaattttaaggcttttcctaacaaattttcgcttttttgatttattcaaaaatggtcaaaaaatttatacataaatatgtataaaaaattatgtataaaaaacccaaaatatgtaatttttttggggaaaaaattcttcgtaaaaggtgaaataggcacgaaataccattaaaaaatgaccaaattgggcttagaatcacattttagtatttttaaaattaacttttgatatatcttttttgaaggaggaaaaaaaacgattttaaagggtaaattttcaattattatttaattatctcatttatcgatatggtgccaaaaaagaaaacaaagcaaaaacataggggtcagcaaaaaaaaagtgattggaatttttataccaaaatttatttctttttttatttaaaatttatataaattttagcataatctgtgattatataaaagaagaaacatccataacaacattatgtttaatggtgattaggaaaaattatttgttggaagttttagacgaaaaaagcccaaattttaacaaaagtcacatcgaatcaccggctaaaagtgacgaatgttttgacgaatcagttgctgagcgcataattgatgaaaataatgaaggaattgttgaatggatgctcagcgatatgctccacttttttgacaaaagacagcgattgaacaaatatttggagtaattaaaaccaattaaatttttattgaatttaacacattttttagaataagaaatttatattattttaaaaatataca

SEQ ID NO: 78540 - DNA, 840 bp, Heterodera glycines
  Genomic contig location: Contig_ID=SeqID_14495; Location=2080..2919; Strand=+
  SCN-specific regions: Sequence locations=1-5,39-111,133-618,641 -761,794-840
atggacaaaatgctgttgctcttcctatttctgatcatcgtcatcggattgatcgctgctgacaaatgcaacaacttgtatgatgaatgaaatatttgtaaacaattttaatcacttgttttagtccaaggctgaatttcctgtcgcttcagcagcagcggaaaactcgagaatcgcgttgctgctcaatgccaacgagtcgcgtcatgttcggttcagaaactggtccttacgacaaaggcgacgtactttgttcaatttatcatcaaaaacaagtgagtcagtaaaaaaaattctgcataaatttaaaaaaacagaagaaaacattaaacccgtttaaaactttatcaaacaatttttttttggcatttcgtgccttttttctaaaaacttaactttcgtgtttttgaggttatttttgaaattccagatcatagacccatagggctatatttttttctttttttttgcattttttattgttaatttccaaatatggatttattggcggaaacccccaaaatatggattaactgttaaatttatgtatccattaagaatggcctaatgagcagatgcagcggagtgctgttcaacccttctcttgtcctcacgtgtgctcatttctgggaaaaggcagagaaagacggtgacggatcgatggcttatgcgggaatcgaggatggacaaagtgtggaggagggcgtttccaagaaggtgcagttttacaataacaaaaattactacccacttataattatggcaaaaacccccaaaaatttaatttttagttgaatgattcattatgcccctaaccttacccagctatttaaatttgaa

SEQ ID NO: 78541 - DNA, 1203 bp, Heterodera glycines
  Genomic contig location: Contig_ID=SeqID_14497; Location=549..1751; Strand=+
  SCN-specific regions: Sequence locations=1-128,150-265,293-1130,1197 -1203
atgagaaatcagtccctggtactcagttggcgctcggatcaaaaaacctatagttttcccgaattctcctcaaaaagttgtaagacccttccactactttcagacccgtcccattagccgttaagctcaaattagtttttgaaacgaaactccttgtcaatataacgtatatactagcgggtgcgtgaaccgtcggctatttagctgggaaaaagcgcttcgcgctttgggagcttcgctacctagattagctatcgggttgtgaaaagatttggaatttttaaaaaattatcagcgatttttaggccgcttcgcggcctcagacgggcgctacgcacccgttttttaaattcggtgatttttaggctgcttcgcggcctcagacgggcgcttcgcgcccgtttctaatttttgttgtgcttttcggccgcttcgcggccgttttttaaattgtgttgagtcggacgggcgcttcgcgcccgttattaaattttgatggactcagacgggcgcttcgcgcccgtttctaatttttgttgtgcttttcggccgcttcgcggccgttttttaaattgtgttgagtcggacgggcgcttcgcgcccgttattaaattttgatggactcagacgggcgcttcgcgcccgtttttaaatttgttggccttggacgggcgcttcgcgcccgttatttaaagtttgttggttcatacgggcgcttcgcgcccgttattcaaattttgttggccttacagagattagaagaggtacaacagtgattagaagaggtacaacagtgattagaagaggtacaacagtgattagaagaggtacaaaagtgattaaaagaggtacaacagtgattaaaagaggtacaaaagtgattagaagaggtacaacagtgattagaagaggtacaaaagtgattagaagaagtacaaaagcgattagaaaaggtacaacagtgattaaaagaggtacaaaagtgattagaagaggtacaacagtgattagaagaggtgcaaaagtgattaaaagaggtacaacagtgattaaaagaggtacaaaagtgattagaaaggtacaacagtgattagaagaggtacaaaagtctaacttgttatgagatgtacaaaaataatttcataattttaaatataattttatagaattaggtttatttaaaaatttaaaaaaaacaaaata

SEQ ID NO: 78542 - DNA, 839 bp, Heterodera glycines
  Genomic contig location: Contig_ID=SeqID_14498; Location=831..1669; Strand=+
  SCN-specific regions: Sequence locations=1-9,31-275,297-806,828-839
atgaacagcatttttgtcatttgcattgatatttatgatggagttgcgccctccccccttattttatccgaaaaatcgtgttttagcagtaaattaataaataccggtttatttgcagtcaccattctgattcaaggcatggcccaacaagtgctaccggacaattgtaaacagggctcaggtgaaattttcaaaaaatgtcacgagcactattgcttatttcataagttttcttaaaaaaaagtaataggacaaaatcactcatgatcaacataattaaatttaaaaatttgcacgaaatgtcatatattgtaagctaaatgtcgccaaatctttaagaacgcaattgacaaagcctacaatgccgcaagacaaatttatcaacaacggaacattggtggcactttctttgcggctaaacacttagagatcgtgttcgagccagctgactggccaatcagcggggggtcgtgcagtgctgcagcggctattgcgctcctttcaaaggccgaaaaggaactggcccgagttgacactgtggtgtcgggaggagtgctgccaaatgggccaatttcacatgtcagtggcctggagcttaagatcacgggcgcaagaaattacaatatgcgccggatactactgccaaccgcaaattttggagatgttgccgaattgccgccgaacgtaacaaatggcattgaaattgtttttagagcaaatatttttcaaattatggaggatatgcatttgtctatgacacaccttctggctgtttagtttttattgttgagaaaaatttaccgctttttattctggtttttattactctaatgcttaaa

SEQ ID NO: 78543 - DNA, 903 bp, Heterodera glycines
  misc_feature (758)..(758): n is a, c, g, or t
  misc_feature (765)..(766): n is a, c, g, or t
  misc_feature (786)..(786): n is a, c, g, or t
  misc_feature (788)..(788): n is a, c, g, or t
  misc_feature (796)..(796): n is a, c, g, or t
  misc_feature (804)..(804): n is a, c, g, or t
  misc_feature (806)..(807): n is a, c, g, or t
  misc_feature (815)..(815): n is a, c, g, or t
  misc_feature (827)..(827): n is a, c, g, or t
  misc_feature (833)..(833): n is a, c, g, or t
  misc_feature (838)..(838): n is a, c, g, or t
  misc_feature (843)..(843): n is a, c, g, or t
  misc_feature (846)..(848): n is a, c, g, or t
  misc_feature (884)..(884): n is a, c, g, or t
  misc_feature (887)..(887): n is a, c, g, or t
  Genomic contig location: Contig_ID=SeqID_14498; Location=2109..3011; Strand=+
  SCN-specific regions: Sequence locations=1-92,115-315,337-807,846-903
atgcggaaccggaatatggaaccagcccttgtaagaagcaatcaaacaaattttttatgaattttgtttgatgtataacagagagaagaaccatatatatatgaagaaggtaaacgaaagataccaagaatgaaattttggtttgatttgataaaaaacagaaataagtttggtgttgtgttgtgtacgaatcacggactaacaggcattgcagcgtattcatcggagaccatttcgacggcgatggcaccggcggtgtttgtgtcggccaggacaacggccggtgattgggtgttggaagaaaagtccaaaggacgagagacagacgacgaagaaactgttagggatgaagcgattttttttttctgaacatggcacgggtatgggataggccgatgtatccccggccgaaacgtcgccggatgttttcggaccattacttttttttgttgttaatcaaattacgctttgttgatgctttcgatagctatgcgttttgttagtgagttcgacttggacctggatttttgtccaggaaatcaaggtccaacatgagattaagtccaggcttttttcaaaatgtcgaacttatttaatttggttgagaaaaaatgatggtccaaaaactcgtctggcgacaatttcgacaacaatgttttgtcctgctttggagattataaaagcattatttaaaattacatatatcccctgcacaaaattttttttcattaaacatcaaaaaattccaatacctactnttatttnnacaaatttaaattcttatantncaaacatnctcccccnannaaaattanaatttttaaaanattttnttaanaaaanttnnntcaatttcacaaaatactcctattaaaacaatctcncanataaattttaaaaaaa

SEQ ID NO: 78544 - DNA, 264 bp, Heterodera glycines
  Genomic contig location: Contig_ID=SeqID_14500; Location=2006..2269; Strand=+
  SCN-specific regions: Sequence locations=1-85,107-216,238-264
atgagcaacctaatccggatggtactgggcccacaagtggcaattcttcgtcaacgagtaaacacggcacggacacatgtcgaccgtgaggaagatgaagaagtcaacaacgctgcgctgatggaagcaaaagtattgctgttaaaagtattgcagcgtgtggaagctgaactagcgaaatgggaaaacgtgatttctggacttcaaggacaagaaaaacagacagaacaagaacgactcgagacattcatcaacgaaagagaa

SEQ ID NO: 78545 - DNA, 1228 bp, Heterodera glycines
  Genomic contig location: Contig_ID=SeqID_14500; Location=1..1228; Strand=+
  SCN-specific regions: Sequence locations=1-693,716-1228
  Gene Ontology: Mol. function=calpain activity
cattttacgcgtcccatgacgttttacgcgtcccgtgacattttacgcgtcccgtgacattttacgcgtcccgtgacattttacgcgtcccgtgacattttacgcgtcccatgacgttttacgcgtcccgtgacattttacgcgtcccatgacattttacgcgtcccgtgacattttacgcgtcccgtgacattttacgcgtcccatgacattttacgcgtcccgtgacattttacgcgtcccgtgacattttacgcgtcccgtgacattttacgcgtcccgtgacattttacgcgtcccgtgacattttacgcgtcccgtgacattttacgcgtcccgtgacattttacgcgtcccgtgacattttacgcgtcccgtgacattttacgcgtcccgtgacattttacgcgtcccatgacgttttacgcgtcccgtgacattttacgcgtcccatgacattttacgcgtcccatgacattttacgcgtcccatgacattttacgcgtcccatgacattttacgcgtcccatgacattttacgcgtcccatgacattttacgcgtcccgtgacattttacgcgtcccatgacgttttacgcgtcccgtgacattttacgcgtcccgtgacatttttgagcaaggtcaccctactcccgcttcaccaattcgcatctcgtcatgtgccattgtttaggtctgcttggaaattgctggcttttgtctgcgttggctgtcatttctcaacggcccgacattctcgagaagttgttcattacgaaagagtacaatcatagaggggtctacgaagtcaggtggtgacaactttattttgatcataccgataatcggttttaaggctttgtattcacggaatttggcggcggattatcgtcgacgattttttcccttgtcatcggtcaactaaacgccaaatttttgcggtggggaggagaggccaactttgggtgtcgctaattgagaatgcacttgcgaagtataatggcaattatgccatcctgaaatccggactaatttcagaaggtataaataaatttagtggtttgggcggttactacatgcctttttttaggattttcaaccctcaccgggcagccaaccctttttatcgaccttgaatttttgagtgactccgactttgacatcgtttgggctaagctgttaagtgcgagacagctgttctttttgatgtcatgttcttgtggtgcag

SEQ ID NO: 78546 - DNA, 1511 bp, Heterodera glycines
  Genomic contig location: Contig_ID=SeqID_14502; Location=1..1511; Strand=-
  SCN-specific regions: Sequence locations=1-56,78-130,152-408,430 -515,537-651,673-950,972-978,1016-1092,1140-1511
  Gene Ontology: Mol. function=mRNA 3' UTR binding; Cellular component =Cajal body; Biological process=regulation of transcription, DNA -dependent
gagacggaggggaggacgagcgggaaaagcgcgagagataggtctcggaacggaacaccaacctgatcatcaactacttgccgcagaacatgacgcaggaagaggtggcatagaaagcggatgaatgaataaatgcccacgaacaaacgcagcccatttaaaacgttaaaaaacaatggcatttttagcttaaatgcctacttttaaaattgaatttttggattttcggattcatatcatgtgtttggcaattttttcactttttactatgagtttcgcatgtttagatttcatttttagtgttgccttccgttttatttgtccctctccgtttttaggtgcgcgcccttttcggttcgatgggcgaagtggagtcgtgcaagtaataacagacaatcatttccatgctttgattttaaaaactcattttgattaagattgattcgtgacaaatcctccggtgagtgctttttcctaccgtaccttttcagcattctctgctaccgtactcctccactttccttcccctctttccaccgtatcttttgcctctttccaatgcttttaactcacctcagtttcatcttctaaatttggttgtgtgttaaatggacgcgatgaatgctgcgctgtttttgttgtcgttgtttcacttttcttttcatttcctttggattttttttgtcctttcgttccggtcactttttccattgacttaataatcccccgggggaatgccatgccaagtcttttcgtattttccgtttggcattatccacccccccttctcccaattgctccctctttttcttcttccgaactcctcggtttaggccaatcgcttggctacgcttttgtaaattatgagcggccggaggacgcgcgaaaggctctgacctcaatgaacggacttcggctgcagaacaaagtgctaaaggtgagggcgaaggacggactttccttttcagttcctccgagtaattaagtaattagttaattaatcatgttaattaatgtttctgttctttgcgttgtgtccaaatcggatgatgggctgacaaacaatgaattattcttttttttccattttcattttgcttttggttttctttctatttttttttttgtttttgtttttgagtgccaacaaatccactcagtttttctcgttcattcaccgatttccattcgcaccagtgatatggaattccgatgctctaaaaaatttcgggtggcggaattccgtctcctcactgattcgattcgcacccccgggggcgttcatccccccgcccccctcccccgcccccaatttttgcgcttttcgttcttcccaatttgcccctctccgccacaggtgtccctggcaaggccctccaaagatgacattaagggcgccaatctgtacgtcagcggactgcctaagtctctgacccaatttgagctcgagtcggtgttccgtcccttcggcactattatcacttcgcgtattttgtccgacaatgtcaccg

SEQ ID NO: 78547 - DNA, 429 bp, Heterodera glycines
  Genomic contig location: Contig_ID=SeqID_14503; Location=447..875; Strand=+
  SCN-specific regions: Sequence locations=1-188,217-326,355-429
atcgatctgtcctcccattttcttatgtccgtttcgccagtgatcaatcgaatgctcagcgtggagatgaaggaaaagcagcagcggtcgctcactttggacgagttgggcatcgagatggagcagttcatggaatttgtggaagccatctcaatcactgcttttcacaagccaattctaccaaatcgtaattttaatttattattttttttatttgtaatggctaaaattttgccacaacatatttttggcaacaaaattcctcttaacatgaatatggatgtcattgatttcgatcaattttaaaattgaaatcgaacaaaatgtttattttttaatttttaatcattttttccaagatcgcaatgactgaatagatatcatattcttgatcagtaatgatttaattatttggcaaaatttaagaca

SEQ ID NO: 78548 - DNA, 2009 bp, Heterodera glycines
  Genomic contig location: Contig_ID=SeqID_14504; Location=30..2038; Strand=+
  SCN-specific regions: Sequence locations=1-118,140-355,387-441,474 -651,674-1122,1144-1556,1578-1589,1618-1954,1991-2009
atgaatgactcgtgtacaattcacggcaaaaaattcgattgctcatttgcgtggcttttggaaagatacaaactctcagacaaatttgcaattacggaaaagattgtggtaattaacaaaaatttgcttattttccatctgcaataagaattaattatatttcgaattttaattaaggtcaaattccctgggcatcaaaaatttgcctttgtggcgggcgccgataaaaaattttttccgtcattgaggagagtgatcgcaaacataaaaaaaaactttggctgcaaccaaaaaatcattttctatgatttgggaggggtgacagaaaacgaaaaatgggtaaaaacgtaaaaacataattaaataattataaaatataataaaatgaacaaagttaatgagaatttcacaaaaatcaaacacattttaatacaattgatcattttttttactaatttaaattttttttaattcaatgttcccaaattttaaggttgatgaattaaattcgatatgcaactttgaaaggcacgtgttcgatttttctcaaatggtcgatggttcggtgcgccgcctggaaacttacgcgtggaaggtgtttttactcgcggtaacaagcaatttttttggtaggggtcagttgtatgtctgagccaagcttaaaacatcataactttttccgtgttgaccaaattttataaatttagtaatcagtggaaagctatatgtttagaaaccgttgataagttatttctaagcgattaaacaactcataaaaatttgcaacaataaacccacaaaaaagtaaaccataaaaaagtcagaatttttgaatatttttatttataacttttttacaagtcagtttatctttgtgatttttgagaagcaacaaagaaaaaagttatgacggacgttttaaacttgtctcagatgcaactggcccgctcagatttttttttgtttattttaaaattccataagctttttttaattttaagcatgttttgttggagtatgacactgtcgtttgggtggacacgacaattatctttgacaatttcaatttgacggcgattttgacatcaatgaacgagggtagaattggaccagtacaaatgccactaggtggggcatggaaatttcacaaactaatttataagagttaattgttgttttaaacttggttaatttaagtcgcttggcatggcacaaacattgcaacgcatccgggtaaacaaaattgatttaaaaagggtatttttaaaagttgatgatagaagttaattagtgaaacataatgagtagagaaaatgaaaaactcaaatttgacaaaaaagctgatctttgctaagtcatttgaaaaattatgaataatttaaaaccaaaatccataaaagcttaaaacatgtaaaaatttacaaaatgtaagccttaaatggggcatttaacagatatagaatatacacaaggcaattatttcgaaagtcagtgtttttggaataattccttattaaagttccaaaattatttgtgtgttttacattcgttttatcaaaccaaggtcatgaaaatttgtggcctcacacaattaatattttcatttttaatttaaaagtccattcattttccaggaatgtacgaatttttgccaatgttcagcaattttgaggccaaaaatggaataaactgacaaatgacccaccacaattcgagtccgcccttatcatcattcacaaaagcgaacaaacgcggcaactgatgaaatggtacaaaattaacgggaatttaagccaatgccttaaaatttaatcccgtttcaaaaagtgatggaaattcaaattttgtaaaattatcaagagttttgacggctaaatattaacggcgggcatcgactcaataatttctaaggaaattgtgaaatttgcagggaaccgcgcgtcttggaacatggaaattttattaattaatattagattctaaaatataagccaattagcaaatttaaa

SEQ ID NO: 78549 - DNA, 418 bp, Heterodera glycines
  Genomic contig location: Contig_ID=SeqID_14505; Location=132..549; Strand=+
  SCN-specific regions: Sequence locations=1-186,208-262,284-351,380-418
atggctattgaacattcatttgtcggtggcccactgtttgcaccgtttcattgctttgctcgcccattttcaacaacacgagccttcggcacaatcaccggcattggcacaatcgccaccatcggacgattcagtaccaaatgccgtgccaatgccaacaaaatttgcgcaaaattccacggcaccaaacagaagcagcgaagaagaccaatgccagcagagaaattgatgaaagcaataagagatagagagagagaaaaggaccatttttaaaattaaaatgccaatgctggcacccaatttttgttttaagtatgccaaaatgcctaattagccttttttgcatttcttttaaattcattctttccatctttcgttgtatctgatctctaaattttttgaatattgttttatttca

SEQ ID NO: 78550 - DNA, 735 bp, Heterodera glycines
  Genomic contig location: Contig_ID=SeqID_14506; Location=292..1026; Strand=+
  SCN-specific regions: Sequence locations=1-61,83-104,126-222,263 -370,403-440,462-586,631-686,732-735
atgaccaatgatcaaagggcatataaaaatgacggcattttcaagggaatggcacaggtcagaggatggataggagagaatgttcgtctttggtggaaaaattgccgctgatgtgaccgatggacgccgaaatcagccgatttggcatttattaattaattgggggcaaaatacggacaccggcgagtggcgtcgcacttaaatttgtaagatttgaaattgttttttaaattttattttttgtattttaatgaaattttttgcaattttgcagcgggttaatacataatatgtacatagagcatgtcatttgtaaaacatcaactatattaataccgaattaaacaagaggaggaaaaatgagggagcgattaaatatttttatacaattttttttattaacctcccttaaattcattttttatttgttttttaaaagatacaataatcaaggtagaattaaaaaattataatgattaaaatagtacagaaaaaacagctgaggaatgaagaaaatttgaaatattaaagaaaaatgagctttcttctgctgctgaagagaatgagtcatcatttttaagttgagatttaatttaaaataatttaaaaatcaaattattaattttaaatgatggaacttattaaatgttaaattaatggctgaattcatgcaaaaacttaggcccaaaaataatataaaattaataattttataatttaatttaaaaaatgata

SEQ ID NO: 78551 - DNA, 594 bp, Heterodera glycines
  Genomic contig location: Contig_ID=SeqID_14506; Location=1040..1633; Strand=-
  SCN-specific regions: Sequence locations=1-594
atgccattttcccaaattttccccatcttttcacaggtgtctatagtcgaagataatggacattatgaacaacgatatttgtggactctggtgaagaagaaggaggacaatataaacaacaaccaaattgatgcacttgggcagaaattggacactctcatcgagaagattgaccaagacaaaaatgtgcaacagaaaagtgtggacactctcgtggaacaaaccaagactctcaatgacaaattggacactctcgtcaatgcaattagcactctcgtggagcaattagagaagaagagtgtcaaagtttcgctctggtgaaagtgatcattctgatcacaattgagcaaatgaatcggatgatgttcctgttggtttctccattttcaagtgcgatctttttaaattgtcccttttaaatggctttaaatgttggcgaaatttgccacataatttgctttaaagttaacatttgtaggcctggtaatgattattttatacagtttatccaataattgtatctaaggatgaaaaagcaatcatttattatttttttttgcagttgagagaaaataattcgcattttaaaataaa

SEQ ID NO: 78552 - DNA, 1253 bp, Heterodera glycines
  Genomic contig location: Contig_ID=SeqID_2222; Location=131..1383; Strand=-
  SCN-specific regions: Sequence locations=1-1,29-34,56-461,483 -1228,1251-1253
atgctagcctcggcttctcttctggtgtcatgttggccgcttctttttggtctttgctttcgccggccatcgaaatttccgaaagacaaatggccaaattggcctttgtcccagtcggtaaaaaacaaaaatttaatcttttttttctgattttaattaaaaatcagtcgaaaaataattcagccgttggatttgcgttgggtgccttttttgtatatttatccgaccgattaacacaaaagtgagcaaattattaaaaaaaacaatgaccaattaagttttaaatgttattattttaagtgctaattatgcattttttaattagtttcaatggcagcgctctctccgatcagataaatcaattagagaattggcattcggccaatcagcaaaatggaattcatagtgaaaatgctccattcgattttgaaacagaccgacagagttgagtcattaagcatcaatttaaaacaaattaatttgcattttacttaattaaccgatttaattgtgtcccttattaatcttaattaccatttaattaactcgtataattgattttaggagcgaaaatcccgaaaacgctggcgaattggccgcttcgttacgccaacgctgcgtaaaagcgccaaattcgaaagggatggccgacaaagagacaattcgcttggatggccagcagcagcaaaagcgctcacaagaacagtcgtggcatcgaattatgatgctgatcattgccataacggcacataatttccccgaggtgaaaaaatagaaaaaaaacaattagggagggaccttttttggttttttgcaattggcagttttttcattcgtttcccgtgccatccaattaattaattacccaaacaactgcccaattccaacagggattggccgtcggcgttggcttcggcggtgccggccggtcggagtccgttagcctggagaaggcgtcaaatttggcgctgagcattggcctccaaaacttccccgagggcatggccgtcgctttgcctctggcggcctttggccactccaaatggaaggcgtttttgtacggccaaatcagcggaatggttgagccaatggccgctctgatcggtgcttcgcttgtgctaagcattgaatttgtgctgccctacgcactttcctttgccggtccaattttggccaattaaattaatggctatttctttactaattacctaattaggcaaatgaattatcattatttactaattattaataaa

SEQ ID NO: 78553 - DNA, 287 bp, Heterodera glycines
  Genomic contig location: Contig_ID=SeqID_2222; Location=2230..2516; Strand=+
  SCN-specific regions: Sequence locations=42-42,75-142,178-197,238-287
attacataataactaatagcttcataagaaataacaaattgatttacaaaattcaatcacttggaatgaaaaggactttgtacaattttttaaattttgcataatttggctctttcattttttcaaaaaaggtttgttggcatttcttccgccgtttttctctgtcacttctttttgtcgtacgattgctgtatcattgtaagtgttaatctgatcagaaaaggagatttaagtgataagagtgggaaaaagacatgtcgcattatgccaatgacttgtggatactg

SEQ ID NO: 78554 - DNA, 1678 bp, Heterodera glycines
  Genomic contig location: Contig_ID=SeqID_2223; Location=1147..2824; Strand=+
  SCN-specific regions: Sequence locations=42-42,74-142,193-261,283 -292,318-647,677-795,834-1142,1172-1222,1244-1346,1395-1395,1468 -1528,1551-1577,1599-1608,1654-1678
attacataataactaatagcttcataagaaataacaaattgatttacaaaattcaatcacttggaatgaaaaggtttttgtacaattttttaaattttgcataatttggctctttcattttttcaaaaaaggtttgttggcatttcttccgccgtttttctctgtcacttctttttgccgtacgattgttggcccaagttgaagctttgctctttgccctccagaaaataggtggtcacttcacctttgccctgaggcaacaaaactttgatttgttgaaaatctgctgatcagaaagtattttttgccccacggattgatcattaatgatcagcaactgatcgtttaccgggaaatagcccacccatttcagtgagtgatcactctgatcagagaatgattaaggaatttctcataataaattgatagtaaaaaatgatcaatcagtcaatttgcttaaacaaatggcggctcactttgatctccactttgccacgttcgatcatcacaaattggtggtaaaaacagctgagcaaattgaacgaatgttcactgatctgaaaattaaaataacagcaaaaataaataaaaactgaaaattttttgcctgaattttattcggaagtccatgggattcctaaaaaggcaaaaaataaaaataaaaacaaataaatttggctaatgaaattggcggaccattcgtgaagcgaagttgacagtttcgccgaataagcagtagcgaggcgcttgcaagcccacctatgagtattattatatcatttcgttgtttcattgaaaaaaatgttaaaatttaaatgataatttatttatttgagtttggcattttgtttgtgccattttggcaaaccgaccactccggcagccaccggtccgctgtggaagccgatgcgcaccatcatcacctcgtccggacggtgggccaatttgaaattggcgacaaatgtgcgcattttcagcccaatttccgaaatgtggtgcacatgcgcgttgccattctcgcgcggcagacccgagacaatcatataagcatcgccaatctgatcagaaagtgggataataatgtgggaaaacgattaatgatcgaagcgaaggtttataatgactaatctgatcataaaactgggagatgggaggggggagggagatgtgtaaactaatcagagcaaaagccaaaaatgatcaatgagcggatttaatttgatcagcagtgaaagggacagagttaactggatagtgggctattagctgatcagagtgggataaatgagatcagaaagcggggatgggtcgaataaaggtccagaaaacgtgacggacgagcatctgatcagtgtaagtgttaatctgatcagaaaaggagatttaagtgatcagagtgggaaaaagacgggtcgcattatgccaatgccttgtggctactgtaatgcttgctggcacctaccgtttccactttgtacgcgtcgtgtttggcgatgatcgcatcgaaaccgctgaaaaggtcgttcagaaaagcgaccacttggatgggcgttgaagtggaggaaatgcgcgtgaaactgaacaaaaaggggtgggggattatttgggatttaaaacattaaaaaataattattttttaaattttaaatttaagatttgagtataaaataccccctta

SEQ ID NO: 78555 - DNA, 5607 bp, Heterodera glycines
  Genomic contig location: Contig_ID=SeqID_2223; Location=1617..7223; Strand=-
  SCN-specific regions: Sequence locations=1-1157,1179-1204,1314 -1626,1648-1791,1846-2194,2216-2414,2436-2446,2487-3329,3352 -3360,3382-3806,3830-3837,3859-4424,4470-4479,4501-4527,4550 -4610,4683-4683,4732-4834,4856-4906,...
  SCN-specific regions: Sequence locations=...4936-5244,5283-5401,5431 -5607
  Gene Ontology: Mol. function=protein tyrosine kinase activity; Cellular component=mitochondrial inner membrane; Biological process =transport
ttttatgcgtcccaaagaacttttatgcgtcccatggctttttttttatgcgtcccaaagaacttttatgcgtcccaaagaacttttatgcgtcccatggccttttatgcgtcccatggccttttttttatgcgtcccaaagaacttttatgcgtcccatggccttttatgcgtcccatggccttttttttatgcgtcccaaagaacttttatgcgtcccatggccttttatgcgtcccaaagaacttttatgcgtcccatggccttttatgcgtcccaaagaacttttatgcgtcccatggccttttatgcgtcccatggccttttttttatgcgtcccaaagaacttttatgcgtcccatggccttttttttatgcgtcccaaagaacttttatgcgtcccatggccttttatgcgtcccaaagaacttttatgcgtcccatggccttttatgcgtcccaaagaacttttatgcgtcccatggccttttatgcgtcccatggccttttatgcgtcccaaagaacttttatgcgtcccatggccttttatgcgtcccatggcctttttttatgcgtcccaaagaccttttatgcgtcccatgaacttttatgcgtcccatggccttttttttatgcgtcccaaagaacttttatgcgtcccatggccttttatgcgtcccatggccttttttttatgcgtcccaaagaacttttatgcgtcccatggccttttttttatgcgtcccaaagaacttttatgcgtcccatggccttttttttatgcgtcccaaagaacttttatgcgtcccatggccttttatgcgtcccatggccttttttttatgcgtcccaaagaacttttatgcgtcccatggccttttatgcgtcccatggccttttatgcgtcccaaagaacttttatgcgtcccatggccttttatgcgtcccatggccttttatgcgtcccatggccttttttttacggatcagtacaacattttttgtccccatttaaatatttggaacatttcttccccagtcactgatttcatttggttgtcactaataaatgttaaatgctcatttatcagtttcacttctgctaattatctctccactactccctctcctgctcacttctttgatcagttcgtttttgtttctgatttttgctttcaaatctctttatttgtccatatttgatcattttttgccctctctgatcattcctttttttctccttttctccttatctcttttttgatcaccttctctcctcctcctgctttttatcacttcttttattgtctctctgatcattccaatttttgctccttccgatcacttttcgaatttatttccgcccctttcagtggtcattccgttcggctattttctgtacgtgcgcgaaaaggagcgcatgctgtacgacatgacgtggcgcatcccgcgcgagcagatcaaactgttgggcgaaggcggcaaacaccagcgccgctccgacccgtcgctgggcaaatcgatggaaagcgcctccgccggctcaatggtcgcgaattgggtcagcagagagttgatttgactaaattcactcaattaaataatttaaatgccgacaaaaatgtcaaatgtttgttttccccttaagcgactgtcaacgaaacaagcggtggccaatggggttaagtgcgcgtgcaaacgctacctgcagacgcgcaacatttcgttcaacaaacacgacttgacacggctgaaggagctgaaggcaaaacgaaactaatgggaaattgaaattaaataaattaaaaatggaaattaaatttaaataattaaaaataaaaaaagccattttgaaatgtcagatgatggagaatgagaacctgaacaagttctatgggatcagcttcaatcagcagaatgaactcatcgcgctttgggtgctgtgccaacgcggcagtttggaggacgttttattcagtggggagatcaaaatcgggcgcaactcttcaagtgacctttgccaaagacgtaggacaaattgagcaattagggggcgcggaagagatgggcaattaatgggataaattggcaattagtgggacaaatggacaattagtgggacaaatgcacaatcagtaggacaaataggcacttagtgggacaaatggccaattcgtgggacaaatggtcaactagtggaacaaagtcattcattgttcccttctccccccgcagggcctttacttcctgcacaattcccccatccgaatgcacggctttctgtgcctccaaaactgtttggtggactccaattggaacatcaaactgaccaatttcgtcacggaagagatcatcggggacaaattgaagcacaacgaactgaaatacgttgacagagacgagatggaccaacaagaagtaaataaaaaatgaatggaaatttggaaattaaatttaaattaaattttaaaatttaaatttaaaacgaaaggcaaagcgaaagcgcgagaagcgggagcacagagaacgcgagaacggcacggatgatcagcagcaggagaaagcggaaaaggcgaaggagcgcgagaaacggcgcaaacggcgcgactcaatcgattcggacggagtgcgggacgactcggagatggatatggcggcgatcaaaatgcgcgagaaaaaaaacgcaaaaagtagttcaaattggcaatgggctgacaatgctaattgagggacaaaatgaatgggaagcagaattttgtagaatgatcagttagagggggggggggggcaaagtgatcggaatggggatggaattaggatgaccaagagtattcggaatcggaagatcggacaacatacaaatggccaaattgatcaattgggtgggcgcaagggtcaaagggatgggaaagagtgcgtaattaatgatcataaaatggtggggcagacaaattttggttggatgagtttacaattaatcgttttttgattgactagagattggatcgagaattcgttttcaaaaagattaatttattgcaaatggaaggaaacagcttaaccaattcataattctcattaagaactgatccaacaagcgccggagattgtccgcgaatatctcagctcaaagcatttgcccccggggacacccgcggccgacatttatagtaattggggcggaatgccattcaattcaaatccttttcccccattaatttgttggcatggcgatggttttgtaccaaattatgttcaaattggagccgttctatgagcgcaatttgccgcccaacagtgagcaatttgttattattatatgcgacaaaatataaaatgacaattaattagcctattaggaattaaaaataacggttaatttctttcaatgaatatttaaaagactattaaattatttgccaaaaaataacaatttcgattgcattttttgccgaaaattggtccatttttgcggatttaacggcactttctcactaatttgatgaattatgttgttcagaaattgtgtctaaaattgccatgtccaacgacaacgaccaaatcattcgcccgtcctttcccaatcagcaacaaaatttggcgcccaagcagcaacagtcgcaggaggaggaggagcaggcgtacaacttgcagctgctgtccgctctcgaggcgtgctggttggaaatcccggagatgcggccgaacatcaaacgcatcaaaatgatcgtcttcgccaaccttcgctcgacgggcagcggctcactggtggaccaaatgatgaaaatgatggaggaagtgagccggagggagggggagggggtaattatggctaattaacattgtaattaattgcccatttggacaaaacaatgggtggcaaaaaaactgctaggacagcgcagcagaaggtaatgaatataggaggaaatgtgctctataatggggaaatgaacaaaccaaagacgggagggcagtcaattaccttccgtctcattacagtatgcttcgtggatgcatttaaagggatgagaagaaataattttggaatcgggaaagtcatgccatctctaaaaaatgttagggatcggatttcggtgattggaatcggattagcttaccttagtccggtctttatcattaaacaactgtttccccgctacagtacaccagcaatttggagcaattagtgaaggaacggacccaaatgttggaggacacgcagcaacaagctgatcggctgctgaagagcatgttgccggcggcaattgccgacgatttaaaggcatttttgatgaagaaaagtttaattcaattgccgtcttttaccgcccctttaggccggccgttctgtgccgccccaactttattcaaatgccaccgttctcttttccgacataagggggtattttatactcaaatcttaaatttaaaatttaaaaaataattattttttaatgttttaaatcccaaataatcccccacccctttttgttcagtttcacgcgcatttcctccacttcaacgcccatccaagtggtcgcttttctgaacgaccttttcagcggtttcgatgcgatcatcgccaaacacgacgcgtacaaagtggaaacggtaggtgccagcaagcattacagtagccacaaggcattggcataatgcgacccgtctttttcccactctgatcacttaaatctccttttctgatcagattaacacttacactgatcagatgctcgtccgtcacgttttctggacctttattcgacccatccccgctttctgatctcatttatcccactctgatcagctaatagcccactatccagttaactctgtccctttcactgctgatcaaattaaatccgctcattgatcatttttggcttttgctctgattagtttacacatctccctcccccctcccatctcccagttttatgatcagattagtcattataaaccttcgcttcgatcattaatcgttttcccacattattatcccactttctgatcagattggcgatgcttatatgattgtctcgggtctgccgcgcgagaatggcaacgcgcatgtgcaccacatttcggaaattgggctgaaaatgcgcacatttgtcgccaatttcaaattggcccaccgtccggacgaggtgatgatggtgcgcatcggcttccacagcggaccggtggctgccggagtggtcggtttgccaaaatggcacaaacaaaatgccaaactcaaataaataaattatcatttaaattttaacatttttttcaatgaaacaacgaaatgatataataatactcataggtgggcttgcaagcgcctcgctactgcttattcggcgaaactgtcaacttcgcttcacgaatggtccgccaatttcattagccaaatttatttgtttttatttttattttttgcctttttaggaatcccatggacttccgaataaaattcaggcaaaaaattttcagtttttatttatttttgctgttattttaattttcagatcagtgaacattcgttcaatttgctcagctgtttttaccaccaatttgtgatgatcgaacgtggcaaagtggagatcaaagtgagc

SEQ ID NO: 78556 - DNA, 70 bp, Heterodera glycines
  Genomic contig location: Contig_ID=SeqID_2223; Location=6016..6085; Strand=+
  SCN-specific regions: Sequence locations=1-30,52-70
atgatcaaatatggacaaataaagagatttgaaagcaaaaatcagaaacaaaaacgaactgatcaaagaa

SEQ ID NO: 78557 - DNA, 286 bp, Heterodera glycines
  Genomic contig location: Contig_ID=SeqID_14507; Location=80..365; Strand=-
  SCN-specific regions: Sequence locations=1-286
atgccggaattttccgttgtttgggtttcgtttcgggtttgtacaggtgccggatttttacctgtttttagtgtttttggaattaaattttttttattagtctatgcacaaattagcttgtcgccaattttttggcgacaagggcagacaaacggaagtgtcaaacggaagggccgaacggacggaaagcactgattgtgggagggaagctttgtttgccggaaagggaccccaacggcactcaatgaatcggaatttgctaattgagagtgaggcggtgcaatag

SEQ ID NO: 78558 - DNA, 1894 bp, Heterodera glycines
  Genomic contig location: Contig_ID=SeqID_14507; Location=579..2472; Strand=+
  SCN-specific regions: Sequence locations=1-216,263-368,447-549,571 -729,751-861,891-1129,1173-1394,1416-1894
atgaatttttcggcttttaattttgccgccctttgccttttattttgtctctgttttcatccgtcaaaaaatattctcaatgcaacaacaaattcttcgccatcttctccaaaaaacattggaatattcacaaaactcggaaaacaaaattcaaatgttgttgcgctaaaaataagttaaaaaattattaattcattttgaagcgaattttgattgaattaaattattatttattatttttaatatattttaatgaaattaagttcccaacttttcatcgatgagctcttcacaaaattattcaagtcaaaaactgtttaaccaaggcaatggaattttatggaacgaaagtggaggagcataatgacaaataattaaaaaaataaattggtttttattttgaattaatagcccaaaaattaatttaaaaaaaattatttttaaatcacaggtggacgctttaattcgaagctggccaaaaacaaagctgtaaaagtgttggcaagaattgactttccgaaagatgggaaaagccgtttcaattacgaaaatcaattgcaaattatgttgggcaatcaaaagcgacttttaaacgagcgaattgtgctcaagcagaccatttacaagtcgaatcaaaagcagaaggtgggacacggcttaatggccaattctaaggcccattaattactaaggatacgatttatagtgctaaaaactgccaaaataattagtttttaggttttaaaaacacccaaaataggtgctaaaaatgggaaaatattgtaggtgccaaaaagtttcaaatttaggggtataaaatgccaaaatttactcaaaaaaagtaacaaaatcagtattgagataaataatttttaaaatcaaatattcttgtcaagaaataatttttgtgaaaatttttcataataactcgaaaaactaaaaatatcacgcctgcccattatttttgttagttggccaaattcaaaagattttggtagagcattcgggggataacaggggatttatcggatttagtcgacttaaacaatgccgaaggaattcaatactttgattaaaaaaagtgtgtttagttaatcattccttacgagatttgcgcactcaaatcggcgaaattagaagtggaaaactcaagaaatctaaacaaaattgacaatgaaagtcttaaaagtaattatacacaaattctcagcggaagtcagctgataagaataattgcaaatgcaatgagcagagaaattgaccaatttaacaatgcaatgcttctcgataaaggcgatgtaagtgatgagcggatctgagaagcaatttgaaaagtgattaaaataaaaataagaaaaaacatttaatactaattggggatcggattagtaagcaaatgcaaaatttcatattttgcatttaatttattaaaaaattggttttacatggttttcactaataaattagaaataactttaaaatcccacaatctttggtcaaatccgacccttaatgataatcggcaatttaaaggaggaattgtggcggatgtcaattggacatcatttccactaattgttttttaggagtctgtgcggagagtcggctcttcggcttttgccggcgctgacgagaaggagcagttgcgcttcgttggattggtcctttggcatttggtgttccgcgactgtcccatcattgacccgacggcggacgaatttgtgttcatcgcaaaggtcgagccgagcattgacgccaccgacccaaatgtggcgatggcattctgtgccgaattggacagcgaattggcgcgaaaaagccaaccgaaggagcaaaaagaagagaaaaaagtggcggaaaaaatgcaagagaaaattgagaaggaattcgatct

SEQ ID NO: 78559 - DNA, 712 bp, Heterodera glycines
  Genomic contig location: Contig_ID=SeqID_14508; Location=165..876; Strand=-
  SCN-specific regions: Sequence locations=1-43,80-275,299-326,364-712
atgaaatcaactgcgattccaataaatgtaagcaaaatcaaactaattaatttataataattaattaatgataatataactcgcacaatttcctctatttttgacagtcgccgacattttgaacaatttgtaccgttctgaccaaattccgttgttaattattttaactgttctttttactgtggtcgttgcgctttgtttctattttcggccgtgtcgaaaaaaggcgacgaatcattgcccaaataaggcggaaaggttgccaaaatatgaggaaaaattaaatttaaattttaaactttgctttatttatattcgctaattacttagaaaattaaattttgaaaacagattaaaacgaaaggagcaatttggacaatgcaaagtcaaaacgaacgccacaaactacacattgaacattggcaaagcagaaaactggaattttaatagcaaaacaatgccaaatttggcaaaaaataaatcggtaattcgtcagttaattaactaattacaaaaaaaaacgcatgatttcagcagagaaattcgttgagcaattggtcattgtccgatttggcacctgttgaaaggcatcacgaaaattgtcagcaaaagttttgcaaaacggtggccaaatcacattaatttgttaatgaacattcaaatttcaataattatgaaatagaaatttggaggcgattttcattttaataaa

SEQ ID NO: 78560 - DNA, 971 bp, Heterodera glycines
  Genomic contig location: Contig_ID=SeqID_14509; Location=204..1174; Strand=+
  SCN-specific regions: Sequence locations=1-167,223-306,335-535,557 -838,871-971
atgagtcaatgtttcactgaatttaagggcggttggttatcttttaattctgaataaataaccaacaacaaatagaatgaaatttatagcgaatcgagcaagcgaaaacagtaattaggagatatttttaaacatagataacagcattcgtatttttcccgaaattcaatatatataaattttattaattcagatttaatcaaattaaaagtttttttttttgctttctttttttcatttgcttatttaaaaattttggcgaatgaggagaccgcggtgcaggcagataaacaataaataccaccgacaaatatttttatttgaatagattcaactaaaattttttcaaaaattgccgataatctgaacaagacaaatacgaatactgttatttaaatttttttatcaatgagaatgatcaattagtcaatttatgaaggacttgcttcagtgggaagttgctgaacattctgttgctgatcgtccttagatggaaaaatttaaaatgtatttgattagttcaatatatgcctcattttgttgttgctttttctttgggagattcatttcctcaatgtctgcttgtttcaactttattacacttaagggtcgacgaatcattgaatttcggacaagtgataatttagcgtaatctaaaacataaaaaaatcaagtgtcgttttgggtgctccttctcaattggcgattcttttatccgacaaaatcaaaacttttcaaaatgaatttttggcgaaacgttctattctcgatatcgcaagaaactgctaaaaacagctgaaattctttaagatcagggaatacctaaacacagtcttttagattatgtgtgtgtgttttttccttctttaaataatttgtgcacaatgttttttgtgaaattctttttgtttttttttaaattttcctttatttaccacatgctaactttcctttttgtttagaaaggcata

SEQ ID NO: 78561 - DNA, 1212 bp, Heterodera glycines
  Genomic contig location: Contig_ID=SeqID_14510; Location=1138..2349; Strand=+
  SCN-specific regions: Sequence locations=1-965,987-1212
atgaattgtttctcgtccgccgtctcgcggattcaacacgcacgagcgcacatttaccattcgatcagtgacattggagttcatgtggatgacaacggatttaatcgactctttccccaacttttacattacgaaagggcaacggaaccaccccaagcggacattacactgactttcattcgtcctggaggtaattgctgaacttaatgtttgtaattgcttttgctcatacaataaccactttgttattagcaactccttcacattcccaaatcccgagtgttgtctcccagccgccttcgcgtgattctccgcctcattccgattcgacgccgaatcccccttctcatagtcagcagaataatccgactgctcttaattcgttgctttccggctttatgtcttttgcacatcaatgtacacagttttctttctgattatctttccaggctttatgcttaattttcagtgcttggcggtgttcctgatcaaaatcatccacgacaccccaccatttcgccgcgtatgtcttctcgctccgtttccttcgccccgcggtcgtccgcttcgtccagatcaactaattccacgggtttgactggacaattccctcgaccctttcgtcacgtgcaagggtcccaaagacgttttccttttggtcttacaactttgaattggaatcagacaccacccagcgtaagtaatccatttattgtatcggcacttattagcttacttttgaggcacccaatgcgcttttcgttggtcctcggccaccctttgtttttcctattttcacaatcgatccgtttttgacttgttccagccgacgatatcgtgtatttgagagtgactcggtaggactaggactgtttttacgtcacaacgaaccccaaaatttatagcgccacaatgatttttggaatgaccccgaaactgcgcgtcttggcatttttcctccgtcgaattctgtcactgcttcctccaaccgaatgcaaaatgttcctccgtttgctttcaattcggcatctgatgacattttgttggatggaatgtctcacaaccaacgtggcaatgcgaatgctaacatgggacctcctcaaggggttggttctggctcttctgctgagaattccgactcataagcggataatcaaccttcaaatgagcaatgggaagcgaagggaagagcaaaagccaacttcttgcaat

SEQ ID NO: 78562 - DNA, 462 bp, Heterodera glycines
  Genomic contig location: Contig_ID=SeqID_14511; Location=155..616; Strand=-
  SCN-specific regions: Sequence locations=1-123,153-319,341-462
atgctactttattcatttgctttgctgattttcactcaattctttggcgtttttgctcaattttttggcgtccattcgcaaaaaaagacggaatcgtaagtgtagtacagtattattatacggtattatttttttttaattttcatttattagaattcgtcttaccggtgtccgaaaagatgtgttcaaagtgccggtggctgttttggaccaatgctttccgtaccaggaggagaagtcattcggattcgaattccaattcccgccgagtggcggcgaatgcaaaaatgggtttaatttgaggaaggattttgtgaaattaaaataaaattcatgaaaaacagattgaccatttgctacccgagcttattggccacacagaagctggaaaatgagcatttcatggacgaagcgtcaatcaattccaaactgttcaacattgacgtcgattacaatgtgtga

SEQ ID NO: 78563 - DNA, 842 bp, Heterodera glycines
  Genomic contig location: Contig_ID=SeqID_14511; Location=1746..2587; Strand=-
  SCN-specific regions: Sequence locations=1-351,393-768,790-799,821-842
atgatcgtggtgagtcgaagtgcaaaaagtccgaatgtggcgaagtgcaaaaagtccgaatgagtggtgatcagaaggggcgggtcatttcagtaccgaagatttattctaatgactaattatcatttaaatttataattgaatgatgccaaccaaatccaacattgttggtgtcattcgatagccctatgtatcctctattagcctaaaaaatttcgttaaggttcaaaaaagttatggccagaagaattcaaaaaaccaaattttcaaacttttttggctcgaactttttttgaactcgacgaaattttttggaattttgcaggctaatcgagcatctaatgagctttcgaatgataccacaatgttggatttggttggcaaagaaaaaagttatagtccaaaaacatgtgttcgtatgaaaacggtccgtacgaaaacggcctggcacctaactttccatatacaaatcgtagaaccaccattccaaaagcaattcggtagcaaattctgtgctctttccagtcagcttgtccattttctctagaaaaaattttccagccccctagggattttttcgaaaattccccgattttcagtgtattttgggtgtcccggtcactaggatgagtgatctgatcaagttggtgtaagagacttttttgatcagcaccaaaagttgtgcaagcatgaattatttcaagtttttaaatgaactataagatagtttttcaggtttgagtcaagacttttttggggcactgtatttctctcacaaaaatgtaatttgtttgggaaatattaaatataaagctaaattataattagggccagcaaataaa

SEQ ID NO: 78564 - DNA, 1053 bp, Heterodera glycines
  Genomic contig location: Contig_ID=SeqID_14513; Location=503..1555; Strand=+
  SCN-specific regions: Sequence locations=1-354,384-506,535-717,748 -1053
atgccggcttcaacaaattccatggatgctgtgacagctgcttattacggtttggtgcaattttgtgacgaccccaaccaccgtagtctgacactgacactgacggccatcgctttgttcgtcatttacgcgattggcattctgtcccaattggttgtgctgccggcaaattggcgcctgtccgagcagcgctccgcttttctgcttctgcttcacattgtgagtgaacataatttttaacatttgagtgttgggaaatgaaatttgctgtttcagaatttttacagccaaaagccttaaccttagagttttggtattccaaaaaaaaagagattttttgaacgtgaacaaaagaatttaaaatttaaaaaataatttaattactgagttatagaaatcaatttgaaagagaaaatgaaagttaaatgacaatatttgcatgacgaatattggaatttgggacgtcacaactgaataacgaccgggatattcatctaaaaaagaccaattttatcaaaaaaaaaaaaaaaaattcaaaggacaattttcgtattttaaaatattatcgaaagttgttctaaatttccaaaaaaaaaacattttcccggcgatgcctatcgacaccgccggcctcaaaactctttatctctcttaagaaattgaatcaaaaccgcaaaaatttcctgcaaatctctagggaagagtcaaaaagatttgaaaataatattaataattaaataaataaatgccgcttctcttttttaaataaatcgaaattttaaatcattacaataattggtgttcatttttctttaagaatgtgttcgatctgatctggctgttcgagtacgtttggctttccctggaatatctgatcggcactcgtctcatcgtcaaattctctttggatgcctttctttttcgttttgtcaatttttgcattgacactttttacattgaattggcgttcaaccgatgcattgcttttctgttcccacgcctttacaacacaatttgctgcgaaaagtccgtccgttaattttgggaattcaa

SEQ ID NO: 78565 - DNA, 168 bp, Heterodera glycines
  Genomic contig location: Contig_ID=SeqID_14514; Location=688..855; Strand=+
  SCN-specific regions: Sequence locations=1-168
atggccaaggatccgtgccaatgtcttccgacaccgccgactttcgggcgagacgcatttgtggtgacgccgtcggcacagaaattcaaatgggtgaccaaatggcaatggttccgacacaatcgactccgatggaacagccaaattgtcatcagcagcatgacgacg

SEQ ID NO: 78566 - DNA, 246 bp, Heterodera glycines
  Genomic contig location: Contig_ID=SeqID_14515; Location=1..246; Strand=+
  SCN-specific regions: Sequence locations=1-246
acacaatgtgccatttgcagcagaatgagaggaaaatccgttggaaattgaagcgcaggcaatcggcacatttctttttcgacgcctttttcatgtgtcccttttcgtccagaattgtctgttggatttgcgtcaagagttggccttcgtcgactcgttagacccttccctgggccaatgtttgaccaactcgcggcgtttgctgatcagcgagtcgatgaaattggaggagtggcacaaccccga

SEQ ID NO: 78567 - DNA, 659 bp, Heterodera glycines
  Genomic contig location: Contig_ID=SeqID_14516; Location=356..1014; Strand=+
  SCN-specific regions: Sequence locations=1-247,552-579,613-627,652-659
caccaagcttatggaaatccaatgagttttggttcccgggaaatagcgaattccatgaaaatccgtgacgaggaaaatcacgacgaaatcccgggctaaaatcttgtcaagaacccggaccaaatcatggtaaaagtatgacagcaatggtaggaaaataatgaaatgaacttaaactgaaaacgatggatgaaaattaaaaattcacatgtgtcaggcgtccaaacacgtgcgcgaaaatcactccttaaattaaaaaaaaatatttaggtaaaaaaaaaaaaaattaaatttatacatttttaaatttaaattatattatatatataattattttatagataatttaaatatttagtttagtaataaaaaaaataaaatttgtaaaatatttaaattatttttattaataataagtttaaaattggatattcacacagaaaaatgttttaaaataaaaaaataagaaaaataaaaatatttttaatttttccttttaaattaaaatatttttaatttttcctaattaaaaattaaaaaataaaaataatcaaaatggtacccactttaatgttatgttggtggtgcacacatttaaatgcttaaaacttagtcgagggtcaagcctaaattaaattaaaaattaaaaaaccaaaaac

SEQ ID NO: 78568 - DNA, 1285 bp, Heterodera glycines
  Genomic contig location: Contig_ID=SeqID_14516; Location=1..1285; Strand=-
  SCN-specific regions: Sequence locations=1-16,41-114,140-279,304 -318,352-379,684-1285
caaagcattgaattttaattaaaaataacattttttagtttacttcccgaagcggatggtgttaatgtgacgattgaattgcatgttcaggtgttttcctctaaattcgttttcaatttctttaaatttaaattttcttagggtatctccaaaatttcggaaatcactgctgattttggtaaatttaccatgaattattaaacaacaattaatttttctaacttcacagaattggacgtaatgtacagcgaaatttggtaaaaaattgaaagtttttggttttttaatttttaatttaatttaggcttgaccctcgactaagttttaagcatttaaatgtgtgcaccaccaacataacattaaagtgggtaccattttgattatttttattttttaatttttaattaggaaaaattaaaaatattttaatttaaaaggaaaaattaaaaatatttttatttttcttatttttttattttaaaacatttttctgtgtgaatatccaattttaaacttattattaataaaaataatttaaatattttacaaattttattttttttattactaaactaaatatttaaattatctataaaataattatatatataatataatttaaatttaaaaatgtataaatttaattttttttttttttacctaaatatttttttttaatttaaggagtgattttcgcgcacgtgtttggacgcctgacacatgtgaatttttaattttcatccatcgttttcagtttaagttcatttcattattttcctaccattgctgtcatacttttaccatgatttggtccgggttcttgacaagattttagcccgggatttcgtcgtgattttcctcgtcacggattttcatggaattcgctatttcccgggaaccaaaactcattggatttccataagcttggtgcactgcgtccaattgattttcacttttttgaaaattcgaccgaaattttttgaggattttttttggcaaattttgctgattttattttatttgggaaatttccaattttccaccactgaatttgccattcatcttgtttttagtattttttttttttgctgcttctaaggtatcatcaactccaagggctcgtcaattcataaaagtccatcggaaaatacagtaaatcctgagaattttggaaatttccaaaattaaaaaaaaatttccgcagtttgtcatcctctacgaacatggcctcgtctggtccaacttcaagggccaaaattataaaatttggtgtgtaaatacgctc

SEQ ID NO: 78569 - DNA, 252 bp, Heterodera glycines
  Genomic contig location: Contig_ID=SeqID_14517; Location=690..941; Strand=-
  SCN-specific regions: Sequence locations=1-178,211-252
atggctttcatggcccgtcttcgtcgacaccaagctgtacatgttcgtcgtccatgccgtcgtcgtgttcaacagcaacagttcaacagaaacatcatggaaagcgatattattccgtccattccaaacacattactggcaccaatgatggcactttgtcgccttcgtcatcaagttcaagcagtacaacagaaacaaaaacaacaacacggtcaagcagtacatgcgaaacaaatgcgacaactacggtaa

SEQ ID NO: 78570 - DNA, 359 bp, Heterodera glycines
  Genomic contig location: Contig_ID=SeqID_14518; Location=793..1151; Strand=+
  SCN-specific regions: Sequence locations=1-218,246-359
atgcaaatggtgccatttgaattggtgaacgaatggacaaaggaaaagctgacattggccaaagaaaacgaaaatgaattggaggacaactgttggattatgaaacgatgcaaaattggggaggccgcggcggttcagcttcagaaagatgaaaattgtaacaatgtgttcttttaccttaatgccaataattgcattgggtgagcaattaaaaaagcatttttattttttaaataattaaaattgcgcttaattaaggccattgtctccgccaccaccagcaaaagaagaaggacgacgcgggataaagcatcacaaaggagccgtcttctgacaatgagtgacggacaaagcaacaa

SEQ ID NO: 78571 - DNA, 552 bp, Heterodera glycines
  Genomic contig location: Contig_ID=SeqID_14520; Location=53..604; Strand=+
  SCN-specific regions: Sequence locations=1-552
ggagctgaatgtgccgacggcgaatgctgcgatttggagcagtgcaagccgaaaggtcggtccaccgtttgtcgggaagaggccaatgagtgcgatttgcccgaatattgcgacggaacaaacccaatttgtcctcgtaagaacaaattgctgtaaaattgccaatttcttttccatttaagccgacttttttgtccaggatggccatacgtgtcccaaaaattcggaggtaaatttccgtgtaatcataaattatgccaaactcagttttgatgaataactaaaaatcttggttttgccttctccaaaagtgcatatttggcatggcgttgtgtattgattaattattttgtgttttgccaacatcaaaaaattgcaggatttttgctaccaaggcgtgtgtggcagtcgtgagcagcagtgccgcttcatttggggcccgaccgcgaagaattccatcgcggaatgctacgcgtacaacgaatacggctcattcagcggcaactgcggctacgaccaggccaaagaccaataccatcgctgcaagaaaag

SEQ ID NO: 78572 - DNA, 679 bp, Heterodera glycines
  Genomic contig location: Contig_ID=SeqID_14521; Location=522..1200; Strand=+
  SCN-specific regions: Sequence locations=1-167,189-282,310-379,401 -430,452-653,675-679
atggcaacaaaaccagccaaaaagggaaataatggcacaaggggagggattgtgccatcgttggcggaacagcgctcgttggtcgcgcacccgggctatgacacgggcgggtctacttcctccgacgaacagcagccgacaagaacaacagtagcagaccaaagggcacaacaacaacaggaacagcaaacggtaattgttgcacaacaaccgtaccgtaatcccctaacaatggtaatagacaaaattacagtatgaccatcggcaccgatacggcgttgagactcctccgccaccgccgccgccccataaaaatgtacacaaaagcggagaaaaagtaaatggttaaggaaatgagcagcaacagaactaaccaaagagttcaggcagtacagcagaaacagccaaaaatgccaacgaaaccgccgacaatcaaagtgaaggaggaaaaaggaggggcagaagcgaagataaatgtgaaagcgatggcagcgaaattcgagaaaaaatgaaatgggttattcgatcgactctgatgtgatcctctccttaattctttaataccaaaattgcctttttgcatttgcaaattcttattttttgatatttctccgccccattttctttttaattaagcgattaccaaaatttctattcattttttgcaaattttcctata

SEQ ID NO: 78573 - DNA, 305 bp, Heterodera glycines
  Genomic contig location: Contig_ID=SeqID_14522; Location=132..436; Strand=-
  SCN-specific regions: Sequence locations=1-26,52-193
atggcaaaggaaatgacaaatgatgaaaataaggaagaagaagaagaactatgggaaaagtgggaaaatttgcataaaatcggaagttaaatttgaaggaaaatttaaaaaaaacgaagggaatttatagcaaatcaaaaaaagagaattatattattataaatgtgtaaattcgacaacgatttttaaagccaaatttaattttatttcaaaaaataatttgaaaatataatgttggaaattttttaggaaatttaatttgaatcgataaaaaattataacttaaaaaataatcattaattaaa

SEQ ID NO: 78574 - DNA, 689 bp, Heterodera glycines
  Genomic contig location: Contig_ID=SeqID_14523; Location=332..1020; Strand=+
  SCN-specific regions: Sequence locations=1-183,364-485,536-689
atgctctgccgacgaccacacaaaatttgcataataatcgcaattatttttctcgtttttgtgccgtattgtgccgccttttgtccgccgggctgtgagtgccgtgacgatcaatttttggtggcatgcaattcttcggcactgacctccattccgatactgtaagtgttgcttttggtactgttataattatacaaaaatattaaatttcttaaattattaattattataattcaatattttctttatattctttttaaaaaaatttatatgatttacaataaaagaaattccatatattattatctttatattgtaaaataatggatttttaaattcataaattaattaatattttattatgcaattgctcatttttttagcctcaatccgatgctgaaaacattggtcatcacaaactcaaatgggcttaaattggactctttttcaattgctctttatcaacgttggttttttacccatttttttattttattttatttattttttttataaaaattttgtatttttaattgcagaacttgaatctctggaacttagcaacaaccaaataacgcgaattccaagcaactttttgagccggttaacaaaattgcgaagtaaaattcaattaactgcgaattcatttttattaattgccgataattaagcacttaatttacgtggaa

SEQ ID NO: 78575 - DNA, 1443 bp, Heterodera glycines
  Genomic contig location: Contig_ID=SeqID_14523; Location=1464..2906; Strand=-
  SCN-specific regions: Sequence locations=1-100,141-507,529-534,556 -587,609-674,698-935,958-999,1021-1075,1097-1207,1261-1343,1365-1443
atgcgaccaattcgcagtcgcaattccaacgatttcctgaacggtggggaaagtttaaaaaaaaaattcatagtaactaaattaatcaatgttcatcatgaaaattaatttaattttaaatattataaataaataataaagcaatcttttgaaaattattgtaaattttctttcaatttttatacaataaatcttttaccacttagtccaactttcttcagcattgaccaattcagcaagttttggtcaattgtcgaaagttgacagttggccaaatccaattgctccaatgaattagcgccaataaatgattttggatcaatgtatgacaaaaaagttgaattggtcaaaaaaagactgcccaattttggcaatccgacgaaagcatttgcctaaaattattaactcattttgaaaactattaaatcgtaagttaccctaatctcccgtaattggttcatctgttccaggtgcaactccctcaattcccataagccaccatcgaaggttcttgctgggatctggcacacattccaaagaatgaaaacttttaattttattttaataagtcacctcggcccaagcatttcctgacaaatccaatttccttaagccaattaggttttcccaatttgcatttcggcgacaaccatcgataacctcggaggtcggtgttgataactttaaaaataactaatgttactatgttacatatctatcaaatgatttttcttaaattcgccacggtgtttttctacaaaagaaaatccttaaagttttgatcaaagccaatcaacttttatattttgtgagataatagagaaaattagagctaatgaaggattaggagatttcaaatttggtgcttttggacggagttataacgaattattttaagaagaaagtgcctatgtaaaatataatttttcaacaaattttaaatacatttttcttttgtttcatcagctgaaatagccgcataaacagtaataaatttggttaaaatttgtgcaaataaaagtcattgagaagagaaagcctaagattgacacatgggatttggcttatcggtggcactcaaaacaaacaaatgaagccccgggggaagggagtgagtgcattacgggctcaaatttggctaatgaactgaaccgatccggcgacggggttaatttactaaaaatttggtaatataataatgattagctaataaatttaattttttaaataaaatgaactaattttatagaatttttttatgttgaaacgattaaattggctcagcaattaccaaatttcgtgccaaatttaatgactccaatcgctgcagtcccgaaaaggcgtccttctccatacatgaaatcaaatttgagcttaaatccaaatcgcgcagcttttcaagtgaagaaaacggcttggccattagctaaatgaacaaataaa

SEQ ID NO: 78576 - DNA, 1704 bp, Heterodera glycines
  Genomic contig location: Contig_ID=SeqID_14524; Location=451..2154; Strand=+
  SCN-specific regions: Sequence locations=1-269,318-591,655-931,973 -1176,1199-1486,1546-1589,1611-1704
  Gene Ontology: Mol. function=protein binding; Cellular component =nucleoplasm
atgatcgaaattttggccacacggaccaatcaacaaattgctgatctgagaaatgtttatgatacggaactggctattagtgacccacaatatcggcttcttgaggcttacatcaaagaaaaaaccagtgggccattccaacacttacttgtctcgttgcttaatgagtcaagagatgagacacacgcgagtgatgaggaaatggcaaaaaaagtatgctaattatactttaattacaaataatgccttaattaattggaaattgaagcaaaaataataatttatttcaaataaatataaataaattttatatttaacattttaccaatttattaacaggaagcacaacaactcttcgaattaagacggaaaggtgaaattttgtccgaaaccgcataaaaacattaaaaattttcccgactgcgtttgtcggcatcgctccaaaagttctgtttaaaaaaaggaattttaattcaaaaatgtttatcaaatcgaaaatttaatttttccaacgggcacctgttggcacggcgaatggcaacaaatttgaacaaatttgttatcaaacattatcaaaatatcatctgaatgataataatttaattaaaatatttaaattttacatattattattgaataaatatagtttttaaacggttaaacataatcgttttttgactccctcgcccactggttttttagattgaatgttcaggttttgaaaatttaagacttcaagattttcgattggtaattacgaaggatttttttccatcctttactagaatttaagattttttttaggattagcagcgaagagtccttgggtcagcaaaaatgctgctgaattcaacagagtgtttgctaaaggaagcttcagccaagtaaaaaaatatttcgcaaatttcaaatttaccatgattaatgaatgtaatttaattagaaatatatattaaagataaattttatttagctgcgaaaattattcgattattacaaacaaatagttgttcagcatcaaaaacaaaaaagacattataaagaggaatatgataaatctggtaaatacgacattgaggctgccatcacaaatgagttttccggaattgacaaggatgggtaagggataattgagaatgagtccgtttttctaagcttttgccgcctattggcacatttttatatatttttattgaatgtattaccgtaattatttaccttttgcatttattatataacgacagacataagctgaagctttcttattatttaagttatttggcattgatcaaatatgtccgtgacggcccaaaatattttgcagatttattgcacgaatccatcactggtaattttttgccaaaaatgcccagcgacttgactcgtgttctggtttcacgatctgaaattgatctggctgagataaaggtgactgatttaattgaactatttgtaattaaaaggcataaatggtataacaaataagtttttatattaaattgttaaataatatatataaaaaaaaattattatttatcataaaaagtaatgaatagggtcgcgatccacacacccctaagattcgacctaaaaattttcaaaaccactcctaagaaatgaaaaaaattttatttttaggtacctatttttggttttttgcacttaaaaatcccagtcctactcatttgcaactgcaactagtga

SEQ ID NO: 78577 - DNA, 345 bp, Heterodera glycines
  Genomic contig location: Contig_ID=SeqID_2224; Location=459..803; Strand=+
  SCN-specific regions: Sequence locations=1-95,117-345
attatggcttttttgcaaagaaattggcaaatcggtctttttaaacgcattaaagaagattcagtcgattgcttggagtgtaagcaaaaaaacgttattaatttttcatcttcatcattttttggtttaaaaatatattgaatacttttttatactttgaaagacttttttataatacagaattttttgaaatttcctaaaatccgcaatcctgcgcaggatcctgcagattttaaatgcaggatttgcaggattaatcctgccggatcctgtcctgtaaaaaattttgaattccaatcctgcaacaggacccgcaaatttgaaatttccggtctctaattccta

SEQ ID NO: 78578 - DNA, 2696 bp, Heterodera glycines
  Genomic contig location: Contig_ID=SeqID_2225; Location=1490..4185; Strand=-
  SCN-specific regions: Sequence locations=1-102,172-184,206-260,347 -356,385-700,766-884,929-948,970-1172,1196-1316,1353-1361,1386 -1691,1715-1734,1757-2178,2206-2240,2308-2611,2636-2696
gtgtggacaaatttttggaagatattgctgacatgcttcgcattcaaaaattgccatcagttgatttcttttcgagtcgtgaacattttatgtggcggtgagaaaaatatatgatttttaatataaataataattaattaattttacaattttaaatttaagaaaatttatgcacatcattggaccaacaggttcttacataaaatggatgtggtcaatgtttacaccaattgttcttacggtgagattataattataggaaatatttttttataagaaaaatcataaaagattcacattttaaagaaattttcatttttaaatatttattcaaaaataatttaatgctaaaatgccaaaaattaagaaatttaaatcatttttctattatttatgcttaagatgcttcttgcgtttctgatttgggctattccgaaaatattttaatggcaaaatgtcaaaaatcattaaatttaaatcatttttccaaaaatatttaatgacaatatgcctaaatcatttattccatattcaatttgattcagatgcttctgatcgcttccattttggactatgaacgtgtaacattcaatggcatcatattacccattgaatatgaattgattgcatggattgtgatgatcggaccattgctgattgtgcctggtacagcaatttacaacatttgggatgcaaggcgaaaaaataaagtaaaaattaataataatatttattttttaaaattatttttattacaattaaaatcgatttttattagccattaaaaagcgtgtttaatggaagttttcgtaaacgtgaattggatgacgaggagagtaagcagccaaagcatacccagcagcaagaaggcggtctatacgatgtaattataataaaaatttaaataatatatttaatattattttatcactctactcaattttagaacaaaattttaggtttggattttaaaattagtcaaaataaatttctggcgcaggagcctttagaaagtcggaaattttcggtgccaaaaaccatatgccattttcagtgccgatttttcttttttcattttcagtacattgatccgttgtcgagaggtgcttcgacaaaatccggtgttaatcgcattagccgtcgatcgggcgttatgcagtggcaaaatgatcagcaacagcaacaacagaagcattcggcttcagcaataatagatgatgatcaaaagtaccaacaagttcgggaacggttacgacgatggaccgaggaggagggcagcagttcaattggcattcaacggagtttgagtaaatggcttatttaaatatttctaatcatttattaaatattttgttgcgttatttttccaaatttttgaagaatgaaagatacagcgattctaaaggcactgccggaaatttttttggatataatttattcatgtattttgtactaaaaatgtctttaatccttgaaacataaaaattccggcttttgtatgggaatttcataaaaattgctgaacattgaaataagaccctcaaaattgatcggaaaaatcgatttaagtactgaaaaatcgataaaattggtaaaattttaaaaattcctaaaaaaaaattccaacatcatgctagagataaactttttttaaatgttccagcaaaaacaagataataacgctaatcgcaataataaatattgtgattttcaagctgatcggcccgaaattgaagatgacagtgctgaagaaaatcttgaggatgaaacccatgacaatcgaatgcctggccgtatccgagaatggcatcagcaacagttgcacggcattgccgtgtcgtcatcatcctcgcccaccccgccaccacttgactaccattgctatcagcagcagcaaaaactcactgatacaagcatctctgacaatcaaaggtgtgtttgtgtgtgcaatattaatccgaaaattgttaaaatataaaattactactattttatgaaccattatattttcctaatttctaattcgccgttaattgattaattcttcaatttagggttgggtgctccccgaccttcagcagggagagaaaaactcggggattaataaacaaatttcctgaaacttattttagcaaatttttaatattcaccaggggtggatcacagtaaaaaaaattgccgaggttttttaaaatttttcaatttactgaagggttgcggagacctgcggcgcttgcgggaaattatttatatttaattttattttaagattttatattaaaaataggcatttttaaaatatttttaggaaatgcgagtcgcccttcttgttcggtccacctccgatgcaggcaattttgtcagcaggaagcattcattccggccacccaactgatgccgttgacgactgtcgtaatgaatcggcggccacttctgacattattaagaccaaaattacgcgacaacatggcgacgatggcattattggacaaaatgacaaaaacaaaaatttgggcattcaaaaatttcatcagtcctcatccgccattgaacttgatgagttcggcaaaagttgtcttggatcagtcagtgtgtttaatgtgccatttcgacaacaacaacaacaacaacaacatcatgatcaacagttttcactgtcatctcccatccgaacacagccaaattggagatcatcg

SEQ ID NO: 78579 - DNA, 2594 bp, Heterodera glycines
  Genomic contig location: Contig_ID=SeqID_2226; Location=103..2696; Strand=-
  SCN-specific regions: Sequence locations=1-321,365-418,449-520,547 -661,683-892,930-991,1020-1074,1118-1170,1209-1640,1662-1680,1703 -1707,1766-1856,1895-1935,1957-2040,2063-2162,2185-2441,2517-2594
atggcactctcccctttatcacaggtaagacgccaaagcgtgccagtcgagggcacaatgcagtgaacaggcgcagcctgtggaatcggataactgatcgcggcatgcgtcggctgcgcgaccgggcaagcggcgcacgggcggacgaagtgcgcgacctgtggaacacgcaaattgaattctttttgtcctgtctgggcttcattgttggtggcgggaacacgctgcgcttcccggcaatgatttttgaatttggcggtgagcaaaaaaatgatgagcaactaattaacaagttttcgatttactaccaaaaaatattggtttatttcttatttacatttttattttaaaataattaaatttacgtttttaaaatccaaacttaactataaaataggaactatcatcagttgtatggattaaaaatttttacaaaatgccagtcgggtttttgtagctctgtttacagttaccttgacaaattgactaaggccctacagactgaaaaattccaaaatttttactctctatttttcaaattttctgtgaaatttgtacctatgaaaatgcacatattattttgcaaattttcaagtctttctgattatgaattaaattacaaaatttacttgtcaaaattcaaatgtttagtatagcgccctagctataaatataattatgtgatttctaacctattgatgtaaatatttggtttaataatattatatttctttcagcaaaaataactttcacctcctaaatatatctctgattttattttattttttatcattttaaggtatttttttcatacctcatctgtttttcatggttattttcggatttccgcttgtctatatgcacttgacaattggccaatattcaggcaatatatttatttatttattttttgcaattatttatttattattttaggactttctgcaagcgcagccttttataaaatgatgccaattgcttctggtctgtgaaataaataaatatattttttttaattagcagaagtttttcaaagcatataaaaatcaatttttcagttaaaaacaatttgggaatatttgaatataatttaataaatacaatttactatttttaacactttattgaataataatttcacattattttcaggaatcggctgggcgttcgttttatttattttatatttctaaattaattttttttttcaagtcttgtcctattggcattacccgtgtcaatttattacattttctatgttgcttggggcttttactacctgtggtttgctttgcatggcattttcgagcaggacggcatggtacggtaaaacaaaaaatctacagtagtaaaaacaaattatgttttatagccagccatagtaaaaggcggcactgcagtaatttttttttgaactatttttttaaatctcaaggtgtgggaacattgcaagcccgaatggataaaacaatttaactgttgtgaactcacgactactgtaaacggtgaactgtgtggcggctacggtactcagtcaatgccagcgcctgaggcattcttctagtaatgattttgcttgcatacaaaatatgaaaaaatttatttttgtttttcaacaaattttgatttttttttcaaatggaagaattaaaatgaaacttttgcatttaattaaaaaaacaacaaaatgcttgaacaacaaaaacgaattatttaatttaaattgttgttttttttttgtaaatttaaattaatcattatttttgttaagctttcaggtaggacaaaaaaggacttgtttaatcaacttatttcaattggagttttccataggtgctgaatcgcacaatggttagtttattatataaaattatttaaaaaaaaatatttttttgcgtaaaattccaatgaaatttttaaggacatacaaagtacggctcttggacaaattcaagaacatttgctcatttcgttgataatttcttggataattggttggattatttatagtattactaaataatatttatgtataatttggttttgaatttcagtattttttggtgtgttcaagggacttggatcaatcggctgggcagtgtctttcaccgcaacgctaccatattttttggttgataaaattaattaatcacaaaagcataaatggatttcgtaaattttcatgaaaacgcaccaattttttttaaaaaaatgagtttatttcagtggtaaattttttaaaagcaactgaattatttgggattattttttttaatttaaagaaaacattgataatcatacctatcaaatgccaataagcttcaaaccaattggattaagctgatcattcttctgcttcgcagtgtttcgcttgaaggtgcttcgtcgggactcgtttatctgttcaagcctgagtttaaaaacctatggagccttaaggcaataatataatataatttttatttaaattatttatattatctaaaaaaggtttaattaattcaaaaaataattttcttcaactatgtttatatcttttttttgtatcttagctctggcgtaaagcagctgagcaagtaatttcctttaataaa

SEQ ID NO: 78580 - DNA, 1396 bp, Heterodera glycines
  Genomic contig location: Contig_ID=SeqID_14526; Location=2324..3719; Strand=+
  SCN-specific regions: Sequence locations=1-64,86-217,243-377,454 -474,496-931,957-1031,1053-1120,1143-1156,1178-1396
atgcccggcaacgccgtgctcgcgttcaccactccgtcgacgcccgtggccaatcagacgctgatcaaagtggccatgttggtggcccaaaatgacacggactacggcctgccgcggaaaaacgcggcactgcgagattctggcggcgcaattccaatggcattggaacagttgtgggcggacgaaatccttccaaaaagcatcaatttttcgtcagttaaatattttaaaataaaaaaattgaacaaattcacagatttcaatggcattatgggaattgcaacgaggcgtcggcattgggccgaatttacaaatatgtgaaggaattcgatgccgacgcaatcatcgcaacgccgtgcatggacggtgaaagaaacaataaatttaataaaaaataattaaacatatttaaatttataaataataaataaaataattaaaaaacattattttgttgtcacagtgcccccaatgcttggccatttggcttccaatttcaacttgccaatgatggtttggggacagagcatggcgtcgatgtgagttcataaaaaaacccttctccaaattggcttaacactcaattgcatttcgctctgttttagcctcgcctcctccaacaatttgacttacccaactctgctgaacattgtgccaaattacaaatagtgagttgactcatccctttgttttacggcatttccttctttagcatggcttccggccttgtcagtcttatgcaatatttcaattggactcgctttggctttgtgcttcaaagtgacatcaacggagtcagcggaggttaacgcactgaaaaggcaaaacaaaaatttccatgtgaataattataatttaggctgtaatttattcgcccgcgacatcgatgtactgtaaaaccgtattcaattgaccgtttctctttttttggatttaaaaaatacatttcatatatttagaaagcggtgggtgaacagtcgacggtcagtatcaatttcaaggcacgcattttcaacacccaaacgtccgatttgagcacaattgtcaatggactgcgcaaaagggcacggagtgagtgggggggggggataaaaagggatttgttgggataggacaagtgaaataaaaagggattttaaaaacggatcgggatttgaattaaatgaaatgaaataaacccaaaatgtaaaaacacattccgatatgtcagtcattttgctttgcttcgacgacgtcactcagttgcgaaccttcgcactttctttgtttgatggaggactgaaaacaaaggtgcgtgggatgccaaattacgcgaattaatgatttaatcgatcattaaggattatttgtacatcatcccggataatgacctgatcctttcatgtttgatcaatta

SEQ ID NO: 78581 - DNA, 1415 bp, Heterodera glycines
  Genomic contig location: Contig_ID=SeqID_14527; Location=2..1416; Strand=-
  SCN-specific regions: Sequence locations=1-13,35-349,378-428,456 -541,564-668,690-1062,1084-1245,1267-1278,1300-1365,1394-1415
atgaacagacggtaagcaatttcttttgaaaaattacaatttcgttttacccaattttcttatgtttcagttggatttgtggcgacgtttggatggacattctcccatcttttgaccgtcctgaactcggcctcaaaatggcattgctttccgaccgtttcgatgttttggtggacaaacatttcgatggaaaaagcgaattcacaatttggaaagcaatcgaaattcgcaaggacgaagaaccaaaagcgaaactgtctgtatggaccgatgacaaatgcgtggcatttccattgccggaccgtccgctgcccatcaaaatccgttttaaggaccttcagattcagtaaatcaaaaaatatacagaaaaccaatcttcatttttccccttttcagttacattgaccattctgtgctcacatttctccgttccaacaagccaatttgggacagaagtggcaccaatttggaattgtatattgaatattgtgaccagcgaatttgggatgttttggaccgtcaaatttggccaatttttgcgaaaagcattcgtcattttggctttcacgatggcgatgatttggacaaattgcgtcgccgcatttcaccgacaattctcactgatgttgatcaattgaattcaattgattctggtgctctattccccgatggaattgctgatgatgggccaaatgcaactgctggccaagctttgaccaaatggttgcacactccgagcaaagatggtcaaccgaagcaattgtatcgcaataattattttggtccaccaaagctggaatgggtcaacaacttcaaagaggtgtgtctcgccagaatttccgtcaatttgtttttattttaccaatttttgtgtttagaaatttcgccatgccaccacttctgtcagttacacaattcaactgttttttcttgtggacacaatgcaaattgaaccatttgaattagtgaatggacggacgaaagaaaagctgacattgaaacatagcgatgaattaggctataattgcctgtataattggctgttgcaacggtgcccaattggggagacggcgacggcgccagttaagtgggaaaacgtgaaaattcgggtgctaatttgaactatatcagatttgagctgcgatatgccaattattcgggtgccaatttgaacaagatccgatttgatttgtgggatggaattcattgcattgggtgagcagcaaaagcaatttttgattgtcgaaaaaatataaataattttaggccattgtcgctgccagcggaagaagaagcggatgaaagcattgaaaaataatttaatttgagaaatggccgatctcacacatttggaatttgatttgatgccatcattttctccgaaatgcttttgttgattctttcgttcgaataaa

SEQ ID NO: 78582 - DNA, 777 bp, Heterodera glycines
  Genomic contig location: Contig_ID=SeqID_14529; Location=180..956; Strand=-
  SCN-specific regions: Sequence locations=1-280,351-417,439-777
atgccccgctgctgtgaaggaccgacgcaccgtggacaaatgctatcgtgccatggagacggtgattcggctgtgccagcagccccggctgaacttgaagaactcgccgccgttcatcctggacattctgcccgacatttacaatctgttgaacagcatttttgcaaatgagcccaacattttgcaggttgaaaaagagaaaatcgatttttaaaatcttttttttaaatgtttttgcccataaaattcataaataaatcaccctaagggtcagctttagaaaatttaaaaaattaaccaaattttaaataaaaatttaatttggcaaatttagtatataaaaaaaaattgaattggaagttttatatgggttttatccatattttaaaaaaaaattccatataaattgttaatgtttttggccccatttgttgaaaacaacaaaatttgagtttgatttaccaaaattatttgaggacaatttgtacttgcgtctgttcctctccaatttgacgctgaaatgcaaacagacggtcaaactgttcaaaacgtaccgcgaccaaatcttcgacgagggcaccagcggacggcgccacctcaccaaaaactcgctgatcttcgcgcatatgctctccgagctgaagtcccagtttccggagggcaaatttgtgggcaacaaatttcgaatcacaaaacggcaggcggaggagttttggctgaacacatttggggacaggtgcaaattgtggaaaatgccaaattgggaatgccagaaag

SEQ ID NO: 78583 - DNA, 310 bp, Heterodera glycines
  Genomic contig location: Contig_ID=SeqID_14530; Location=1791..2100; Strand=-
  SCN-specific regions: Sequence locations=1-5,36-161,203-218,245 -245,267-310
atgcttcaaatgctttttggtcgtaattggcaattgtttcgtacgtaagtaccaacagggaaaggctggttgtttttttctagaaattaagcctaaaaacaatttatttataacagctgctgataaatgcattttgattgattactgaagagcaaaaagtgcaattcggcaaaacccataatcattttcttgggaggggcagaggcgatcatttcggtataatcctgcgggaagagttcccggtacaagcgatgtggactgaacttggcaatgtataccgaaagcggagcaggtccataaaaataataaa

SEQ ID NO: 78584 - DNA, 1685 bp, Heterodera glycines
  Genomic contig location: Contig_ID=SeqID_14533; Location=106..1790; Strand=+
  SCN-specific regions: Sequence locations=1-394,418-453,475-819,845 -1047,1069-1685
atgaacggagtgaatcagcagaacggagtggtgggttttggaaaagtcgttggtcattggcattttgaaggtcgacaaacgcgtggttccgtcacttcgtcagtggaacccttcttatcatataaagactgtgctcgaggacatacggaggttggcctgtgacattaatattcttaattgttctatgtaccattatttcaattcgtcgaaaaggtaatactggaaaacctggactacgtaaaaaatctcattaaaacaccaatccgcggggttttttggggggcttctgatcacaaatatgacatcagatttgcaaaattaatttccgaataattattgacaaggtgataaatgctcatctaattcaacaaattatcgagtgctgctagacgtaaatatttatataattcaaacttcgaaaatcggattttaaaacaatgataaaatcaacgattttgaaaattttatatcatatttgtaaacagaagcaacgaagcccccgaattggtcgtttcataacagaaaaaaaacattatttttttgtggagtcaagattctccaatattaccggtaaaaatcattcgacttacaattaatttattgttagtctataatttaatttccaaataattttttttttgttctttataggcacttgatgactgccaaagagaattcgaagctttcccagcccgccgaaggttcgtcgtactgatgggttgcactccgttccttcaaacgaatattccttccatcggtttttgccccaatttgtcgtggtatttcgttataatttgagtccttcgaatttagctcctcctttttgttcgttcgtttgttttgtctcttcactataactgattttaaaataaaaactcccagacattttatgacaaatgaatatttagctccgaagtttctttttgaagctttgcttattttaccacgtttctatattacctaatttatttttactttgtttttttctgccgtttttctaatggtaagaaattcggccctttcttttcttcacttcctttgttttgtcaggagctttattttgaaattctgcgcaagaagcaacatttgctggtgcaggcgcgggagaattggacagcgaaagatctgaaaagagtggtggagggcattctgaaggtggtaccaatttccactcataaaatatggtctcgttaatcaaaggaatagtcaggaactgtattgggttttgagggaagttggtgattaatcattaatgacacgcttttcaggtgccacccgagaaacagtctctgtacaagccgaccaatgagcagcggacggaatgggaggcaatggacgagaagcaaacgttgcacgaattgggattcacaatgaaaaatgcgcgagcggatggtaaaactgccgatttatgcggtaaagtcgttcctttgtaggcccggctgtgttggcgttggttttgccaggtttactcacaacctgacttagaactgtttttaagttcatggcttattgacagaggatggcaaaagtcccgacatagtgccaatgacagtcgcaccgccggtgcccgaagcaatggcacagaacaaacagtccgaagttgaaatggtcgaggagtgacgacaccactaacattttagagggcagtgattttctcagttgacttcgccaaattttattggaaa

SEQ ID NO: 78585 - DNA, 562 bp, Heterodera glycines
  misc_feature (6)..(6): n is a, c, g, or t
  Genomic contig location: Contig_ID=SeqID_14533; Location=2048..2609; Strand=-
  SCN-specific regions: Sequence locations=1-57,80-376,398-562
gcattnacagcttggagcgtgtttccttcttagccgattctttgttccgtttgttcaccaaattttatgaatgtatcaaatggcatttccgacaaagcccaaataaaagcgaaatcgaaaagtttggagcagcaattctcaaatttggccgttttgtttgtgggacgctgagagaggtgaattaagaaatcaagaactttagcgaaatggctaaaataacctaatgaaagagcccttcagatgcaaactgtgaaacagccgaacatttcccaaaatgtgaccactcgtcactgggggccaaacttaaactgggcatccccaaatgcttttccgattctgattaacagaaaagcaactaatcatatccaaagtgagaaaaatatttggaagaaatttggcccacatttaagggcgacaacgcgggttccttttgtctcccgagctcgactacgataggcaccgaattgctgttaccatccactcttcgaaaaataaaacagaagacaaaaggaagaaaagagcaaaaaacaatcaccgggagaataaaagtttcgacagagaa

SEQ ID NO: 78586 - DNA, 2054 bp, Heterodera glycines
  Genomic contig location: Contig_ID=SeqID_14535; Location=188..2241; Strand=+
  SCN-specific regions: Sequence locations=1-250,272-993,1015-1241,1267- 1579,1620-1622,1651-1651,1674-1776,1815-1997,2020-2054
atgagcatgtggccaatctcgtgggcagctatcttagaaattaaaaacgtaattaaaaaaggtggcacgaaaactaacctccgaaagcgcgtgtcgtttatgacgataaggaggaaacacgttctatgttctccaaactcatcctccgtagctgtacacatgccgattgaaagtaaaagcccaaccaaaaggagagttgaaataggcgcagaccgaggccaaagtcttcccggaggagattctcatttttcttttgaaataaaatgccaatataaaccataggatttctatggcgcttgcgttgattcgactcagtaaaattacgccaattaattcccagaaaattccagagtcgagagtgtcgatcagggatgttgcaaagagaaaaataaaaagcgaaatcaaaataaaaagcgaaaaggcgaaagcgaaatgcccaaaaaaagcgaaaaggcgaaagtttttcccaaaaaaatgccattgtttatttcaaaaacccaatctttaggggtgtacatcaggaatgggccgaggtttcgcttttcgcatcctcttcagaaaggggggataattagagattgggggataaatagagaaggggggattatttttcgacagaattattttgtgtaaaatttttgaaattttttgaccatgtcgccaaaaaatgtcatcgagtcaaagaaaaatcattttttattgcattttttaaaagaaattctgttttttctagtcttttaactatctataattatggttgtaaattatatggattaacatattttttctacgcatatgctatgaagaaaggggcttaaaaataacatttctgcgttaaaatttttcgatttggtgaaggtttttagtccatataaatccatattttgggcttgccactataaaaaacattttggaagttggccactaaaatagtttttttttgccacaaatttagcattttgccacctatttttcactattccgacattttttggaaaattccttaacaaaaatgcaataacaccaaaaaatacactgtgttaatttaaaataaagacaccctgttttttgggagtttgaccacttcccatgaaccgatcgagctgaatttttaactgtacgtagcaattctgaaaatattaagattctgaaagtgagaaaccgaaatgatgacggaaaaaagttttacgattttttttcaaaaatggggtgttaatttaaaatagaaaaatttttttaggtaactattttgggttttttggtcttaaaaatcccagtcctactcatttgcaactgcaaaatttcgggtgaggtagttcttggagggggtattatgtcattatggacttttcgccactatctttgccactattttggcatttgtagtacttttactgtcgattttgtttgtttttgaaaaaaattgacggcatataattttctgaaaattctatttatccccctggaggataaatggagactgggggattatttttcaaacccctcctagactgggggataattggagattgggggataattagagcaaatacggtatattacccatttatcattttacaaaaaaaaaacggaagcaaaaaatataaaaaaaaaaaaaatcaaatttcttttatttttcatttaaaatttgaaaaaatacagaattcaaagcttttaaaattatttcatttcggctcccggacaatccgacagtggacaatccgacagtgaggacaatccgacagaagtggacaatccgacagtggacaatccgacagtaaatttctattttaaaaaatattttcaagtcattagaacggattatttcctaaaaatatctcaatcaaaaaaattattaaaaggaaatgactagttactatttaaaataggttatttcgcgtcctttaaatgtccctgcaaagtttggtgcgcttctgatcagtttctgaaaaaaagttaagcctaaacattttggcctgtttaaaaaggaattaaaaatttttattcttcaccatttttcataatatacgcctaagagggcctttaacacgtaa

SEQ ID NO: 78587 - DNA, 295 bp, Heterodera glycines
  Genomic contig location: Contig_ID=SeqID_14535; Location=2380..2674; Strand=-
  SCN-specific regions: Sequence locations=1-106,145-244,267-295
atgaaacgtgactggacaatccgacagtggacaatccgacagttggacaatccgacagtgaggacaatccgacagaagtggacaatccgacagtggacaatccgacagtaaatttctattttaaaaaatattttcaagtcattagaacggattatttcctaaaaatatctcaatcaaatcaatttagctttaatttgttaccaaattaaaaaaagttagtttggtatgctggtaacaaaagtacaataaaataaaaaataattaaagataagtgatccatacaaccataaataaa

SEQ ID NO: 78588 - DNA, 165 bp, Heterodera glycines
  Genomic contig location: Contig_ID=SeqID_14535; Location=2808..2972; Strand=+
  SCN-specific regions: Sequence locations=1-165
atgtttttctacgcattggacgacgatcagcggccaaatgacagcaatcaacaacagcagatgatcagccgatggtttgaaattgatgaacaaacgggacagatcagtgccatcagtgcgccaccgattggcattgatcagcagcgcaaaaccgtcaaatttggg

SEQ ID NO: 78589 - DNA, 1135 bp, Heterodera glycines
  Genomic contig location: Contig_ID=SeqID_14536; Location=278..1412; Strand=+
  SCN-specific regions: Sequence locations=1-12,34-432,455-511,548 -703,725-736,759-796,848-942,969-1064,1088-1109,1132-1135
atgtcacaagcgttggaaatggtaaagttgattatgtgtggttactgtttaggtaggcattaggcgagaacaaagaagccgctgctgtcattgtcaaatcgaatttgtccaatcgttccgaagtcgaaaaggcggaaacgaaaataacaaagaatttgaaaaacggattcaaaattcacagtaaattaaaggggtcgtaaaatatgtgttttttgtacaaaaattcgcgatgaattttcttataaatttagttaattaagaaaacatgaaatcattctttggccttgaatgccgtttattagtctagaaaattatgaataaatttcttttttacataaaaaatcgaaattttgtttgggtttacattttttaaaccttagttttttatttttcataattttggtacatttatcgacattgaattaatctactaattatgttgtttctgtggaaaatgttgataaattatggttttcgaagaaggtgtcgaaatttacaaatgtacccgcactaatataaattaattttaaattatatttttaattttgctaaatattgacccattttttagacagttattttacaaaggtcggagatggtcacattgaatttgtgtggttactgttgaaggattcgtcgggcaaaaatgaaagtgccggtgccgtaattttgaagtcttctctttccgagagtgtcgaatatcaaaaaattattttcaaaaaagagactgagcttcaaaagactcaaaatgctttaacggacaatttgataaaaggatacaaaattcacagtaatctttttttaaaaatatattttttatataattattgtattaatttaattaattgttcgcccaactctttcagaaacttttaccaatcgcgtggggaatggcaaaattgactatgtgtgggtaatggtgaaggactaagaatttctttttagaaattttgataaatttatatatttcgcgctttttcttacataaaatccccattcctaaaaatatcattttgatccaattccatataaacttgttaccattagaattacttgaatttgttaaatttagtttaatttaatttgtcgagcgaaccaaaggcacatagtgcttttacatggtgccaaaaagaaa
